United States Patent 12,577,609 (METHODS FOR CELL-TYPE SPECIFIC PROFILING TO IDENTIFY DRUG TARGETS) - sequence listing, part 19

SEQ ID NO: 31930 - protein, 1134 aa, Homo sapiens
  ENSP00000442847
MPEPTKKEEPSKEKEAGTTPAKDWTLVETPPGEEQAKQNANSQLSILFIEKPQGGTVKVGEDITFIAKVKAEDLLRKPTIKWFKGKWMDLASKAGKHLQLKETFERHSRVYTFEMQIIKAKDNFAGNYRCEVTYKDKFDSCSFDLEVHESTGTTPNIDIRSAFKRSGEGQEDAGELDFSGLLKRREVKQQEEEPQVDVWELLKNAKPSEYEKIAFQYGITDLRGMLKRLKRMRREEKKSAAFAKILDPAYQVDKGGRVRFVVELADPKLEVKWYKNGQEIRPSTKYIFEHKGCQRILFINNCQMTDDSEYYVTAGDEKCSTELFVREPPIMVTKQLEDTTAYCGERVELECEVSEDDANVKWFKNGEEIIPGPKSRYRIRVEGKKHILIIEGATKADAAEYSVMTTGGQSSAKLSVDLKPLKILTPLTDQTVNLGKEICLKCEISENIPGKWTKNGLPVQESDRLKVVHKGRIHKLVIANALTEDEGDYVFAPDAYNVTLPAKVHVIDPPKIILDGLDADNTVTVIAGNKLRLEIPISGEPPPKAMWSRGDKAIMEGSGRIRTESYPDSSTLVIDIAERDDSGVYHINLKNEAGEAHASIKVKVVDFPDPPVAPTVTEVGDDWCIMNWEPPAYDGGSPILGYFIERKKKQSSRWMRLNFDLCKETTFEPKKMIEGVAYEVRIFAVNAIGISKPSMPSRPFVPLAVTSPPTLLTVDSVTDTTVTMRWRPPDHIGAAGLDGYVLEYCFEGTEDWIVANKDLIDKTKFTITGLPTDAKIFVRVKAVNAAGASEPKYYSQPILVKEIIEPPKIRIPRHLKQTYIRRVGEAVNLVIPFQGKPRPELTWKKDGAEIDKNQINIRNSETDTIIFIRKAERSHSGKYDLQVKVDKFVETASIDIQIIDRPGPPQIVKIEDVWGENVALTWTPPKDDGNAAITGYTIQKADKKSMEWFTVIEHYHRTSATITELVIGNEYYFRVFSENMCGLSEDATMTKESAVIARDGKIYKNPVYEDFDFSEAPMFTQPLVNTYAIAGYNATLNCSVRGNPKPKITWMKNKVAIVDDPRYRMFSNQGVCTLEIRKPSPYDGGTYCCKAVNDLGTVEIECKLEVKVIYQGVNTPGQPVFLEGQQQSLHNKDF

SEQ ID NO: 31931 - protein, 1171 aa, Homo sapiens
  ENSP00000354849
MPEPTKKEENEVPAPAPPPEEPSKEKEAGTTPAKDEEEVSPPSALPPGLGSRALERKDSDWTLVETPPGEEQAKQNANSQLSILFIEKPQGGTVKVGEDITFIAKVKAEDLLRKPTIKWFKGKWMDLASKAGKHLQLKETFERHSRVYTFEMQIIKAKDNFAGNYRCEVTYKDKFDSCSFDLEVHESTGTTPNIDIRSAFKRSGEGQEDAGELDFSGLLKRREVKQQEEEPQVDVWELLKNAKPSEYEKIAFQYGITDLRGMLKRLKRMRREEKKSAAFAKILDPAYQVDKGGRVRFVVELADPKLEVKWYKNGQEIRPSTKYIFEHKGCQRILFINNCQMTDDSEYYVTAGDEKCSTELFVREPPIMVTKQLEDTTAYCGERVELECEVSEDDANVKWFKNGEEIIPGPKSRYRIRVEGKKHILIIEGATKADAAEYSVMTTGGQSSAKLSVDLKPLKILTPLTDQTVNLGKEICLKCEISENIPGKWTKNGLPVQESDRLKVVHKGRIHKLVIANALTEDEGDYVFAPDAYNVTLPAKVHVIDPPKIILDGLDADNTVTVIAGNKLRLEIPISGEPPPKAMWSRGDKAIMEGSGRIRTESYPDSSTLVIDIAERDDSGVYHINLKNEAGEAHASIKVKVVDFPDPPVAPTVTEVGDDWCIMNWEPPAYDGGSPILGYFIERKKKQSSRWMRLNFDLCKETTFEPKKMIEGVAYEVRIFAVNAIGISKPSMPSRPFVPLAVTSPPTLLTVDSVTDTTVTMRWRPPDHIGAAGLDGYVLEYCFEGTEDWIVANKDLIDKTKFTITGLPTDAKIFVRVKAVNAAGASEPKYYSQPILVKEIIEPPKIRIPRHLKQTYIRRVGEAVNLVIPFQGKPRPELTWKKDGAEIDKNQINIRNSETDTIIFIRKAERSHSGKYDLQVKVDKFVETASIDIQIIDRPGPPQIVKIEDVWGENVALTWTPPKDDGNAAITGYTIQKADKKSMEWFTVIEHYHRTSATITELVIGNEYYFRVFSENMCGLSEDATMTKESAVIARDGKIYKNPVYEDFDFSEAPMFTQPLVNTYAIAGYNATLNCSVRGNPKPKITWMKNKVAIVDDPRYRMFSNQGVCTLEIRKPSPYDGGTYCCKAVNDLGTVEIECKLEVKVIYQGVNTPGQPVFLEGQQQSLHNKDF

SEQ ID NO: 31932 - protein, 1024 aa, Homo sapiens
  ENSP00000447116
MDLASKAGKHLQLKETFERHSRVYTFEMQIIKAKDNFAGNYRCEVTYKDKFDSCSFDLEVHESTGTTPNIDIRSAFKRSGEGQEDAGELDFSGLLKRREVKQQEEEPQVDVWELLKNAKPSEYEKIAFQYGITDLRGMLKRLKRMRREEKKSAAFAKILDPAYQVDKGGRVRFVVELADPKLEVKWYKNGQEIRPSTKYIFEHKGCQRILFINNCQMTDDSEYYVTAGDEKCSTELFVREPPIMVTKQLEDTTAYCGERVELECEVSEDDANVKWFKNGEEIIPGPKSRYRIRVEGKKHILIIEGATKADAAEYSVMTTGGQSSAKLSVDLKPLKILTPLTDQTVNLGKEICLKCEISENIPGKWTKNGLPVQESDRLKVVHKGRIHKLVIANALTEDEGDYVFAPDAYNVTLPAKVHVIDPPKIILDGLDADNTVTVIAGNKLRLEIPISGEPPPKAMWSRGDKAIMEGSGRIRTESYPDSSTLVIDIAERDDSGVYHINLKNEAGEAHASIKVKVVDFPDPPVAPTVTEVGDDWCIMNWEPPAYDGGSPILGYFIERKKKQSSRWMRLNFDLCKETTFEPKKMIEGVAYEVRIFAVNAIGISKPSMPSRPFVPLAVTSPPTLLTVDSVTDTTVTMRWRPPDHIGAAGLDGYVLEYCFEGTEDWIVANKDLIDKTKFTITGLPTDAKIFVRVKAVNAAGASEPKYYSQPILVKEIIEPPKIRIPRHLKQTYIRRVGEAVNLVIPFQGKPRPELTWKKDGAEIDKNQINIRNSETDTIIFIRKAERSHSGKYDLQVKVDKFVETASIDIQIIDRPGPPQIVKIEDVWGENVALTWTPPKDDGNAAITGYTIQKADKKSMEWFTVIEHYHRTSATITELVIGNEYYFRVFSENMCGLSEDATMTKESAVIARDGKIYKNPVYEDFDFSEAPMFTQPLVNTYAIAGYNATLNCSVRGNPKPKITWMKNKVAIVDDPRYRMFSNQGVCTLEIRKPSPYDGGTYCCKAVNDLGTVEIECKLEVKVIAQ

SEQ ID NO: 31933 - protein, 1141 aa, Homo sapiens
  ENSP00000449702
MPEPTKKEENEVPAPAPPPEEPSKEKEAGTTPAKDWTLVETPPGEEQAKQNANSQLSILFIEKPQGGTVKVGEDITFIAKVKAEDLLRKPTIKWFKGKWMDLASKAGKHLQLKETFERHSRVYTFEMQIIKAKDNFAGNYRCEVTYKDKFDSCSFDLEVHESTGTTPNIDIRSAFKRSGEGQEDAGELDFSGLLKRREVKQQEEEPQVDVWELLKNAKPSEYEKIAFQYGITDLRGMLKRLKRMRREEKKSAAFAKILDPAYQVDKGGRVRFVVELADPKLEVKWYKNGQEIRPSTKYIFEHKGCQRILFINNCQMTDDSEYYVTAGDEKCSTELFVREPPIMVTKQLEDTTAYCGERVELECEVSEDDANVKWFKNGEEIIPGPKSRYRIRVEGKKHILIIEGATKADAAEYSVMTTGGQSSAKLSVDLKPLKILTPLTDQTVNLGKEICLKCEISENIPGKWTKNGLPVQESDRLKVVHKGRIHKLVIANALTEDEGDYVFAPDAYNVTLPAKVHVIDPPKIILDGLDADNTVTVIAGNKLRLEIPISGEPPPKAMWSRGDKAIMEGSGRIRTESYPDSSTLVIDIAERDDSGVYHINLKNEAGEAHASIKVKVVDFPDPPVAPTVTEVGDDWCIMNWEPPAYDGGSPILGYFIERKKKQSSRWMRLNFDLCKETTFEPKKMIEGVAYEVRIFAVNAIGISKPSMPSRPFVPLAVTSPPTLLTVDSVTDTTVTMRWRPPDHIGAAGLDGYVLEYCFEGSTSAKQSDENGEAAYDLPAEDWIVANKDLIDKTKFTITGLPTDAKIFVRVKAVNAAGASEPKYYSQPILVKEIIEPPKIRIPRHLKQTYIRRVGEAVNLVIPFQGKPRPELTWKKDGAEIDKNQINIRNSETDTIIFIRKAERSHSGKYDLQVKVDKFVETASIDIQIIDRPGPPQIVKIEDVWGENVALTWTPPKDDGNAAITGYTIQKADKKSMEWFTVIEHYHRTSATITELVIGNEYYFRVFSENMCGLSEDATMTKESAVIARDGKIYKNPVYEDFDFSEAPMFTQPLVNTYAIAGYNATLNCSVRGNPKPKITWMKNKVAIVDDPRYRMFSNQGVCTLEIRKPSPYDGGTYCCKAVNDLGTVEIECKLEVKVIAQ

SEQ ID NO: 31934 - protein, 104 aa, Homo sapiens
  ENSP00000447404
MDLASKAGKHLQLKETFERHSRVYTFEMQIIKAKDNFAGNYRCEVTYKDKFDSCSFDLEVHESTGTTPNIDIRSAFKRSGEGQEDAGELDFSGLLKRREVKQQE

SEQ ID NO: 31935 - protein, 394 aa, Homo sapiens
  ENSP00000380494
MCVCAGCRAAPSRRGAGPLQVAGGWSEGADMDYDSYQHYFYDYDCGEDFYRSTAPSEDIWKKFELVPSPPTSPPWGLGPGAGDPAPGIGPPEPWPGGCTGDEAESRGHSKGWGRNYASIIRRDCMWSGFSARERLERAVSDRLAPGAPRGNPPKASAAPDCTPSLEAGNPAPAAPCPLGEPKTQACSGSESPSDSENEEIDVVTVEKRQSLGIRKPVTITVRADPLDPCMKHFHISIHQQQHNYAARFPPESCSQEEASERGPQEEVLERDAAGEKEDEEDEEIVSPPPVESEAAQSCHPKPVSSDTEDVTKRKNHNFLERKRRNDLRSRFLALRDQVPTLASCSKAPKVVILSKALEYLQALVGAEKRMATEKRQLRCRQQQLQKRIAYLTGY

SEQ ID NO: 31936 - protein, 364 aa, Homo sapiens
  ENSP00000361903
MDYDSYQHYFYDYDCGEDFYRSTAPSEDIWKKFELVPSPPTSPPWGLGPGAGDPAPGIGPPEPWPGGCTGDEAESRGHSKGWGRNYASIIRRDCMWSGFSARERLERAVSDRLAPGAPRGNPPKASAAPDCTPSLEAGNPAPAAPCPLGEPKTQACSGSESPSDSENEEIDVVTVEKRQSLGIRKPVTITVRADPLDPCMKHFHISIHQQQHNYAARFPPESCSQEEASERGPQEEVLERDAAGEKEDEEDEEIVSPPPVESEAAQSCHPKPVSSDTEDVTKRKNHNFLERKRRNDLRSRFLALRDQVPTLASCSKAPKVVILSKALEYLQALVGAEKRMATEKRQLRCRQQQLQKRIAYLTGY

SEQ ID NO: 31937 - protein, 236 aa, Homo sapiens
  ENSP00000361902
MCVCAGCRAAPSRRGAGPLQVAGGWSEGADMDYDSYQHYFYDYDCGEDFYRSTAPSEDIWKKFELVPSPPTSPPWGLGPGAGDPAPGIGPPEPWPGGCTGDEAESRGHSKGWGRNYASIIRRDCMWSGFSARERLERAVSDRLAPGAPRGNPPKASAAPDCTPSLEAGNPAPAAPCPLGEPKTQACSGSESPSDSGKDLPEPSKRGPPHGWPKLCPCLRSGIGSSQALGPSPPLFG

SEQ ID NO: 31938 - protein, 100 aa, Homo sapiens
  ENSP00000434375
MDYDSYQHYFYDYDCGEDFYRSTAPSEDIWKKFELVPSPPTSPPWGLGPGAGDPAPGIGPPEPWPGGCTGDEAESRGHSKGWGRNYASIIRRDCMWSGFS

SEQ ID NO: 31939 - protein, 1945 aa, Homo sapiens
  ENSP00000478092
MAQKGQLSDDEKFLFVDKNFINSPVAQADWAAKRLVWVPSEKQGFEAASIKEEKGDEVVVELVENGKKVTVGKDDIQKMNPPKFSKVEDMAELTCLNEASVLHNLRERYFSGLIYTYSGLFCVVVNPYKHLPIYSEKIVDMYKGKKRHEMPPHIYAIADTAYRSMLQDREDQSILCTGESGAGKTENTKKVIQYLAVVASSHKGKKDTSITQGPSFAYGELEKQLLQANPILEAFGNAKTVKNDNSSRFGKFIRINFDVTGYIVGANIETYLLEKSRAIRQARDERTFHIFYYMIAGAKEKMRSDLLLEGFNNYTFLSNGFVPIPAAQDDEMFQETVEAMAIMGFSEEEQLSILKVVSSVLQLGNIVFKKERNTDQASMPDNTAAQKVCHLMGINVTDFTRSILTPRIKVGRDVVQKAQTKEQADFAVEALAKATYERLFRWILTRVNKALDKTHRQGASFLGILDIAGFEIFEVNSFEQLCINYTNEKLQQLFNHTMFILEQEEYQREGIEWNFIDFGLDLQPCIELIERPNNPPGVLALLDEECWFPKATDKSFVEKLCTEQGSHPKFQKPKQLKDKTEFSIIHYAGKVDYNASAWLTKNMDPLNDNVTSLLNASSDKFVADLWKDVDRIVGLDQMAKMTESSLPSASKTKKGMFRTVGQLYKEQLGKLMTTLRNTTPNFVRCIIPNHEKRSGKLDAFLVLEQLRCNGVLEGIRICRQGFPNRIVFQEFRQRYEILAANAIPKGFMDGKQACILMIKALELDPNLYRIGQSKIFFRTGVLAHLEEERDLKITDVIMAFQAMCRGYLARKAFAKRQQQLTAMKVIQRNCAAYLKLRNWQWWRLFTKVKPLLQVTRQEEEMQAKEDELQKTKERQQKAENELKELEQKHSQLTEEKNLLQEQLQAETELYAEAEEMRVRLAAKKQELEEILHEMEARLEEEEDRGQQLQAERKKMAQQMLDLEEQLEEEEAARQKLQLEKVTAEAKIKKLEDEILVMDDQNNKLSKERKLLEERISDLTTNLAEEEEKAKNLTKLKNKHESMISELEVRLKKEEKSRQELEKLKRKLEGDASDFHEQIADLQAQIAELKMQLAKKEEELQAALARLDDEIAQKNNALKKIRELEGHISDLQEDLDSERAARNKAEKQKRDLGEELEALKTELEDTLDSTATQQELRAKREQEVTVLKKALDEETRSHEAQVQEMRQKHAQAVEELTEQLEQFKRAKANLDKNKQTLEKENADLAGELRVLGQAKQEVEHKKKKLEAQVQELQSKCSDGERARAELNDKVHKLQNEVESVTGMLNEAEGKAIKLAKDVASLSSQLQDTQELLQEETRQKLNVSTKLRQLEEERNSLQDQLDEEMEAKQNLERHISTLNIQLSDSKKKLQDFASTVEALEEGKKRFQKEIENLTQQYEEKAAAYDKLEKTKNRLQQELDDLVVDLDNQRQLVSNLEKKQRKFDQLLAEEKNISSKYADERDRAEAEAREKETKALSLARALEEALEAKEELERTNKMLKAEMEDLVSSKDDVGKNVHELEKSKRALETQMEEMKTQLEELEDELQATEDAKLRLEVNMQALKGQFERDLQARDEQNEEKRRQLQRQLHEYETELEDERKQRALAAAAKKKLEGDLKDLELQADSAIKGREEAIKQLRKLQAQMKDFQRELEDARASRDEIFATAKENEKKAKSLEADLMQLQEDLAAAERARKQADLEKEELAEELASSLSGRNALQDEKRRLEARIAQLEEELEEEQGNMEAMSDRVRKATQQAEQLSNELATERSTAQKNESARQQLERQNKELRSKLHEMEGAVKSKFKSTIAALEAKIAQLEEQVEQEAREKQAATKSLKQKDKKLKEILLQVEDERKMAEQYKEQAEKGNARVKQLKRQLEEAEEESQRINANRRKLQRELDEATESNEAMGREVNALKSKLRGPPPQETSQ

SEQ ID NO: 31940 - protein, 1979 aa, Homo sapiens
  ENSP00000478109
MAQKGQLSDDEKFLFVDKNFINSPVAQADWAAKRLVWVPSEKQGFEAASIKEEKGDEVVVELVENGKKVTVGKDDIQKMNPPKFSKVEDMAELTCLNEASVLHNLRERYFSGLIYTYSGLFCVVVNPYKHLPIYSEKIVDMYKGKKRHEMPPHIYAIADTAYRSMLQDREDQSILCTGESGAGKTENTKKVIQYLAVVASSHKGKKDTSITQGPSFAYGELEKQLLQANPILEAFGNAKTVKNDNSSRFGKFIRINFDVTGYIVGANIETYLLEKSRAIRQARDERTFHIFYYMIAGAKEKMRSDLLLEGFNNYTFLSNGFVPIPAAQDDEMFQETVEAMAIMGFSEEEQLSILKVVSSVLQLGNIVFKKERNTDQASMPDNTAAQKVCHLMGINVTDFTRSILTPRIKVGRDVVQKAQTKEQADFAVEALAKATYERLFRWILTRVNKALDKTHRQGASFLGILDIAGFEIFEVNSFEQLCINYTNEKLQQLFNHTMFILEQEEYQREGIEWNFIDFGLDLQPCIELIERPNNPPGVLALLDEECWFPKATDKSFVEKLCTEQGSHPKFQKPKQLKDKTEFSIIHYAGKVDYNASAWLTKNMDPLNDNVTSLLNASSDKFVADLWKDVDRIVGLDQMAKMTESSLPSASKTKKGMFRTVGQLYKEQLGKLMTTLRNTTPNFVRCIIPNHEKRSGKLDAFLVLEQLRCNGVLEGIRICRQGFPNRIVFQEFRQRYEILAANAIPKGFMDGKQACILMIKALELDPNLYRIGQSKIFFRTGVLAHLEEERDLKITDVIMAFQAMCRGYLARKAFAKRQQQLTAMKVIQRNCAAYLKLRNWQWWRLFTKVKPLLQVTRQEEEMQAKEDELQKTKERQQKAENELKELEQKHSQLTEEKNLLQEQLQAETELYAEAEEMRVRLAAKKQELEEILHEMEARLEEEEDRGQQLQAERKKMAQQMLDLEEQLEEEEAARQKLQLEKVTAEAKIKKLEDEILVMDDQNNKLSKERKLLEERISDLTTNLAEEEEKAKNLTKLKNKHESMISELEVRLKKEEKSRQELEKLKRKLEGDASDFHEQIADLQAQIAELKMQLAKKEEELQAALARLDDEIAQKNNALKKIRELEGHISDLQEDLDSERAARNKAEKQKRDLGEELEALKTELEDTLDSTATQQELRAKREQEVTVLKKALDEETRSHEAQVQEMRQKHAQAVEELTEQLEQFKRAKANLDKNKQTLEKENADLAGELRVLGQAKQEVEHKKKKLEAQVQELQSKCSDGERARAELNDKVHKLQNEVESVTGMLNEAEGKAIKLAKDVASLSSQLQDTQELLQEETRQKLNVSTKLRQLEEERNSLQDQLDEEMEAKQNLERHISTLNIQLSDSKKKLQDFASTVEALEEGKKRFQKEIENLTQQYEEKAAAYDKLEKTKNRLQQELDDLVVDLDNQRQLVSNLEKKQRKFDQLLAEEKNISSKYADERDRAEAEAREKETKALSLARALEEALEAKEELERTNKMLKAEMEDLVSSKDDVGKNVHELEKSKRALETQMEEMKTQLEELEDELQATEDAKLRLEVNMQALKGQFERDLQARDEQNEEKRRQLQRQLHEYETELEDERKQRALAAAAKKKLEGDLKDLELQADSAIKGREEAIKQLRKLQAQMKDFQRELEDARASRDEIFATAKENEKKAKSLEADLMQLQEDLAAAERARKQADLEKEELAEELASSLSGRNALQDEKRRLEARIAQLEEELEEEQGNMEAMSDRVRKATQQAEQLSNELATERSTAQKNESARQQLERQNKELRSKLHEMEGAVKSKFKSTIAALEAKIAQLEEQVEQEAREKQAATKSLKQKDKKLKEILLQVEDERKMAEQYKEQAEKGNARVKQLKRQLEEAEEESQRINANRRKLQRELDEATESNEAMGREVNALKSKLRRGNETSFVPSRRSGGRRVIENADGSEEETDTRDADFNGTKASE

SEQ ID NO: 31941 - protein, 1938 aa, Homo sapiens
  ENSP00000478816
MAQKGQLSDDEKFLFVDKNFINSPVAQADWAAKRLVWVPSEKQGFEAASIKEEKGDEVVVELVENGKKVTVGKDDIQKMNPPKFSKVEDMAELTCLNEASVLHNLRERYFSGLIYTYSGLFCVVVNPYKHLPIYSEKIVDMYKGKKRHEMPPHIYAIADTAYRSMLQDREDQSILCTGESGAGKTENTKKVIQYLAVVASSHKGKKDTSITGELEKQLLQANPILEAFGNAKTVKNDNSSRFGKFIRINFDVTGYIVGANIETYLLEKSRAIRQARDERTFHIFYYMIAGAKEKMRSDLLLEGFNNYTFLSNGFVPIPAAQDDEMFQETVEAMAIMGFSEEEQLSILKVVSSVLQLGNIVFKKERNTDQASMPDNTAAQKVCHLMGINVTDFTRSILTPRIKVGRDVVQKAQTKEQADFAVEALAKATYERLFRWILTRVNKALDKTHRQGASFLGILDIAGFEIFEVNSFEQLCINYTNEKLQQLFNHTMFILEQEEYQREGIEWNFIDFGLDLQPCIELIERPNNPPGVLALLDEECWFPKATDKSFVEKLCTEQGSHPKFQKPKQLKDKTEFSIIHYAGKVDYNASAWLTKNMDPLNDNVTSLLNASSDKFVADLWKDVDRIVGLDQMAKMTESSLPSASKTKKGMFRTVGQLYKEQLGKLMTTLRNTTPNFVRCIIPNHEKRSGKLDAFLVLEQLRCNGVLEGIRICRQGFPNRIVFQEFRQRYEILAANAIPKGFMDGKQACILMIKALELDPNLYRIGQSKIFFRTGVLAHLEEERDLKITDVIMAFQAMCRGYLARKAFAKRQQQLTAMKVIQRNCAAYLKLRNWQWWRLFTKVKPLLQVTRQEEEMQAKEDELQKTKERQQKAENELKELEQKHSQLTEEKNLLQEQLQAETELYAEAEEMRVRLAAKKQELEEILHEMEARLEEEEDRGQQLQAERKKMAQQMLDLEEQLEEEEAARQKLQLEKVTAEAKIKKLEDEILVMDDQNNKLSKERKLLEERISDLTTNLAEEEEKAKNLTKLKNKHESMISELEVRLKKEEKSRQELEKLKRKLEGDASDFHEQIADLQAQIAELKMQLAKKEEELQAALARLDDEIAQKNNALKKIRELEGHISDLQEDLDSERAARNKAEKQKRDLGEELEALKTELEDTLDSTATQQELRAKREQEVTVLKKALDEETRSHEAQVQEMRQKHAQAVEELTEQLEQFKRAKANLDKNKQTLEKENADLAGELRVLGQAKQEVEHKKKKLEAQVQELQSKCSDGERARAELNDKVHKLQNEVESVTGMLNEAEGKAIKLAKDVASLSSQLQDTQELLQEETRQKLNVSTKLRQLEEERNSLQDQLDEEMEAKQNLERHISTLNIQLSDSKKKLQDFASTVEALEEGKKRFQKEIENLTQQYEEKAAAYDKLEKTKNRLQQELDDLVVDLDNQRQLVSNLEKKQRKFDQLLAEEKNISSKYADERDRAEAEAREKETKALSLARALEEALEAKEELERTNKMLKAEMEDLVSSKDDVGKNVHELEKSKRALETQMEEMKTQLEELEDELQATEDAKLRLEVNMQALKGQFERDLQARDEQNEEKRRQLQRQLHEYETELEDERKQRALAAAAKKKLEGDLKDLELQADSAIKGREEAIKQLRKLQAQMKDFQRELEDARASRDEIFATAKENEKKAKSLEADLMQLQEDLAAAERARKQADLEKEELAEELASSLSGRNALQDEKRRLEARIAQLEEELEEEQGNMEAMSDRVRKATQQAEQLSNELATERSTAQKNESARQQLERQNKELRSKLHEMEGAVKSKFKSTIAALEAKIAQLEEQVEQEAREKQAATKSLKQKDKKLKEILLQVEDERKMAEQYKEQAEKGNARVKQLKRQLEEAEEESQRINANRRKLQRELDEATESNEAMGREVNALKSKLRGPPPQETSQ

SEQ ID NO: 31942 - protein, 1972 aa, Homo sapiens
  ENSP00000488461
MAQKGQLSDDEKFLFVDKNFINSPVAQADWAAKRLVWVPSEKQGFEAASIKEEKGDEVVVELVENGKKVTVGKDDIQKMNPPKFSKVEDMAELTCLNEASVLHNLRERYFSGLIYTYSGLFCVVVNPYKHLPIYSEKIVDMYKGKKRHEMPPHIYAIADTAYRSMLQDREDQSILCTGESGAGKTENTKKVIQYLAVVASSHKGKKDTSITGELEKQLLQANPILEAFGNAKTVKNDNSSRFGKFIRINFDVTGYIVGANIETYLLEKSRAIRQARDERTFHIFYYMIAGAKEKMRSDLLLEGFNNYTFLSNGFVPIPAAQDDEMFQETVEAMAIMGFSEEEQLSILKVVSSVLQLGNIVFKKERNTDQASMPDNTAAQKVCHLMGINVTDFTRSILTPRIKVGRDVVQKAQTKEQADFAVEALAKATYERLFRWILTRVNKALDKTHRQGASFLGILDIAGFEIFEVNSFEQLCINYTNEKLQQLFNHTMFILEQEEYQREGIEWNFIDFGLDLQPCIELIERPNNPPGVLALLDEECWFPKATDKSFVEKLCTEQGSHPKFQKPKQLKDKTEFSIIHYAGKVDYNASAWLTKNMDPLNDNVTSLLNASSDKFVADLWKDVDRIVGLDQMAKMTESSLPSASKTKKGMFRTVGQLYKEQLGKLMTTLRNTTPNFVRCIIPNHEKRSGKLDAFLVLEQLRCNGVLEGIRICRQGFPNRIVFQEFRQRYEILAANAIPKGFMDGKQACILMIKALELDPNLYRIGQSKIFFRTGVLAHLEEERDLKITDVIMAFQAMCRGYLARKAFAKRQQQLTAMKVIQRNCAAYLKLRNWQWWRLFTKVKPLLQVTRQEEEMQAKEDELQKTKERQQKAENELKELEQKHSQLTEEKNLLQEQLQAETELYAEAEEMRVRLAAKKQELEEILHEMEARLEEEEDRGQQLQAERKKMAQQMLDLEEQLEEEEAARQKLQLEKVTAEAKIKKLEDEILVMDDQNNKLSKERKLLEERISDLTTNLAEEEEKAKNLTKLKNKHESMISELEVRLKKEEKSRQELEKLKRKLEGDASDFHEQIADLQAQIAELKMQLAKKEEELQAALARLDDEIAQKNNALKKIRELEGHISDLQEDLDSERAARNKAEKQKRDLGEELEALKTELEDTLDSTATQQELRAKREQEVTVLKKALDEETRSHEAQVQEMRQKHAQAVEELTEQLEQFKRAKANLDKNKQTLEKENADLAGELRVLGQAKQEVEHKKKKLEAQVQELQSKCSDGERARAELNDKVHKLQNEVESVTGMLNEAEGKAIKLAKDVASLSSQLQDTQELLQEETRQKLNVSTKLRQLEEERNSLQDQLDEEMEAKQNLERHISTLNIQLSDSKKKLQDFASTVEALEEGKKRFQKEIENLTQQYEEKAAAYDKLEKTKNRLQQELDDLVVDLDNQRQLVSNLEKKQRKFDQLLAEEKNISSKYADERDRAEAEAREKETKALSLARALEEALEAKEELERTNKMLKAEMEDLVSSKDDVGKNVHELEKSKRALETQMEEMKTQLEELEDELQATEDAKLRLEVNMQALKGQFERDLQARDEQNEEKRRQLQRQLHEYETELEDERKQRALAAAAKKKLEGDLKDLELQADSAIKGREEAIKQLRKLQAQMKDFQRELEDARASRDEIFATAKENEKKAKSLEADLMQLQEDLAAAERARKQADLEKEELAEELASSLSGRNALQDEKRRLEARIAQLEEELEEEQGNMEAMSDRVRKATQQAEQLSNELATERSTAQKNESARQQLERQNKELRSKLHEMEGAVKSKFKSTIAALEAKIAQLEEQVEQEAREKQAATKSLKQKDKKLKEILLQVEDERKMAEQYKEQAEKGNARVKQLKRQLEEAEEESQRINANRRKLQRELDEATESNEAMGREVNALKSKLRRGNETSFVPSRRSGGRRVIENADGSEEETDTRDADFNGTKASE

SEQ ID NO: 31943 - protein, 1979 aa, Homo sapiens; identical to SEQ ID NO: 31940
  ENSP00000379616

SEQ ID NO: 31944 - protein, 1945 aa, Homo sapiens; identical to SEQ ID NO: 31939
  ENSP00000407821

SEQ ID NO: 31945 - protein, 1938 aa, Homo sapiens; identical to SEQ ID NO: 31941
  ENSP00000458731

SEQ ID NO: 31946 - protein, 1972 aa, Homo sapiens; identical to SEQ ID NO: 31942
  ENSP00000300036

SEQ ID NO: 31947 - protein, 2003 aa, Homo sapiens
  ENSP00000472543
MAAVTMSVPGRKAPPRPGPVPEAAQPFLFTPRGPSAGGGPGSGTSPQVEWTARRLVWVPSELHGFEAAALRDEGEEEAEVELAESGRRLRLPRDQIQRMNPPKFSKAEDMAELTCLNEASVLHNLRERYYSGLIYTYSGLFCVVINPYKQLPIYTEAIVEMYRGKKRHEVPPHVYAVTEGAYRSMLQDREDQSILCTGESGAGKTENTKKVIQYLAHVASSPKGRKEPGVPASVSTVSYGELERQLLQANPILEAFGNAKTVKNDNSSRFGKFIRINFDVAGYIVGANIETYLLEKSRAIRQAKDECSFHIFYQLLGGAGEQLKADLLLEPCSHYRFLTNGPSSSPGQERELFQETLESLRVLGFSHEEIISMLRMVSAVLQFGNIALKRERNTDQATMPDNTAAQKLCRLLGLGVTDFSRALLTPRIKVGRDYVQKAQTKEQADFALEALAKATYERLFRWLVLRLNRALDRSPRQGASFLGILDIAGFEIFQLNSFEQLCINYTNEKLQQLFNHTMFVLEQEEYQREGIPWTFLDFGLDLQPCIDLIERPANPPGLLALLDEECWFPKATDKSFVEKVAQEQGGHPKFQRPRHLRDQADFSVLHYAGKVDYKANEWLMKNMDPLNDNVAALLHQSTDRLTAEIWKDVEGIVGLEQVSSLGDGPPGGRPRRGMFRTVGQLYKESLSRLMATLSNTNPSFVRCIVPNHEKRAGKLEPRLVLDQLRCNGVLEGIRICRQGFPNRILFQEFRQRYEILTPNAIPKGFMDGKQACEKMIQALELDPNLYRVGQSKIFFRAGVLAQLEEERDLKVTDIIVSFQAAARGYLARRAFQKRQQQQSALRVMQRNCAAYLKLRHWQWWRLFTKVKPLLQVTRQDEVLQARAQELQKVQELQQQSAREVGELQGRVAQLEEERARLAEQLRAEAELCAEAEETRGRLAARKQELELVVSELEARVGEEEECSRQMQTEKKRLQQHIQELEAHLEAEEGARQKLQLEKVTTEAKMKKFEEDLLLLEDQNSKLSKERKLLEDRLAEFSSQAAEEEEKVKSLNKLRLKYEATIADMEDRLRKEEKGRQELEKLKRRLDGESSELQEQMVEQQQRAEELRAQLGRKEEELQAALARAEDEGGARAQLLKSLREAQAALAEAQEDLESERVARTKAEKQRRDLGEELEALRGELEDTLDSTNAQQELRSKREQEVTELKKTLEEETRIHEAAVQELRQRHGQALGELAEQLEQARRGKGAWEKTRLALEAEVSELRAELSSLQTARQEGEQRRRRLELQLQEVQGRAGDGERARAEAAEKLQRAQAELENVSGALNEAESKTIRLSKELSSTEAQLHDAQELLQEETRAKLALGSRVRAMEAEAAGLREQLEEEAAARERAGRELQTAQAQLSEWRRRQEEEAGALEAGEEARRRAAREAEALTQRLAEKTETVDRLERGRRRLQQELDDATMDLEQQRQLVSTLEKKQRKFDQLLAEEKAAVLRAVEERERAEAEGREREARALSLTRALEEEQEAREELERQNRALRAELEALLSSKDDVGKSVHELERACRVAEQAANDLRAQVTELEDELTAAEDAKLRLEVTVQALKTQHERDLQGRDEAGEERRRQLAKQLRDAEVERDEERKQRTLAVAARKKLEGELEELKAQMASAGQGKEEAVKQLRKMQAQMKELWREVEETRTSREEIFSQNRESEKRLKGLEAEVLRLQEELAASDRARRQAQQDRDEMADEVANGNLSKAAILEEKRQLEGRLGQLEEELEEEQSNSELLNDRYRKLLLQVESLTTELSAERSFSAKAESGRQQLERQIQELRGRLGEEDAGARARHKMTIAALESKLAQAEEQLEQETRERILSGKLVRRAEKRLKEVVLQVEEERRVADQLRDQLEKGNLRVKQLKRQLEEAEEEASRAQAGRRRLQRELEDVTESAESMNREVTTLRNRLRRGPLTFTTRTVRQVFRLEEGVASDEEAEEAQPGSGPSPEPEGSPPAHPQ

SEQ ID NO: 31948 - protein, 1002 aa, Homo sapiens
  ENSP00000469573
MAAVTMSVPGRKAPPRPGPVPEAAQPFLFTPRGPSAGGGPGSGTSPQVEWTARRLVWVPSELHGFEAAALRDEGEEEAEVELAESGRRLRLPRDQIQRMNPPKFSKAEDMAELTCLNEASVLHNLRERYYSGLIYTYSGLFCVVINPYKQLPIYTEAIVEMYRGKKRHEVPPHVYAVTEGAYRSMLQDREDQSILCTGESGAGKTENTKKVIQYLAHVASSPKGRKEPGVPASVSTVSYGELERQLLQANPILEAFGNAKTVKNDNSSRFGKFIRINFDVAGYIVGANIETYLLEKSRAIRQAKDECSFHIFYQLLGGAGEQLKADLLLEPCSHYRFLTNGPSSSPGQERELFQETLESLRVLGFSHEEIISMLRMVSAVLQFGNIALKRERNTDQATMPDNTAAQKLCRLLGLGVTDFSRALLTPRIKVGRDYVQKAQTKEQADFALEALAKATYERLFRWLVLRLNRALDRSPRQGASFLGILDIAGFEIFQLNSFEQLCINYTNEKLQQLFNHTMFVLEQEEYQREGIPWTFLDFGLDLQPCIDLIERPANPPGLLALLDEECWFPKATDKSFVEKVAQEQGGHPKFQRPRHLRDQADFSVLHYAGKVDYKANEWLMKNMDPLNDNVAALLHQSTDRLTAEIWKDVEGIVGLEQVSSLGDGPPGGRPRRGMFRTVGQLYKESLSRLMATLSNTNPSFVRCIVPNHEKRAGKLEPRLVLDQLRCNGVLEGIRICRQGFPNRILFQEFRQRYEILTPNAIPKGFMDGKQACEKMIQALELDPNLYRVGQSKIFFRAGVLAQLEEERDLKVTDIIVSFQAAARGYLARRAFQKRQQQQSALRVMQRNCAAYLKLRHWQWWRLFTKVKPLLQVTRQDEVLQARAQELQKVQELQQQSAREVGELQGRVAQLEEERARLAEQLRAEAELCAEAEETRGRLAARKQELELVVSELEARVGEEEECSRQMQTEKKRLQQHIQELEAHLEAEEGARQKLQLEKVTTE

SEQ ID NO: 31949 - protein, 2036 aa, Homo sapiens
  ENSP00000470298
MAAVTMSVPGRKAPPRPGPVPEAAQPFLFTPRGPSAGGGPGSGTSPQVEWTARRLVWVPSELHGFEAAALRDEGEEEAEVELAESGRRLRLPRDQIQRMNPPKFSKAEDMAELTCLNEASVLHNLRERYYSGLIYTYSGLFCVVINPYKQLPIYTEAIVEMYRGKKRHEVPPHVYAVTEGAYRSMLQDREDQSILCTGESGAGKTENTKKVIQYLAHVASSPKGRKEPGVPASVSTVSYGELERQLLQANPILEAFGNAKTVKNDNSSRFGKFIRINFDVAGYIVGANIETYLLEKSRAIRQAKDECSFHIFYQLLGGAGEQLKADLLLEPCSHYRFLTNGPSSSPGQERELFQETLESLRVLGFSHEEIISMLRMVSAVLQFGNIALKRERNTDQATMPDNTAAQKLCRLLGLGVTDFSRALLTPRIKVGRDYVQKAQTKEQADFALEALAKATYERLFRWLVLRLNRALDRSPRQGASFLGILDIAGFEIFQLNSFEQLCINYTNEKLQQLFNHTMFVLEQEEYQREGIPWTFLDFGLDLQPCIDLIERPANPPGLLALLDEECWFPKATDKSFVEKVAQEQGGHPKFQRPRHLRDQADFSVLHYAGKVDYKANEWLMKNMDPLNDNVAALLHQSTDRLTAEIWKDEHGGFQQFSFLGSFPPSPPGSAERCSSAISPPGVEGIVGLEQVSSLGDGPPGGRPRRGMFRTVGQLYKESLSRLMATLSNTNPSFVRCIVPNHEKRAGKLEPRLVLDQLRCNGVLEGIRICRQGFPNRILFQEFRQRYEILTPNAIPKGFMDGKQACEKMIQALELDPNLYRVGQSKIFFRAGVLAQLEEERDLKVTDIIVSFQAAARGYLARRAFQKRQQQQSALRVMQRNCAAYLKLRHWQWWRLFTKVKPLLQVTRQDEVLQARAQELQKVQELQQQSAREVGELQGRVAQLEEERARLAEQLRAEAELCAEAEETRGRLAARKQELELVVSELEARVGEEEECSRQMQTEKKRLQQHIQELEAHLEAEEGARQKLQLEKVTTEAKMKKFEEDLLLLEDQNSKLSKERKLLEDRLAEFSSQAAEEEEKVKSLNKLRLKYEATIADMEDRLRKEEKGRQELEKLKRRLDGESSELQEQMVEQQQRAEELRAQLGRKEEELQAALARAEDEGGARAQLLKSLREAQAALAEAQEDLESERVARTKAEKQRRDLGEELEALRGELEDTLDSTNAQQELRSKREQEVTELKKTLEEETRIHEAAVQELRQRHGQALGELAEQLEQARRGKGAWEKTRLALEAEVSELRAELSSLQTARQEGEQRRRRLELQLQEVQGRAGDGERARAEAAEKLQRAQAELENVSGALNEAESKTIRLSKELSSTEAQLHDAQELLQEETRAKLALGSRVRAMEAEAAGLREQLEEEAAARERAGRELQTAQAQLSEWRRRQEEEAGALEAGEEARRRAAREAEALTQRLAEKTETVDRLERGRRRLQQELDDATMDLEQQRQLVSTLEKKQRKFDQLLAEEKAAVLRAVEERERAEAEGREREARALSLTRALEEEQEAREELERQNRALRAELEALLSSKDDVGKSVHELERACRVAEQAANDLRAQVTELEDELTAAEDAKLRLEVTVQALKTQHERDLQGRDEAGEERRRQLAKQLRDAEVERDEERKQRTLAVAARKKLEGELEELKAQMASAGQGKEEAVKQLRKMQAQMKELWREVEETRTSREEIFSQNRESEKRLKGLEAEVLRLQEELAASDRARRQAQQDRDEMADEVANGNLSKAAILEEKRQLEGRLGQLEEELEEEQSNSELLNDRYRKLLLQVESLTTELSAERSFSAKAESGRQQLERQIQELRGRLGEEDAGARARHKMTIAALESKLAQAEEQLEQETRERILSGKLVRRAEKRLKEVVLQVEEERRVADQLRDQLEKGNLRVKQLKRQLEEAEEEASRAQAGRRRLQRELEDVTESAESMNREVTTLRNRLRRGPLTFTTRTVRQVFRLEEGVASDEEAEEAQPGSGPSPEPEGSPPAHPQ

SEQ ID NO: 31950 - protein, 1995 aa, Homo sapiens
  ENSP00000472819
MAAVTMSVPGRKAPPRPGPVPEAAQPFLFTPRGPSAGGGPGSGTSPQVEWTARRLVWVPSELHGFEAAALRDEGEEEAEVELAESGRRLRLPRDQIQRMNPPKFSKAEDMAELTCLNEASVLHNLRERYYSGLIYTYSGLFCVVINPYKQLPIYTEAIVEMYRGKKRHEVPPHVYAVTEGAYRSMLQDREDQSILCTGESGAGKTENTKKVIQYLAHVASSPKGRKEPGVPGELERQLLQANPILEAFGNAKTVKNDNSSRFGKFIRINFDVAGYIVGANIETYLLEKSRAIRQAKDECSFHIFYQLLGGAGEQLKADLLLEPCSHYRFLTNGPSSSPGQERELFQETLESLRVLGFSHEEIISMLRMVSAVLQFGNIALKRERNTDQATMPDNTAAQKLCRLLGLGVTDFSRALLTPRIKVGRDYVQKAQTKEQADFALEALAKATYERLFRWLVLRLNRALDRSPRQGASFLGILDIAGFEIFQLNSFEQLCINYTNEKLQQLFNHTMFVLEQEEYQREGIPWTFLDFGLDLQPCIDLIERPANPPGLLALLDEECWFPKATDKSFVEKVAQEQGGHPKFQRPRHLRDQADFSVLHYAGKVDYKANEWLMKNMDPLNDNVAALLHQSTDRLTAEIWKDVEGIVGLEQVSSLGDGPPGGRPRRGMFRTVGQLYKESLSRLMATLSNTNPSFVRCIVPNHEKRAGKLEPRLVLDQLRCNGVLEGIRICRQGFPNRILFQEFRQRYEILTPNAIPKGFMDGKQACEKMIQALELDPNLYRVGQSKIFFRAGVLAQLEEERDLKVTDIIVSFQAAARGYLARRAFQKRQQQQSALRVMQRNCAAYLKLRHWQWWRLFTKVKPLLQVTRQDEVLQARAQELQKVQELQQQSAREVGELQGRVAQLEEERARLAEQLRAEAELCAEAEETRGRLAARKQELELVVSELEARVGEEEECSRQMQTEKKRLQQHIQELEAHLEAEEGARQKLQLEKVTTEAKMKKFEEDLLLLEDQNSKLSKERKLLEDRLAEFSSQAAEEEEKVKSLNKLRLKYEATIADMEDRLRKEEKGRQELEKLKRRLDGESSELQEQMVEQQQRAEELRAQLGRKEEELQAALARAEDEGGARAQLLKSLREAQAALAEAQEDLESERVARTKAEKQRRDLGEELEALRGELEDTLDSTNAQQELRSKREQEVTELKKTLEEETRIHEAAVQELRQRHGQALGELAEQLEQARRGKGAWEKTRLALEAEVSELRAELSSLQTARQEGEQRRRRLELQLQEVQGRAGDGERARAEAAEKLQRAQAELENVSGALNEAESKTIRLSKELSSTEAQLHDAQELLQEETRAKLALGSRVRAMEAEAAGLREQLEEEAAARERAGRELQTAQAQLSEWRRRQEEEAGALEAGEEARRRAAREAEALTQRLAEKTETVDRLERGRRRLQQELDDATMDLEQQRQLVSTLEKKQRKFDQLLAEEKAAVLRAVEERERAEAEGREREARALSLTRALEEEQEAREELERQNRALRAELEALLSSKDDVGKSVHELERACRVAEQAANDLRAQVTELEDELTAAEDAKLRLEVTVQALKTQHERDLQGRDEAGEERRRQLAKQLRDAEVERDEERKQRTLAVAARKKLEGELEELKAQMASAGQGKEEAVKQLRKMQAQMKELWREVEETRTSREEIFSQNRESEKRLKGLEAEVLRLQEELAASDRARRQAQQDRDEMADEVANGNLSKAAILEEKRQLEGRLGQLEEELEEEQSNSELLNDRYRKLLLQVESLTTELSAERSFSAKAESGRQQLERQIQELRGRLGEEDAGARARHKMTIAALESKLAQAEEQLEQETRERILSGKLVRRAEKRLKEVVLQVEEERRVADQLRDQLEKGNLRVKQLKRQLEEAEEEASRAQAGRRRLQRELEDVTESAESMNREVTTLRNRLRRGPLTFTTRTVRQVFRLEEGVASDEEAEEAQPGSGPSPEPEGSPPAHPQ

SEQ ID NO: 31951 - protein, 2003 aa, Homo sapiens; identical to SEQ ID NO: 31947
  ENSP00000407879

SEQ ID NO: 31952 - protein, 1995 aa, Homo sapiens; identical to SEQ ID NO: 31950
  ENSP00000366169

SEQ ID NO: 31953 - protein, 508 aa, Homo sapiens
  ENSP00000262269
MKKFEEDLLLLEDQNSKLSKERKLLEDRLAEFSSQAAEEEEKVKSLNKLRLKYEATIADMEDRLRKEEKGRQELEKLKRRLDGESSELQEQMVEQQQRAEELRAQLGRKEEELQAALARAEDEGGARAQLLKSLREAQAALAEAQEDLESERVARTKAEKQRRDLGEELEALRGELEDTLDSTNAQQELRSKREQEVTELKKTLEEETRIHEAAVQELRQRHGQALGELAEQLEQARRGKGAWEKTRLALEAEVSELRAELSSLQTARQEGEQRRRRLELQLQEVQGRAGDGERARAEAAEKLQRAQAELENVSGALNEAESKTIRLSKELSSTEAQLHDAQELLQEETRAKLALGSRVRAMEAEAAGLREQLEEEAAARERAGRELQTAQAQLSEWRRRQEEEAGALEAGEEARRRAAREAEALTQRLAEKTETVDRLERGRRRLQQELDDATMDLEQQRQLVSTLEKKQRKFDQLLAEEKAAVLRAVEERERPRQRAGSVRLGPCH

SEQ ID NO: 31954 - protein, 638 aa, Homo sapiens
  ENSP00000406273
MEAEAAGLREQLEEEAAARERAGRELQTAQAQLSEWRRRQEEEAGALEAGEEARRRAAREAEALTQRLAEKTETVDRLERGRRRLQQELDDATMDLEQQRQLVSTLEKKQRKFDQLLAEEKAAVLRAVEERERAEAEGREREARALSLTRALEEEQEAREELERQNRALRAELEALLSSKDDVGKSVHELERACRVAEQAANDLRAQVTELEDELTAAEDAKLRLEVTVQALKTQHERDLQGRDEAGEERRRQLAKQLRDAEVERDEERKQRTLAVAARKKLEGELEELKAQMASAGQGKEEAVKQLRKMQAQMKELWREVEETRTSREEIFSQNRESEKRLKGLEAEVLRLQEELAASDRARRQAQQDRDEMADEVANGNLSKAAILEEKRQLEGRLGQLEEELEEEQSNSELLNDRYRKLLLQVESLTTELSAERSFSAKAESGRQQLERQIQELRGRLGEEDAGARARHKMTIAALESKLAQAEEQLEQETRERILSGKLVRRAEKRLKEVVLQVEEERRVADQLRDQLEKGNLRVKQLKRQLEEAEEEASRAQAGRRRLQRELEDVTESAESMNREVTTLRNRLRRGPLTFTTRTVRQVFRLEEGVASDEEAEEAQPGSGPSPEPEGSPPAHPQ

SEQ ID NO: 31955 - protein, 1939 aa, Homo sapiens
  ENSP00000348634
MTDAQMADFGAAAQYLRKSEKERLEAQTRPFDIRTECFVPDDKEEFVKAKILSREGGKVIAETENGKTVTVKEDQVLQQNPPKFDKIEDMAMLTFLHEPAVLFNLKERYAAWMIYTYSGLFCVTVNPYKWLPVYNAEVVAAYRGKKRSEAPPHIFSISDNAYQYMLTDRENQSILITGESGAGKTVNTKRVIQYFASIAAIGDRGKKDNANANKGTLEDQIIQANPALEAFGNAKTVRNDNSSRFGKFIRIHFGATGKLASADIETYLLEKSRVIFQLKAERNYHIFYQILSNKKPELLDMLLVTNNPYDYAFVSQGEVSVASIDDSEELMATDSAFDVLGFTSEEKAGVYKLTGAIMHYGNMKFKQKQREEQAEPDGTEDADKSAYLMGLNSADLLKGLCHPRVKVGNEYVTKGQSVQQVYYSIGALAKAVYEKMFNWMVTRINATLETKQPRQYFIGVLDIAGFEIFDFNSFEQLCINFTNEKLQQFFNHHMFVLEQEEYKKEGIEWTFIDFGMDLQACIDLIEKPMGIMSILEEECMFPKATDMTFKAKLYDNHLGKSNNFQKPRNIKGKQEAHFSLIHYAGTVDYNILGWLEKNKDPLNETVVALYQKSSLKLMATLFSSYATADTGDSGKSKGGKKKGSSFQTVSALHRENLNKLMTNLRTTHPHFVRCIIPNERKAPGVMDNPLVMHQLRCNGVLEGIRICRKGFPNRILYGDFRQRYRILNPVAIPEGQFIDSRKGTEKLLSSLDIDHNQYKFGHTKVFFKAGLLGLLEEMRDERLSRIITRMQAQARGQLMRIEFKKIVERRDALLVIQWNIRAFMGVKNWPWMKLYFKIKPLLKSAETEKEMATMKEEFGRIKETLEKSEARRKELEEKMVSLLQEKNDLQLQVQAEQDNLNDAEERCDQLIKNKIQLEAKVKEMNERLEDEEEMNAELTAKKRKLEDECSELKKDIDDLELTLAKVEKEKHATENKVKNLTEEMAGLDEIIAKLTKEKKALQEAHQQALDDLQVEEDKVNSLSKSKVKLEQQVDDLEGSLEQEKKVRMDLERAKRKLEGDLKLTQESIMDLENDKLQLEEKLKKKEFDINQQNSKIEDEQVLALQLQKKLKENQARIEELEEELEAERTARAKVEKLRSDLSRELEEISERLEEAGGATSVQIEMNKKREAEFQKMRRDLEEATLQHEATAAALRKKHADSVAELGEQIDNLQRVKQKLEKEKSEFKLELDDVTSNMEQIIKAKANLEKVSRTLEDQANEYRVKLEEAQRSLNDFTTQRAKLQTENGELARQLEEKEALISQLTRGKLSYTQQMEDLKRQLEEEGKAKNALAHALQSARHDCDLLREQYEEETEAKAELQRVLSKANSEVAQWRTKYETDAIQRTEELEEAKKKLAQRLQDAEEAVEAVNAKCSSLEKTKHRLQNEIEDLMVDVERSNAAAAALDKKQRNFDKILAEWKQKYEESQSELESSQKEARSLSTELFKLKNAYEESLEHLETFKRENKNLQEEISDLTEQLGEGGKNVHELEKVRKQLEVEKLELQSALEEAEASLEHEEGKILRAQLEFNQIKAEIERKLAEKDEEMEQAKRNHQRVVDSLQTSLDAETRSRNEVLRVKKKMEGDLNEMEIQLSHANRMAAEAQKQVKSLQSLLKDTQIQLDDAVRANDDLKENIAIVERRNNLLQAELEELRAVVEQTERSRKLAEQELIETSERVQLLHSQNTSLINQKKKMESDLTQLQSEVEEAVQECRNAEEKAKKAITDAAMMAEELKKEQDTSAHLERMKKNMEQTIKDLQHRLDEAEQIALKGGKKQLQKLEARVRELEGELEAEQKRNAESVKGMRKSERRIKELTYQTEEDKKNLLRLQDLVDKLQLKVKAYKRQAEEAEEQANTNLSKFRKVQHELDEAEERADIAESQVNKLRAKSRDIGAKQKMHDEE

SEQ ID NO: 31956 - protein, 1939 aa, Homo sapiens; identical to SEQ ID NO: 31955
  ENSP00000386041

SEQ ID NO: 31957 - protein, 445 aa, Homo sapiens
  ENSP00000349298
MLCYVTRPDAVLMEVEVEAKANGEDCLNQVCRRLGIIEVDYFGLQFTGSKGESLWLNLRNRISQQMDGLAPYRLKLRVKFFVEPHLILQEQTRHIFFLHIKEALLAGHLLCSPEQAVELSALLAQTKFGDYNQNTAKYNYEELCAKELSSATLNSIVAKHKELEGTSQASAEYQVLQIVSAMENYGIEWHSVRDSEGQKLLIGVGPEGISICKDDFSPINRIAYPVVQMATQSGKNVYLTVTKESGNSIVLLFKMISTRAASGLYRAITETHAFYRCDTVTSAVMMQYSRDLKGHLASLFLNENINLGKKYVFDIKRTSKEVYDHARRALYNAGVVDLVSRNNQSPSHSPLKSSESSMNCSSCEGLSCQQTRVLQEKLRKLKEAMLCMVCCEEEINSTFCPCGHTVCCESCAAQLQSCPVCRSRVEHVQHVYLPTHTSLLNLTVI

SEQ ID NO: 31958 - protein, 264 aa, Homo sapiens
  ENSP00000008686
MENYGIEWHSVRDSEGQKLLIGVGPEGISICKDDFSPINRIAYPVVQMATQSGKNVYLTVTKESGNSIVLLFKMISTRAASGLYRAITETHAFYRCDTVTSAVMMQYSRDLKGHLASLFLNENINLGKKYVFDIKRTSKEVYDHARRALYNAGVVDLVSRNNQSPSHSPLKSSESSMNCSSCEGLSCQQTRVLQEKLRKLKEAMLCMVCCEEEINSTFCPCGHTVCCESCAAQLQSCPVCRSRVEHVQHVYLPTHTSLLNLTVI

SEQ ID NO: 31959 - protein, 2058 aa, Homo sapiens
  ENSP00000421280
MDNFFTEGTRVWLRENGQHFPSTVNSCAEGIVVFRTDYGQVFTYKQSTITHQKVTAMHPTNEEGVDDMASLTELHGGSIMYNLFQRYKRNQIYTYIGSILASVNPYQPIAGLYEPATMEQYSRRHLGELPPHIFAIANECYRCLWKRHDNQCILISGESGAGKTESTKLILKFLSVISQQSLELSLKEKTSCVERAILESSPIMEAFGNAKTVYNNNSSRFGKFVQLNICQKGNIQGGRIVDYLLEKNRVVRQNPGERNYHIFYALLAGLEHEEREEFYLSTPENYHYLNQSGCVEDKTISDQESFREVITAMDVMQFSKEEVREVSRLLAGILHLGNIEFITAGGAQVSFKTALGRSAELLGLDPTQLTDALTQRSMFLRGEEILTPLNVQQAVDSRDSLAMALYACCFEWVIKKINSRIKGNEDFKSIGILDIFGFENFEVNHFEQFNINYANEKLQEYFNKHIFSLEQLEYSREGLVWEDIDWIDNGECLDLIEKKLGLLALINEESHFPQATDSTLLEKLHSQHANNHFYVKPRVAVNNFGVKHYAGEVQYDVRGILEKNRDTFRDDLLNLLRESRFDFIYDLFEHVSSRNNQDTLKCGSKHRRPTVSSQFKDSLHSLMATLSSSNPFFVRCIKPNMQKMPDQFDQAVVLNQLRYSGMLETVRIRKAGYAVRRPFQDFYKRYKVLMRNLALPEDVRGKCTSLLQLYDASNSEWQLGKTKVFLRESLEQKLEKRREEEVSHAAMVIRAHVLGFLARKQYRKVLYCVVIIQKNYRAFLLRRRFLHLKKAAIVFQKQLRGQIARRVYRQLLAEKREQEEKKKQEEEEKKKREEEERERERERREAELRAQQEEETRKQQELEALQKSQKEAELTRELEKQKENKQVEEILRLEKEIEDLQRMKEQQELSLTEASLQKLQERRDQELRRLEEEACRAAQEFLESLNFDEIDECVRNIERSLSVGSEFSSELAESACEEKPNFNFSQPYPEEEVDEGFEADDDAFKDSPNPSEHGHSDQRTSGIRTSDDSSEEDPYMNDTVVPTSPSADSTVLLAPSVQDSGSLHNSSSGESTYCMPQNAGDLPSPDGDYDYDQDDYEDGAITSGSSVTFSNSYGSQWSPDYRCSVGTYNSSGAYRFSSEGAQSSFEDSEEDFDSRFDTDDELSYRRDSVYSCVTLPYFHSFLYMKGGLMNSWKRRWCVLKDETFLWFRSKQEALKQGWLHKKGGGSSTLSRRNWKKRWFVLRQSKLMYFENDSEEKLKGTVEVRTAKEIIDNTTKENGIDIIMADRTFHLIAESPEDASQWFSVLSQVHASTDQEIQEMHDEQANPQNAVGTLDVGLIDSVCASDSPDRPNSFVIITANRVLHCNADTPEEMHHWITLLQRSKGDTRVEGQEFIVRGWLHKEVKNSPKMSSLKLKKRWFVLTHNSLDYYKSSEKNALKLGTLVLNSLCSVVPPDEKIFKETGYWNVTVYGRKHCYRLYTKLLNEATRWSSAIQNVTDTKAPIDTPTQQLIQDIKENCLNSDVVEQIYKRNPILRYTHHPLHSPLLPLPYGDINLNLLKDKGYTTLQDEAIKIFNSLQQLESMSDPIPIIQGILQTGHDLRPLRDELYCQLIKQTNKVPHPGSVGNLYSWQILTCLSCTFLPSRGILKYLKFHLKRIREQFPGSEMEKYALFTYESLKKTKCREFVPSRDEIEALIHRQEMTSTVYCHGGGSCKITINSHTTAGEVVEKLIRGLAMEDSRNMFALFEYNGHVDKAIESRTVVADVLAKFEKLAATSEVGDLPWKFYFKLYCFLDTDNVPKDSVEFAFMFEQAHEAVIHGHHPAPEENLQVLAALRLQYLQGDYTLHAAIPPLEEVYSLQRLKARISQSTKTFTPCERLEKRRTSFLEGTLRRSFRTGSVVRQKVEEEQMLDMWIKEEVSSARASIIDKWRKFQGMNQEQAMAKYMALIKEWPGYGSTLFDVECKEGGFPQELWLGVSADAVSVYKRGEGRPLEVFQYEHILSFGAPLANTYKIVVDERELLFETSEVVDVAKLMKAYISMIVKKRYSTTRSASSQGSSR

SEQ ID NO: 31960 - protein, 1397 aa, Homo sapiens
  ENSP00000425051
MLETVRIRKAGYAVRRPFQDFYKRYKVLMRNLALPEDVRGKCTSLLQLYDASNSEWQLGKTKVFLRESLEQKLEKRREEEVSHAAMVIRAHVLGFLARKQYRKVLYCVVIIQKNYRAFLLRRRFLHLKKAAIVFQKQLRGQIARRVYRQLLAEKREQEEKKKQEEEEKKKREEEERERERERREAELRAQQEEETRKQQELEALQKSQKEAELTRELEKQKENKQVEEILRLEKEIEDLQRMKEQQELSLTEASLQKLQERRDQELRRLEEEACRAAQEFLESLNFDEIDECVRNIERSLSVGSEFSSELAESACEEKPNFNFSQPYPEEEVDEGFEADDDAFKDSPNPSEHGHSDQRTSGIRTSDDSSEEDPYMNDTVVPTSPSADSTVLLAPSVQDSGSLHNSSSGESTYCMPQNAGDLPSPDGDYDYDQDDYEDGAITSGSSVTFSNSYGSQWSPDYRCSVGTYNSSGAYRFSSEGAQSSFEDSEEDFDSRFDTDDELSYRRDSVYSCVTLPYFHSFLYMKGGLMNSWKRRWCVLKDETFLWFRSKQEALKQGWLHKKGGGSSTLSRRNWKKRWFVLRQSKLMYFENDSEEKLKGTVEVRTAKEIIDNTTKENGIDIIMADRTFHLIAESPEDASQWFSVLSQVHASTDQEIQEMHDEQANPQNAVGTLDVGLIDSVCASDSPDRPNSFVIITANRVLHCNADTPEEMHHWITLLQRSKGDTRVEGQEFIVRGWLHKEVKNSPKMSSLKLKKRWFVLTHNSLDYYKSSEKNALKLGTLVLNSLCSVVPPDEKIFKETGYWNVTVYGRKHCYRLYTKLLNEATRWSSAIQNVTDTKAPIDTPTQQLIQDIKENCLNSDVVEQIYKRNPILRYTHHPLHSPLLPLPYGDINLNLLKDKGYTTLQDEAIKIFNSLQQLESMSDPIPIIQGILQTGHDLRPLRDELYCQLIKQTNKVPHPGSVGNLYSWQILTCLSCTFLPSRGILKYLKFHLKRIREQFPGSEMEKYALFTYESLKKTKCREFVPSRDEIEALIHRQEMTSTVYCHGGGSCKITINSHTTAGEVVEKLIRGLAMEDSRNMFALFEYNGHVDKAIESRTVVADVLAKFEKLAATSEVGDLPWKFYFKLYCFLDTDNVPKDSVEFAFMFEQAHEAVIHGHHPAPEENLQVLAALRLQYLQGDYTLHAAIPPLEEVYSLQRLKARISQSTKTFTPCERLEKRRTSFLEGTLRRSFRTGSVVRQKVEEEQMLDMWIKEEVSSARASIIDKWRKFQGMNQEQAMAKYMALIKEWPGYGSTLFDVECKEGGFPQELWLGVSADAVSVYKRGEGRPLEVFQYEHILSFGAPLANTYKIVVDERELLFETSEVVDVAKLMKAYISMIVKKRYSTTRSASSQGSSR

SEQ ID NO: 31961 - protein, 1397 aa, Homo sapiens; identical to SEQ ID NO: 31960
  ENSP00000421170

SEQ ID NO: 31962 - protein, 830 aa, Homo sapiens
  ENSP00000421309
MTSLPRLRLNTRDQAIQLGTRVWLRENGQHFPSTVNSCAEGIVVFRTDYGQVFTYKQSTITHQKVTAMHPTNEEGVDDMASLTELHGGSIMYNLFQRYKRNQIYTYIGSILASVNPYQPIAGLYEPATMEQYSRRHLGELPPHIFAIANECYRCLWKRHDNQCILISGESGAGKTESTKLILKFLSVISQQSLELSLKEKTSCVERAILESSPIMEAFGNAKTVYNNNSSRFGKFVQLNICQKGNIQGGRIVDYLLEKNRVVRQNPGERNYHIFYALLAGLEHEEREEFYLSTPENYHYLNQSGCVEDKTISDQESFREVITAMDVMQFSKEEVREVSRLLAGILHLGNIEFITAGGAQVSFKTALGRSAELLGLDPTQLTDALTQRSMFLRGEEILTPLNVQQAVDSRDSLAMALYACCFEWVIKKINSRIKGNEDFKSIGILDIFGFENFEVNHFEQFNINYANEKLQEYFNKHIFSLEQLEYSREGLVWEDIDWIDNGECLDLIEKKLGLLALINEESHFPQATDSTLLEKLHSQHANNHFYVKPRVAVNNFGVKHYAGEVQYDVRGILEKNRDTFRDDLLNLLRESRFDFIYDLFEHVSSRNNQDTLKCGSKHRRPTVSSQFKDSLHSLMATLSSSNPFFVRCIKPNMQKMPDQFDQAVVLNQLRYSGMLETVRIRKAGYAVRRPFQDFYKRYKVLMRNLALPEDVRGKCTSLLQLYDASNSEWQLGKTKVFLRESLEQKLEKRREEEVSHAAMVIRAHVLGFLARKQYRKVLYCVVIIQKNYRAFLLRRRFLHLKKAAIVFQKQLRGQIARRVYRQLLAEKREQE

SEQ ID NO: 31963 - protein, 212 aa, Homo sapiens
  ENSP00000426783
MDNFFTEVFTYKQSTITHQKVTAMHPTNEEGVDDMASLTELHGGSIMYNLFQRYKRNQIYTYIGSILASVNPYQPIAGLYEPATMEQYSRRHLGELPPHIFAIANECYRCLWKRHDNQCILISGESGAGKTESTKLILKFLSVISQQSLELSLKEKTSCVERAILESSPIMEAFGNAKTVYNNNSSRFGKFVQLNICQKGNIQGGRIVDYLL

SEQ ID NO: 31964 - protein, 97 aa, Homo sapiens
  ENSP00000426664
MDNFFTEGTRVWLRENGQHFPSTVNSCAEGIVVFRTDYGQVFTYKQSTITHQKVTAMHPTNEEGVDDMASLTELHGGSIMYNLFQRYKRNQIYVQIG

SEQ ID NO: 31965 - protein, 2069 aa, Homo sapiens
  ENSP00000274203
MDNFFTEGTRVWLRENGQHFPSTVNSCAEGIVVFRTDYGQVFTYKQSTITHQKVTAMHPTNEEGVDDMASLTELHGGSIMYNLFQRYKRNQIYTYIGSILASVNPYQPIAGLYEPATMEQYSRRHLGELPPHIFAIANECYRCLWKRHDNQCILISGESGAGKTESTKLILKFLSVISQQSLELSLKEKTSCVERAILESSPIMEAFGNAKTVYNNNSSRFGKFVQLNICQKGNIQGGRIVDYLLEKNRVVRQNPGERNYHIFYALLAGLEHEEREEFYLSTPENYHYLNQSGCVEDKTISDQESFREVITAMDVMQFSKEEVREVSRLLAGILHLGNIEFITAGGAQVSFKTALGRSAELLGLDPTQLTDALTQRSMFLRGEEILTPLNVQQAVDSRDSLAMALYACCFEWVIKKINSRIKGNEDFKSIGILDIFGFENFEVNHFEQFNINYANEKLQEYFNKHIFSLEQLEYSREGLVWEDIDWIDNGECLDLIEKKLGLLALINEESHFPQATDSTLLEKLHSQHANNHFYVKPRVAVNNFGVKHYAGEVQYDVRGILEKNRDTFRDDLLNLLRESRFDFIYDLFEHVSSRNNQDTLKCGSKHRRPTVSSQFKDSLHSLMATLSSSNPFFVRCIKPNMQKMPDQFDQAVVLNQLRYSGMLETVRIRKAGYAVRRPFQDFYKRQEGAELDSLSFQRVLMRNLALPEDVRGKCTSLLQLYDASNSEWQLGKTKVFLRESLEQKLEKRREEEVSHAAMVIRAHVLGFLARKQYRKVLYCVVIIQKNYRAFLLRRRFLHLKKAAIVFQKQLRGQIARRVYRQLLAEKREQEEKKKQEEEEKKKREEEERERERERREAELRAQQEEETRKQQELEALQKSQKEAELTRELEKQKENKQVEEILRLEKEIEDLQRMKEQQELSLTEASLQKLQERRDQELRRLEEEACRAAQEFLESLNFDEIDECVRNIERSLSVGSEFSSELAESACEEKPNFNFSQPYPEEEVDEGFEADDDAFKDSPNPSEHGHSDQRTSGIRTSDDSSEEDPYMNDTVVPTSPSADSTVLLAPSVQDSGSLHNSSSGESTYCMPQNAGDLPSPDGDYDYDQDDYEDGAITSGSSVTFSNSYGSQWSPDYRCSVGTYNSSGAYRFSSEGAQSSFEDSEEDFDSRFDTDDELSYRRDSVYSCVTLPYFHSFLYMKGGLMNSWKRRWCVLKDETFLWFRSKQEALKQGWLHKKGGGSSTLSRRNWKKRWFVLRQSKLMYFENDSEEKLKGTVEVRTAKEIIDNTTKENGIDIIMADRTFHLIAESPEDASQWFSVLSQVHASTDQEIQEMHDEQANPQNAVGTLDVGLIDSVCASDSPDRPNSFVIITANRVLHCNADTPEEMHHWITLLQRSKGDTRVEGQEFIVRGWLHKEVKNSPKMSSLKLKKRWFVLTHNSLDYYKSSEKNALKLGTLVLNSLCSVVPPDEKIFKETGYWNVTVYGRKHCYRLYTKLLNEATRWSSAIQNVTDTKAPIDTPTQQLIQDIKENCLNSDVVEQIYKRNPILRYTHHPLHSPLLPLPYGDINLNLLKDKGYTTLQDEAIKIFNSLQQLESMSDPIPIIQGILQTGHDLRPLRDELYCQLIKQTNKVPHPGSVGNLYSWQILTCLSCTFLPSRGILKYLKFHLKRIREQFPGSEMEKYALFTYESLKKTKCREFVPSRDEIEALIHRQEMTSTVYCHGGGSCKITINSHTTAGEVVEKLIRGLAMEDSRNMFALFEYNGHVDKAIESRTVVADVLAKFEKLAATSEVGDLPWKFYFKLYCFLDTDNVPKDSVEFAFMFEQAHEAVIHGHHPAPEENLQVLAALRLQYLQGDYTLHAAIPPLEEVYSLQRLKARISQSTKTFTPCERLEKRRTSFLEGTLRRSFRTGSVVRQKVEEEQMLDMWIKEEVSSARASIIDKWRKFQGMNQEQAMAKYMALIKEWPGYGSTLFDVECKEGGFPQELWLGVSADAVSVYKRGEGRPLEVFQYEHILSFGAPLANTYKIVVDERELLFETSEVVDVAKLMKAYISMIVKKRYSTTRSASSQGSSR

SEQ ID NO: 31966 - protein, 940 aa, Homo sapiens
  ENSP00000251041
MEIDQCLLESLPLGQRQRLVKRMRCEQIKAYYEREKAFQKQEGFLKRLKHAKNPKVHFNLTDMLQDAIIHHNDKEVLRLLKEGADPHTLVSSGGSLLHLCARYDNAFIAEILIDRGVNVNHQDEDFWTPMHIACACDNPDIVLLLVLAGANVLLQDVNGNIPLDYAVEGTESSSILLTYLDENGVDLTSLRQMKLQRPMSMLTDVKHFLSSGGNVNEKNDEGVTLLHMACASGYKEVVSLILEHGGDLNIVDDQYWTPLHLAAKYGQTNLVKLLLMHQANPHLVNCNEEKASDIAASEFIEEMLLKAEIAWEEKMKEPLSASTLAQEEPYEEIIHDLPVLSSKLSPLVLPIAKQDSLLEKDIMFKDATKGLCKQQSQDSIPENPMMSGSTKPEQVKLMPPAPNDDLATLSELNDGSLLYEIQKRFGNNQIYTFIGDILLLVNPYKELPIYSSMVSQLYFSSSGKLCSSLPPHLFSCVERAFHQLFREQRPQCFILSGERGSGKSEASKQIIRHLTCRAGASRATLDSRFKHVVCILEAFGHAKTTLNDLSSCFIKYFELQFCERKQQLTGARIYTYLLEKSRLVSQPLGQSNFLIFYLLMDGLSAEEKYGLHLNNLCAHRYLNQTIQDDASTGERSLNREKLAVLKRALNVVGFSSLEVENLFVILAAILHLGDIRFTALNEGNSAFVSDLQLLEQVAGMLQVSTDELASALTTDIQYFKGDMIIRRHTIQIAEFFRDLLAKSLYSRLFSFLVNTMNSCLHSQDEQKSMQTLDIGILDIFGFEEFQKNEFEQLCVNMTNEKMHHYINEVLFLHEQVECVQEGVTMETAYSPGNQNGVLDFFFQKPSGFLTLLDEESQMIWSVESNFPKKLQSLLESSNTNAVYSPMKDGNGNVALKDHGTAFTIMHYAGRVMYDVVGAIEKNKDSLSQNLLFVMKRGRCF

SEQ ID NO: 31967 - protein, 1858 aa, Homo sapiens
  ENSP00000350160
MEIDQCLLESLPLGQRQRLVKRMRCEQIKAYYEREKAFQKQEGFLKRLKHAKNPKVHFNLTDMLQDAIIHHNDKEVLRLLKEGADPHTLVSSGGSLLHLCARYDNAFIAEILIDRGVNVNHQDEDFWTPMHIACACDNPDIVLLLVLAGANVLLQDVNGNIPLDYAVEGTESSSILLTYLDENGVDLTSLRQMKLQRPMSMLTDVKHFLSSGGNVNEKNDEGVTLLHMACASGYKEVVSLILEHGGDLNIVDDQYWTPLHLAAKYGQTNLVKLLLMHQANPHLVNCNEEKASDIAASEFIEEMLLKAEIAWEEKMKEPLSASTLAQEEPYEEIIHDLPVLSSKLSPLVLPIAKQDSLLEKDIMFKDATKGLCKQQSQDSIPENPMMSGSTKPEQVKLMPPAPNDDLATLSELNDGSLLYEIQKRFGNNQIYTFIGDILLLVNPYKELPIYSSMVSQLYFSSSGKLCSSLPPHLFSCVERAFHQLFREQRPQCFILSGERGSGKSEASKQIIRHLTCRAGASRATLDSRFKHVVCILEAFGHAKTTLNDLSSCFIKYFELQFCERKQQLTGARIYTYLLEKSRLVSQPLGQSNFLIFYLLMDGLSAEEKYGLHLNNLCAHRYLNQTIQDDASTGERSLNREKLAVLKRALNVVGFSSLEVENLFVILAAILHLGDIRFTALNEGNSAFVSDLQLLEQVAGMLQVSTDELASALTTDIQYFKGDMIIRRHTIQIAEFFRDLLAKSLYSRLFSFLVNTMNSCLHSQDEQKSMQTLDIGILDIFGFEEFQKNEFEQLCVNMTNEKMHHYINEVLFLHEQVECVQEGVTMETAYSPGNQNGVLDFFFQKPSGFLTLLDEESQMIWSVESNFPKKLQSLLESSNTNAVYSPMKDGNGNVALKDHGTAFTIMHYAGRVMYDVVGAIEKNKDSLSQNLLFVMKTSENVVINHLFQSKLSQTGSLVSAYPSFKFRGHKSALLSKKMTASSIIGENKNYLELSKLLKKKGTSTFLQRLERGDPVTIASQLRKSLMDIIGKLQKCTPHFIHCIRPNNSKLPDTFDNFYVSAQLQYIGVLEMVKIFRYGYPVRLSFSDFLSRYKPLADTFLREKKEQSAAERCRLVLQQCKLQGWQMGVRKVFLKYWHADQLNDLCLQLQRKIITCQKVIRGFLARQHLLQRISIRQQEVTSINSFLQNTEDMGLKTYDALVIQNASDIARENDRLRSEMNAPYHKEKLEVRNMQEEGSKRTDDKSGPRHFHPSSMSVCAAVDGLGQCLVGPSIWSPSLHSVFSMDDSSSLPSPRKQPPPKPKRDPNTRLSASYEAVSACLSAAREAANEALARPRPHSDDYSTMKKIPPRKPKRSPNTKLSGSYEEISGSRPGDARPAGAPGAAARVLTPGTPQCALPPAAPPGDEDDSEPVYIEMLGHAARPDSPDPGESVYEEMKCCLPDDGGPGAGSFLLHGASPPLLHRAPEDEAAGPPGDACDIPPPFPNLLPHRPPLLVFPPTPVTCSPASDESPLTPLEVKKLPVLETNLKYPVQPEGSSPLSPQYSKSQKGDGDRPASPGLALFNGSGRASPPSTPPPPPPPPGPPPAPYRPCAHLAFPPEPAPVNAGKAGPSAEAPKVHPKPNSAPVAGPCSSFPKIPYSPVKATRADARKAGSSASPPAPYSPPSSRPLSSPLDELASLFNSGRSVLRKSAAGRKIREAEGFETNMNISSRDDPSTSEITSETQDRNANNHGIQLSNSLSSAITAENGNSISNGLPEEDGYSRLSISGTGTSTFQRHRDSHTTQVIHQLRLSENESVALQELLDWRRKLCEEGQDWQQILHHAEPRVPPPPPCKKPSLLKKPEGASCNRLPSELWDTTI

SEQ ID NO: 31968 - protein, 1858 aa, Homo sapiens; identical to SEQ ID NO: 31967
  ENSP00000349145

SEQ ID NO: 31969 - protein, 1880 aa, Homo sapiens
  ENSP00000401633
MSHYHFIKCCCFQLCNVFRSHEMEIDQCLLESLPLGQRQRLVKRMRCEQIKAYYEREKAFQKQEGFLKRLKHAKNPKVHFNLTDMLQDAIIHHNDKEVLRLLKEGADPHTLVSSGGSLLHLCARYDNAFIAEILIDRGVNVNHQDEDFWTPMHIACACDNPDIVLLLVLAGANVLLQDVNGNIPLDYAVEGTESSSILLTYLDENGVDLTSLRQMKLQRPMSMLTDVKHFLSSGGNVNEKNDEGVTLLHMACASGYKEVVSLILEHGGDLNIVDDQYWTPLHLAAKYGQTNLVKLLLMHQANPHLVNCNEEKASDIAASEFIEEMLLKAEIAWEEKMKEPLSASTLAQEEPYEEIIHDLPVLSSKLSPLVLPIAKQDSLLEKDIMFKDATKGLCKQQSQDSIPENPMMSGSTKPEQVKLMPPAPNDDLATLSELNDGSLLYEIQKRFGNNQIYTFIGDILLLVNPYKELPIYSSMVSQLYFSSSGKLCSSLPPHLFSCVERAFHQLFREQRPQCFILSGERGSGKSEASKQIIRHLTCRAGASRATLDSRFKHVVCILEAFGHAKTTLNDLSSCFIKYFELQFCERKQQLTGARIYTYLLEKSRLVSQPLGQSNFLIFYLLMDGLSAEEKYGLHLNNLCAHRYLNQTIQDDASTGERSLNREKLAVLKRALNVVGFSSLEVENLFVILAAILHLGDIRFTALNEGNSAFVSDLQLLEQVAGMLQVSTDELASALTTDIQYFKGDMIIRRHTIQIAEFFRDLLAKSLYSRLFSFLVNTMNSCLHSQDEQKSMQTLDIGILDIFGFEEFQKNEFEQLCVNMTNEKMHHYINEVLFLHEQVECVQEGVTMETAYSPGNQNGVLDFFFQKPSGFLTLLDEESQMIWSVESNFPKKLQSLLESSNTNAVYSPMKDGNGNVALKDHGTAFTIMHYAGRVMYDVVGAIEKNKDSLSQNLLFVMKTSENVVINHLFQSKLSQTGSLVSAYPSFKFRGHKSALLSKKMTASSIIGENKNYLELSKLLKKKGTSTFLQRLERGDPVTIASQLRKSLMDIIGKLQKCTPHFIHCIRPNNSKLPDTFDNFYVSAQLQYIGVLEMVKIFRYGYPVRLSFSDFLSRYKPLADTFLREKKEQSAAERCRLVLQQCKLQGWQMGVRKVFLKYWHADQLNDLCLQLQRKIITCQKVIRGFLARQHLLQRISIRQQEVTSINSFLQNTEDMGLKTYDALVIQNASDIARENDRLRSEMNAPYHKEKLEVRNMQEEGSKRTDDKSGPRHFHPSSMSVCAAVDGLGQCLVGPSIWSPSLHSVFSMDDSSSLPSPRKQPPPKPKRDPNTRLSASYEAVSACLSAAREAANEALARPRPHSDDYSTMKKIPPRKPKRSPNTKLSGSYEEISGSRPGDARPAGAPGAAARVLTPGTPQCALPPAAPPGDEDDSEPVYIEMLGHAARPDSPDPGESVYEEMKCCLPDDGGPGAGSFLLHGASPPLLHRAPEDEAAGPPGDACDIPPPFPNLLPHRPPLLVFPPTPVTCSPASDESPLTPLEVKKLPVLETNLKYPVQPEGSSPLSPQYSKSQKGDGDRPASPGLALFNGSGRASPPSTPPPPPPPPGPPPAPYRPCAHLAFPPEPAPVNAGKAGPSAEAPKVHPKPNSAPVAGPCSSFPKIPYSPVKATRADARKAGSSASPPAPYSPPSSRPLSSPLDELASLFNSGRSVLRKSAAGRKIREAEGFETNMNISSRDDPSTSEITSETQDRNANNHGIQLSNSLSSAITAENGNSISNGLPEEDGYSRLSISGTGTSTFQRHRDSHTTQVIHQLRLSENESVALQELLDWRRKLCEEGQDWQQILHHAEPRVPPPPPCKKPSLLKKPEGASCNRLPSELWDTTI

SEQ ID NO: 31970 - protein, 1858 aa, Homo sapiens; identical to SEQ ID NO: 31967
  ENSP00000489329

SEQ ID NO: 31971 - protein, 1880 aa, Homo sapiens; identical to SEQ ID NO: 31969
  ENSP00000488923

SEQ ID NO: 31972 - protein, 940 aa, Homo sapiens; identical to SEQ ID NO: 31966
  ENSP00000489279

SEQ ID NO: 31973 - protein, 1858 aa, Homo sapiens; identical to SEQ ID NO: 31967
  ENSP00000488918

SEQ ID NO: 31974 - protein, 1006 aa, Homo sapiens
  ENSP00000324527
MAEQESLEFGKADFVLMDTVSMPEFMANLRLRFEKGRIYTFIGEVVVSVNPYKLLNIYGRDTIEQYKGRELYERPPHLFAIADAAYKAMKRRSKDTCIVISGESGAGKTEASKYIMQYIAAITNPSQRAEVERVKNMLLKSNCVLEAFGNAKTNRNDNSSRFGKYMDINFDFKGDPIGGHINNYLLEKSRVIVQQPGERSFHSFYQLLQGGSEQMLRSLHLQKSLSSYNYIHVGAQLKSSINDAAEFRVVADAMKVIGFKPEEIQTVYKILAAILHLGNLKFVVDGDTPLIENGKVVSIIAELLSTKTDMVEKALLYRTVATGRDIIDKQHTEQEASYGRDAFAKAIYERLFCWIVTRINDIIEVKNYDTTIHGKNTVIGVLDIYGFEIFDNNSFEQFCINYCNEKLQQLFIQLVLKQEQEEYQREGIPWKHIDYFNNQIIVDLVEQQHKGIIAILDDACMNVGKVTDEMFLEALNSKLGKHAHFSSRKLCASDKILEFDRDFRIRHYAGDVVYSVIGFIDKNKDTLFQDFKRLMYNSSNPVLKNMWPEGKLSITEVTKRPLTAATLFKNSMIALVDNLASKEPYYVRCIKPNDKKSPQIFDDERCRHQVEYLGLLENVRVRRAGFAFRQTYEKFLHRYKMISEFTWPNHDLPSDKEAVKKLIERCGFQDDVAYGKTKIFIRTPRTLFTLEELRAQMLIRIVLFLQKVWRGTLARMRYKRTKAALTIIRYYRRYKVKSYIHEVARRFHGVKTMRDYGKHVKWPSPPKVLRRFEEALQTIFNRWRASQLIKSIPASDLPQVRAKVAAVEMLKGQRADLGLQRAWEGNYLASKPDTPQTSGTFVPVANELKRKDKYMNVLFSCHVRKVNRFSKVEDRAIFVTDRHLYKMDPTKQYKVMKTIPLYNLTGLSVSNGKDQLVVFHTKDNKDLIVCLFSKQPTHESRIGELVGVLVNHFKSEKRHLQVNVTNPVQCSLHGKKCTVSVETRLNQPQPDFTKNRSGFILSVPGN

SEQ ID NO: 31975 - protein, 918 aa, Homo sapiens
  ENSP00000464741
MKRRSKDTCIVISGESGAGKTEASKYIMQYIAAITNPSQRAEVERVKNMLLKSNCVLEAFGNAKTNRNDNSSRFGKYMDINFDFKGDPIGGHINNYLLEKSRVIVQQPGERSFHSFYQLLQGGSEQMLRSLHLQKSLSSYNYIHVGAQLKSSINDAAEFRVVADAMKVIGFKPEEIQTVYKILAAILHLGNLKFVVDGDTPLIENGKVVSIIAELLSTKTDMVEKALLYRTVATGRDIIDKQHTEQEASYGRDAFAKAIYERLFCWIVTRINDIIEVKNYDTTIHGKNTVIGVLDIYGFEIFDNNSFEQFCINYCNEKLQQLFIQLVLKQEQEEYQREGIPWKHIDYFNNQIIVDLVEQQHKGIIAILDDACMNVGKVTDEMFLEALNSKLGKHAHFSSRKLCASDKILEFDRDFRIRHYAGDVVYSVIGFIDKNKDTLFQDFKRLMYNSSNPVLKNMWPEGKLSITEVTKRPLTAATLFKNSMIALVDNLASKEPYYVRCIKPNDKKSPQIFDDERCRHQVEYLGLLENVRVRRAGFAFRQTYEKFLHRYKMISEFTWPNHDLPSDKEAVKKLIERCGFQDDVAYGKTKIFIRTPRTLFTLEELRAQMLIRIVLFLQKVWRGTLARMRYKRTKAALTIIRYYRRYKVKSYIHEVARRFHGVKTMRDYGKHVKWPSPPKVLRRFEEALQTIFNRWRASQLIKSIPASDLPQVRAKVAAVEMLKGQRADLGLQRAWEGNYLASKPDTPQTSGTFVPVANELKRKDKYMNVLFSCHVRKVNRFSKVEDRAIFVTDRHLYKMDPTKQYKVMKTIPLYNLTGLSVSNGKDQLVVFHTKDNKDLIVCLFSKQPTHESRIGELVGVLVNHFKSEKRHLQVNVTNPVQCSLHGKKCTVSVETRLNQPQPDFTKNRSGFILSVPGN

SEQ ID NO: 31976 - protein, 961 aa, Homo sapiens
  ENSP00000464305
MAEQESLEFGKADFVLMDTVSMPEFMANLRLRFEKGRIYTFIGEVVVSVNPYKLLNIYGRDTIEQYKGRELYERPPHLFAIADAAYKAMKRRSKDTCIVISGESGAGKTEASKYIMQYIAAITNPSQRAEVERVKNMLLKSNCVLEAFGNAKTNRNDNSSRFGKYMDINFDFKGDPIGGHINNYLLEKSRVIVQQPGERSFHSFYQLLQGGSEQMLRSLHLQKSLSSYNYIHVGAQLKSSINDAAEFRVVADAMKVIGFKPEEIQTVYKILAAILHLGNLKFVVDGDTPLIENGKVVSIIAELLSTKTDMVEKALLYRTVATGRDIIDKQHTEQEASYGRDAFAKAIYERLFCWIVTRINDIIEVKNYDTTIHGKNTVIGVLDIYGFEIFDNNSFEQFCINYCNEKLQQLFIQLVLKQEQEEYQREGIPWKHIDYFNNQIIVDLVEQQHKGIIAILDDACMNVGKVTDEMFLEALNSKLGKHAHFSSRKLCASDKILEFDRDFRIRHYAGDVVYSVIGFIDKNKDTLFQDFKRLMYNSSNPVLKNMWPEGKLSITEVTKRPLTAATLFKNSMIALVDNLASKEPYYVRCIKPNDKKSPQIFDDERCRHQVEYLGLLENVRVRRAGFAFRQTYEKFLHRYKMISEFTWPNHDLPSDKEAVKKLIERCGFQDDVAYGKTKIFIRTPRTLFTLEELRAQMLIRIVLFLQKVWRGTLARMRYKRTKAALTIIRYYRRYKVKSYIHEVARRFHGVKTMRDYGKHVKWPSPPKVLRRFEEALQTIFNRWRASQLIKSIPASDLPQVRAKVAAVEMLKGQRADLGLQRAWEGNYLASKPDTPQTSGTFVPVANELKRKDKYMNVLFSCHVRKVNRFSKVEDRAIFVTDRHLYKMDPTKQYKVMKTIPLYNLTGLSVSNGKDQLVVFHTKDNKDLIVCLFSKQPTHESRIGELVGVLVNHFKRNHLLIL

SEQ ID NO: 31977 - protein, 44 aa, Homo sapiens
  ENSP00000464346
KHAHFSSRKLCASDKILEFDRDFRIRHYAGDVVSSWNLLSYPQH

SEQ ID NO: 31978 - protein, 436 aa, Homo sapiens
  ENSP00000462055
MAEQESLEFGKADFVLMDTVSMPEFMANLRLRFEKGRIYTFIGEVVVSVNPYKLLNIYGRDTIEQYKGRELYERPPHLFAIADAAYKAMKRRSKDTCIVISGESGAGKTEASKYIMQYIAAITNPSQRAEVERVKNMLLKSNCVLEAFGNAKTNRNDNSSRFGKYMDINFDFKGDPIGGHINNYLLEKSRVIVQQPGERSFHSFYQLLQGGSEQMLRSLHLQKSLSSYNYIHVGAQLKSSINDAAEFRVVADAMKVIGFKPEEIQTVYKILAAILHLGNLKFVVDGDTPLIENGKVVSIIAELLSTKTDMVEKALLYRTVATGRDIIDKQHTEQEASYGRDAFAKAIYERLFCWIVTRINDIIEVKNYDTTIHGKNTVIGVLDIYGFEIFDNNSFEQFCINYCNEKLQQLFIQLVLKQEQEEYQREGIPWKHVGLL

SEQ ID NO: 31979 - protein, 2215 aa, Homo sapiens
  ENSP00000386331
MVILQQGDHVWMDLRLGQEFDVPIGAVVKLCDSGQVQVVDDEDNEHWISPQNATHIKPMHPTSVHGVEDMIRLGDLNEAGILRNLLIRYRDHLIYTYTGSILVAVNPYQLLSIYSPEHIRQYTNKKIGEMPPHIFAIADNCYFNMKRNSRDQCCIISGESGAGKTESTKLILQFLAAISGQHSWIEQQVLEATPILEAFGNAKTIRNDNSSRFGKYIDIHFNKRGAIEGAKIEQYLLEKSRVCRQALDERNYHVFYCMLEGMSEDQKKKLGLGQASDYNYLAMGNCITCEGRVDSQEYANIRSAMKVLMFTDTENWEISKLLAAILHLGNLQYEARTFENLDACEVLFSPSLATAASLLEVNPPDLMSCLTSRTLITRGETVSTPLSREQALDVRDAFVKGIYGRLFVWIVDKINAAIYKPPSQDVKNSRRSIGLLDIFGFENFAVNSFEQLCINFANEHLQQFFVRHVFKLEQEEYDLESIDWLHIEFTDNQDALDMIANKPMNIISLIDEESKFPKGTDTTMLHKLNSQHKLNANYIPPKNNHETQFGINHFAGIVYYETQGFLEKNRDTLHGDIIQLVHSSRNKFIKQIFQADVAMGAETRKRSPTLSSQFKRSLELLMRTLGACQPFFVRCIKPNEFKKPMLFDRHLCVRQLRYSGMMETIRIRRAGYPIRYSFVEFVERYRVLLPGVKPAYKQGDLRGTCQRMAEAVLGTHDDWQIGKTKIFLKDHHDMLLEVERDKAITDRVILLQKVIRGFKDRSNFLKLKNAATLIQRHWRGHNCRKNYGLMRLGFLRLQALHRSRKLHQQYRLARQRIIQFQARCRAYLVRKAFRHRLWAVLTVQAYARGMIARRLHQRLRAEYLWRLEAEKMRLAEEEKLRKEMSAKKAKEEAERKHQERLAQLAREDAERELKEKEAARRKKELLEQMERARHEPVNHSDMVDKMFGFLGTSGGLPGQEGQAPSGFEDLERGRREMVEEDLDAALPLPDEDEEDLSEYKFAKFAATYFQGTTTHSYTRRPLKQPLLYHDDEGDQLAALAVWITILRFMGDLPEPKYHTAMSDGSEKIPVMTKIYETLGKKTYKRELQALQGEGEAQLPEGQKKSSVRHKLVHLTLKKKSKLTEEVTKRLHDGESTVQGNSMLEDRPTSNLEKLHFIIGNGILRPALRDEIYCQISKQLTHNPSKSSYARGWILVSLCVGCFAPSEKFVKYLRNFIHGGPPGYAPYCEERLRRTFVNGTRTQPPSWLELQATKSKKPIMLPVTFMDGTTKTLLTDSATTAKELCNALADKISLKDRFGFSLYIALFDKVSSLGSGSDHVMDAISQCEQYAKEQGAQERNAPWRLFFRKEVFTPWHSPSEDNVATNLIYQQVVRGVKFGEYRCEKEDDLAELASQQYFVDYGSEMILERLLNLVPTYIPDREITPLKTLEKWAQLAIAAHKKGIYAQRRTDAQKVKEDVVSYARFKWPLLFSRFYEAYKFSGPSLPKNDVIVAVNWTGVYFVDEQEQVLLELSFPEIMAVSSSRECRVWLSLGCSDLGCAAPHSGWAGLTPAGPCSPCWSCRGAKTTAPSFTLATIKGDEYTFTSSNAEDIRDLVVTFLEGLRKRSKYVVALQDNPNPAGEESGFLSFAKGDLIILDHDTGEQVMNSGWANGINERTKQRGDFPTDSVYVMPTVTMPPREIVALVTMTPDQRQDVVRLLQLRTAEPEVRAKPYTLEEFSYDYFRPPPKHTLSRVMVSKARGKDRLWSHTREPLKQALLKKLLGSEELSQEACLAFIAVLKYMGDYPSKRTRSVNELTDQIFEGPLKAEPLKDEAYVQILKQLTDNHIRYSEERGWELLWLCTGLFPPSNILLPHVQRFLQSRKHCPLAIDCLQRLQKALRNGSRKYPPHLVEVEAIQHKTTQIFHKVYFPDDTDEAFEVESSTKAKDFCQNIATRLLLKSSEGFSLFVKIADKVLSVPENDFFFDFVRHLTDWIKKARPIKDGIVPSLTYQVFFMKKLWTTTVPGKDPMADSIFHYYQELPKYLRGYHKCTREEVLQLGALIYRVKFEEDKSYFPSIPKLLRELVPQDLIRQVSPDDWKRSIVAYFNKHAGKSKEEAKLAFLKLIFKWPTFGSAFFEVKQTTEPNFPEILLIAINKYGVSLIDPKTKDILTTHPFTKISNWSSGNTYFHITIGNLVRGSKLLCETSLGYKMDDLLTSYISQMLTAMSKQRGSRSGK

SEQ ID NO: 31980 - protein, 1178 aa, Homo sapiens
  ENSP00000386689
MVILQQGDHVWMDLRLGQEFDVPIGAVVKLCDSGQVQVVDDEDNEHWISPQNATHIKPMHPTSVHGVEDMIRLGDLNEAGILRNLLIRYRDHLIYTYTGSILVAVNPYQLLSIYSPEHIRQYTNKKIGEMPPHIFAIADNCYFNMKRNSRDQCCIISGESGAGKTESTKLILQFLAAISGQHSWIEQQVLEATPILEAFGNAKTIRNDNSSRFGKYIDIHFNKRGAIEGAKIEQYLLEKSRVCRQALDERNYHVFYCMLEGMSEDQKKKLGLGQASDYNYLAMGNCITCEGRVDSQEYANIRSAMKVLMFTDTENWEISKLLAAILHLGNLQYEARTFENLDACEVLFSPSLATAASLLEVNPPDLMSCLTSRTLITRGETVSTPLSREQALDVRDAFVKGIYGRLFVWIVDKINAAIYKPPSQDVKNSRRSIGLLDIFGFENFAVNSFEQLCINFANEHLQQFFVRHVFKLEQEEYDLESIDWLHIEFTDNQDALDMIANKPMNIISLIDEESKFPKGTDTTMLHKLNSQHKLNANYIPPKNNHETQFGINHFAGIVYYETQGFLEKNRDTLHGDIIQLVHSSRNKFIKQIFQADVAMGAETRKRSPTLSSQFKRSLELLMRTLGACQPFFVRCIKPNEFKKPMLFDRHLCVRQLRYSGMMETIRIRRAGYPIRYSFVEFVERYRVLLPGVKPAYKQGDLRGTCQRMAEAVLGTHDDWQIGKTKIFLKDHHDMLLEVERDKAITDRVILLQKVIRGFKDRSNFLKLKNAATLIQRHWRGHNCRKNYGLMRLGFLRLQALHRSRKLHQQYRLARQRIIQFQARCRAYLVRKAFRHRLWAVLTVQAYARGMIARRLHQRLRAEYLWRLEAEKMRLAEEEKLRKEMSAKKAKEEAERKHQERLAQLAREDAERELKEKEAARRKKELLEQMERARHEPVNHSDMVDKMFGFLGTSGGLPGQEGQAPSGFEDLERGRREMVEEDLDAALPLPDEDEEDLSEYKFAKFAATYFQGTTTHSYTRRPLKQPLLYHDDEGDQLAALAVWITILRFMGDLPEPKYHTAMSDGSEKIPVMTKIYETLGKKTYKRELQALQGEGEAQLPEGQKKSSVRHKLVHLTLKKKSKLTEEVTKRLHDGESTVQGNSMLEDRPTSNLEKLHFIIGNGILRPALRSVPGGGDTRA

SEQ ID NO: 31981 - protein, 2175 aa, Homo sapiens
  ENSP00000392185
MVILQQGDHVWMDLRLGQEFDVPIGAVVKLCDSGQVQVVDDEDNEHWISPQNATHIKPMHPTSVHGVEDMIRLGDLNEAGILRNLLIRYRDHLIYTYTGSILVAVNPYQLLSIYSPEHIRQYTNKKIGEMPPHIFAIADNCYFNMKRNSRDQCCIISGESGAGKTESTKLILQFLAAISGQHSWIEQQVLEATPILEAFGNAKTIRNDNSSRFGKYIDIHFNKRGAIEGAKIEQYLLEKSRVCRQALDERNYHVFYCMLEGMSEDQKKKLGLGQASDYNYLAMGNCITCEGRVDSQEYANIRSAMKVLMFTDTENWEISKLLAAILHLGNLQYEARTFENLDACEVLFSPSLATAASLLEVNPPDLMSCLTSRTLITRGETVSTPLSREQALDVRDAFVKGIYGRLFVWIVDKINAAIYKPPSQDVKNSRRSIGLLDIFGFENFAVNSFEQLCINFANEHLQQFFVRHVFKLEQEEYDLESIDWLHIEFTDNQDALDMIANKPMNIISLIDEESKFPKGTDTTMLHKLNSQHKLNANYIPPKNNHETQFGINHFAGIVYYETQGFLEKNRDTLHGDIIQLVHSSRNKFIKQIFQADVAMGAETRKRSPTLSSQFKRSLELLMRTLGACQPFFVRCIKPNEFKKPMLFDRHLCVRQLRYSGMMETIRIRRAGYPIRYSFVEFVERYRVLLPGVKPAYKQGDLRGTCQRMAEAVLGTHDDWQIGKTKIFLKDHHDMLLEVERDKAITDRVILLQKVIRGFKDRSNFLKLKNAATLIQRHWRGHNCRKNYGLMRLGFLRLQALHRSRKLHQQYRLARQRIIQFQARCRAYLVRKAFRHRLWAVLTVQAYARGMIARRLHQRLRAEYLWRLEAEKMRLAEEEKLRKEMSAKKAKEEAERKHQERLAQLAREDAERELKEKEAARRKKELLEQMERARHEPVNHSDMVDKMFGFLGTSGGLPGQEGQAPSGFEDLERGRREMVEEDLDAALPLPDEDEEDLSEYKFAKFAATYFQGTTTHSYTRRPLKQPLLYHDDEGDQLAALAVWITILRFMGDLPEPKYHTAMSDGSEKIPVMTKIYETLGKKTYKRELQALQGEGEAQLPEGQKKSSVRHKLVHLTLKKKSKLTEEVTKRLHDGESTVQGNSMLEDRPTSNLEKLHFIIGNGILRPALRDEIYCQISKQLTHNPSKSSYARGWILVSLCVGCFAPSEKFVKYLRNFIHGGPPGYAPYCEERLRRTFVNGTRTQPPSWLELQATKSKKPIMLPVTFMDGTTKTLLTDSATTAKELCNALADKISLKDRFGFSLYIALFDKVSSLGSGSDHVMDAISQCEQYAKEQGAQERNAPWRLFFRKEVFTPWHSPSEDNVATNLIYQQVVRGVKFGEYRCEKEDDLAELASQQYFVDYGSEMILERLLNLVPTYIPDREITPLKTLEKWAQLAIAAHKKGIYAQRRTDAQKVKEDVVSYARFKWPLLFSRFYEAYKFSGPSLPKNDVIVAVNWTGVYFVDEQEQVLLELSFPEIMAVSSSRGAKTTAPSFTLATIKGDEYTFTSSNAEDIRDLVVTFLEGLRKRSKYVVALQDNPNPAGEESGFLSFAKGDLIILDHDTGEQVMNSGWANGINERTKQRGDFPTDSVYVMPTVTMPPREIVALVTMTPDQRQDVVRLLQLRTAEPEVRAKPYTLEEFSYDYFRPPPKHTLSRVMVSKARGKDRLWSHTREPLKQALLKKLLGSEELSQEACLAFIAVLKYMGDYPSKRTRSVNELTDQIFEGPLKAEPLKDEAYVQILKQLTDNHIRYSEERGWELLWLCTGLFPPSNILLPHVQRFLQSRKHCPLAIDCLQRLQKALRNGSRKYPPHLVEVEAIQHKTTQIFHKVYFPDDTDEAFEVESSTKAKDFCQNIATRLLLKSSEGFSLFVKIADKVLSVPENDFFFDFVRHLTDWIKKARPIKDGIVPSLTYQVFFMKKLWTTTVPGKDPMADSIFHYYQELPKYLRGYHKCTREEVLQLGALIYRVKFEEDKSYFPSIPKLLRELVPQDLIRQVSPDDWKRSIVAYFNKHAGKSKEEAKLAFLKLIFKWPTFGSAFFEQTTEPNFPEILLIAINKYGVSLIDPKTKDILTTHPFTKISNWSSGNTYFHITIGNLVRGSKLLCETSLGYKMDDLLTSYISQMLTAMSKQRGSRSGK

SEQ ID NO: 31982 - protein, 2166 aa, Homo sapiens
  ENSP00000386635
MDLRLGQEFDVPIGAVVKLCDSGQVQVVDDEDNEHWISPQNATHIKPMHPTSVHGVEDMIRLGDLNEAGILRNLLIRYRDHLIYTYTGSILVAVNPYQLLSIYSPEHIRQYTNKKIGEMPPHIFAIADNCYFNMKRNSRDQCCIISGESGAGKTESTKLILQFLAAISGQHSWIEQQVLEATPILEAFGNAKTIRNDNSSRFGKYIDIHFNKRGAIEGAKIEQYLLEKSRVCRQALDERNYHVFYCMLEGMSEDQKKKLGLGQASDYNYLAMGNCITCEGRVDSQEYANIRSAMKVLMFTDTENWEISKLLAAILHLGNLQYEARTFENLDACEVLFSPSLATAASLLEVNPPDLMSCLTSRTLITRGETVSTPLSREQALDVRDAFVKGIYGRLFVWIVDKINAAIYKPPSQDVKNSRRSIGLLDIFGFENFAVNSFEQLCINFANEHLQQFFVRHVFKLEQEEYDLESIDWLHIEFTDNQDALDMIANKPMNIISLIDEESKFPKGTDTTMLHKLNSQHKLNANYIPPKNNHETQFGINHFAGIVYYETQGFLEKNRDTLHGDIIQLVHSSRNKFIKQIFQADVAMGAETRKRSPTLSSQFKRSLELLMRTLGACQPFFVRCIKPNEFKKPMLFDRHLCVRQLRYSGMMETIRIRRAGYPIRYSFVEFVERYRVLLPGVKPAYKQGDLRGTCQRMAEAVLGTHDDWQIGKTKIFLKDHHDMLLEVERDKAITDRVILLQKVIRGFKDRSNFLKLKNAATLIQRHWRGHNCRKNYGLMRLGFLRLQALHRSRKLHQQYRLARQRIIQFQARCRAYLVRKAFRHRLWAVLTVQAYARGMIARRLHQRLRAEYLWRLEAEKMRLAEEEKLRKEMSAKKAKEEAERKHQERLAQLAREDAERELKEKEAARRKKELLEQMERARHEPVNHSDMVDKMFGFLGTSGGLPGQEGQAPSGFEDLERGRREMVEEDLDAALPLPDEDEEDLSEYKFAKFAATYFQGTTTHSYTRRPLKQPLLYHDDEGDQLAALAVWITILRFMGDLPEPKYHTAMSDGSEKIPVMTKIYETLGKKTYKRELQALQGEGEAQLPEGQKKSSVRHKLVHLTLKKKSKLTEEVTKRLHDGESTVQGNSMLEDRPTSNLEKLHFIIGNGILRPALRDEIYCQISKQLTHNPSKSSYARGWILVSLCVGCFAPSEKFVKYLRNFIHGGPPGYAPYCEERLRRTFVNGTRTQPPSWLELQATKSKKPIMLPVTFMDGTTKTLLTDSATTAKELCNALADKISLKDRFGFSLYIALFDKVSSLGSGSDHVMDAISQCEQYAKEQGAQERNAPWRLFFRKEVFTPWHSPSEDNVATNLIYQQVVRGVKFGEYRCEKEDDLAELASQQYFVDYGSEMILERLLNLVPTYIPDREITPLKTLEKWAQLAIAAHKKGIYAQRRTDAQKVKEDVVSYARFKWPLLFSRFYEAYKFSGPSLPKNDVIVAVNWTGVYFVDEQEQVLLELSFPEIMAVSSSRGAKTTAPSFTLATIKGDEYTFTSSNAEDIRDLVVTFLEGLRKRSKYVVALQDNPNPAGEESGFLSFAKGDLIILDHDTGEQVMNSGWANGINERTKQRGDFPTDSVYVMPTVTMPPREIVALVTMTPDQRQDVVRLLQLRTAEPEVRAKPYTLEEFSYDYFRPPPKHTLSRVMVSKARGKDRLWSHTREPLKQALLKKLLGSEELSQEACLAFIAVLKYMGDYPSKRTRSVNELTDQIFEGPLKAEPLKDEAYVQILKQLTDNHIRYSEERGWELLWLCTGLFPPSNILLPHVQRFLQSRKHCPLAIDCLQRLQKALRNGSRKYPPHLVEVEAIQHKTTQIFHKVYFPDDTDEAFEVESSTKAKDFCQNIATRLLLKSSEGFSLFVKIADKVLSVPENDFFFDFVRHLTDWIKKARPIKDGIVPSLTYQVFFMKKLWTTTVPGKDPMADSIFHYYQELPKYLRGYHKCTREEVLQLGALIYRVKFEEDKSYFPSIPKLLRELVPQDLIRQVSPDDWKRSIVAYFNKHAGKSKEEAKLAFLKLIFKWPTFGSAFFEVKQTTEPNFPEILLIAINKYGVSLIDPKTKDILTTHPFTKISNWSSGNTYFHITIGNLVRGSKLLCETSLGYKMDDLLTSYISQMLTAMSKQRGSRSGK

SEQ ID NO: 31983 - protein, 1357 aa, Homo sapiens
  ENSP00000417017
FQARCRAYLVRKAFRHRLWAVLTVQAYARGMIARRLHQRLRAEYLWRLEAEKMRLAEEEKLRKEMSAKKAKEEAERKHQERLAQLAREDAERELKEKEAARRKKELLEQMERARHEPVNHSDMVDKMFGFLGTSGGLPGQEGQAPSGFEDLERGRREMVEEDLDAALPLPDEDEEDLSEYKFAKFAATYFQGTTTHSYTRRPLKQPLLYHDDEGDQLAALAVWITILRFMGDLPEPKYHTAMSDGSEKIPVMTKIYETLGKKTYKRELQALQGEGEAQLPEGQKKSSVRHKLVHLTLKKKSKLTEEVTKRLHDGESTVQGNSMLEDRPTSNLEKLHFIIGNGILRPALRDEIYCQISKQLTHNPSKSSYARGWILVSLCVGCFAPSEKFVKYLRNFIHGGPPGYAPYCEERLRRTFVNGTRTQPPSWLELQATKSKKPIMLPVTFMDGTTKTLLTDSATTAKELCNALADKISLKDRFGFSLYIALFDKVSSLGSGSDHVMDAISQCEQYAKEQGAQERNAPWRLFFRKEVFTPWHSPSEDNVATNLIYQQVVRGVKFGEYRCEKEDDLAELASQQYFVDYGSEMILERLLNLVPTYIPDREITPLKTLEKWAQLAIAAHKKGIYAQRRTDAQKVKEDVVSYARFKWPLLFSRFYEAYKFSGPSLPKNDVIVAVNWTGVYFVDEQEQVLLELSFPEIMAVSSSRGAKTTAPSFTLATIKGDEYTFTSSNAEDIRDLVVTFLEGLRKRSKYVVALQDNPNPGEESGFLSFAKGDLIILDHDTGEQVMNSGWANGINERTKQRGDFPTDSVYVMPTVTMPPREIVALVTMTPDQRQDVVRLLQLRTAEPEVRAKPYTLEEFSYDYFRPPPKHTLSRVMVSKARGKDRLWSHTREPLKQALLKKLLGSEELSQEACLAFIAVLKYMGDYPSKRTRSVNELTDQIFEGPLKAEPLKDEAYVQILKQLTDNHIRYSEERGWELLWLCTGLFPPSNILLPHVQRFLQSRKHCPLAIDCLQRLQKALRNGSRKYPPHLVEVEAIQHKTTQIFHKVYFPDDTDEAFEVESSTKAKDFCQNIATRLLLKSSEGFSLFVKIADKVLSVPENDFFFDFVRHLTDWIKKARPIKDGIVPSLTYQVFFMKKLWTTTVPGKDPMADSIFHYYQELPKYLRGYHKCTREEVLQLGALIYRVKFEEDKSYFPSIPKLLRELVPQDLIRQVSPDDWKRSIVAYFNKHAGKSKEEAKLAFLKLIFKWPTFGSAFFEVKQTTEPNFPEILLIAINKYGVSLIDPKTKDILTTHPFTKISNWSSGNTYFHITIGNLVRGSKLLCETSLGYKMDDLLTSYISQMLTAMSKQRGSRSGK

SEQ ID NO: 31984 - protein, 1198 aa, Homo sapiens
  ENSP00000477640
MVILQQGDHVWMDLRLGQEFDVPIGAVVKLCDSGQVQVVDDEDNEHWISPQNATHIKPMHPTSVHGVEDMIRLGDLNEAGILRNLLIRYRDHLIYTYTGSILVAVNPYQLLSIYSPEHIRQYTNKKIGEMPPHIFAIADNCYFNMKRNSRDQCCIISGESGAGKTESTKLILQFLAAISGQHSWIEQQVLEATPILEAFGNAKTIRNDNSSRFGKYIDIHFNKRGAIEGAKIEQYLLEKSRVCRQALDERNYHVFYCMLEGMSEDQKKKLGLGQASDYNYLAMGNCITCEGRVDSQEYANIRSAMKVLMFTDTENWEISKLLAAILHLGNLQYEARTFENLDACEVLFSPSLATAASLLEVNPPDLMSCLTSRTLITRGETVSTPLSREQALDVRDAFVKGIYGRLFVWIVDKINAAIYKPPSQDVKNSRRSIGLLDIFGFENFAVNSFEQLCINFANEHLQQFFVRHVFKLEQEEYDLESIDWLHIEFTDNQDALDMIANKPMNIISLIDEESKFPKGTDTTMLHKLNSQHKLNANYIPPKNNHETQFGINHFAGIVYYETQGFLEKNRDTLHGDIIQLVHSSRNKFIKQIFQADVAMGAETRKRSPTLSSQFKRSLELLMRTLGACQPFFVRCIKPNEFKKPMLFDRHLCVRQLRYSGMMETIRIRRAGYPIRYSFVEFVERYRVLLPGVKPAYKQGDLRGTCQRMAEAVLGTHDDWQIGKTKIFLKDHHDMLLEVERDKAITDRVILLQKVIRGFKDRSNFLKLKNAATLIQRHWRGHNCRKNYGLMRLGFLRLQALHRSRKLHQQYRLARQRIIQFQARCRAYLVRKAFRHRLWAVLTVQAYARGMIARRLHQRLRAEYLWRLEAEKMRLAEEEKLRKEMSAKKAKEEAERKHQERLAQLAREDAERELKEKEAARRKKELLEQMERARHEPVNHSDMVDKMFGFLGTSGGLPGQEGQAPSGFEDLERGRREMVEEDLDAALPLPDEDEEDLSEYKFAKFAATYFQGTTTHSYTRRPLKQPLLYHDDEGDQLAALAVWITILRFMGDLPEPKYHTAMSDGSEKIPVMTKIYETLGKKTYKRELQALQGEGEVLQAQLPEGQKKSSVRHKLVHLTLKKKSKLTEEVTKRLHDGESTVQGNSMLEDRPTSNLEKLHFIIGNGILRTPGPESLLVAEWCLCQPSKRLSRPGFGFAAS

SEQ ID NO: 31985 - protein, 498 aa, Homo sapiens
  ENSP00000239926
MFNYERPKHFIQSQNPCGSRLQPPGPETSSFSSQTKQSSIIIQPRQCTEQRFSASSTLSSHITMSSSAFPASPQQHAGSNPGQRVTTTYNQSPASFLSSILPSQPDYNSSKIPSAMDSNYQQSSAGQPINAKPSQTANAKPIPRTPDHEIQGSKEALIQDLERKLKCKDTLLHNGNQRLTYEEKMARRLLGPQNAAAVFQAQDDSGAQDSQQHNSEHARLQVPTSQVRSRSTSRGDVNDQDAIQEKFYPPRFIQVPENMSIDEGRFCRMDFKVSGLPAPDVSWYLNGRTVQSDDLHKMIVSEKGLHSLIFEVVRASDAGAYACVAKNRAGEATFTVQLDVLAKEHKRAPMFIYKPQSKKVLEGDSVKLECQISAIPPPKLFWKRNNEMVQFNTDRISLYQDNTGRVTLLIKDVNKKDAGWYTVSAVNEAGVTTCNTRLDVTARPNQTLPAPKQLRVRPTFSKYLALNGKGLNVKQAFNPEGEFQRLAAQSGLYESEEL

SEQ ID NO: 31986 - protein, 314 aa, Homo sapiens
  ENSP00000391185
MARRLLGPQNAAAVFQAQDDSGAQDSQQHNSEHARLQVPTSQVRSRSTSRGDVNDQDAIQEKFYPPRFIQVPENMSIDEGRFCRMDFKVSGLPAPDVSWYLNGRTVQSDDLHKMIVSEKGLHSLIFEVVRASDAGAYACVAKNRAGEATFTVQLDVLAKEHKRAPMFIYKPQSKKVLEGDSVKLECQISAIPPPKLFWKRNNEMVQFNTDRISLYQDNTGRVTLLIKDVNKKDAGWYTVSAVNEAGVTTCNTRLDVTARPNQTLPAPKQLRVRPTFSKYLALNGKGLNVKQAFNPEGEFQRLAAQSGLYESEEL

SEQ ID NO: 31987 - protein, 383 aa, Homo sapiens
  ENSP00000426281
MDSNYQQSSAGQPINAKPSQTANAKPIPRTPDHEIQGSKEALIQDLERKLKCKDTLLHNGNQRLTYEEKMARRLLGPQNAAAVFQAQDDSGAQDSQQHNSEHARLQVPTSQVRSRSTSRGDVNDQDAIQEKFYPPRFIQVPENMSIDEGRFCRMDFKVSGLPAPDVSWYLNGRTVQSDDLHKMIVSEKGLHSLIFEVVRASDAGAYACVAKNRAGEATFTVQLDVLAKEHKRAPMFIYKPQSKKVLEGDSVKLECQISAIPPPKLFWKRNNEMVQFNTDRISLYQDNTGRVTLLIKDVNKKDAGWYTVSAVNEAGVTTCNTRLDVTARPNQTLPAPKQLRVRPTFSKYLALNGKGLNVKQAFNPEGEFQRLAAQSGLYESEEL

SEQ ID NO: 31988 - protein, 1151 aa, Homo sapiens
  ENSP00000278836
MEVVDETEALQRFFEGHDINGALEPSNIDTSILEEYISKEDASDLCFPDISAPASSASYSHGQPAMPGSSGVHHLSPPGGGPSPGRHGPLPPPGYGTPLNCNNNNGMGAAPKPFPGGTGPPIKAEPKAPYAPGTLPDSPPDSGSEAYSPQQVNEPHLLRTITPETLCHVGVPSRLEHPPPPPAHLPGPPPPPPPPPHYPVLQRDLYMKAEPPIPHYAAMGQGLVPTDLHHTQQSQMLHQLLQQHGAELPTHPSKKRKHSESPPSTLNAQMLNGMIKQEPGTVTALPLHPTRAPSPPWPPQGPLSPGPGSLPLSIARVQTPPWHPPGAPSPGLLQDSDSLSGSYLDPNYQSIKWQPHQQNKWATLYDANYKELPMLTYRVDADKGFNFSVGDDAFVCQKKNHFQVTVYIGMLGEPKYVKTPEGLKPLDCFYLKLHGVKLEALNQSINIEQSQSDRSKRPFNPVTVNLPPEQVTKVTVGRLHFSETTANNMRKKGKPNPDQRYFMLVVALQAHAQNQNYTLAAQISERIIVRASNPGQFESDSDVLWQRAQVPDTVFHHGRVGINTDRPDEALVVHGNVKVMGSLMHPSDLRAKEHVQEVDTTEQLKRISRMRLVHYRYKPEFAASAGIEATAPETGVIAQEVKEILPEAVKDTGDMVFANGKTIENFLVVNKERIFMENVGAVKELCKLTDNLETRIDELERWSHKLAKLRRLDSLKSTGSSGAFSHAGSQFSRAGSVPHKKRPPKVASKSSSVVPDQACISQRFLQGTIIALVVVMAFSVVSMSTLYVLSLRTEEDLVDTDGSFAVSTSCLLALLRPQPPGGSEALCPWSSQSFGTTQLRQSPLTTGLPGIQPSLLLVTTSLTSSAPGSAVRTLDMCSSHPCPVICCSSPTTNPTTGPSLGPSFNPGHVLSPSPSPSTNRSGPSQMALLPVTNIRAKSWGLSVNGIGHSKHHKSLEPLASPAVPFPGGQGKAKNSPSLGFHGRARRGALQSSVGPAEPTWAQGQSASLLAEPVPSLTSIQVLENSMSITSQYCAPGDACRPGNFTYHIPVSSGTPLHLSLTLQMNSSSPVSVVLCSLRSKEEPCEEGSLPQSLHTHQDTQGTSHRWPITILSFREFTYHFRVALLGQANCSSEALAQPATDYHFHFYRLCD

SEQ ID NO: 31989 - protein, 1111 aa, Homo sapiens
  ENSP00000265460
MHWLPAGHDINGALEPSNIDTSILEEYISKEDASDLCFPDISAPASSASYSHGQPAMPGSSGVHHLSPPGGGPSPGRHGPLPPPGYGTPLNCNNNNGMGAAPKPFPGGTGPPIKAEPKAPYAPGTLPDSPPDSGSEAYSPQQVNEPHLLRTITPETLCHVGVPSRLEHPPPPPAHLPGPPPPPPPPPHYPVLQRDLYMKAEPPIPHYAAMGQGLVPTDLHHTQQSQMLHQLLQQHGAELPTHPSKKRKHSESPPSTLNAQMLNGMIKQEPGTVTALPLHPTRAPSPPWPPQGPLSPGPGSLPLSIARVQTPPWHPPGAPSPGLLQDSDSLSGSYLDPNYQSIKWQPHQQNKWATLYDANYKELPMLTYRVDADKGFNFSVGDDAFVCQKKNHFQVTVYIGMLGEPKYVKTPEGLKPLDCFYLKLHGVKLEALNQSINIEQSQSDRSKRPFNPVTVNLPPEQVTKVTVGRLHFSETTANNMRKKGKPNPDQRYFMLVVALQAHAQNQNYTLAAQISERIIVRASNPGQFESDSDVLWQRAQVPDTVFHHGRVGINTDRPDEALVVHGNVKVMGSLMHPSDLRAKEHVQEVDTTEQLKRISRMRLVHYRYKPEFAASAGIEATAPETGVIAQEVKEILPEAVKDTGDMVFANGKTIENFLVVNKERIFMENVGAVKELCKLTDNLETRIDELERWSHKLAKLRRLDSLKSTGSSGAFSHAGSQFSRAGSVPHKKRPPKVASKSSSVVPDQACISQRFLQGTIIALVVVMAFSVVSMSTLYVLSLRTEEDLVDTDGRSSQSFGTTQLRQSPLTTGLPGIQPSLLLVTTSLTSSAPGSAVRTLDMCSSHPCPVICCSSPTTNPTTGPSLGPSFNPGHVLSPSPSPSTNRSGPSQMALLPVTNIRAKSWGLSVNGIGHSKHHKSLEPLASPAVPFPGGQGKAKNSPSLGFHGRARRGALQSSVGPAEPTWAQGQSEPVPSLTSIQVLENSMSITSQYCAPGDACRPGNFTYHIPVSSGTPLHLSLTLQMNSSSPVSVVLCSLRSKEEPCEEGSLPQSLHTHQDTQGTSHRWPITILSFREFTYHFRVALLGQANCSSEALAQPATDYHFHFYRLCD

SEQ ID NO: 31990 - protein, 537 aa, Homo sapiens
  ENSP00000374253
MRLVHYRYKPEFAASAGIEATAPETGVIAQEVKEILPEAVKDTGDMVFANGKTIENFLVVNKERIFMENVGAVKELCKLTDNLETRIDELERWSHKLAKLRRLDSLKSTGSSGAFSHAGSQFSRAGSVPHKKRPPKVASKSSSVVPDQACISQRFLQGTIIALVVVMAFSVVSMSTLYVLSLRTEEDLVDTDGSFAVSTSCLLALLRPQPPGGSEALCPWSSQSFGTTQLRQSPLTTGLPGIQPSLLLVTTSLTSSAPGSAVRTLDMCSSHPCPVICCSSPTTNPTTGPSLGPSFNPGHVLSPSPSPSTNRSGPSQMALLPVTNIRAKSWGLSVNGIGHSKHHKSLEPLASPAVPFPGGQGKAKNSPSLGFHGRARRGALQSSVGPAEPTWAQGQSEPVPSLTSIQVLENSMSITSQYCAPGDACRPGNFTYHIPVSSGTPLHLSLTLQMNSSSPVSVVLCSLRSKEEPCEEGSLPQSLHTHQDTQGTSHRWPITILSFREFTYHFRVALLGQANCSSEALAQPATDYHFHFYRLCD

SEQ ID NO: 31991 - protein, 859 aa, Homo sapiens
  ENSP00000398665
MGRKLDLSGLTDDETEHVLQVVQRDFNLRKKEEERLSELKQKLDEEGSKCSILSKHQQFVEHCCMRCCSPFTFLVNTKRQCGDCKFNVCKSCCSYQKHEKAWVCCVCQQARLLRAQSLEWFYNNVKSRFKRFGSAKVLKNLYRKHRLESGACFDILGGSLFESNLENEGSISGSDSTFYRQSEGHSVMDTLAVALRVAEEAIEEAISKAEAYGDSLDKQNEASYLRDHKEELTEELATTILQKIIRKQKSKSEQQVEEEPGWPHPQSCSTKVADEGTSASPGGYRAPAALWRSQSAFSITGEEALKTPPVEAPSRQPRDQGQHPRAESALPSWKSVDRLDETNLAPVLQSPDGNWVALKDGAPPPTRLLAKPKSGTFQALEVASSVASAYDEMGSDSEEDFDWSEALSKLCPRSRALPRNPQPQPTQAQSSDQGPIAASPSSALSPNPEAMCSDSETSSAGSSREVGHQARLSWLQRKAPRNPAAEKMRLHGELDVNFNPQLASRETSDSSEPEEAPHTTDRRARRWRRARLGSEEPSKEPSSPSAQLRDLDTHQVSDDLSETDISNEARDPQTLTDTTEEKRRNRLYELAMKMSEKETSSGEDQESEPKTESENQKESLSSEDNSQSVQEELKKKFSAVSLCNISTEVLKVINATEELIAGSTGPWESPQVPPDRQKGMFPRGTDQVRLDEQLTSLEENVYLAAGTVYGLETQLTELEDAARCIHSGTDETHLADLEDQVATAAAQVHHAELQISDIESRISALTIAGLNIAPCVRFTRRRDQKQRTQVQTIDTSRQQRRKLPAPPVKAEKIETSSVTTIKTFNHNFILQGSSTNRTKERKGTTKDLMEPALESAVMY

SEQ ID NO: 31992 - protein, 859 aa, Homo sapiens; identical to SEQ ID NO: 31991
  ENSP00000301972

SEQ ID NO: 31993 - protein, 794 aa, Homo sapiens
  ENSP00000389323
MGRKLDLSGLTDDETEHVLQVVQRDFNLRKKEEERLSELKQKLDEEGSKCSILSKHQQFVEHCCMRCCSPFTFLVNTKRQCGDCKFNVCKSCCSYQKHEKAWVCCVCQQARLLRAQSLEWFYNNVKSRFKRFGSAKVLKNLYRKHRLESGACFDILGGSLFESNLENEGSISGSDSTFYRQSEGHSVMDTLAVALRVAEEAIEEAISKAEAYGDSLDKQNEASYLRDHKEELTEELATTILQKIIRKQKSKSEQQVEEEPGWPHPQSCSTKVADEGTSASPGGYRAPAALWRSQSAFSITGEEALKTPPVEAPSRQPRDQGQHPRAESALPSWKSVDRLDETNLAPVLQSPDGNWVALKDGAPPPTRLLAKPKSGTFQALEVASSVASAYDEMGSDSEEDFDWSEALSKLCPRSRALPRNPQPQPTQAQSSDQGPIAASPSSALSPNPEAMCSDSETSSAGSSREVGHQARLSWLQRKAPRNPAAEKMRLHGELDVNFNPQLASRETSDSSEPEEAPHTTDRRARRWRRARLGSEEPSKEPSSPSAQLRDLDTHQVSDDLSETDISNEARDPQTLTDTTEEKRRNRLYELAMKMSEKETSSGEDQESEPKTESENQKESLSSEDNSQSVQEELKKVYLAAGTVYGLETQLTELEDAARCIHSGTDETHLADLEDQVATAAAQVHHAELQISDIESRISALTIAGLNIAPCVRFTRRRDQKQRTQVQTIDTSRQQRRKLPAPPVKAEKIETSSVTTIKTFNHNFILQGSSTNRTKERKGTTKDLMEPALESAVMY

SEQ ID NO: 31994 - protein, 115 aa, Homo sapiens
  ENSP00000400916
MGRKLDLSGLTDDETEHVLQVVQRDFNLRKKEEERLSELKQKLDEEGSKCSILSKHQQFVEHCCMRCCSPFTFLVNTKRQCGDCKFNVCKSCCSYQKHEKAWVCCVCQQARRKPF

SEQ ID NO: 31995 - protein, 637 aa, Homo sapiens
  ENSP00000413392
MGRKLDLSGLTDDETEHVLQVVQRDFNLRKKEEERLSELKQKLDEEGSKCSILSKHQQFVEHCCMRCCSPFTFLVNTKRQCGDCKFNVCKSCCSYQKHEKAWVCCVCQQARLLRAQSLEWFYNNVKSRFKRFGSAKVLKNLYRKHRLESGACFDILGGSLFESNLENEGSISGSDSTFYRQSEGHSVMDTLAVALRVAEEAIEEAISKAEAYGDSLDKQNEASYLRDHKEELTEELATTILQKIIRKQKSKSEQQVEEEPGWPHPQSCSTKVADEGTSASPGGYRAPAALWRSQSAFSITGEEALKTPPVEAPSRQPRDQGQHPRAESALPSWKSVDRLDETNLAPVLQSPDGNWVALKDGAPPPTRLLAKPKSGTFQALEVASSVASAYDEMGSDSEEDFDWSEALSKLCPRSRALPRNPQPQPTQAQSSDQGPIAASPSSALSPNPEAMCSDSETSSAGSSREVGHQARLSWLQRKAPRNPAAEKMRLHGELDVNFNPQLASRETSDSSEPEEAPHTTDRRARRWRRARLGSEEPSKEPSSPSAQLRDLDTHQVSDDLSETDISNEARDPQTLTDTTEEKRRNRLYELAMKMSEKETSSGEDQESEPKTESENQKESLSSEDNSQSVQEELKKKS

SEQ ID NO: 31996 - protein, 770 aa, Homo sapiens
  ENSP00000379519
MRKAASAASSRSTSSLWSTAACAAARPSPSSSTPSASVEIANSMSARAAAPTRSTKRPGSAASASKRGGSLFESNLENEGSISGSDSTFYRQSEGHSVMDTLAVALRVAEEAIEEAISKAEAYGDSLDKQNEASYLRDHKEELTEELATTILQKIIRKQKSKSEQQVEEEPGWPHPQSCSTKVADEGTSASPGGYRAPAALWRSQSAFSITGEEALKTPPVEAPSRQPRDQGQHPRAESALPSWKSVDRLDETNLAPVLQSPDGNWVALKDGAPPPTRLLAKPKSGTFQALEVASSVASAYDEMGSDSEEDFDWSEALSKLCPRSRALPRNPQPQPTQAQSSDQGPIAASPSSALSPNPEAMCSDSETSSAGSSREVGHQARLSWLQRKAPRNPAAEKMRLHGELDVNFNPQLASRETSDSSEPEEAPHTTDRRARRWRRARLGSEEPSKEPSSPSAQLRDLDTHQVSDDLSETDISNEARDPQTLTDTTEEKRRNRLYELAMKMSEKETSSGEDQESEPKTESENQKESLSSEDNSQSVQEELKKKFSAVSLCNISTEVLKVINATEELIAGSTGPWESPQVPPDRQKGMFPRGTDQVRLDEQLTSLEENVYLAAGTVYGLETQLTELEDAARCIHSGTDETHLADLEDQVATAAAQVHHAELQISDIESRISALTIAGLNIAPCVRFTRRRDQKQRTQVQTIDTSRQQRRKLPAPPVKAEKIETSSVTTIKTFNHNFILQGSSTNRTKERKGTTKDLMEPALESAVMY

SEQ ID NO: 31997 - protein, 672 aa, Homo sapiens
  ENSP00000438297
MDTLAVALRVAEEAIEEAISKAEAYGDSLDKQNEASYLRDHKEELTEELATTILQKIIRKQKSKSEQQVEEEPGWPHPQSCSTKVADEGTSASPGGYRAPAALWRSQSAFSITGEEALKTPPVEAPSRQPRDQGQHPRAESALPSWKSVDRLDETNLAPVLQSPDGNWVALKDGAPPPTRLLAKPKSGTFQALEVASSVASAYDEMGSDSEEDFDWSEALSKLCPRSRALPRNPQPQPTQAQSSDQGPIAASPSSALSPNPEAMCSDSETSSAGSSREVGHQARLSWLQRKAPRNPAAEKMRLHGELDVNFNPQLASRETSDSSEPEEAPHTTDRRARRWRRARLGSEEPSKEPSSPSAQLRDLDTHQVSDDLSETDISNEARDPQTLTDTTEEKRRNRLYELAMKMSEKETSSGEDQESEPKTESENQKESLSSEDNSQSVQEELKKKFSAVSLCNISTEVLKVINATEELIAGSTGPWESPQVPPDRQKGMFPRGTDQVRLDEQLTSLEENVYLAAGTVYGLETQLTELEDAARCIHSGTDETHLADLEDQVATAAAQVHHAELQISDIESRISALTIAGLNIAPCVRFTRRRDQKQRTQVQTIDTSRQQRRKLPAPPVKAEKIETSSVTTIKTFNHNFILQGSSTNRTKERKGTTKDLMEPALESAVMY

SEQ ID NO: 31998 - protein, 591 aa, Homo sapiens
  ENSP00000353269
MSLENEDKRARTRSKALRGPPETTAADLSCPTPGCTGSGHVRGKYSRHRSLQSCPLAKKRKLEGAEAEHLVSKRKSHPLKLALDEGYGVDSDGSEDTEVKDASVSDESEGTLEGAEAETSGQDEIHRPETAEDPSRAEKREIKCPTPGCDGTGHVTGLYPHHRSLSGCPHKDRIPPEILAMHENVLKCPTPGCTGQGHVNSNRNTHRSLSGCPIAAAEKLAKSHEKQQPQTGDPSKSSSNSDRILRPMCFVKQLEVPPYGSYRPNVAPATPRANLAKELEKFSKVTFDYASFDAQVFGKRMLAPKIQTSETSPKAFQCFDYSQDAEAAHMAATAILNLSTRCWEMPENLSTKPQDLPSKSVDIEVDENGTLDLSMHKHRKRENAFPSSSSCSSSPGVKSPDASQRHSSTSAPSSSMTSPQSSQASRQDEWDRPLDYTKPSRLREEEPEESEPAAHSFASSEADDQEVSEENFEERKYPGEVTLTNFKLKFLSKDIKKELLTCPTPGCDGSGHITGNYASHRRCPTPGCDGSGHITGNYASHRSLSGCPRAKKSGVKVAPTKDDKEDPELMKYVGPCWLFHCIAELRFSCVL

SEQ ID NO: 31999 - protein, 1121 aa, Homo sapiens
  ENSP00000327465
MSLENEDKRARTRSKALRGPPETTAADLSCPTPGCTGSGHVRGKYSRHRSLQSCPLAKKRKLEGAEAEHLVSKRKSHPLKLALDEGYGVDSDGSEDTEVKDASVSDESEGTLEGAEAETSGQDEIHRPETAEGRSPVKSHFGSNPIGSATASSKGSYSSYQGIIATSLLNLGQIAEETLVEEDLGQAAKPGPGIVHLLQEAAEGAASEEGEKGLFIQPEDAEEVVEVTTERSQDLCPQSLEDAASEESSKQKGILSHEEEDEEEEEEEEEEEEDEEEEEEEEEEEEEEEEEEEEEEEEEEEEEEEEAAPDVIFQEDTSHTSAQKAPELRGPESPSPKPEYSVIVEVRSDDDKDEDTHSRKSTVTDESEMQDMMTRGNLGLLEQAIALKAEQVRTVCEPGCPPAEQSQLGLGEPGKAAKPLDTVRKSYYSKDPSRAEKREIKCPTPGCDGTGHVTGLYPHHRSLSGCPHKDRIPPEILAMHENVLKCPTPGCTGQGHVNSNRNTHRSLSGCPIAAAEKLAKSHEKQQPQTGDPSKSSSNSDRILRPMCFVKQLEVPPYGSYRPNVAPATPRANLAKELEKFSKVTFDYASFDAQVFGKRMLAPKIQTSETSPKAFQCFDYSQDAEAAHMAATAILNLSTRCWEMPENLSTKPQDLPSKSVDIEVDENGTLDLSMHKHRKRENAFPSSSSCSSSPGVKSPDASQRHSSTSAPSSSMTSPQSSQASRQDEWDRPLDYTKPSRLREEEPEESEPAAHSFASSEADDQEVSEENFEERKYPGEVTLTNFKLKFLSKDIKKELLTCPTPGCDGSGHITGNYASHRSLSGCPLADKSLRNLMAAHSADLKCPTPGCDGSGHITGNYASHRSLSGCPRAKKSGVKVAPTKDDKEDPELMKCPVPGCVGLGHISGKYASHRSASGCPLAARRQKEGSLNGSSFSWKSLKNEGPTCPTPGCDGSGHANGSFLTHRSLSGCPRATFAGKKGKLSGDEVLSPKFKTSDVLENDEEIKQLNQEIRDLNESNSEMEAAMVQLQSQISSMEKNLKNIEEENKLIEEQNEALFLELSGLSQALIQSLANIRLPHMEPICEQNFDAYVSTLTDMYSNQDPENKDLLESIKQAVRGIQV

SEQ ID NO: 32000 - protein, 591 aa, Homo sapiens; identical to SEQ ID NO: 31998
  ENSP00000480510

SEQ ID NO: 32001 - protein, 1148 aa, Homo sapiens
  ENSP00000442412
MSLENEDKRARTRSKALRGPPETTAADLSCPTPGCTGSGHVRGKYSRHRSLQSCPLAKKRKLEGAEAEHLVSKRKSHPLKLALDEGYGVDSDGSEDTEVKDASVSDESEGTLEGAEAETSGQDEIHRPETAEGRSPVKSHFGSNPIGSATASSKGSYSSYQGIIATSLLNLGQIAEETLVEEDLGQAAKPGPGIVHLLQEAAEGAASEEGEKGLFIQPEDAEEVVEVTTERSQDLCPQSLEDAASEESSKQKGILSHEEEDEEEEEEEEEEEEDEEEEEEEEEEEEEEEEEEEEEEEEEEEEEEEEAAPDVIFQEDTSHTSAQKAPELRGPESPSPKPEYSVIVEVRSDDDKDEDTHSRKSTVTDESEMQDMMTRGNLGLLEQAIALKAEQVRTVCEPGCPPAEQSQLGLGEPGKAAKPLDTVRKSYYSKDPSRAEKREIKCPTPGCDGTGHVTGLYPHHRSLSGCPHKDRIPPEILAMHENVLKCPTPGCTGQGHVNSNRNTHRSLSGCPIAAAEKLAKSHEKQQPQTGDPSKSSSNSDRILRPMCFVKQLEVPPYGSYRPNVAPATPRANLAKELEKFSKVTFDYASFDAQVFGKRMLAPKIQTSETSPKAFQSKPFPKASSPRHSPSSSYVRSTSSSSAGFDYSQDAEAAHMAATAILNLSTRCWEMPENLSTKPQDLPSKSVDIEVDENGTLDLSMHKHRKRENAFPSSSSCSSSPGVKSPDASQRHSSTSAPSSSMTSPQSSQASRQDEWDRPLDYTKPSRLREEEPEESEPAAHSFASSEADDQEVSEENFEERKYPGEVTLTNFKLKFLSKDIKKELLTCPTPGCDGSGHITGNYASHRSLSGCPLADKSLRNLMAAHSADLKCPTPGCDGSGHITGNYASHRSLSGCPRAKKSGVKVAPTKDDKEDPELMKCPVPGCVGLGHISGKYASHRSASGCPLAARRQKEGSLNGSSFSWKSLKNEGPTCPTPGCDGSGHANGSFLTHRSLSGCPRATFAGKKGKLSGDEVLSPKFKTSDVLENDEEIKQLNQEIRDLNESNSEMEAAMVQLQSQISSMEKNLKNIEEENKLIEEQNEALFLELSGLSQALIQSLANIRLPHMEPICEQNFDAYVSTLTDMYSNQDPENKDLLESIKQAVRGIQV

SEQ ID NO: 32002 - protein, 591 aa, Homo sapiens; identical to SEQ ID NO: 31998
  ENSP00000481863

SEQ ID NO: 32003 - protein, 1121 aa, Homo sapiens; identical to SEQ ID NO: 31999
  ENSP00000477771

SEQ ID NO: 32004 - protein, 591 aa, Homo sapiens; identical to SEQ ID NO: 31998
  ENSP00000478819

SEQ ID NO: 32005 - protein, 1148 aa, Homo sapiens; identical to SEQ ID NO: 32001
  ENSP00000483021

SEQ ID NO: 32006 - protein, 1186 aa, Homo sapiens
  ENSP00000382114
MEVDTEEKRHRTRSKGVRVPVEPAIQELFSCPTPGCDGSGHVSGKYARHRSVYGCPLAKKRKTQDKQPQEPAPKRKPFAVKADSSSVDECDDSDGTEDMDEKEEDEGEEYSEDNDEPGDEDEEDEEGDREEEEEIEEEDEDDDEDGEDVEDEEEEEEEEEEEEEEEENEDHQMNCHNTRIMQDTEKDDNNNDEYDNYDELVAKSLLNLGKIAEDAAYRARTESEMNSNTSNSLEDDSDKNENLGRKSELSLDLDSDVVRETVDSLKLLAQGHGVVLSENMNDRNYADSMSQQDSRNMNYVMLGKPMNNGLMEKMVEESDEEVCLSSLECLRNQCFDLARKLSETNPQERNPQQNMNIRQHVRPEEDFPGRTPDRNYSDMLNLMRLEEQLSPRSRVFASCAKEDGCHERDDDTTSVNSDRSEEVFDMTKGNLTLLEKAIALETERAKAMREKMAMEAGRRDNMRSYEDQSPRQLPGEDRKPKSSDSHVKKPYYGKDPSRTEKKESKCPTPGCDGTGHVTGLYPHHRSLSGCPHKDRVPPEILAMHESVLKCPTPGCTGRGHVNSNRNSHRSLSGCPIAAAEKLAKAQEKHQSCDVSKSSQASDRVLRPMCFVKQLEIPQYGYRNNVPTTTPRSNLAKELEKYSKTSFEYNSYDNHTYGKRAIAPKVQTRDISPKGYDDAKRYCKDPSPSSSSTSSYAPSSSSNLSCGGGSSASSTCSKSSFDYTHDMEAAHMAATAILNLSTRCREMPQNLSTKPQDLCATRNPDMEVDENGTLDLSMNKQRPRDSCCPILTPLEPMSPQQQAVMNNRCFQLGEGDCWDLPVDYTKMKPRRIDEDESKDITPEDLDPFQEALEERRYPGEVTIPSPKPKYPQCKESKKDLITLSGCPLADKSIRSMLATSSQELKCPTPGCDGSGHITGNYASHRSLSGCPRAKKSGIRIAQSKEDKEDQEPIRCPVPGCDGQGHITGKYASHRSASGCPLAAKRQKDGYLNGSQFSWKSVKTEGMSCPTPGCDGSGHVSGSFLTHRSLSGCPRATSAMKKAKLSGEQMLTIKQRASNGIENDEEIKQLDEEIKELNESNSQMEADMIKLRTQITTMESNLKTIEEENKVIEQQNESLLHELANLSQSLIHSLANIQLPHMDPINEQNFDAYVTTLTEMYTNQDRYQSPENKALLENIKQAVRGIQV

SEQ ID NO: 32007 - protein, 184 aa, Homo sapiens
  ENSP00000384219
MSCPTPGCDGSGHVSGSFLTHRSLSGCPRATSAMKKAKLSGEQMLTIKQRASNGIENDEEIKQLDEEIKELNESNSQMEADMIKLRTQVTITTMESNLKTIEEENKVIEQQNESLLHELANLSQSLIHSLANIQLPHMDPINEQNFDAYVTTLTEMYTNQDRYQSPENKALLENIKQAVRGIQV

SEQ ID NO: 32008 - protein, 202 aa, Homo sapiens
  ENSP00000382111
EDQEPIRCPVPGCDGQGHITGKYASHRSASGCPLAAKRQKDGYLNGSQFSWKSVKTEGMSCPTPGCDGSGHVSGSFLTHRSLSGCPRATSAMKKAKLSGEQMLTIKQRASNGIENDEEIKQLDEEIKELNESNSQMEADMIKLRTQITTMESNLKTIEEENKVIEQQNESLLHELANLSQSLIHSLANIQLPHMEDGVWWGQ

SEQ ID NO: 32009 - protein, 1184 aa, Homo sapiens
  ENSP00000396103
MEVDTEEKRHRTRSKGVRVPVEPAIQELFSCPTPGCDGSGHVSGKYARHRSVYGCPLAKKRKTQDKQPQEPAPKRKPFAVKADSSSVDECDDSDGTEDMDEKEEDEGEEYSEDNDEPGDEDEEDEEGDREEEEEIEEEDEDDDEDGEDVEDEEEEEEEEEEEEEEEENEDHQMNCHNTRIMQDTEKDDNNNDEYDNYDELVAKSLLNLGKIAEDAAYRARTESEMNSNTSNSLEDDSDKNENLGRKSELSLDLDSDVVRETVDSLKLLAQGHGVVLSENMNDRNYADSMSQQDSRNMNYVMLGKPMNNGLMEKMVEESDEEVCLSSLECLRNQCFDLARKLSETNPQERNPQQNMNIRQHVRPEEDFPGRTPDRNYSDMLNLMRLEEQLSPRSRVFASCAKEDGCHERDDDTTSVNSDRSEEVFDMTKGNLTLLEKAIALETERAKAMREKMAMEAGRRDNMRSYEDQSPRQLPGEDRKPKSSDSHVKKPYYDPSRTEKKESKCPTPGCDGTGHVTGLYPHHRSLSGCPHKDRVPPEILAMHESVLKCPTPGCTGRGHVNSNRNSHRSLSGCPIAAAEKLAKAQEKHQSCDVSKSSQASDRVLRPMCFVKQLEIPQYGYRNNVPTTTPRSNLAKELEKYSKTSFEYNSYDNHTYGKRAIAPKVQTRDISPKGYDDAKRYCKDPSPSSSSTSSYAPSSSSNLSCGGGSSASSTCSKSSFDYTHDMEAAHMAATAILNLSTRCREMPQNLSTKPQDLCATRNPDMEVDENGTLDLSMNKQRPRDSCCPILTPLEPMSPQQQAVMNNRCFQLGEGDCWDLPVDYTKMKPRRIDEDESKDITPEDLDPFQEALEERRYPGEVTIPSPKPKYPQCKESKKDLITLSGCPLADKSIRSMLATSSQELKCPTPGCDGSGHITGNYASHRSLSGCPRAKKSGIRIAQSKEDKEDQEPIRCPVPGCDGQGHITGKYASHRSASGCPLAAKRQKDGYLNGSQFSWKSVKTEGMSCPTPGCDGSGHVSGSFLTHRSLSGCPRATSAMKKAKLSGEQMLTIKQRASNGIENDEEIKQLDEEIKELNESNSQMEADMIKLRTQITTMESNLKTIEEENKVIEQQNESLLHELANLSQSLIHSLANIQLPHMDPINEQNFDAYVTTLTEMYTNQDRYQSPENKALLENIKQAVRGIQV

SEQ ID NO: 32010 - protein, 343 aa, Homo sapiens
  ENSP00000473409
QERNPQQNMNIRQHVRPEEDFPGRTPDRNYSDMLNLMRLEEQLSPRSRVFASCAKEDGCHERDDDTTSVNSDRSEEVFDMTKGNLTLLEKAIALETERAKAMREKMAMEAGRRDNMRSYEDQSPRQLPGEDRKPKSSDSHVKKPYYGKDPSRTEKKESKCPTPGCDGTGHVTGLYPHHRSLSGCPHKDRVPPEILAMHESVLKCPTPGCTGRGHVNSNRNSHRSLSGCPIAAAEKLAKAQEKHQSCDVSKSSQASDRVLRPMCFVKQLEIPQYGYRNNVPTTTPRSNLAKELEKYSKTSFEYNSYDNHTYGKRAIAPKRSGTARTPAPAAAAPAATRPAAAAT

SEQ ID NO: 32011 - protein, 178 aa, Homo sapiens
  ENSP00000335636
MTTLRAFTCDDLFRFNNINLDPLTETYGIPFYLQYLAHWPEYFIVAEAPGGELMGYIMGKAEGSVAREEWHGHVTALSVAPEFRRLGLAAKLMELLEEISERKGGFFVDLFVRVSNQVAVNMYKQLGYSVYRTVIEYYSASNGEPDEDAYDMRKALSRDTEKKSIIPLPHPVRPEDIE

SEQ ID NO: 32012 - protein, 111 aa, Homo sapiens
  ENSP00000311027
MTTLRAFTCDDLFRFNNINLDPLTETYGIPFYLQYLAHWPEYFIVAEAPGGELMGYIMGKAEGSVAREEWHGHVTALSVAPEFRRLGLAAKLMELLEEISERYEESTFQGY

SEQ ID NO: 32013 - protein, 166 aa, Homo sapiens
  ENSP00000381603
MLSQSCNLDPLTETYGIPFYLQYLAHWPEYFIVAEAPGGELMGYIMGKAEGSVAREEWHGHVTALSVAPEFRRLGLAAKLMELLEEISERKGGFFVDLFVRVSNQVAVNMYKQLGYSVYRTVIEYYSASNGEPDEDAYDMRKALSRDTEKKSIIPLPHPVRPEDIE

SEQ ID NO: 32014 - protein, 525 aa, Homo sapiens
  ENSP00000300131
MHRAPSPTAEQPPGGGDSARRTLQPRLKPSARAMALPRTLGELQLYRVLQRANLLSYYETFIQQGGDDVQQLCEAGEEEFLEIMALVGMATKPLHVRRLQKALREWATNPGLFSQPVPAVPVSSIPLFKISETAGTRKGSMSNGHGSPGEKAGSARSFSPKSPLELGEKLSPLPGGPGAGDPRIWPGRSTPESDVGAGGEEEAGSPPFSPPAGGGVPEGTGAGGLAAGGTGGGPDRLEPEMVRMVVESVERIFRSFPRGDAGEVTSLLKLNKKLARSVGHIFEMDDNDSQKEEEIRKYSIIYGRFDSKRREGKQLSLHELTINEAAAQFCMRDNTLLLRRVELFSLSRQVARESTYLSSLKGSRLHPEELGGPPLKKLKQEVGEQSHPEIQQPPPGPESYVPPYRPSLEEDSASLSGESLDGHLQAVGSCPRLTPPPADLPLALPAHGLWSRHILQQTLMDEGLRLARLVSHDRVGRLSPCVPAKPPLAEFEEGLLDRCPAPGPHPALVEGRRSSVKVEAEASRQ

SEQ ID NO: 32015 - protein, 461 aa, Homo sapiens
  ENSP00000341491
MHRAPSPTAEQPPGGGDSARRTLQPRLKPSARAMALPRTLGELQLYRVLQRANLLSYYETFIQQGGDDVQQLCEAGEEEFLEIMALVGMATKPLHVRRLQKALREWATNPGLFSQPVPAVPVSSIPLFKISETAGTRKGSMSNGHGSPGEKAGSARSFSPKSPLELGEKLSPLPGGPGAGDPRIWPGRSTPESDVGAGGEEEAGSPPFSPPAGGGVPEGTGAGGLAAGGTGGGPDRLEPEMVRMVVESVERIFRSFPRGDAGEVTSLLKLNKKLARSVGHIFEMDDNDSQKEEEIRKYSIIYGRFDSKRREGKQLSLHELTINEAAAQFCMRDNTLLLRRVELFSLSRQVARESTYLSSLKGSRLHPEELGGPPLKKLKQEVGEQSHPEIQQPPPGPESYVPPYRPSLEEDSASLSGESLDGHLQEFEEGLLDRCPAPGPHPALVEGRRSSVKVEAEASRQ

SEQ ID NO: 32016 - protein, 42 aa, Homo sapiens
  ENSP00000427518
MYFAPSMKDFTQYIFTEKLKQDKGSDASWKNDQEPPPETMVD

SEQ ID NO: 32017 - protein, 389 aa, Homo sapiens
  ENSP00000408963
MEVVEAAAAQLETLKFNGTDFGVGEGPAAPSPGSAPVPGTQPPLQSFEGSPDAGQTVEVKPAGEQPLQPVLNAVAAGTPAPQPQPPAESPACGDCVTSPGAAEPARAPDSLETSDSDSDSDSETDSDSSSSSSSSSSSSSSSSSSCISLPPVLSDGDDDLQIEKENKNFPLKTKDELLLNELPSVEELTIILPEDIELKPLGMVSSIIEQLVIIESMTNLPPVNEETVIFKSDRQAAGKIFEIFGPVAHPFYVLRFNSSDHIESKGIKIKETMYFAPSMKDFTQYIFTEKLKQDKGSDASWKNDQEPPPEALDFSDDEKEKEAKQRKKSQIQGRKKLKSEFNEPGTGISHRYCGLGSRPLQSSESHKLFGFQMHIKVTFTCYFSLLSMQ

SEQ ID NO: 32018 - protein, 494 aa, Homo sapiens
  ENSP00000274054
MEVVEAAAAQLETLKFNGTDFGVGEGPAAPSPGSAPVPGTQPPLQSFEGSPDAGQTVEVKPAGEQPLQPVLNAVAAGTPAPQPQPPAESPACGDCVTSPGAAEPARAPDSLETSDSDSDSDSETDSDSSSSSSSSSSSSSSSSSSCISLPPVLSDGDDDLQIEKENKNFPLKTKDELLLNELPSVEELTIILPEDIELKPLGMVSSIIEQLVIIESMTNLPPVNEETVIFKSDRQAAGKIFEIFGPVAHPFYVLRFNSSDHIESKGIKIKETMYFAPSMKDFTQYIFTEKLKQDKGSDASWKNDQEPPPEALDFSDDEKEKEAKQRKKSQIQGRKKLKSEFNEPGEDFTEVHQNWNAHSSASEHAKGYRNREFTRGFSRARYPRSCHGRPPPQHFYNSEHMVSQETSGFPSQRQNNPIMPQYPFPLPVFDMHNFPLRPPPPPPPPPVNMGWATPNMAAHPLLNLPYSLPPPPPPPPLPPPPSSGDSNSHFGPYY

SEQ ID NO: 32019 - protein, 491 aa, Homo sapiens [sequence omitted]

SEQ ID NO: 32020 - protein, 368 aa, Homo sapiens
  ENSP00000346242
MNPAAEAEFNILLATDSYKVTHYKQYPPNTSKVYSYFECREKKTENSKLRKVKYEETVFYGLQYILNKYLKGKVVTKEKIQEAKDVYKEHFQDDVFNEKGWNYILEKYDGHLPIEIKAVPEGFVIPRGNVLFTVENTDPECYWLTNWIETILVQSWYPITVATNSREQKKILAKYLLETSGNLDGLEYKLHDFGYRGVSSQETAGIGASAHLVNFKGTDTVAGLALIKKYYGTKDPVPGYSVPAAEHSTITAWGKDHEKDAFEHIVTQFSSVPVSVVSDSYDIYNACEKIWGEDLRHLIVSRSTQAPLIIRPDSGNPLDTVLKVLEILGKKFPVTENSKGYKLLPPYLRVIQGDGVDINTLQEVCVLY

SEQ ID NO: 32021 - protein, 88 aa, Homo sapiens
  ENSP00000390591
MNPAAEAEFNILLATDSYKVTHYKQYPPNTSKVYSYFECREKKTENSKLRKVKYEETVFYGLQYILNKYLKGKVVTKEKIQEAKDVYK

SEQ ID NO: 32022 - protein, 60 aa, Homo sapiens
  ENSP00000390896
MNPAAEAEFNILLATDSYKVTHYKQYPPNTSKVYSYFECREKKTENSKLRKVKYEETVFY

SEQ ID NO: 32023 - protein, 295 aa, Homo sapiens
  ENSP00000263354
MDNSGKEAEAMALLAEAERKVKNSQSFFSGLFGGSSKIEEACEIYARAANMFKMAKNWSAAGNAFCQAAQLHLQLQSKHDAATCFVDAGNAFKKADPQEAINCLMRAIEIYTDMGRFTIAAKHHISIAEIYETELVDIEKAIAHYEQSADYYKGEESNSSANKCLLKVAGYAALLEQYQKAIDIYEQVGTNAMDSPLLKYSAKDYFFKAALCHFCIDMLNAKLAVQKYEELFPAFSDSRECKLMKKLLEAHEEQNVDSYTESVKEYDSISRLDQWLTTMLLRIKKTIQGDEEDLR

SEQ ID NO: 32024 - protein, 83 aa, Homo sapiens
  ENSP00000472235
HFCIDMLNAKLAVQKYEELFPAFSDSRECKLMKKLLEAHEEQNVDSYTESVKEYDSISRLDQWLTTMLLRIKKTIQGDEEDLR

SEQ ID NO: 32025 - protein, 256 aa, Homo sapiens
  ENSP00000471520
MDNSGKEAEAMALLAEAERKVKNSQSFFSGLFGGSSKIEEACEIYARAANMFKMAKNWSEAINCLMRAIEIYTDMGRFTIAAKHHISIAEIYETELVDIEKAIAHYEQSADYYKGEESNSSANKCLLKVAGYAALLEQYQKAIDIYEQVGTNAMDSPLLKYSAKDYFFKAALCHFCIDMLNAKLAVQKYEELFPAFSDSRECKLMKKLLEAHEEQNVDSYTESVKEYDSISRLDQWLTTMLLRIKKTIQGDEEDLR

SEQ ID NO: 32026 - protein, 35 aa, Homo sapiens
  ENSP00000470654
MDNSGKEAEAMALLAEAERKVKNSQSFFSGLFGGH

SEQ ID NO: 32027 - protein, 268 aa, Homo sapiens
  ENSP00000472667
MDNSGKEAEAMALLAEAERKVKNSQSFFSGLFGGSSKIEEACEIYARAANMFKMAKNWSGMSSPLELLQAAGNAFCQAAQLHLQLQSKHDAATCFVDAGNAFKKADPQEAINCLMRAIEIYTDMGRFTIAAKHHISIAEIYETELVDIEKAIAHYEQSADYYKGEESNSSANKCLLKVAGYAALLEQYQKAIDIYEQVGTNAMDSPLLKYSAKDYFFKAALCHFCIDMLNAKLAVQKYEELFPAFSDSRECKLMKKLLEAHEEQNVDS

SEQ ID NO: 32028 - protein, 139 aa, Homo sapiens
  ENSP00000471261
  MOD_RES (1)..(1): Any amino acid
XAGNAFCQAAQLHLQLQSKHDAATCFVDAGNAFKKADPQEAINCLMRAIEIYTDMGRFTIAAKHHISIAEIYETELVDIEKVGTNAMDSPLLKYSAKDYFFKAALCHFCIDMLNAKLAVQKYEELFPAFSDSRECKLMK

SEQ ID NO: 32029 - protein, 60 aa, Homo sapiens
  ENSP00000470665
MDNSGKEAEAMALLAEAERKVKNSQSFFSGLFGPHPDPTERIPKCVAVGLWFDEMSTSCG

SEQ ID NO: 32030 - protein, 102 aa, Homo sapiens
  ENSP00000470946
MRAIEIYTDMGRFTIAAKHHISIAEIYETELVDIEKAIAHYEQSADYYKGEESNSSANKCLLKVAGYAALLEQYQKAIDIYEQVGTNAMDSPLLKYSAKDYF

SEQ ID NO: 32031 - protein, 137 aa, Homo sapiens
  ENSP00000471018
MFKMAKNWSAAGNAFCQAAQLHLQLQSKHDAATCFVDAGNAFKKADPQEAINCLMRAIEIYTDMGRFTIAAKHHISIAEIYETELVDIEKAIAHYEQSADYYKGEESNSSANKCLLKVAGYAALLEQYQKAIDIYEQ

SEQ ID NO: 32032 - protein, 74 aa, Homo sapiens
  ENSP00000470954
MDNSGKEAEAMALLAEAERKVKNSQSFFSGLFGCWKRVLPGCTAAPAAPEQARRSHLLCGRWQRIQESRPPRGH

SEQ ID NO: 32033 - protein, 477 aa, Homo sapiens
  ENSP00000281038
MLGVRCLLRSVRFCSSAPFPKHKPSAKLSVRDALGAQNASGERIKIQGWIRSVRSQKEVLFLHVNDGSSLESLQVVADSGLDSRELNFGSSVEVQGQLIKSPSKRQNVELKAEKIKVIGNCDAKDFPIKYKERHPLEYLRQYPHFRCRTNVLGSILRIRSEATAAIHSFFKDSGFVHIHTPIITSNDSEGAGELFQLEPSGKLKVPEENFFNVPAFLTVSGQLHLEVMSGAFTQVFTFGPTFRAENSQSRRHLAEFYMIEAEISFVDSLQDLMQVIEELFKATTMMVLSKCPEDVELCHKFIAPGQKDRLEHMLKNNFLIISYTEAVEILKQASQNFTFTPEWGADLRTEHEKYLVKHCGNIPVFVINYPLTLKPFYMRDNEDGPQHTVAAVDLLVPGVGELFGGGLREERYHFLEERLARSGLTEVYQWYLDLRRFGSVPHGGFGMGFERYLQCILGVDNIKDVIPFPRFPHSCLL

SEQ ID NO: 32034 - protein, 81 aa, Homo sapiens
  ENSP00000435298
  MOD_RES (1)..(1): Any amino acid
XVAAVDLLVPGVGELFGGGLREERYHFLEERLARYLDLRRFGSVPHGGFGMGFERYLQCILGVDNIKDVIPFPRFPHSCLL

SEQ ID NO: 32035 - protein, 250 aa, Homo sapiens
  ENSP00000432635
MSGAFTQVFTFGPTFRAENSQSRRHLAEFYMIEAEISFVDSLQDLMQVIEELFKATTMMVLSKCPEDVELCHKFIAPGQKDRLEHMLKNNFLIISYTEAVEILKQASQNFTFTPEWGADLRTEHEKYLVKHCGNIPVFVINYPLTLKPFYMRDNEDGPQHTVAAVDLLVPGVGELFGGGLREERYHFLEERLARSGLTEVYQWYLDLRRFGSVPHGGFGMGFERYLQCILGVDNIKDVIPFPRFPHSCLL

SEQ ID NO: 32036 - protein, 106 aa, Homo sapiens
  ENSP00000436114
  MOD_RES (1)..(1): Any amino acid
XPIKYKERHPLEYLRQYPHFRCRTNVLGSILRIRSEATAAIHSFFKDSGFVHIHTPIITSNDSEGAGELFQLEPSGKLKVPEENFFNVPAFLTVSGQLHLEVMSGL

SEQ ID NO: 32037 - protein, 241 aa, Homo sapiens
  ENSP00000432240
MLGVRCLLRSVRFCSSAPFPKHKPSAKLSVRDALGAQNASGERIKIQGWIRSVRSQKEVLFLHVNDGSSLESLQVVADSGLDSRELNFGSSVEVQGQLIKSPSKRQNVELKAEKIKVIGNCDAKDFPIKYKERHPLEYLRQYPHFRCRTNVLGSILRIRSEATAAIHSFFKDSGFVHIHTPIITSNDSEGAGELFQLEWGADLRTEHEKYLVKHCGNIPVFVINYPLTLKPFYMRDNEDGP

SEQ ID NO: 32038 - protein, 2 aa, Homo sapiens
  ENSP00000433478
MS

SEQ ID NO: 32039 - protein, 2365 aa, Homo sapiens
  ENSP00000353871
MESVSESSQQQKRKPVIHGLEDQKRIYTDWANHYLAKSGHKRLIRDLQQDVTDGVLLAQIIQVVANEKIEDINGCPKNRSQMIENIDACLNFLAAKGINIQGLSAEEIRNGNLKAILGLFFSLSRYKQQQQQPQKQHLSSPLPPAVSQVAGAPSQCQAGTPQQQVPVTPQAPCQPHQPAPHQQSKAQAEMQSRLPGPTARVSAAGSEAKTRGGSTTANNRRSQSFNNYDKSKPVTSPPPPPSSHEKEPLASSASSHPGMSDNAPASLESGSSSTPTNCSTSSAIPQPGAATKPWRSKSLSVKHSATVSMLSVKPPGPEAPRPTPEAMKPAPNNQKSMLEKLKLFNSKGGSKAGEGPGSRDTSCERLETLPSFEESEELEAASRMLTTVGPASSSPKIALKGIAQRTFSRALTNKKSSLKGNEKEKEKQQREKDKEKSKDLAKRASVTERLDLKEEPKEDPSGAAVPEMPKKSSKIASFIPKGGKLNSAKKEPMAPSHSGIPKPGMKSMPGKSPSAPAPSKEGERSRSGKLSSGLPQQKPQLDGRHSSSSSSLASSEGKGPGGTTLNHSISSQTVSGSVGTTQTTGSNTVSVQLPQPQQQYNHPNTATVAPFLYRSQTDTEGNVTAESSSTGVSVEPSHFTKTGQPALEELTGEDPEARRLRTVKNIADLRQNLEETMSSLRGTQVTHSTLETTFDTNVTTEMSGRSILSLTGRPTPLSWRLGQSSPRLQAGDAPSMGNGYPPRANASRFINTESGRYVYSAPLRRQLASRGSSVCHVDVSDKAGDEMDLEGISMDAPGYMSDGDVLSKNIRTDDITSGYMTDGGLGLYTRRLNRLPDGMAVVRETLQRNTSLGLGDADSWDDSSSVSSGISDTIDNLSTDDINTSSSISSYANTPASSRKNLDVQTDAEKHSQVERNSLWSGDDVKKSDGGSDSGIKMEPGSKWRRNPSDVSDESDKSTSGKKNPVISQTGSWRRGMTAQVGITMPRTKPSAPAGALKTPGTGKTDDAKVSEKGRLSPKASQVKRSPSDAGRSSGDESKKPLPSSSRTPTANANSFGFKKQSGSAAGLAMITASGVTVTSRSATLGKIPKSSALVSRSAGRKSSMDGAQNQDDGYLALSSRTNLQYRSLPRPSKSNSRNGAGNRSSTSSIDSNISSKSAGLPVPKLREPSKTALGSSLPGLVNQTDKEKGISSDNESVASCNSVKVNPAAQPVSSPAQTSLQPGAKYPDVASPTLRRLFGGKPTKQVPIATAENMKNSVVISNPHATMTQQGNLDSPSGSGVLSSGSSSPLYSKNVDLNQSPLASSPSSAHSAPSNSLTWGTNASSSSAVSKDGLGFQSVSSLHTSCESIDISLSSGGVPSHNSSTGLIASSKDDSLTPFVRTNSVKTTLSESPLSSPAASPKFCRSTLPRKQDSDPHLDRNTLPKKGLRYTPTSQLRTQEDAKEWLRSHSAGGLQDTAANSPFSSGSSVTSPSGTRFNFSQLASPTTVTQMSLSNPTMLRTHSLSNADGQYDPYTDSRFRNSSMSLDEKSRTMSRSGSFRDGFEEVHGSSLSLVSSTSSVYSTPEEKCQSEIRKLRRELDASQEKVSALTTQLTANAHLVAAFEQSLGNMTIRLQSLTMTAEQKDSELNELRKTIELLKKQNAAAQAAINGVINTPELNCKGNGTAQSADLRIRRQHSSDSVSSINSATSHSSVGSNIESDSKKKKRKNWLRSSFKQAFGKKKSPKSASSHSDIEEMTDSSLPSSPKLPHNGSTGSTPLLRNSHSNSLISECMDSEAETVMQLRNELRDKEMKLTDIRLEALSSAHQLDQLREAMNRMQSEIEKLKAENDRLKSESQGSGCSRAPSQVSISASPRQSMGLSQHSLNLTESTSLDMLLDDTGECSARKEGGRHVKIVVSFQEEMKWKEDSRPHLFLIGCIGVSGKTKWDVLDGVVRRLFKEYIIHVDPVSQLGLNSDSVLGYSIGEIKRSNTSETPELLPCGYLVGENTTISVTVKGLAENSLDSLVFESLIPKPILQRYVSLLIEHRRIILSGPSGTGKTYLANRLSEYIVLREGRELTDGVIATFNVDHKSSKELRQYLSNLADQCNSENNAVDMPLVIILDNLHHVSSLGEIFNGLLNCKYHKCPYIIGTMNQATSSTPNLQLHHNFRWVLCANHTEPVKGFLGRFLRRKLMETEISGRVRNMELVKIIDWIPKVWHHLNRFLEAHSSSDVTIGPRLFLSCPIDVDGSRVWFTDLWNYSIIPYLLEAVREGLQLYGRRAPWEDPAKWVMDTYPWAASPQQHEWPPLLQLRPEDVGFDGYSMPREGSTSKQMPPSDAEGDPLMNMLMRLQEAANYSSPQSYDSDSNSNSHHDDILDSSLESTL

SEQ ID NO: 32040 - protein, 2432 aa, Homo sapiens
  ENSP00000379394
MPAILVASKMKSGLPKPVHSAAPILHVPPARAGPQPCYLKLGSKVEVSKTTYPSQIPLKSQVLQGLQEPAGEGLPLRKSGSVENGFDTQIYTDWANHYLAKSGHKRLIRDLQQDVTDGVLLAQIIQVVANEKIEDINGCPKNRSQMIENIDACLNFLAAKGINIQGLSAEEIRNGNLKAILGLFFSLSRYKQQQQQPQKQHLSSPLPPAVSQVAGAPSQCQAGTPQQQVPVTPQAPCQPHQPAPHQQSKAQAEMQSRLPGPTARVSAAGSEAKTRGGSTTANNRRSQSFNNYDKSKPVTSPPPPPSSHEKEPLASSASSHPGMSDNAPASLESGSSSTPTNCSTSSAIPQPGAATKPWRSKSLSVKHSATVSMLSVKPPGPEAPRPTPEAMKPAPNNQKSMLEKLKLFNSKGGSKAGEGPGSRDTSCERLETLPSFEESEELEAASRMLTTVGPASSSPKIALKGIAQRTFSRALTNKKSSLKGNEKEKEKQQREKDKEKSKDLAKRASVTERLDLKEEPKEDPSGAAVPEMPKKSSKIASFIPKGGKLNSAKKEPMAPSHSGIPKPGMKSMPGKSPSAPAPSKEGERSRSGKLSSGLPQQKPQLDGRHSSSSSSLASSEGKGPGGTTLNHSISSQTVSGSVGTTQTTGSNTVSVQLPQPQQQYNHPNTATVAPFLYRSQTDTEGNVTAESSSTGVSVEPSHFTKTGQPALEELTGEDPEARRLRTVKNIADLRQNLEETMSSLRGTQVTHSTLETTFDTNVTTEMSGRSILSLTGRPTPLSWRLGQSSPRLQAGDAPSMGNGYPPRANASRFINTESGRYVYSAPLRRQLASRGSSVCHVDVSDKAGDEMDLEGISMDAPGYMSDGDVLSKNIRTDDITSGYMTDGGLGLYTRRLNRLPDGMAVVRETLQRNTSLGLGDADSWDDSSSVSSGISDTIDNLSTDDINTSSSISSYANTPASSRKNLDVQTDAEKHSQVERNSLWSGDDVKKSDGGSDSGIKMEPGSKWRRNPSDVSDESDKSTSGKKNPVISQTGSWRRGMTAQVGITMPRTKPSAPAGALKTPGTGKTDDAKVSEKGRLSPKASQVKRSPSDAGRSSGDESKKPLPSSSRTPTANANSFGFKKQSGSAAGLAMITASGVTVTSRSATLGKIPKSSALVSRSAGRKSSMDGAQNQDDGYLALSSRTNLQYRSLPRPSKSNSRNGAGNRSSTSSIDSNISSKSAGLPVPKLREPSKTALGSSLPGLVNQTDKEKGISSDNESVASCNSVKVNPAAQPVSSPAQTSLQPGAKYPDVASPTLRRLFGGKPTKQVPIATAENMKNSVVISNPHATMTQQGNLDSPSGSGVLSSGSSSPLYSKNVDLNQSPLASSPSSAHSAPSNSLTWGTNASSSSAVSKDGLGFQSVSSLHTSCESIDISLSSGGVPSHNSSTGLIASSKDDSLTPFVRTNSVKTTLSESPLSSPAASPKFCRSTLPRKQDSDPHLDRNTLPKKGLRYTPTSQLRTQEDAKEWLRSHSAGGLQDTAANSPFSSGSSVTSPSGTRFNFSQLASPTTVTQMSLSNPTMLRTHSLSNADGQYDPYTDSRFRNSSMSLDEKSRTMSRSGSFRDGFEEVHGSSLSLVSSTSSVYSTPEEKCQSEIRKLRRELDASQEKVSALTTQLTANAHLVAAFEQSLGNMTIRLQSLTMTAEQKDSELNELRKTIELLKKQNAAAQAAINGVINTPELNCKGNGTAQSADLRIRRQHSSDSVSSINSATSHSSVGSNIESDSKKKKRKNWVNELRSSFKQAFGKKKSPKSASSHSDIEEMTDSSLPSSPKLPHNGSTGSTPLLRNSHSNSLISECMDSEAETVMQLRNELRDKEMKLTDIRLEALSSAHQLDQLREAMNRMQSEIEKLKAENDRLKSESQGSGCSRAPSQVSISASPRQSMGLSQHSLNLTESTSLDMLLDDTGECSARKEGGRHVKIVVSFQEEMKWKEDSRPHLFLIGCIGVSGKTKWDVLDGVVRRLFKEYIIHVDPVSQLGLNSDSVLGYSIGEIKRSNTSETPELLPCGYLVGENTTISVTVKGLAENSLDSLVFESLIPKPILQRYVSLLIEHRRIILSGPSGTGKTYLANRLSEYIVLREGRELTDGVIATFNVDHKSSKELRQYLSNLADQCNSENNAVDMPLVIILDNLHHVSSLGEIFNGLLNCKYHKCPYIIGTMNQATSSTPNLQLHHNFRWVLCANHTEPVKGFLGRFLRRKLMETEISGRVRNMELVKIIDWIPKVWHHLNRFLEAHSSSDVTIGPRLFLSCPIDVDGSRVWFTDLWNYSIIPYLLEAVREGLQLYGRRAPWEDPAKWVMDTYPWAASPQQHEWPPLLQLRPEDVGFDGYSMPREGSTSKQMPPSDAEGDPLMNMLMRLQEAANYSSPQSYDSDSNSNSHHDDILDSSLESTL

SEQ ID NO: 32041 - protein, 2429 aa, Homo sapiens
  ENSP00000309577
MPAILVASKMKSGLPKPVHSAAPILHVPPARAGPQPCYLKLGSKVEVSKTTYPSQIPLKSQVLQGLQEPAGEGLPLRKSGSVENGFDTQIYTDWANHYLAKSGHKRLIRDLQQDVTDGVLLAQIIQVVANEKIEDINGCPKNRSQMIENIDACLNFLAAKGINIQGLSAEEIRNGNLKAILGLFFSLSRYKQQQQQPQKQHLSSPLPPAVSQVAGAPSQCQAGTPQQQVPVTPQAPCQPHQPAPHQQSKAQAEMQSRLPGPTARVSAAGSEAKTRGGSTTANNRRSQSFNNYDKSKPVTSPPPPPSSHEKEPLASSASSHPGMSDNAPASLESGSSSTPTNCSTSSAIPQPGAATKPWRSKSLSVKHSATVSMLSVKPPGPEAPRPTPEAMKPAPNNQKSMLEKLKLFNSKGGSKAGEGPGSRDTSCERLETLPSFEESEELEAASRMLTTVGPASSSPKIALKGIAQRTFSRALTNKKSSLKGNEKEKEKQQREKDKEKSKDLAKRASVTERLDLKEEPKEDPSGAAVPEMPKKSSKIASFIPKGGKLNSAKKEPMAPSHSGIPKPGMKSMPGKSPSAPAPSKEGERSRSGKLSSGLPQQKPQLDGRHSSSSSSLASSEGKGPGGTTLNHSISSQTVSGSVGTTQTTGSNTVSVQLPQPQQQYNHPNTATVAPFLYRSQTDTEGNVTAESSSTGVSVEPSHFTKTGQPALEELTGEDPEARRLRTVKNIADLRQNLEETMSSLRGTQVTHSTLETTFDTNVTTEMSGRSILSLTGRPTPLSWRLGQSSPRLQAGDAPSMGNGYPPRANASRFINTESGRYVYSAPLRRQLASRGSSVCHVDVSDKAGDEMDLEGISMDAPGYMSDGDVLSKNIRTDDITSGYMTDGGLGLYTRRLNRLPDGMAVVRETLQRNTSLGLGDADSWDDSSSVSSGISDTIDNLSTDDINTSSSISSYANTPASSRKNLDVQTDAEKHSQVERNSLWSGDDVKKSDGGSDSGIKMEPGSKWRRNPSDVSDESDKSTSGKKNPVISQTGSWRRGMTAQVGITMPRTKPSAPAGALKTPGTGKTDDAKVSEKGRLSPKASQVKRSPSDAGRSSGDESKKPLPSSSRTPTANANSFGFKKQSGSAAGLAMITASGVTVTSRSATLGKIPKSSALVSRSAGRKSSMDGAQNQDDGYLALSSRTNLQYRSLPRPSKSNSRNGAGNRSSTSSIDSNISSKSAGLPVPKLREPSKTALGSSLPGLVNQTDKEKGISSDNESVASCNSVKVNPAAQPVSSPAQTSLQPGAKYPDVASPTLRRLFGGKPTKQVPIATAENMKNSVVISNPHATMTQQGNLDSPSGSGVLSSGSSSPLYSKNVDLNQSPLASSPSSAHSAPSNSLTWGTNASSSSAVSKDGLGFQSVSSLHTSCESIDISLSSGGVPSHNSSTGLIASSKDDSLTPFVRTNSVKTTLSESPLSSPAASPKFCRSTLPRKQDSDPHLDRNTLPKKGLRYTPTSQLRTQEDAKEWLRSHSAGGLQDTAANSPFSSGSSVTSPSGTRFNFSQLASPTTVTQMSLSNPTMLRTHSLSNADGQYDPYTDSRFRNSSMSLDEKSRTMSRSGSFRDGFEEVHGSSLSLVSSTSSVYSTPEEKCQSEIRKLRRELDASQEKVSALTTQLTANAHLVAAFEQSLGNMTIRLQSLTMTAEQKDSELNELRKTIELLKKQNAAAQAAINGVINTPELNCKGNGTAQSADLRIRRQHSSDSVSSINSATSHSSVGSNIESDSKKKKRKNWLRSSFKQAFGKKKSPKSASSHSDIEEMTDSSLPSSPKLPHNGSTGSTPLLRNSHSNSLISECMDSEAETVMQLRNELRDKEMKLTDIRLEALSSAHQLDQLREAMNRMQSEIEKLKAENDRLKSESQGSGCSRAPSQVSISASPRQSMGLSQHSLNLTESTSLDMLLDDTGECSARKEGGRHVKIVVSFQEEMKWKEDSRPHLFLIGCIGVSGKTKWDVLDGVVRRLFKEYIIHVDPVSQLGLNSDSVLGYSIGEIKRSNTSETPELLPCGYLVGENTTISVTVKGLAENSLDSLVFESLIPKPILQRYVSLLIEHRRIILSGPSGTGKTYLANRLSEYIVLREGRELTDGVIATFNVDHKSSKELRQYLSNLADQCNSENNAVDMPLVIILDNLHHVSSLGEIFNGLLNCKYHKCPYIIGTMNQATSSTPNLQLHHNFRWVLCANHTEPVKGFLGRFLRRKLMETEISGRVRNMELVKIIDWIPKVWHHLNRFLEAHSSSDVTIGPRLFLSCPIDVDGSRVWFTDLWNYSIIPYLLEAVREGLQLYGRRAPWEDPAKWVMDTYPWAASPQQHEWPPLLQLRPEDVGFDGYSMPREGSTSKQMPPSDAEGDPLMNMLMRLQEAANYSSPQSYDSDSNSNSHHDDILDSSLESTL

SEQ ID NO: 32042 - protein, 2488 aa, Homo sapiens
  ENSP00000379396
MPAILVASKMKSGLPKPVHSAAPILHVPPARAGPQPCYLKLGSKVEVSKTTYPSQIPLKSQVLQGLQEPAGEGLPLRKSGSVENGFDTQIYTDWANHYLAKSGHKRLIRDLQQDVTDGVLLAQIIQVVANEKIEDINGCPKNRSQMIENIDACLNFLAAKGINIQGLSAEEIRNGNLKAILGLFFSLSRYKQQQQQPQKQHLSSPLPPAVSQVAGAPSQCQAGTPQQQVPVTPQAPCQPHQPAPHQQSKAQAEMQSSASSKDSSQSKIIRFTLGQKKISRLPGPTARVSAAGSEAKTRGGSTTANNRRSQSFNNYDKSKPVTSPPPPPSSHEKEPLASSASSHPGMSDNAPASLESGSSSTPTNCSTSSAIPQPGAATKPWRSKSLSVKHSATVSMLSVKPPGPEAPRPTPEAMKPAPNNQKSMLEKLKLFNSKGGSKAGEGPGSRDTSCERLETLPSFEESEELEAASRMLTTVGPASSSPKIALKGIAQRTFSRALTNKKSSLKGNEKEKEKQQREKDKEKSKDLAKRASVTERLDLKEEPKEDPSGAAVPEMPKKSSKIASFIPKGGKLNSAKKEPMAPSHSGIPKPGMKSMPGKSPSAPAPSKEGERSRSGKLSSGLPQQKPQLDGRHSSSSSSLASSEGKGPGGTTLNHSISSQTVSGSVGTTQTTGSNTVSVQLPQPQQQYNHPNTATVAPFLYRSQTDTEGNVTAESSSTGVSVEPSHFTKTGQPALEELTGEDPEARRLRTVKNIADLRQNLEETMSSLRGTQVTHSTLETTFDTNVTTEMSGRSILSLTGRPTPLSWRLGQSSPRLQAGDAPSMGNGYPPRANASRFINTESGRYVYSAPLRRQLASRGSSVCHVDVSDKAGDEMDLEGISMDAPGYMSDGDVLSKNIRTDDITSGYMTDGGLGLYTRRLNRLPDGMAVVRETLQRNTSLGLGDADSWDDSSSVSSGISDTIDNLSTDDINTSSSISSYANTPASSRKNLDVQTDAEKHSQVERNSLWSGDDVKKSDGGSDSGIKMEPGSKWRRNPSDVSDESDKSTSGKKNPVISQTGSWRRGMTAQVGITMPRTKPSAPAGALKTPGTGKTDDAKVSEKGRLSPKASQVKRSPSDAGRSSGDESKKPLPSSSRTPTANANSFGFKKQSGSAAGLAMITASGVTVTSRSATLGKIPKSSALVSRSAGRKSSMDGAQNQDDGYLALSSRTNLQYRSLPRPSKSNSRNGAGNRSSTSSIDSNISSKSAGLPVPKLREPSKTALGSSLPGLVNQTDKEKGISSDNESVASCNSVKVNPAAQPVSSPAQTSLQPGAKYPDVASPTLRRLFGGKPTKQVPIATAENMKNSVVISNPHATMTQQGNLDSPSGSGVLSSGSSSPLYSKNVDLNQSPLASSPSSAHSAPSNSLTWGTNASSSSAVSKDGLGFQSVSSLHTSCESIDISLSSGGVPSHNSSTGLIASSKDDSLTPFVRTNSVKTTLSESPLSSPAASPKFCRSTLPRKQDSDPHLDRNTLPKKGLRYTPTSQLRTQEDAKEWLRSHSAGGLQDTAANSPFSSGSSVTSPSGTRFNFSQLASPTTVTQMSLSNPTMLRTHSLSNADGQYDPYTDSRFRNSSMSLDEKSRTMSRSGSFRDGFEEESWEKSSVDNFVSRLHSSLHFSLPLFHHARYELVHGSSLSLVSSTSSVYSTPEEKCQSEIRKLRRELDASQEKVSALTTQLTANAHLVAAFEQSLGNMTIRLQSLTMTAEQKDSELNELRKTIELLKKQNAAAQAAINGVINTPELNCKGNGTAQSADLRIRRQHSSDSVSSINSATSHSSVGSNIESDSKKKKRKNWVNELRSSFKQAFGKKKSPKSASSHSDIEEMTDSSLPSSPKLPHNGSTGSTPLLRNSHSNSLISECMDSEAETVMQLRNELRDKEMKLTDIRLEALSSAHQLDQLREAMNRMQSEIEKLKAENDRLKSESQGSGCSRAPSQVSISASPRQSMGLSQHSLNLTESTSLDMLLDDTGECSARKEGGRHVKIVVSFQEEMKWKEDSRPHLFLIGCIGVSGKTKWDVLDGVVRRLFKEYIIHVDPVSQLGLNSDSVLGYSIGEIKRSNTSETPELLPCGYLVGENTTISVTVKGLAENSLDSLVFESLIPKPILQRYVSLLIEHRRIILSGPSGTGKTYLANRLSEYIVLREGRELTDGVIATFNVDHKSSKELRQYLSNLADQCNSENNAVDMPLVIILDNLHHVSSLGEIFNGLLNCKYHKCPYIIGTMNQATSSTPNLQLHHNFRWVLCANHTEPVKGFLGRFLRRKLMETEISGRVRNMELVKIIDWIPKVWHHLNRFLEAHSSSDVTIGPRLFLSCPIDVDGSRVWFTDLWNYSIIPYLLEAVREGLQLYGRRAPWEDPAKWVMDTYPWAASPQQHEWPPLLQLRPEDVGFDGYSMPREGSTSKQMPPSDAEGDPLMNMLMRLQEAANYSSPQSYDSDSNSNSHHDDILDSSLESTL

SEQ ID NO: 32043 - protein, 1493 aa, Homo sapiens
  ENSP00000437316
MLWPRNLTSWDDSSSVSSGISDTIDNLSTDDINTSSSISSYANTPASSRKNLDVQTDAEKHSQVERNSLWSGDDVKKSDGGSDSGIKMEPGSKWRRNPSDVSDESDKSTSGKKNPVISQTGSWRRGMTAQVGITMPRTKPSAPAGALKTPGTGKTDDAKVSEKGRLSPKASQVKRSPSDAGRSSGDESKKPLPSSSRTPTANANSFGFKKQSGSAAGLAMITASGVTVTSRSATLGKIPKSSALVSRSAGRKSSMDGAQNQDDGYLALSSRTNLQYRSLPRPSKSNSRNGAGNRSSTSSIDSNISSKSAGLPVPKLREPSKTALGSSLPGLVNQTDKEKGISSDNESVASCNSVKVNPAAQPVSSPAQTSLQPGAKYPDVASPTLRRLFGGKPTKQVPIATAENMKNSVVISNPHATMTQQGNLDSPSGSGVLSSGSSSPLYSKNVDLNQSPLASSPSSAHSAPSNSLTWGTNASSSSAVSKDGLGFQSVSSLHTSCESIDISLSSGGVPSHNSSTGLIASSKDDSLTPFVRTNSVKTTLSESDPHLDRNTLPKKGLRYTPTSQLRTQEDAKEWLRSHSAGGLQDTAANSPFSSGSSVTSPSGTRFNFSQLASPTTVTQMSLSNPTMLRTHSLSNADGQYDPYTDSRFRNSSMSLDEKSRTMSRSGSFRDGFEEVHGSSLSLVSSTSSVYSTPEEKCQSEIRKLRRELDASQEKVSALTTQLTANAHLVAAFEQSLGNMTIRLQSLTMTAEQKDSELNELRKTIELLKKQNAAAQAAINGVINTPELNCKGNGTAQSADLRIRRQHSSDSVSSINSATSHSSVGSNIESDSKKKKRKNWLRSSFKQAFGKKKSPKSASSHSDIEEMTDSSLPSSPKLPHNGSTGSTPLLRNSHSNSLISECMDSEAETVMQLRNELRDKEMKLTDIRLEALSSAHQLDQLREAMNRMQSEIEKLKAENDRLKSESQGSGCSRAPSQVSISASPRQSMGLSQHSLNLTESTSLDMLLDDTGECSARKEGGRHVKIVVSFQEEMKWKEDSRPHLFLIGCIGVSGKTKWDVLDGVVRRLFKEYIIHVDPVSQLGLNSDSVLGYSIGEIKRSNTSETPELLPCGYLVGENTTISVTVKGLAENSLDSLVFESLIPKPILQRYVSLLIEHRRIILSGPSGTGKTYLANRLSEYIVLREGRELTDGVIATFNVDHKSSKELRQYLSNLADQCNSENNAVDMPLVIILDNLHHVSSLGEIFNGLLNCKYHKCPYIIGTMNQATSSTPNLQLHHNFRWVLCANHTEPVKGFLGRFLRRKLMETEISGRVRNMELVKIIDWIPKVWHHLNRFLEAHSSSDVTIGPRLFLSCPIDVDGSRVWFTDLWNYSIIPYLLEAVREGLQLYGRRAPWEDPAKWVMDTYPWAASPQQHEWPPLLQLRPEDVGFDGYSMPREGSTSKQMPPSDAEGDPLMNMLMRLQEAANYSSPQSYDSDSNSNSHHDDILDSSLESTL

SEQ ID NO: 32044 - protein, 815 aa, Homo sapiens
  ENSP00000437136
MLWPRNLTSWDDSSSVSSGISDTIDNLSTDDINTSSSISSYANTPASSRKNLDVQTDAEKHSQVERNSLWSGDDVKKSDGGSDSGIKMEPGSKWRRNPSDVSDESDKSTSGKKNPVISQTGSWRRGMTAQVGITMPRTKPSAPAGALKTPGTGKTDDAKVSEKGRLSPKASQVKRSPSDAGRSSGDESKKPLPSSSRTPTANANSFGFKKQSGSAAGLAMITASGVTVTSRSATLGKIPKSSALVSRSAGRKSSMDGAQNQDDGYLALSSRTNLQYRSLPRPSKSNSRNGAGNRSSTSSIDSNISSKSAGLPVPKLREPSKTALGSSLPGLVNQTDKEKGISSDNESVASCNSVKVNPAAQPVSSPAQTSLQPGAKYPDVASPTLRRLFGGKPTKQVPIATAENMKNSVVISNPHATMTQQGNLDSPSGSGVLSSGSSSPLYSKNVDLNQSPLASSPSSAHSAPSNSLTWGTNASSSSAVSKDGLGFQSVSSLHTSCESIDISLSSGGVPSHNSSTGLIASSKDDSLTPFVRTNSVKTTLSERYTPTSQLRTQEDAKEWLRSHSAGGLQDTAANSPFSSGSSVTSPSGTRFNFSQLASPTTVTQMSLSNPTMLRTHSLSNADGQYDPYTDSRFRNSSMSLDEKSRTMSRSGSFRDGFEEVHGSSLSLVSSTSSVYSTPEEKCQSEIRKLRRELDASQEKVSALTTQLTANAHLVAAFEQSLGNMTIRLQSLTMTAEQKDSELNELRKTIELLKKQNAAAQAAINGVINTPELNCKGNGTAQSADLRIRRQHSSDSVSSINSATSHSSVGSNIESD

SEQ ID NO: 32045 - protein, 160 aa, Homo sapiens
  ENSP00000431276
MLWPRNLTSWDDSSSVSSGISDTIDNLSTDDINTSSSISSYANTPASSRKNLDVQTDAEKHSQVERNSLWSGDDVKKSDGGSDSGIKMEPGSKWRRNPSDVSDESDKSTSGKKNPVISQTGSWRRGMTAQVGITMPRTKPSAPAGALKTPGTGKTDDAKV

SEQ ID NO: 32046 - protein, 2433 aa, Homo sapiens
  ENSP00000443489
MPAILVASKMKSGLPKPVHSAAPILHVPPARAGPQPCYLKLGSKVEVSKTTYPSQIPLKSQVLQGLQEPAGEGLPLRKSGSVENGFDTQIYTDWANHYLAKSGHKRLIRDLQQDVTDGVLLAQIIQVVANEKIEDINGCPKNRSQMIENIDACLNFLAAKGINIQGLSAEEIRNGNLKAILGLFFSLSRYKQQQQQPQKQHLSSPLPPAVSQVAGAPSQCQAGTPQQQVPVTPQAPCQPHQPAPHQQSKAQAEMQSRLPGPTARVSAAGSEAKTRGGSTTANNRRSQSFNNYDKSKPVTSPPPPPSSHEKEPLASSASSHPGMSDNAPASLESGSSSTPTNCSTSSAIPQPGAATKPWRSKSLSVKHSATVSMLSVKPPGPEAPRPTPEAMKPAPNNQKSMLEKLKLFNSKGGSKAGEGPGSRDTSCERLETLPSFEESEELEAASRMLTTVGPASSSPKIALKGIAQRTFSRALTNKKSSLKGNEKEKEKQQREKDKEKSKDLAKRASVTERLDLKEEPKEDPSGAAVPEMPKKSSKIASFIPKGGKLNSAKKEPMAPSHSGIPKPGMKSMPGKSPSAPAPSKEGERSRSGKLSSGLPQQKPQLDGRHSSSSSSLASSEGKGPGGTTLNHSISSQTVSGSVGTTQTTGSNTVSVQLPQPQQQYNHPNTATVAPFLYRSQTDTEGNVTAESSSTGVSVEPSHFTKTGQPALEELTGEDPEARRLRTVKNIADLRQNLEETMSSLRGTQVTHSTLETTFDTNVTTEMSGRSILSLTGRPTPLSWRLGQSSPRLQAGDAPSMGNGYPPRANASRFINTESGRYVYSAPLRRQLASRGSSVCHVDVSDKAGDEMDLEGISMDAPGYMSDGDVLSKNIRTDDITSGYMTDGGLGLYTRRLNRLPDGMAVVRETLQRNTSLGLGDADSWDDSSSVSSGISDTIDNLSTDDINTSSSISSYANTPASSRKNLDVQTDAEKHSQVERNSLWSGDDVKKSDGGSDSGIKMEPGSKWRRNPSDVSDESDKSTSGKKNPVISQTGSWRRGMTAQVGITMPRTKPSAPAGALKTPGTGKTDDAKVSEKGRLSPKASQVKRSPSDAGRSSGDESKKPLPSSSRTPTANANSFGFKKQSGSAAGLAMITASGVTVTSRSATLGKIPKSSALVSRSAGRKSSMDGAQNQDDGYLALSSRTNLQYRSLPRPSKSNSRNGAGNRSSTSSIDSNISSKSAGLPVPKLREPSKTALGSSLPGLVNQTDKEKGISSDNESVASCNSVKVNPAAQPVSSPAQTSLQPGAKYPDVASPTLRRLFGGKPTKQVPIATAENMKNSVVISNPHATMTQQGNLDSPSGSGVLSSGSSSPLYSKNVDLNQSPLASSPSSAHSAPSNSLTWGTNASSSSAVSKDGLGFQSVSSLHTSCESIDISLSSGGVPSHNSSTGLIASSKDDSLTPFVRTNSVKTTLSESPLSSPAASPKFCRSTLPRKQDSDPHLDRNTLPKKGLRYTPTSQLRTQEDAKEWLRSHSAGGLQDTAANSPFSSGSSVTSPSGTRFNFSQLASPTTVTQMSLSNPTMLRTHSLSNADGQYDPYTDSRFRNSSMSLDEKSRTMSRSGSFRDGFEEVHGSSLSLVSSTSSVYSTPEEKCQSEIRKLRRELDASQEKVSALTTQLTANAHLVAAFEQSLGNMTIRLQSLTMTAEQKDSELNELRKTIELLKKQNAAAQAAINGVINTPELNCKGNGTAQSADLRIRRQHSSDSVSSINSATSHSSVGSNIESDSKKKKRKNWVNIQLRSSFKQAFGKKKSPKSASSHSDIEEMTDSSLPSSPKLPHNGSTGSTPLLRNSHSNSLISECMDSEAETVMQLRNELRDKEMKLTDIRLEALSSAHQLDQLREAMNRMQSEIEKLKAENDRLKSESQGSGCSRAPSQVSISASPRQSMGLSQHSLNLTESTSLDMLLDDTGECSARKEGGRHVKIVVSFQEEMKWKEDSRPHLFLIGCIGVSGKTKWDVLDGVVRRLFKEYIIHVDPVSQLGLNSDSVLGYSIGEIKRSNTSETPELLPCGYLVGENTTISVTVKGLAENSLDSLVFESLIPKPILQRYVSLLIEHRRIILSGPSGTGKTYLANRLSEYIVLREGRELTDGVIATFNVDHKSSKELRQYLSNLADQCNSENNAVDMPLVIILDNLHHVSSLGEIFNGLLNCKYHKCPYIIGTMNQATSSTPNLQLHHNFRWVLCANHTEPVKGFLGRFLRRKLMETEISGRVRNMELVKIIDWIPKVWHHLNRFLEAHSSSDVTIGPRLFLSCPIDVDGSRVWFTDLWNYSIIPYLLEAVREGLQLYGRRAPWEDPAKWVMDTYPWAASPQQHEWPPLLQLRPEDVGFDGYSMPREGSTSKQMPPSDAEGDPLMNMLMRLQEAANYSSPQSYDSDSNSNSHHDDILDSSLESTL

SEQ ID NO: 32047 - protein, 2489 aa, Homo sapiens
  ENSP00000435395
MPAILVASKMKSGLPKPVHSAAPILHVPPARAGPQPCYLKLGSKVEVSKTTYPSQIPLKSQVLQGLQEPAGEGLPLRKSGSVENGFDTQIYTDWANHYLAKSGHKRLIRDLQQDVTDGVLLAQIIQVVANEKIEDINGCPKNRSQMIENIDACLNFLAAKGINIQGLSAEEIRNGNLKAILGLFFSLSRYKQQQQQPQKQHLSSPLPPAVSQVAGAPSQCQAGTPQQQVPVTPQAPCQPHQPAPHQQSKAQAEMQSSASSKDSSQSKIIRFTLGQKKISRLPGPTARVSAAGSEAKTRGGSTTANNRRSQSFNNYDKSKPVTSPPPPPSSHEKEPLASSASSHPGMSDNAPASLESGSSSTPTNCSTSSAIPQPGAATKPWRSKSLSVKHSATVSMLSVKPPGPEAPRPTPEAMKPAPNNQKSMLEKLKLFNSKGGSKAGEGPGSRDTSCERLETLPSFEESEELEAASRMLTTVGPASSSPKIALKGIAQRTFSRALTNKKSSLKGNEKEKEKQQREKDKEKSKDLAKRASVTERLDLKEEPKEDPSGAAVPEMPKKSSKIASFIPKGGKLNSAKKEPMAPSHSGIPKPGMKSMPGKSPSAPAPSKEGERSRSGKLSSGLPQQKPQLDGRHSSSSSSLASSEGKGPGGTTLNHSISSQTVSGSVGTTQTTGSNTVSVQLPQPQQQYNHPNTATVAPFLYRSQTDTEGNVTAESSSTGVSVEPSHFTKTGQPALEELTGEDPEARRLRTVKNIADLRQNLEETMSSLRGTQVTHSTLETTFDTNVTTEMSGRSILSLTGRPTPLSWRLGQSSPRLQAGDAPSMGNGYPPRANASRFINTESGRYVYSAPLRRQLASRGSSVCHVDVSDKAGDEMDLEGISMDAPGYMSDGDVLSKNIRTDDITSGYMTDGGLGLYTRRLNRLPDGMAVVRETLQRNTSLGLGDADSWDDSSSVSSGISDTIDNLSTDDINTSSSISSYANTPASSRKNLDVQTDAEKHSQVERNSLWSGDDVKKSDGGSDSGIKMEPGSKWRRNPSDVSDESDKSTSGKKNPVISQTGSWRRGMTAQVGITMPRTKPSAPAGALKTPGTGKTDDAKVSEKGRLSPKASQVKRSPSDAGRSSGDESKKPLPSSSRTPTANANSFGFKKQSGSAAGLAMITASGVTVTSRSATLGKIPKSSALVSRSAGRKSSMDGAQNQDDGYLALSSRTNLQYRSLPRPSKSNSRNGAGNRSSTSSIDSNISSKSAGLPVPKLREPSKTALGSSLPGLVNQTDKEKGISSDNESVASCNSVKVNPAAQPVSSPAQTSLQPGAKYPDVASPTLRRLFGGKPTKQVPIATAENMKNSVVISNPHATMTQQGNLDSPSGSGVLSSGSSSPLYSKNVDLNQSPLASSPSSAHSAPSNSLTWGTNASSSSAVSKDGLGFQSVSSLHTSCESIDISLSSGGVPSHNSSTGLIASSKDDSLTPFVRTNSVKTTLSESPLSSPAASPKFCRSTLPRKQDSDPHLDRNTLPKKGLRYTPTSQLRTQEDAKEWLRSHSAGGLQDTAANSPFSSGSSVTSPSGTRFNFSQLASPTTVTQMSLSNPTMLRTHSLSNADGQYDPYTDSRFRNSSMSLDEKSRTMSRSGSFRDGFEEESWEKSSVDNFVSRLHSSLHFSLPLFHHARYELVHGSSLSLVSSTSSVYSTPEEKCQSEIRKLRRELDASQEKVSALTTQLTANAHLVAAFEQSLGNMTIRLQSLTMTAEQKDSELNELRKTIELLKKQNAAAQAAINGVINTPELNCKGNGTAQSADLRIRRQHSSDSVSSINSATSHSSVGSNIESDSKKKKRKNWVNIQLRSSFKQAFGKKKSPKSASSHSDIEEMTDSSLPSSPKLPHNGSTGSTPLLRNSHSNSLISECMDSEAETVMQLRNELRDKEMKLTDIRLEALSSAHQLDQLREAMNRMQSEIEKLKAENDRLKSESQGSGCSRAPSQVSISASPRQSMGLSQHSLNLTESTSLDMLLDDTGECSARKEGGRHVKIVVSFQEEMKWKEDSRPHLFLIGCIGVSGKTKWDVLDGVVRRLFKEYIIHVDPVSQLGLNSDSVLGYSIGEIKRSNTSETPELLPCGYLVGENTTISVTVKGLAENSLDSLVFESLIPKPILQRYVSLLIEHRRIILSGPSGTGKTYLANRLSEYIVLREGRELTDGVIATFNVDHKSSKELRQYLSNLADQCNSENNAVDMPLVIILDNLHHVSSLGEIFNGLLNCKYHKCPYIIGTMNQATSSTPNLQLHHNFRWVLCANHTEPVKGFLGRFLRRKLMETEISGRVRNMELVKIIDWIPKVWHHLNRFLEAHSSSDVTIGPRLFLSCPIDVDGSRVWFTDLWNYSIIPYLLEAVREGLQLYGRRAPWEDPAKWVMDTYPWAASPQQHEWPPLLQLRPEDVGFDGYSMPREGSTSKQMPPSDAEGDPLMNMLMRLQEAANYSSPQSYDSDSNSNSHHDDILDSSLESTL

SEQ ID NO: 32048 - protein, 193 aa, Homo sapiens [sequence omitted]

SEQ ID NO: 32049 - protein, 193 aa, Homo sapiens [sequence omitted]

SEQ ID NO: 32050 - protein, 193 aa, Homo sapiens [sequence omitted]

SEQ ID NO: 32051 - protein, 194 aa, Homo sapiens
  ENSP00000428781
MGKQNSKLRPEVMQDLLESTDFTEHEIQEWYKGFLRDCPSGHLSMEEFKKIYGNFFPYGDASKFAEHVFRTFDANGDGTIDFREFIIALSVTSRGKLEQKLKWAFSMYDLDGNGYISKAEMLEIVQAIYKMVSSVMKMPEDESTPEKRTEKIFRQMDTNRDASFVVDASWECPEPQCACGEHGQTSWCSLFDDF

SEQ ID NO: 32052 - protein, 152 aa, Homo sapiens
  ENSP00000429466
MGKQNSKLRPEVMQDLLESTDFTEHEIQEWYKGFLRDCPSGHLSMEEFKKIYGNFFPYGDASKFAEHVFRTFDANGDGTIDFREFIIALSVTSRGKLEQKLKWAFSMYDLDGNGYISKAEMLEIVQERKKMAQLFFHRFTLVELICVSLEIK

SEQ ID NO: 32053 - protein, 136 aa, Homo sapiens
  ENSP00000429255
MGKQNSKLRPEVMQDLLESTDFTEHEIQEWYKGFLRDCPSGHLSMEEFKKIYGNFFPYGDASKFAEHVFRTFDANGDGTIDFREFIIALSVTSRGKLEQKLKWAFSMYDLDGNGYISKAEMLEIVQAIYKMVSSVM

SEQ ID NO: 32054 - protein, 121 aa, Homo sapiens
  ENSP00000430731
MGKQNSKLRPEVMQDLLESTDFTEHEIQEWYKGFLRDCPSGHLSMEEFKKIYGNFFPYGDASKFAEHVFRTFDANGDGTIDFREFIIALSVTSRGKLEQKLKWAFSMYDLDGNGYISKAEM

SEQ ID NO: 32055 - protein, 120 aa, Homo sapiens
  ENSP00000430925
MGKQNSKLRPEVMQDLLESTDFTEHEIQEWYKGFLRDCPSGHLSMEEFKKIYGNFFPYGDASKFAEHVFRTFDANGDGTIDFREFIIALSVTSRGKLEQKLKWAFSMYDLDGNGYISKAE

SEQ ID NO: 32056 - protein, 116 aa, Homo sapiens
  ENSP00000429522
MGKQNSKLRPEVMQDLLESTDFTEHEIQEWYKGFLRDCPSGHLSMEEFKKIYGNFFPYGDASKFAEHVFRTFDANGDGTIDFREFIIALSVTSRGKLEQKLKWAFSMYDLDGNGYI

SEQ ID NO: 32057 - protein, 112 aa, Homo sapiens
  ENSP00000428598
MGKQNSKLRPEVMQDLLESTDFTEHEIQEWYKGFLRDCPSGHLSMEEFKKIYGNFFPYGDASKFAEHVFRTFDANGDGTIDFREFIIALSVTSRGKLEQKLKWAFSMYDLDG

SEQ ID NO: 32058 - protein, 111 aa, Homo sapiens
  ENSP00000428312
MGKQNSKLRPEVMQDLLESTDFTEHEIQEWYKGFLRDCPSGHLSMEEFKKIYGNFFPYGDASKFAEHVFRTFDANGDGTIDFREFIIALSVTSRGKLEQKLKWAFSMYDLD

SEQ ID NO: 32059 - protein, 105 aa, Homo sapiens
  ENSP00000429493
MGKQNSKLRPEVMQDLLESTDFTEHEIQEWYKGFLRDCPSGHLSMEEFKKIYGNFFPYGDASKFAEHVFRTFDANGDGTIDFREFIIALSVTSRGKLEQKLKWAF

SEQ ID NO: 32060 - protein, 105 aa, Homo sapiens; identical to SEQ ID NO: 32059
  ENSP00000429245

SEQ ID NO: 32061 - protein, 87 aa, Homo sapiens
  ENSP00000430064
MGKQNSKLRPEVMQDLLESTDFTEHEIQEWYKGFLRDCPSGHLSMEEFKKIYGNFFPYGDASKFAEHVFRTFDANGDGTIDFREFII

SEQ ID NO: 32062 - protein, 85 aa, Homo sapiens
  ENSP00000430534
MGKQNSKLRPEVMQDLLESTDFTEHEIQEWYKGFLRDCPSGHLSMEEFKKIYGNFFPYGDASKFAEHVFRTFDANGDGTIDFREF

SEQ ID NO: 32063 - protein, 81 aa, Homo sapiens
  ENSP00000428193
MGKQNSKLRPEVMQDLLESTDFTEHEIQEWYKGFLRDCPSGHLSMEEFKKIYGNFFPYGDASKFAEHVFRTFDANGDGTID

SEQ ID NO: 32064 - protein, 77 aa, Homo sapiens
  ENSP00000430365
MGKQNSKLRPEVMQDLLESTDFTEHEIQEWYKGFLRDCPSGHLSMEEFKKIYGNFFPYGDASKFAEHVFRTFDANGD

SEQ ID NO: 32065 - protein, 74 aa, Homo sapiens
  ENSP00000428093
MGKQNSKLRPEVMQDLLESTDFTEHEIQEWYKGFLRDCPSGHLSMEEFKKIYGNFFPYGDASKFAEHVFRTFDA

SEQ ID NO: 32066 - protein, 52 aa, Homo sapiens
  ENSP00000429296
MGKQNSKLRPEVMQDLLESTDFTEHEIQEWYKGFLRDCPSGHLSMEEFKKIY

SEQ ID NO: 32067 - protein, 15 aa, Homo sapiens
  ENSP00000430578
MGKQNSKLRPEVMQD

SEQ ID NO: 32068 - protein, 14 aa, Homo sapiens
  ENSP00000429162
MGKQNSKLRPEVMQ

SEQ ID NO: 32069 - protein, 3 aa, Homo sapiens
  ENSP00000429347
MGK

SEQ ID NO: 32070 - protein, 193 aa, Homo sapiens [sequence omitted]

SEQ ID NO: 32071 - protein, 193 aa, Homo sapiens [sequence omitted]

SEQ ID NO: 32072 - protein, 837 aa, Homo sapiens
  ENSP00000383392
MSLLLSFYLLGLLVSSGQALLQVTISLSKVELSVGESKFFTCTAIGEPESIDWYNPQGEKIISTQRVVVQKEGVRSRLTIYNANIEDAGIYRCQATDAKGQTQEATVVLEIYQKLTFREVVSPQEFKQGEDAEVVCRVSSSPAPAVSWLYHNEEVTTISDNRFAMLANNNLQILNINKSDEGIYRCEGRVEARGEIDFRDIIVIVNVPPAISMPQKSFNATAERGEEMTFSCRASGSPEPAISWFRNGKLIEENEKYILKGSNTELTVRNIINSDGGPYVCRATNKAGEDEKQAFLQVFVQPHIIQLKNETTYENGQVTLVCDAEGEPIPEITWKRAVDGFTFTEGDKSLDGRIEVKGQHGSSSLHIKDVKLSDSGRYDCEAASRIGGHQKSMYLDIEYAPKFISNQTIYYSWEGNPINISCDVKSNPPASIHWRRDKLVLPAKNTTNLKTYSTGRKMILEIAPTSDNDFGRYNCTATNHIGTRFQEYILALADVPSSPYGVKIIELSQTTAKVSFNKPDSHGGVPIHHYQVDVKEVASEIWKIVRSHGVQTMVVLNNLEPNTTYEIRVAAVNGKGQGDYSKIEIFQTLPVREPSPPSIHGQPSSGKSFKLSITKQDDGGAPILEYIVKYRSKDKEDQWLEKKVQGNKDHIILEHLQWTMGYEVQITAANRLGYSEPTVYEFSMPPKPNIIKDTLFNGLGLGAVIGLGVAALLLILVVTDVSCFFIRQCGLLMCITRRMCGKKSGSSGKSKELEEGKAAYLKDGSKEPIVEMRTEDERVTNHEDGSPVNEPNETTPLTEPEKLPLKEEDGKEALNPETIEIKVSNDIIQSKEDDSKA

SEQ ID NO: 32073 - protein, 819 aa, Homo sapiens
  ENSP00000284894
ALLQVTISLSKVELSVGESKFFTCTAIGEPESIDWYNPQGEKIISTQRVVVQKEGVRSRLTIYNANIEDAGIYRCQATDAKGQTQEATVVLEIYQKLTFREVVSPQEFKQGEDAEVVCRVSSSPAPAVSWLYHNEEVTTISDNRFAMLANNNLQILNINKSDEGIYRCEGRVEARGEIDFRDIIVIVNVPPAISMPQKSFNATAERGEEMTFSCRASGSPEPAISWFRNGKLIEENEKYILKGSNTELTVRNIINSDGGPYVCRATNKAGEDEKQAFLQVFVQPHIIQLKNETTYENGQVTLVCDAEGEPIPEITWKRAVDGFTFTEGDKSLDGRIEVKGQHGSSSLHIKDVKLSDSGRYDCEAASRIGGHQKSMYLDIEYAPKFISNQTIYYSWEGNPINISCDVKSNPPASIHWRRDKLVLPAKNTTNLKTYSTGRKMILEIAPTSDNDFGRYNCTATNHIGTRFQEYILALADVPSSPYGVKIIELSQTTAKVSFNKPDSHGGVPIHHYQVDVKEVASEIWKIVRSHGVQTMVVLNNLEPNTTYEIRVAAVNGKGQGDYSKIEIFQTLPVREPSPPSIHGQPSSGKSFKLSITKQDDGGAPILEYIVKYRSKDKEDQWLEKKVQGNKDHIILEHLQWTMGYEVQITAANRLGYSEPTVYEFSMPPKPNIIKDTLFNGLGLGAVIGLGVAALLLILVVTDVSCFFIRQCGLLMCITRRMCGKKSGSSGKSKELEEGKAAYLKDGSKEPIVEMRTEDERVTNHEDGSPVNEPNETTPLTEPEKLPLKEEDGKEALNPETIEIKVSNDIIQSKEDDSKA

SEQ ID NO: 32074 - protein, 1321 aa, Homo sapiens
  ENSP00000252575
MGAPFVWALGLLMLQMLLFVAGEQGTQDITDASERGLHMQKLGSGSVQAALAELVALPCLFTLQPRPSAARDAPRIKWTKVRTASGQRQDLPILVAKDNVVRVAKSWQGRVSLPSYPRRRANATLLLGPLRASDSGLYRCQVVRGIEDEQDLVPLEVTGVVFHYRSARDRYALTFAEAQEACRLSSAIIAAPRHLQAAFEDGFDNCDAGWLSDRTVRYPITQSRPGCYGDRSSLPGVRSYGRRNPQELYDVYCFARELGGEVFYVGPARRLTLAGARAQCRRQGAALASVGQLHLAWHEGLDQCDPGWLADGSVRYPIQTPRRRCGGPAPGVRTVYRFANRTGFPSPAERFDAYCFRAHHPTSQHGDLETPSSGDEGEILSAEGPPVRELEPTLEEEEVVTPDFQEPLVSSGEEETLILEEKQESQQTLSPTPGDPMLASWPTGEVWLSTVAPSPSDMGAGTAASSHTEVAPTDPMPRRRGRFKGLNGRYFQQQEPEPGLQGGMEASAQPPTSEAAVNQMEPPLAMAVTEMLGSGQSRSPWADLTNEVDMPGAGSAGGKSSPEPWLWPPTMVPPSISGHSRAPVLELEKAEGPSARPATPDLFWSPLEATVSAPSPAPWEAFPVATSPDLPMMAMLRGPKEWMLPHPTPISTEANRVEAHGEATATAPPSPAAETKVYSLPLSLTPTGQGGEAMPTTPESPRADFRETGETSPAQVNKAEHSSSSPWPSVNRNVAVGFVPTETATEPTGLRGIPGSESGVFDTAESPTSGLQATVDEVQDPWPSVYSKGLDASSPSAPLGSPGVFLVPKVTPNLEPWVATDEGPTVNPMDSTVTPAPSDASGIWEPGSQVFEEAESTTLSPQVALDTSIVTPLTTLEQGDKVGVPAMSTLGSSSSQPHPEPEDQVETQGTSGASVPPHQSSPLGKPAVPPGTPTAASVGESASVSSGEPTVPWDPSSTLLPVTLGIEDFELEVLAGSPGVESFWEEVASGEEPALPGTPMNAGAEEVHSDPCENNPCLHGGTCNANGTMYGCSCDQGFAGENCEIDIDDCLCSPCENGGTCIDEVNGFVCLCLPSYGGSFCEKDTEGCDRGWHKFQGHCYRYFAHRRAWEDAEKDCRRRSGHLTSVHSPEEHSFINSFGHENTWIGLNDRIVERDFQWTDNTGLQFENWRENQPDNFFAGGEDCVVMVAHESGRWNDVPCNYNLPYVCKKGTVLCGPPPAVENASLIGARKAKYNVHATVRYQCNEGFAQHHVATIRCRSNGKWDRPQIVCTKPRRSHRMRRHHHHHQHHHQHHHHKSRKERRKHKKHPTEDWEKDEGNFC

SEQ ID NO: 32075 - protein, 175 aa, Homo sapiens
  ENSP00000465599
  MOD_RES (1)..(1): Any amino acid
XGCDRGWHKFQGHCYRYFAHRRAWEDAEKDCRRRSGHLTSVHSPEEHSFINSFGHENTWIGLNDRIVERDFQWTDNTGLQFENWRENQPDNFFAGGEDCVVMVAHESGRWNDVPCNYNLPYVCKKGTARRSHRMRRHHHHHQHHHQHHHHKSRKERRKHKKHPTEDWEKDEGNFC

SEQ ID NO: 32076 - protein, 440 aa, Homo sapiens
  ENSP00000418571
MSSCRGQKVAGGLRVVSPFPLCQPAGEPSQGKMRSSCVLLTALVALAAYYVYIPLPGSVSDPWKLMLLDATFRGAQQVSNLIHYLGLSHHLLALNFIIVSFGKKSAWSSAQVKVTDTDFDGVEVRVFEGPPKPEEPLKRSVVYIHGGGWALASAKIRYYDELCTAMAEELNAVIVSIEYRLVPKVYFPEQIHDVVRATKYFLKPEVLQKYMVDPGRICISGDSAGGNLAAALGQQFTQDASLKNKLKLQALIYPVLQALDFNTPSYQQNVNTPILPRYVMVKYWVDYFKGNYDFVQAMIVNNHTSLDVEEAAAVRARLNWTSLLPASFTKNYKPVVQTTGNARIVQELPQLLDARSAPLIADQAVLQLLPKTYILTCEHDVLRDDGIMYAKRLESAGVEVTLDHFEDGFHGCMIFTSWPTNFSVGIRTRNSYIKWLDQNL

SEQ ID NO: 32077 - protein, 307 aa, Homo sapiens
  ENSP00000392934
  MOD_RES (1)..(1): Any amino acid
XGGLRVVSPFPLCQPAGEPSQGKMRSSCVLLTALVALAAYYVYIPLPGSVSDPWKLMLLDATFRGAQQVSNLIHYLGLSHHLLALNFIIVSFGKKSAWSSAQVKVTDTDFDGVEVRVFEGPPKPEEPLKRSVVYIHGGGWALASASASWSPSDEIRYYDELCTAMAEELNAVIVSIEYRLVPKVYFPEQIHDVVRATKYFLKPEVLQKYMVDPGRICISGDSAGGNLAAALGQQFTQDASLKNKLKLQALIYPVLQALDFNTPSYQQNVNTPILPRYVMVKYWVDYFKGNYDFVQAMIVNNHTSLDV

SEQ ID NO: 32078 - protein, 93 aa, Homo sapiens
  ENSP00000402196
MSSCRGQKVAGGLRVVSPFPLCQPAGEPSQGKMRSSCVLLTALVALAAYYVYIPLPGSVSDPWKLMLLDATFRGAQQVKSGIMMSCVQQWLRN

SEQ ID NO: 32079 - protein, 448 aa, Homo sapiens
  ENSP00000442464
MSSCRGQKVAGGLRVVSPFPLCQPAGEPSQGKMRSSCVLLTALVALAAYYVYIPLPGSVSDPWKLMLLDATFRGAQQVSNLIHYLGLSHHLLALNFIIVSFGKKSAWSSAQVKVTDTDFDGVEVRVFEGPPKPEEPLKRSVVYIHGGGWALASASASWSPSDEIRYYDELCTAMAEELNAVIVSIEYRLVPKVYFPEQIHDVVRATKYFLKPEVLQKYMVDPGRICISGDSAGGNLAAALGQQFTQDASLKNKLKLQALIYPVLQALDFNTPSYQQNVNTPILPRYVMVKYWVDYFKGNYDFVQAMIVNNHTSLDVEEAAAVRARLNWTSLLPASFTKNYKPVVQTTGNARIVQELPQLLDARSAPLIADQAVLQLLPKTYILTCEHDVLRDDGIMYAKRLESAGVEVTLDHFEDGFHGCMIFTSWPTNFSVGIRTRNSYIKWLDQNL

SEQ ID NO: 32080 - protein, 275 aa, Homo sapiens
  ENSP00000443227
MAEELNAVIVSIEYRLVPKVYFPEQIHDVVRATKYFLKPEVLQKYMVDPGRICISGDSAGGNLAAALGQQFTQDASLKNKLKLQALIYPVLQALDFNTPSYQQNVNTPILPRYVMVKYWVDYFKGNYDFVQAMIVNNHTSLDVEEAAAVRARLNWTSLLPASFTKNYKPVVQTTGNARIVQELPQLLDARSAPLIADQAVLQLLPKTYILTCEHDVLRDDGIMYAKRLESAGVEVTLDHFEDGFHGCMIFTSWPTNFSVGIRTRNSYIKWLDQNL

SEQ ID NO: 32081 - protein, 244 aa, Homo sapiens
  ENSP00000490966
  MOD_RES (1)..(1): Any amino acid
XSNCQMRTLDSGIGTFPLPDSGNRSTGRYLCQPDSPEDAEPLLPLQSALSAVSSMRAQTLEREVPSSTDGQRPADSAIVHSTSDPIMTARGMRPLQSRLPKPASSGKVSSQKQNEAEPRPQTCSSFGYAEDPMASQPLPDWGSEVAATGTQKLRQLEETKDDPENRLSKISLESFNKFNSNTVILLEKEKNSLNKVEGQKEEKEKNEETSLSSSDRPGVDNLESLSDSLYDSFSSCASQGSNDV

SEQ ID NO: 32082 - protein, 1909 aa, Homo sapiens
  ENSP00000387128
MEGKRQLEKRDFGKRLSLDSSLVEYMDSNKYIEHLLTQLEEQHRSLWREKLAVARLQREVAQRTSEGAMHEKLIHELEEERHLRLQSEKRLQEVTLESERNRIQMRSLQQQFSRMEETVRNLLQSQGSPEQKKEETVNIMVYQEKLSEEERKHKEALEDLHMVVDEDSRSESSSTDEGKEKTKLLLERLKALEAENSALALENENQREQYERCLDEVANQVVQALLTQKDLREECVKLKTRVFDLEQQNRTLSILFQQRVRPTSDLLLQKLHSRLLDLSSGDLLSEVERNRSLTQSRTDAEVHEHQLNTKSALKCPGLGAVIPGHLCPRNSYSSSSELSLSSTCSEYSSGSSYTWHDGKNLRKRQSSQNWDKRLSIDSSLPSGFASPTNELPPTRIKESHILEGLRKLQKRKVLLEPPSVITKWGYKDCMNSNEGIYSPGIKSSSLKEYPPCKTADLGSPCKEPHKTFVYDLDSHVDADDDPSTLALLQAVPNQSCRPHGSKLTHSVSDSLFGWETNRKHFLEGTSSVYPKERPEKLTSCASSCPLEMKLCPSVQTPQVQRERGPQGQGHGRMALNLQLSDTDDNETFDELHIESSDEKSPSDVSLAADTDKSVENLDVLVGFGKSLCGSPEEEEKQVPIPSETRPKTFSFIKQQRVVKRTSSEECVTVIFDAEDGEPIEFSSHQTGVVTVTRNEISINSTPAGPKAEHTELLPQGIACLQPRAAARDYTFFKRSEEDTEKNIPKDNVDNVPRVSTESFSSRTVTQNPQQQKLVKPTHNISCQSNSRSSAPMGIYQKQNLTKIPPRGKSSPQKSKLMEPEATTLLPSSGLVTLEKSPALAPGKLSRFMKTESSGPLFELRSDPHIPKHSAQLPHSSRMPSRRDWVQCPKSQTPGSRSRPAIESSDSGEPPTRDEHCGSGPEAGVKSPSPPPPPGRSVSLLARPSYDYSPAPSSTKSETRVPSETARTPFKSPLLKGISAPVISSNPATTEVQRKKPSVAFKKPIFTHPMPSPEAVIQTRCPAHAPSSSFTVMALGPPKVSPKRGVPKTSPRQTLGTPQRDIGLQTPRISPSTHEPLEMTSSKSVSPGRKGQLNDSASTPPKPSFLGVNESPSSQVSSSSSSSSPAKSHNSPHGCQSAHEKGLKTRLPVGLKVLMKSPQLLRKSSTVPGKHEKDSLNEASKSSVAVNKSKPEDSKNPASMEITAGERNVTLPDSQAQGSLADGLPLETALQEPLESSIPGSDGRDGVDNRSMRRSLSSSKPHLKPALGMNGAKARSHSFSTHSGDKPSTPPIEGSGKVRTQIITNTAERGNSLTRQNSSTESSPNKAPSAPMLESLPSVGRPSGHPSSGKGSLGSSGSFSSQHGSPSKLPLRIPPKSEGLLIPPGKEDQQAFTQGECPSANVAVLGEPGSDRRSCPPTPTDCPEALQSPGRTQHPSTFETSSTSKLETSGRHPDASATATDAVSSEAPLSPTIEEKVMLCIQENVEKGQVQTKPTSVEAKQKPGPSFASWFGFRKSRLPALSSRKMDISKTKVEKKDAKVLGFGNRQLKSERKKEKKKPELQCETENELIKDTKSADNPDGGLQSKNNRRTPQDIYNQLKIEPRNRHSPVACSTKDTFMTELLNRVDKKAAPQTESGSSNASCRNVLKGSSQGSCLIGSSISTQGNHKKNMKIKADMEVPKDSLVKEANENLQEDEDDAVADSVFQSHIIESNCQMRTLDSGIGTFPLPDSGNRSTGRYLCQPDSPEDAEPLLPLQSALSAVSSMRAQTLEREVPSSTDGQRPADSAIVHSTSDPIMTARGMRPLQSRLPKPASSGKVSSQKQNEAEPRPQTCSSFGYAEDPMASQPLPDWGSEVAATGTQDKAPRMCTYSASGGSNSDSDLDYGDNGFGAGRGQLVKALKSAAPEIETT

SEQ ID NO: 32083 - protein, 110 aa, Homo sapiens
  ENSP00000492746
  MOD_RES (1)..(1): Any amino acid
XSNCQMRTLDSGIGTFPLPDSGNRSTGRYLCQPDSPEDAEPLLPLQSALSAVSSMRAQTLEREVPSSTDGQRPADSAIVHSTSDPIMTARGMRPLQSRLPKPASSEIETT

SEQ ID NO: 32084 - protein, 590 aa, Homo sapiens
  ENSP00000386952
MEGKRQLEKRDFGKRLSLDSSLVEYMDSNKYIEHLLTQLEEQHRSLWREKLAVARLQREVAQRTSEGAMHEKLIHELEEERHLRLQSEKRLQEVTLESERNRIQMRSLQQQFSRMEETVRNLLQSQGSPEQKKEETVNIMVYQEKLSEEERKHKEALEDLHMVVDEDSRSESSSTDEGKEKTKLLLERLKALEAENSALALENENQREQYERCLDEVANQVVQALLTQKDLREECVKLKTRVFDLEQQNRTLSILFQQRVRPTSDLLLQKLHSRLLDLSSGDLLSEVERNRSLTQSRTDAEVHEHQLNTKSALKCPGLGAVIPGHLCPRNSYSSSSELSLSSTCSEYSSGSSYTWHDGKNLRKRVKEANENLQEDEDDAVADSVFQSHIIESNCQMRTLDSGIGTFPLPDSGNRSTGRYLCQPDSPEDAEPLLPLQSALSAVSSMRAQTLEREVPSSTDGQRPADSAIVHSTSDPIMTARGMRPLQSRLPKPASSGKVSSQKQNEAEPRPQTCSSFGYAEDPMASQPLPDWGSEVAATGTQDKAPRMCTYSASGGSNSDSDLDYGDNGFGAGRGQLVKALKSAAPEIETT

SEQ ID NO: 32085 - protein, 114 aa, Homo sapiens
  ENSP00000399070
  MOD_RES (1)..(1): Any amino acid
XQLEKRDFGKRLSLDSSLVEYMDSNKYIEHLLTQLEEQHRSLWREKLAVARLQREVAQRTSEGAMHEKLIHELEEERHLRLQSEKRLQEVTLESERNRIQMRSLQQQFSRRRKM

SEQ ID NO: 32086 - protein, 69 aa, Homo sapiens
  ENSP00000351882
MEGKRQLEKRDFGKRLSLDSSLVEYMDSNKYIEHLLTQLEEQHRSLWREKLAVARLQREVAQRTSEGAM

SEQ ID NO: 32087 - protein, 1909 aa, Homo sapiens [sequence omitted]

SEQ ID NO: 32088 - protein, 590 aa, Homo sapiens [sequence omitted]

SEQ ID NO: 32089 - protein, 145 aa, Homo sapiens
  ENSP00000462052
MDGEDIPDFSSLKEETAYWKELSLKYKQSFQEARDELVEFQEGSRELEAELEAQLVQAEQRNRDLQADNQRLKYEVEALKEKLEHQYAQSYKQVSVLEDDLSQTRAIKEQLHKYVRELEQANDDLERAKRATIVSLEDFEQRLNQ

SEQ ID NO: 32090 - protein, 76 aa, Homo sapiens
  ENSP00000464154
MDGEDIPDFSSLKEETAYWKELSLKYKQSRRGHLWPVLHALILPHHFGHLEILISCLGLHRTDFTFSSASRKLGMS

SEQ ID NO: 32091 - protein, 158 aa, Homo sapiens
  ENSP00000463430
MDGEDIPDFSSLKEETAYWKELSLKYKQSFQEARDELVEFQEGSRELEAELEAQLVQAEQRNRDLQADNQRLKYEVEALKEKLEHQYAQSYKQVSVLEDDLSQTRAIKEQLHKYVRELEQANDDLERAKRATIVSLEDFEQRLNQAIERNAFLESELD

SEQ ID NO: 32092 - protein, 345 aa, Homo sapiens
  ENSP00000333982
MDGEDIPDFSSLKEETAYWKELSLKYKQSFQEARDELVEFQEGSRELEAELEAQLVQAEQRNRDLQADNQRLKYEVEALKEKLEHQYAQSYKQVSVLEDDLSQTRAIKEQLHKYVRELEQANDDLERAKRATIVSLEDFEQRLNQAIERNAFLESELDEKESLLVSVQRLKDEARDLRQELAVRERQQEVTRKSAPSSPTLDCEKMDSAVQASLSLPATPVGKGTENTFPSPKAIPNGFGTSPLTPSARISALNIVGDLLRKVGALESKLAACRNFAKDQASRKSYISGNVNCGVLNGNGTKFSRSGHTSFFDKGAVNGFDPAPPPPGLGSSRPSSAPGMLPLSV

SEQ ID NO: 32093 - protein, 85 aa, Homo sapiens
  ENSP00000463492
MDGEDIPDFSSLKEETAYWKELSLKYKQSFQEARDELVEFQEGSRELEAELEAQLVQAACSGGYWALPSPGTLRDINTGYFLFSP

SEQ ID NO: 32094 - protein, 269 aa, Homo sapiens
  ENSP00000369364
MDGEDIPDFSSLKEETAYWKELSLKYKQSFQEARDELVEFQEGSRELEAELEAQLVQAEQRNRDLQADNQRLKYEVEALKEKLEHQYAQSYKQVSVLEDDLSQTRAIKEQLHKYVRELEQANDDLERAKRATIVSLEDFEQRLNQAIERNAFLESELDEKESLLVSVQRLKDEARDLRQELAVRERQQEVTRKSAPSSPTLDCEKMDSAVQASLSLPATPVGKGTENTFPSPKAIPNGFGTSPLTPSARISALNIVGDLLRKVGGSKRL

SEQ ID NO: 32095 - protein, 328 aa, Homo sapiens
  ENSP00000384963
MDGEDIPDFSSLKEETAYWKELSLKYKQSFQEARDELVEFQEGSRELEAELEAQLVQAEQRNRDLQADNQRLKYEVEALKEKLEHQYAQSYKQVSVLEDDLSQTRAIKEQLHKYVRELEQANDDLERAKRATIVSLEDFEQRLNQAIERNAFLESELDEKESLLVSVQRLKDEARDLRQELAVRERQQEVTRKSAPSSPTLDCEKMDSAVQASLSLPATPVGKGTENTFPSPKAIPNGFGTSPLTPSARISALNIVGDLLRKVGALESKLAACRNFAKDQASRKSYISGNVNCGVLNGNGTKFSRSGHTSFFDKGQEKVIFPTLFMGQ

SEQ ID NO: 32096 - protein, 33 aa, Homo sapiens
  ENSP00000462458
MDGEDIPDFSSLKEETAYWKELSLKYKQSFQEA

SEQ ID NO: 32097 - protein, 72 aa, Homo sapiens
  ENSP00000462759
MDGEDIPDFSSLKEETAYWKELSLKYKQSFQEARDELVEFQEGSRELEAELEAQLVQAEQRNRDLQADNQRL

SEQ ID NO: 32098 - protein, 59 aa, Homo sapiens
  ENSP00000463351
MDGEDIPDFSSLKEETAYWKELSLKYKQSFQEARDELVEFQEGSRELEAELEAQLVQAE

SEQ ID NO: 32099 - protein, 196 aa, Homo sapiens
  ENSP00000464441
  MOD_RES (1)..(1): Any amino acid
XRNAFLESELDEKESLLVSVQRLKDEARDLRQELAVRERQQEVTRKSAPSSPTLDCEKMDSAVQASLSLPATPVGKGTENTFPSPKAIPNGFGTSPLTPSARISALNIVGDLLRKVGALESKLAACRNFAKDQASRKSYISGNVNCGVLNGNGTKFSRSGHTSFFDKGRAGTTLETLTISESSWDFLPSSIIMAHV

SEQ ID NO: 32100 - protein, 194 aa, Homo sapiens
  ENSP00000464634
  MOD_RES (1)..(1): Any amino acid
XLRQELAVRERQQEVTRKSAPSSPTLDCEKMDSAVQASLSLPATPVGKGTENTFPSPKAIPNGFGTSPLTPSARISALNIVGDLLRKVGALESKLAACRNFAKDQASRKSYISGNVNCGVLNGNGTKFSRSGHTSFFDKGCVLTRMNRILTQSWALRACTPCCGGRTLCPTCLISSRFFSSFCSSLVCRSLSNC

SEQ ID NO: 32101 - protein, 568 aa, Homo sapiens
  ENSP00000369014
MVLLHWCLLWLLFPLSSRTQKLPTRDEELFQMQIRDKAFFHDSSVIPDGAEISSYLFRDTPKRYFFVVEEDNTPLSVTVTPCDAPLEWKLSLQELPEDRSGEGSGDLEPLEQQKQQIINEEGTELFSYKGNDVEYFISSSSPSGLYQLDLLSTEKDTHFKVYATTTPESDQPYPELPYDPRVDVTSLGRTTVTLAWKPSPTASLLKQPIQYCVVINKEHNFKSLCAVEAKLSADDAFMMAPKPGLDFSPFDFAHFGFPSDNSGKERSFQAKPSPKLGRHVYSRPKVDIQKICIGNKNIFTVSDLKPDTQYYFDVFVVNINSNMSTAYVGTFARTKEEAKQKTVELKDGKITDVFVKRKGAKFLRFAPVSSHQKVTFFIHSCLDAVQIQVRRDGKLLLSQNVEGIQQFQLRGKPKAKYLVRLKGNKKGASMLKILATTRPTKQSFPSLPEDTRIKAFDKLRTCSSATVAWLGTQERNKFCIYKKEVDDNYNEDQKKREQNQCLGPDIRKKSEKVLCKYFHSQNLQKAVTTETIKGLQPGKSYLLDVYVIGHGGHSVKYQSKVVKTRKFC

SEQ ID NO: 32102 - protein, 145 aa, Homo sapiens
  ENSP00000423352
MVLLHWCLLWLLFPLSSRTQKLPTRDEELFQMQIRDKAFFHDSSVIPDGAEISSYLFRDTPKRYFFVVEEDNTPLSVTVTPCDAPLEWKLSLQELPEDRSGEGSGDLEPLEQQKQQIINEEGTELFSYKGNDVEYFISSSSPSGL

SEQ ID NO: 32103 - protein, 116 aa, Homo sapiens
  ENSP00000426723
MVLLHWCLLWLLFPLSSRTQKLPTRDEELFQMQIRDKAFFHDSSVIPDGAEISSYLFRDTPKRYFFVVEEDNTPLSVTVTPCDAPLEWKLSLQELPEDRSGEGSGDLEPLEQQKQQ

SEQ ID NO: 32104 - protein, 394 aa, Homo sapiens
  ENSP00000319977
MSREMQDVDLAEVKPLVEKGETITGLLQEFDVQEQDIETLHGSVHVTLCGTPKGNRPVILTYHDIGMNHKTCYNPLFNYEDMQEITQHFAVCHVDAPGQQDGAASFPAGYMYPSMDQLAEMLPGVLQQFGLKSIIGMGTGAGAYILTRFALNNPEMVEGLVLINVNPCAEGWMDWAASKISGWTQALPDMVVSHLFGKEEMQSNVEVVHTYRQHIVNDMNPGNLHLFINAYNSRRDLEIERPMPGTHTVTLQCPALLVVGDSSPAVDAVVECNSKLDPTKTTLLKMADCGGLPQISQPAKLAEAFKYFVQGMGYMPSASMTRLMRSRTASGSSVTSLDGTRSRSHTSEGTRSRSHTSEGTRSRSHTSEGAHLDITPNSGAAGNSAGPKSMEVSC

SEQ ID NO: 32105 - protein, 95 aa, Homo sapiens
  ENSP00000429172
MSREMQDVDLAEVKPLVEKGETITGLLQEFDVQTKPATTPSSTTRTCRRSPSTLPSATWTPLASRTAQPPSPQGTCTPPWISWLKCFLESFNSLG

SEQ ID NO: 32106 - protein, 394 aa, Homo sapiens; identical to SEQ ID NO: 32104
  ENSP00000404854

SEQ ID NO: 32107 - protein, 141 aa, Homo sapiens
  ENSP00000429007
MSREMQDVDLAEVKPLVECNSKLDPTKTTLLKMADCGGLPQISQPAKLAEAFKYFVQGMGYMPSASMTRLMRSRTASGSSVTSLDGTRSRSHTSEGTRSRSHTSEGTRSRSHTSEGAHLDITPNSGAAGNSAGPKSMEVSC

SEQ ID NO: 32108 - protein, 328 aa, Homo sapiens
  ENSP00000427894
MNHKTCYNPLFNYEDMQEITQHFAVCHVDAPGQQDGAASFPAGYMYPSMDQLAEMLPGVLQQFGLKSIIGMGTGAGAYILTRFALNNPEMVEGLVLINVNPCAEGWMDWAASKISGWTQALPDMVVSHLFGKEEMQSNVEVVHTYRQHIVNDMNPGNLHLFINAYNSRRDLEIERPMPGTHTVTLQCPALLVVGDSSPAVDAVVECNSKLDPTKTTLLKMADCGGLPQISQPAKLAEAFKYFVQGMGYMPSASMTRLMRSRTASGSSVTSLDGTRSRSHTSEGTRSRSHTSEGTRSRSHTSEGAHLDITPNSGAAGNSAGPKSMEVSC

SEQ ID NO: 32109 - protein, 103 aa, Homo sapiens
  ENSP00000431057
MSREMQDVDLAEAFKYFVQGMGYMPSASMTRLMRSRTASGSSVTSLDGTRSRSHTSEGTRSRSHTSEGTRSRSHTSEGAHLDITPNSGAAGNSAGPKSMEVSC

SEQ ID NO: 32110 - protein, 216 aa, Homo sapiens
  ENSP00000429380
MSREMQDVDLAEVKPLVEKGETITGLLQEFDVQEQDIETLHGSVHVTLCGTPKGNRPVILTYHDIGMNHKTCYNPLFNYEDMQEITQHFAVCHVDAPGQQDGAASFPAGYMYPSMDQLAEMLPGVLQQFGLKSIIGMGTGAGAYILTRFALNNPEMVEGLVLINVNPCAEGWMDWAASKPFDYQALVLDTVMCAVTSCSPSLDLVALKFLALPVPD

SEQ ID NO: 32111 - protein, 193 aa, Homo sapiens
  ENSP00000428345
MAVPPPGIMKQAGDSRDMSREMQDVDLAEVKPLVEKGETITGLLQEFDVQEQDIETLHGSVHVTLCGTPKGNRPVILTYHDIGMNHKTCYNPLFNYEDMQEITQHFAVCHVDAPGQQDGAASFPAGYMYPSMDQLAEMLPGVLQQFGLKSIIGMGTGAGAYILTRFALNNPEMVEGLVLINVNPCAEGWMDWA

SEQ ID NO: 32112 - protein, 100 aa, Homo sapiens
  ENSP00000428802
MNHKTCYNPLFNYEDMQEITQHFAVCHVDAPGQQDGAASFPAGYMYPSMDQLAEMLPGVLQQFGLKSIIGMGTGAGAYILTRFALNNPEMVEGLVLINVN

SEQ ID NO: 32113 - protein, 165 aa, Homo sapiens
  ENSP00000429994
MSREMQDVDLAEVKPLVEKGETITGLLQEFDVQEQDIETLHGSVHVTLCGTPKGNRPVILTYHDIGMNHKTCYNPLFNYEDMQEITQHFAVCHVDAPGQQDGAASFPAGYMYPSMDQLAEMLPGVLQQFGLKSIIGMGTGAGAYILTRFALNNPEMVEGLVLINV

SEQ ID NO: 32114 - protein, 158 aa, Homo sapiens
  ENSP00000429272
MSREMQDVDLAEVKPLVEKGETITGLLQEFDVQEQDIETLHGSVHVTLCGTPKGNRPVILTYHDIGMNHKTCYNPLFNYEDMQEITQHFAVCHVDAPGQQDGAASFPAGYMYPSMDQLAEMLPGVLQQFGLKSIIGMGTGAGAYILTRFALNNPEMVE

SEQ ID NO: 32115 - protein, 158 aa, Homo sapiens; identical to SEQ ID NO: 32114
  ENSP00000428384

SEQ ID NO: 32116 - protein, 156 aa, Homo sapiens
  ENSP00000429840
MTVPAAGDSRDMSREMQDVDLAEVKPLVEKGETITGLLQEFDVQEQDIETLHGSVHVTLCGTPKGNRPVILTYHDIGMNHKTCYNPLFNYEDMQEITQHFAVCHVDAPGQQDGAASFPAGYMYPSMDQLAEMLPGVLQQFGLKSIIGMGTGAGAYI

SEQ ID NO: 32117 - protein, 133 aa, Homo sapiens
  ENSP00000429524
MSREMQDVDLAEVKPLVEKGETITGLLQEFDVQEQDIETLHGSVHVTLCGTPKGNRPVILTYHDIGMNHKTCYNPLFNYEDMQEITQHFAVCHVDAPGQQDGAASFPAGYMYPSMDQLAEMLPGVLQQFGLKS

SEQ ID NO: 32118 - protein, 167 aa, Homo sapiens
  ENSP00000428991
MSGSRESCTVGCVCVFTRMRVPVCLCVCITNLLLGLTVRLKLALCLYVAGDSRDMSREMQDVDLAEVKPLVEKGETITGLLQEFDVQEQDIETLHGSVHVTLCGTPKGNRPVILTYHDIGMNHKTCYNPLFNYEDMQEITQHFAVCHVDAPGQQDGAASFPAGYMYP

SEQ ID NO: 32119 - protein, 42 aa, Homo sapiens
  ENSP00000430171
MNHKTCYNPLFNYEDMQEITQHFAVCHVDAPGQQDGAASFPA

SEQ ID NO: 32120 - protein, 313 aa, Homo sapiens
  ENSP00000437443
MQEITQHFAVCHVDAPGQQDGAASFPAGYMYPSMDQLAEMLPGVLQQFGLKSIIGMGTGAGAYILTRFALNNPEMVEGLVLINVNPCAEGWMDWAASKISGWTQALPDMVVSHLFGKEEMQSNVEVVHTYRQHIVNDMNPGNLHLFINAYNSRRDLEIERPMPGTHTVTLQCPALLVVGDSSPAVDAVVECNSKLDPTKTTLLKMADCGGLPQISQPAKLAEAFKYFVQGMGYMPSASMTRLMRSRTASGSSVTSLDGTRSRSHTSEGTRSRSHTSEGTRSRSHTSEGAHLDITPNSGAAGNSAGPKSMEVSC

SEQ ID NO: 32121 - protein, 371 aa, Homo sapiens
  ENSP00000298687
MAELQEVQITEEKPLLPGQTPEAAKEAELAARILLDQGQTHSVETPYGSVTFTVYGTPKPKRPAILTYHDVGLNYKSCFQPLFQFEDMQEIIQNFVRVHVDAPGMEEGAPVFPLGYQYPSLDQLADMIPCVLQYLNFSTIIGVGVGAGAYILARYALNHPDTVEGLVLINIDPNAKGWMDWAAHKLTGLTSSIPEMILGHLFSQEELSGNSELIQKYRNIITHAPNLDNIELYWNSYNNRRDLNFERGGDITLRCPVMLVVGDQAPHEDAVVECNSKLDPTQTSFLKMADSGGQPQLTQPGKLTEAFKYFLQGMGYMASSCMTRLSRSRTASLTSAASVDGNRSRSRTLSQSSESGTLSSGPPGHTMEVSC

SEQ ID NO: 32122 - protein, 357 aa, Homo sapiens
  ENSP00000344620
MAELQEVQITEEKPLLPGQTPEAAKTHSVETPYGSVTFTVYGTPKPKRPAILTYHDVGLNYKSCFQPLFQFEDMQEIIQNFVRVHVDAPGMEEGAPVFPLGYQYPSLDQLADMIPCVLQYLNFSTIIGVGVGAGAYILARYALNHPDTVEGLVLINIDPNAKGWMDWAAHKLTGLTSSIPEMILGHLFSQEELSGNSELIQKYRNIITHAPNLDNIELYWNSYNNRRDLNFERGGDITLRCPVMLVVGDQAPHEDAVVECNSKLDPTQTSFLKMADSGGQPQLTQPGKLTEAFKYFLQGMGYMASSCMTRLSRSRTASLTSAASVDGNRSRSRTLSQSSESGTLSSGPPGHTMEVSC

SEQ ID NO: 32123 - protein, 139 aa, Homo sapiens
  ENSP00000450835
PKPKRPAILTYHDVGLNYKSCFQPLFQFEDMQEIIQNFVRVHVDAPGMEEGAPVFPLGYQYPSLDQLADMIPCVLQYLNFSTIIGVGVGAGAYILARYALNHPDTVEGLVLINIDPNAKGWMDWAAHKLSLGWAAWGLA

SEQ ID NO: 32124 - protein, 284 aa, Homo sapiens
  ENSP00000452216
MQEIIQNFVRVHVDAPGMEEGAPVFPLGYQYPSLDQLADMIPCVLQYLNFSTIIGVGVGAGAYILARYALNHPDTVEGLVLINIDPNAKGWMDWAAHKLTGLTSSIPEMILGHLFSQEELSGNSELIQKYRNIITHAPNLDNIELYWNSYNNRRDLNFERGGDITLRCPVMLVVGDQAPHEDAVVECNSKLDPTQTSFLKMADSGGQPQLTQPGKLTEAFKYFLQGMGYMASSCMTRLSRSRTASLTSAASVDGNRSRSRTLSQSSESGTLSSGPPGHTMEVSC

SEQ ID NO: 32125 - protein, 357 aa, Homo sapiens; identical to SEQ ID NO: 32122
  ENSP00000452038

SEQ ID NO: 32126 - protein, 357 aa, Homo sapiens; identical to SEQ ID NO: 32122
  ENSP00000452306

SEQ ID NO: 32127 - protein, 371 aa, Homo sapiens; identical to SEQ ID NO: 32121
  ENSP00000380951

SEQ ID NO: 32128 - protein, 357 aa, Homo sapiens; identical to SEQ ID NO: 32122
  ENSP00000353649

SEQ ID NO: 32129 - protein, 371 aa, Homo sapiens; identical to SEQ ID NO: 32121
  ENSP00000451712

SEQ ID NO: 32130 - protein, 137 aa, Homo sapiens
  ENSP00000450446
MAELQEVQITEEKPLLPGQTPEAAKTHSVETPYGSVTFTVYGTPKPKRPAILTYHDVGLNSTVSVRGHAGNHSELCAGSCGCPWNGRGSPCVPFGISVPISGPACRHDPLRPAVPKFLYNNWSWCWSWSLHPGEICS

SEQ ID NO: 32131 - protein, 357 aa, Homo sapiens; identical to SEQ ID NO: 32122
  ENSP00000452006

SEQ ID NO: 32132 - protein, 371 aa, Homo sapiens; identical to SEQ ID NO: 32121
  ENSP00000380949

SEQ ID NO: 32133 - protein, 360 aa, Homo sapiens
  ENSP00000380945
MAELQEVQITEEKPLLPGQTPEAAKEAELAARILLDQGQTHSVETPYGSVTFTVYGTPKPKRPAILTYHDVGLNYKSCFQPLFQFEDMQEIIQNFVRVHVDAPGMEEGAPVFPLGYQYPSLDQLADMIPCVLQYLNFSTIIGVGVGAGAYILARYALNHPDTVEGLVLINIDPNAKGWMDWAAHKLTGLTSSIPEMILGHLFSQEELSGNSELIQKYRNIITHAPNLDNIELYWNSYNNRRDLNFERGGDITLRCPVMLVVECNSKLDPTQTSFLKMADSGGQPQLTQPGKLTEAFKYFLQGMGYMASSCMTRLSRSRTASLTSAASVDGNRSRSRTLSQSSESGTLSSGPPGHTMEVSC

SEQ ID NO: 32134 - protein, 328 aa, Homo sapiens
  ENSP00000298684
MAELQEVQITEEKPLLPGQTPEAAKTHSVETPYGSVTFTVYGTPKPKRPAILTYHDVGLNYKSCFQPLFQFEDMQEIIQNFVRVHVDAPGMEEGAPVFPLGYQYPSLDQLADMIPCVLQYLNFSTIIGVGVGAGAYILARYALTGLTSSIPEMILGHLFSQEELSGNSELIQKYRNIITHAPNLDNIELYWNSYNNRRDLNFERGGDITLRCPVMLVVGDQAPHEDAVVECNSKLDPTQTSFLKMADSGGQPQLTQPGKLTEAFKYFLQGMGYMASSCMTRLSRSRTASLTSAASVDGNRSRSRTLSQSSESGTLSSGPPGHTMEVSC

SEQ ID NO: 32135 - protein, 341 aa, Homo sapiens
  ENSP00000380943
MAELQEVQITEEKPLLPGQTPEAAKTHSVETPYGSVTFTVYGTPKPKRPAILTYHDVGLNYKSCFQPLFQFEDMQEIIQNFVRVHVDAPGMEEGAPVFPLGYQYPSLDQLADMIPCVLQYLNFSTIIGVGVGAGAYILARYALNHPDTVEGLVLINIDPNAKGWMDWAAHKLTGLTSSIPEMILGHLFSQEELSGNSELIQKYRNIITHAPNLDNIELYWNSYNNRRDLNFERGGDITLRCPVMLVVGDQAPHEDAVMADSGGQPQLTQPGKLTEAFKYFLQGMGYMASSCMTRLSRSRTASLTSAASVDGNRSRSRTLSQSSESGTLSSGPPGHTMEVSC

SEQ ID NO: 32136 - protein, 367 aa, Homo sapiens
  ENSP00000385889
MENGGSMQATMAELQEVQITEEKPLLPGQTPEAAKTHSVETPYGSVTFTVYGTPKPKRPAILTYHDVGLNYKSCFQPLFQFEDMQEIIQNFVRVHVDAPGMEEGAPVFPLGYQYPSLDQLADMIPCVLQYLNFSTIIGVGVGAGAYILARYALNHPDTVEGLVLINIDPNAKGWMDWAAHKLTGLTSSIPEMILGHLFSQEELSGNSELIQKYRNIITHAPNLDNIELYWNSYNNRRDLNFERGGDITLRCPVMLVVGDQAPHEDAVVECNSKLDPTQTSFLKMADSGGQPQLTQPGKLTEAFKYFLQGMGYMASSCMTRLSRSRTASLTSAASVDGNRSRSRTLSQSSESGTLSSGPPGHTMEVSC

SEQ ID NO: 32137 - protein, 287 aa, Homo sapiens
  ENSP00000452117
  MOD_RES (1)..(1): Any amino acid
XTVCWLAGGWVFVFKTLALQQKAGDRLQVSTLTTRANLWLLGPFFFASSKESFSTIIGVGVGAGAYILARYALNHPDTVEGLVLINIDPNAKGWMDWAAHKLTGLTSSIPEMILGHLFSQEELSGNSELIQKYRNIITHAPNLDNIELYWNSYNNRRDLNFERGGDITLRCPVMLVVGDQAPHEDAVVECNSKLDPTQTSFLKMADSGGQPQLTQPGKLTEAFKYFLQGMGYMASSCMTRLSRSRTASLTSAASVDGNRSRSRTLSQSSESGTLSSGPPGHTMEVSC

SEQ ID NO: 32138 - protein, 300 aa, Homo sapiens
  ENSP00000451966
MAELQEVQITEEKPLLPGQTPEAAKTHSVETPYGSVTFTVYGTPKPKRPAILTYHDVGLNYKSCFQPLFQFEDMQEIIQNFVRVHVDAPGMEEGAPVFPLGYQYPSLDQLADMIPCVLQYLNFSTIIGVGVGAGAYILARYALNHPDTVEGLVLINIDPNAKGWMDWAAHKLTGLTSSIPEMILGHLFSQEELSGNSELIQKYRNIITHAPNLDNIELYWNSYNNRRDLNFERGGDITLRCPVMLVVGDQAPHEDAVVECNSKLDPTQTSFLKMADSGGQPQLTQPGKLTEAFKYFLQGM

SEQ ID NO: 32139 - protein, 224 aa, Homo sapiens
  ENSP00000489341
  MOD_RES (1)..(1): Any amino acid
XKSCFQPLFQFEDMQEIIQNFVRVHVDAPGMEEGAPVFPLGYQYPSLDQLADMIPCVLQYLNFSTIIGVGVGAGAYILARYALNHPDTVEGLVLINIDPNAKGWMDWAAHKLTGLTSSIPEMILGHLFSQEELSGNSELIQKYRNIITHAPNLDNIELYWNSYNNRRDLNFERGGDITLRCPVMLVVGDQAPHEDAVTSFLKMADSGGQPQLTQPGKLTEAFKY

SEQ ID NO: 32140 - protein, 218 aa, Homo sapiens
  ENSP00000452413
MQEIIQNFVRVHVDAPGMEEGAPVFPLGYQYPSLDQLADMIPCVLQYLNFSTIIGVGVGAGAYILARYALNHPDTVEGLVLINIDPNAKGWMDWAAHKLTGLTSSIPEMILGHLFSQEELSGNSELIQKYRNIITHAPNLDNIELYWNSYNNRRDLNFERGGDITLRCPVMLVVGDQAPHEDAVVECNSKLDPTQTSFLKMADSGGQPQLTQPGKLTE

SEQ ID NO: 32141 - protein, 273 aa, Homo sapiens
  ENSP00000452362
MAELQEVQITEEKPLLPGQTPEAAKTHSVETPYGSVTFTVYGTPKPKRPAILTYHDVGLNYKSCFQPLFQFEDMQEIIQNFVRVHVDAPGMEEGAPVFPLGYQYPSLDQLADMIPCVLQYLNFSTIIGVGVGAGAYILARYALNHPDTVEGLVLINIDPNAKGWMDWAAHKLTGLTSSIPEMILGHLFSQEELSGNSELIQKYRNIITHAPNLDNIELYWNSYNNRRDLNFERGGDITLRCPVMLVVGDQAPHEDAVVECNSKLDPTQTSFLK

SEQ ID NO: 32142 - protein, 273 aa, Homo sapiens; identical to SEQ ID NO: 32141
  ENSP00000451274

SEQ ID NO: 32143 - protein, 252 aa, Homo sapiens
  ENSP00000450691
MAELQEVQITEEKPLLPGQTPEAAKEAELAARILLDQGQTHSVETPYGSVTFTVYGTPKPKRPAILTYHDVGLNYKSCFQPLFQFEDMQEIIQNFVRVHVDAPGMEEGAPVFPLGYQYPSLDQLADMIPCVLQYLNFSTIIGVGVGAGAYILARYALNHPDTVEGLVLINIDPNAKGWMDWAAHKLTGLTSSIPEMILGHLFSQEELSGNSELIQKYRNIITHAPNLDNIELYWNSYNNRRDLNFERGGDIT

SEQ ID NO: 32144 - protein, 181 aa, Homo sapiens
  ENSP00000397250
THSVETPYGSVTFTVYGTPKPKRPAILTYHDVGLNYKSCFQPLFQFEDMQEIIQNFVRVHVDAPGMEEGAPVFPLGYQYPSLDQLADMIPCVLQYLNFSTIIGVGVGAGAYILARYALNHPDTVEGLTSSIPEMILGHLFSQEELSGNSELIQKYRNIITHAPNLDNIELYWNSYNNRRDL

SEQ ID NO: 32145 - protein, 224 aa, Homo sapiens
  ENSP00000452334
MAELQEVQITEEKPLLPGQTPEAAKTHSVETPYGSVTFTVYGTPKPKRPAILTYHDVGLNYKSCFQPLFQFEDMQEIIQNFVRVHVDAPGMEEGAPVFPLGYQYPSLDQLADMIPCVLQYLNFSTIIGVGVGAGAYILARYALNHPDTVEGLVLINIDPNAKGWMDWAAHKLTGLTSSIPEMILGHLFSQEELSGNSELIQKYRNIITHAPNLDNIELYWNSYN

SEQ ID NO: 32146 - protein, 136 aa, Homo sapiens
  ENSP00000451353
MAELQEVQITEEKPLLPGQTPEAAKEAELAARILLDQGQTHSVETPYGSVTFTVYGTPKPKRPAILTYHDVGLNYKSCFQPLFQFEDMQEIIQNFVRVHVDAPGMEEGAPVFPLGYQYPSLDQLADMIPCVLQYLK

SEQ ID NO: 32147 - protein, 221 aa, Homo sapiens
  ENSP00000451105
MAELQEVQITEEKPLLPGQTPEAAKTHSVETPYGSVTFTVYGTPKPKRPAILTYHDVGLNYKSCFQPLFQFEDMQEIIQNFVRVHVDAPGMEEGAPVFPLGYQYPSLDQLADMIPCVLQYLNFSTIIGVGVGAGAYILARYALNHPDTVEGLVLINIDPNAKGWMDWAAHKLTGLTSSIPEMILGHLFSQEELSGNSELIQKYRNIITHAPNLDNIELYWN

SEQ ID NO: 32148 - protein, 173 aa, Homo sapiens
  ENSP00000450545
MAELQEVQITEEKPLLPGQTPEAAKPLFQFEDMQEIIQNFVRVHVDAPGMEEGAPVFPLGYQYPSLDQLADMIPCVLQYLNFSTIIGVGVGAGAYILARYALNHPDTVEGLVLINIDPNAKGWMDWAAHKLTGLTSSIPEMILGHLFSQEELSGNSELIQKYRNIITHAPNLD

SEQ ID NO: 32149 - protein, 219 aa, Homo sapiens
  ENSP00000452482
MAELQEVQITEEKPLLPGQTPEAAKEAELAARILLDQGQTHSVETPYGSVTFTVYGTPKPKRPAILTYHDVGLNYKSCFQPLFQFEDMQEIIQNFVRVHVDAPGMEEGAPVFPLGYQYPSLDQLADMIPCVLQYLNFSTIIGVGVGAGAYILARYALNHPDTVEGLVLINIDPNAKGWMDWAAHKLTGLTSSIPEMILGHLFSQEELSGNSELIQKYRN

SEQ ID NO: 32150 - protein, 194 aa, Homo sapiens
  ENSP00000451094
MAELQEVQITEEKPLLPGQTPEAAKEAELAARILLDQGQTHSVETPYGSVTFTVYGTPKPKRPAILTYHDVGLNYKSCFQPLFQFEDMQEIIQNFVRVHVDAPGMEEGAPVFPLGYQYPSLDQLADMIPCVLQYLNFSTIIGVGVGAGAYILARYALNHPDTVEGLVLINIDPNAKGWMDWAAHKLTGLTSSIP

SEQ ID NO: 32151 - protein, 174 aa, Homo sapiens
  ENSP00000452278
MAELQEVQITEEKPLLPGQTPEAAKTHSVETPYGSVTFTVYGTPKPKRPAILTYHDVGLNYKSCFQPLFQFEDMQEIIQNFVRVHVDAPGMEEGAPVFPLGYQYPSLDQLADMIPCVLQYLNFSTIIGVGVGAGAYILARYALNHPDTVEGLVLINIDPNAKGWMDWAAHKLTG

SEQ ID NO: 32152 - protein, 167 aa, Homo sapiens
  ENSP00000450493
MAELQEVQITEEKPLLPGQTPEAAKTHSVETPYGSVTFTVYGTPKPKRPAILTYHDVGLNYKSCFQPLFQFEDMQEIIQNFVRVHVDAPGMEEGAPVFPLGYQYPSLDQLADMIPCVLQYLNFSTIIGVGVGAGAYILARYALNHPDTVEGLVLINIDPNAKGWMDW

SEQ ID NO: 32153 - protein, 160 aa, Homo sapiens
  ENSP00000451951
MAELQEVQITEEKPLLPGQTPEAAKTHSVETPYGSVTFTVYGTPKPKRPAILTYHDVGLNYKSCFQPLFQFEDMQEIIQNFVRVHVDAPGMEEGAPVFPLGYQYPSLDQLADMIPCVLQYLNFSTIIGVGVGAGAYILARYALNHPDTVEGLVLINIDPN

SEQ ID NO: 32154 - protein, 172 aa, Homo sapiens
  ENSP00000451059
MAELQEVQITEEKPLLPGQTPEAAKEAELAARILLDQGQTHSVETPYGSVTFTVYGTPKPKRPAILTYHDVGLNYKSCFQPLFQFEDMQEIIQNFVRVHVDAPGMEEGAPVFPLGYQYPSLDQLADMIPCVLQYLNFSTIIGVGVGAGAYILARYALNHPDTVEGLVLINID

SEQ ID NO: 32155 - protein, 153 aa, Homo sapiens
  ENSP00000452592
MAELQEVQITEEKPLLPGQTPEAAKTHSVETPYGSVTFTVYGTPKPKRPAILTYHDVGLNYKSCFQPLFQFEDMQEIIQNFVRVHVDAPGMEEGAPVFPLGYQYPSLDQLADMIPCVLQYLNFSTIIGVGVGAGAYILARYALNHPDTVEGLV

SEQ ID NO: 32156 - protein, 153 aa, Homo sapiens; identical to SEQ ID NO: 32155
  ENSP00000450513

SEQ ID NO: 32157 - protein, 77 aa, Homo sapiens
  ENSP00000452053
MAELQEVQITEEKPLLPGQTPEAAKINLASSHCFSSRTCRKSFRTLCGFMWMPLEWKREPLCSLWDISTHLWTSLQT

SEQ ID NO: 32158 - protein, 154 aa, Homo sapiens
  ENSP00000451302
MVMCFCVNPCVSLQEAELAARILLDQGQTHSVETPYGSVTFTVYGTPKPKRPAILTYHDVGLNYKSCFQPLFQFEDMQEIIQNFVRVHVDAPGMEEGAPVFPLGYQYPSLDQLADMIPCVLQYLNFSTIIGVGVGAGAYILARYALNHPDTVEG

SEQ ID NO: 32159 - protein, 150 aa, Homo sapiens
  ENSP00000451471
MAELQEVQITEEKPLLPGQTPEAAKTHSVETPYGSVTFTVYGTPKPKRPAILTYHDVGLNYKSCFQPLFQFEDMQEIIQNFVRVHVDAPGMEEGAPVFPLGYQYPSLDQLADMIPCVLQYLNFSTIIGVGVGAGAYILARYALNHPDTVE

SEQ ID NO: 32160 - protein, 149 aa, Homo sapiens
  ENSP00000452548
MAELQEVQITEEKPLLPGQTPEAAKTHSVETPYGSVTFTVYGTPKPKRPAILTYHDVGLNYKSCFQPLFQFEDMQEIIQNFVRVHVDAPGMEEGAPVFPLGYQYPSLDQLADMIPCVLQYLNFSTIIGVGVGAGAYILARYALNHPDTV

SEQ ID NO: 32161 - protein, 144 aa, Homo sapiens
  ENSP00000450504
MAELQEVQITEEKPLLPGQTPEAAKTHSVETPYGSVTFTVYGTPKPKRPAILTYHDVGLNYKSCFQPLFQFEDMQEIIQNFVRVHVDAPGMEEGAPVFPLGYQYPSLDQLADMIPCVLQYLNFSTIIGVGVGAGAYILARYALN

SEQ ID NO: 32162 - protein, 142 aa, Homo sapiens
  ENSP00000452262
MAELQEVQITEEKPLLPGQTPEAAKTHSVETPYGSVTFTVYGTPKPKRPAILTYHDVGLNYKSCFQPLFQFEDMQEIIQNFVRVHVDAPGMEEGAPVFPLGYQYPSLDQLADMIPCVLQYLNFSTIIGVGVGAGAYILARYA

SEQ ID NO: 32163 - protein, 122 aa, Homo sapiens
  ENSP00000450929
MAELQEVQITEEKPLLPGQTPEAAKTHSVETPYGSVTFTVYGTPKPKRPAILTYHDVGLNYKSCFQPLFQFEDMQEIIQNFVRVHVDAPGMEEGAPVFPLGYQYPSLDQLADMIPCVLQYLK

SEQ ID NO: 32164 - protein, 149 aa, Homo sapiens
  ENSP00000451185
MAELQEVQITEEKPLLPGQTPEAAKEAELAARILLDQGQTHSVETPYGSVTFTVYGTPKPKRPAILTYHDVGLNYKSCFQPLFQFEDMQEIIQNFVRVHVDAPGMEEGAPVFPLGYQYPSLDQLADMIPCVLQYLNFSTIIGVGVGAGA

SEQ ID NO: 32165 - protein, 148 aa, Homo sapiens
  ENSP00000451348
MAELQEVQITEEKPLLPGQTPEAAKEAELAARILLDQGQTHSVETPYGSVTFTVYGTPKPKRPAILTYHDVGLNYKSCFQPLFQFEDMQEIIQNFVRVHVDAPGMEEGAPVFPLGYQYPSLDQLADMIPCVLQYLNFSTIIGVGVGAG

SEQ ID NO: 32166 - protein, 133 aa, Homo sapiens
  ENSP00000451472
MAELQEVQITEEKPLLPGQTPEAAKTHSVETPYGSVTFTVYGTPKPKRPAILTYHDVGLNYKSCFQPLFQFEDMQEIIQNFVRVHVDAPGMEEGAPVFPLGYQYPSLDQLADMIPCVLQYLNFSTIIGVGVGA

SEQ ID NO: 32167 - protein, 127 aa, Homo sapiens
  ENSP00000452247
MAELQEVQITEEKPLLPGQTPEAAKTHSVETPYGSVTFTVYGTPKPKRPAILTYHDVGLNYKSCFQPLFQFEDMQEIIQNFVRVHVDAPGMEEGAPVFPLGYQYPSLDQLADMIPCVLQYLNFSTII

SEQ ID NO: 32168 - protein, 122 aa, Homo sapiens; identical to SEQ ID NO: 32163
  ENSP00000451414

SEQ ID NO: 32169 - protein, 127 aa, Homo sapiens; identical to SEQ ID NO: 32167
  ENSP00000452344

SEQ ID NO: 32170 - protein, 141 aa, Homo sapiens
  ENSP00000450852
MAELQEVQITEEKPLLPGQTPEAAKEAELAARILLDQGQTHSVETPYGSVTFTVYGTPKPKRPAILTYHDVGLNYKSCFQPLFQFEDMQEIIQNFVRVHVDAPGMEEGAPVFPLGYQYPSLDQLADMIPCVLQYLNFSTII

SEQ ID NO: 32171 - protein, 140 aa, Homo sapiens
  ENSP00000451981
MAELQEVQITEEKPLLPGQTPEAAKEAELAARILLDQGQTHSVETPYGSVTFTVYGTPKPKRPAILTYHDVGLNYKSCFQPLFQFEDMQEIIQNFVRVHVDAPGMEEGAPVFPLGYQYPSLDQLADMIPCVLQYLNFSTI

SEQ ID NO: 32172 - protein, 120 aa, Homo sapiens
  ENSP00000451163
MAELQEVQITEEKPLLPGQTPEAAKTHSVETPYGSVTFTVYGTPKPKRPAILTYHDVGLNYKSCFQPLFQFEDMQEIIQNFVRVHVDAPGMEEGAPVFPLGYQYPSLDQLADMIPCVLQY

SEQ ID NO: 32173 - protein, 129 aa, Homo sapiens
  ENSP00000452179
MAELQEVQITEEKPLLPGQTPEAAKEAELAARILLDQGQTHSVETPYGSVTFTVYGTPKPKRPAILTYHDVGLNYKSCFQPLFQFEDMQEIIQNFVRVHVDAPGMEEGAPVFPLGYQYPSLDQLADMIP

SEQ ID NO: 32174 - protein, 108 aa, Homo sapiens
  ENSP00000451541
MAELQEVQITEEKPLLPGQTPEAAKTHSVETPYGSVTFTVYGTPKPKRPAILTYHDVGLNSTVSVRGHAGNHSELCAGSCGCPWNGRGSPCVPFGISVPISGPACRHD

SEQ ID NO: 32175 - protein, 108 aa, Homo sapiens
  ENSP00000452302
MAELQEVQITEEKPLLPGQTPEAAKTHSVETPYGSVTFTVYGTPKPKRPAILTYHDVGLNYKSCFQPLFQFEDMQEIIQNFVRVHVDAPGMEEGAPVFPLGYQYPSLD

SEQ ID NO: 32176 - protein, 118 aa, Homo sapiens
  ENSP00000450825
MAELQEVQITEEKPLLPGQTPEAAKEAELAARILLDQGQTHSVETPYGSVTFTVYGTPKPKRPAILTYHDVGLNYKSCFQPLFQFEDMQEIIQNFVRVHVDAPGMEEGAPVFPLGYQY

SEQ ID NO: 32177 - protein, 92 aa, Homo sapiens
  ENSP00000450450
MAELQEVQITEEKPLLPGQTPEAAKTHSVETPYGSVTFTVYGTPKPKRPAILTYHDVGLNYKSCFQPLFQFEDMQEIIQNFVRVHVDAPGME

SEQ ID NO: 32178 - protein, 99 aa, Homo sapiens
  ENSP00000452458
MAELQEVQITEEKPLLPGQTPEAAKEAELAARILLDQGQTHSVETPYGSVTFTVYGTPKPKRPAILTYHDVGLNYKSCFQPLFQFEDMQEIIQNFVRVH

SEQ ID NO: 32179 - protein, 86 aa, Homo sapiens
  ENSP00000452274
MAELQEVQITEEKPLLPGQTPEAAKEAELAARILLDQGQTHSVETPYGSVTFTVYGTPKPKRPAILTYHDVGLNYKSCFQPLFQFE

SEQ ID NO: 32180 - protein, 371 aa, Homo sapiens; identical to SEQ ID NO: 32121
  ENSP00000380956

SEQ ID NO: 32181 - protein, 356 aa, Homo sapiens [sequence omitted]

SEQ ID NO: 32182 - protein, 873 aa, Homo sapiens
  ENSP00000296499
MSFIMKLHRHFQRTVILLATFCMVSIIISAYYLYSGYKQENELSETASEVDCGDLQHLPYQLMEVKAMKLFDASRTDPTVLVFVESQYSSLGQDIIMILESSRFQYHIEIAPGKGDLPVLIDKMKGKYILIIYENILKYINMDSWNRSLLDKYCVEYGVGVIGFHKTSEKSVQSFQLKGFPFSIYGNLAVKDCCINPHSPLIRVTKSSKLEKGSLPGTDWTVFQINHSAYQPVIFAKVKTPENLSPSISKGAFYATIIHDLGLHDGIQRVLFGNNLNFWLHKLIFIDAISFLSGKRLTLSLDRYILVDIDDIFVGKEGTRMNTNDVKALLDTQNLLRAQITNFTFNLGFSGKFYHTGTEEEDEGDDCLLGSVDEFWWFPHMWSHMQPHLFHNESSLVEQMILNKKFALEHGIPTDMGYAVAPHHSGVYPVHVQLYEAWKKVWNIKITSTEEYPHLKPARYRRGFIHKNIMVLPRQTCGLFTHTIFYKEYPGGPKELDKSIQGGELFFTVVLNPISIFMTHLSNYGNDRLGLYTFVNLANFVKSWTNLRLQTLPPVQLAHKYFELFPDQKDPLWQNPCDDKRHRDIWSKEKTCDRLPKFLVIGPQKTGTTALYLFLVMHPSILSNSPSPKTFEEVQFFNRNNYHRGIDWYMDFFPVPSNVTTDFLFEKSANYFHSEEAPKRAASLVPKAKIITILIDPSDRAYSWYQHQRSHEDPAALKFSFYEVISAGPRAPSELRALQKRCLVPGWYASHIERWLVYFPPFQLLIIDGQQLRTDPATVMDEVQKFLGVLPHYNYSEALTFDSHKGFWCQLLEEGKTKCLGKSKGRKYPPMDSDSRTFLSSYYRDHNVELSKLLHKLGQPLPSWLRQELQKVR

SEQ ID NO: 32183 - protein, 872 aa, Homo sapiens
  ENSP00000264363
MNLIVKLRRSFRTLIVLLATFCLVSIVISAYFLYSGYKQEMTLIETTAEAECTDIKILPYRSMELKTVKPIDTSKTDPTVLLFVESQYSQLGQDIIAILESSRFQYHMVIAPGKGDIPPLTDNGKGKYTLVIYENILKYVSMDSWNRELLEKYCVEYSVSIIGFHKANENSLPSTQLKGFPLNLFNNLALKDCFVNPQSPLLHITKAPKVEKGPLPGEDWTIFQYNHSTYQPVLLTELQTEKSLSSLSSKTLFATVIQDLGLHDGIQRVLFGNNLNFWLHKLIFIDAISFLSGKRLTLSLDRYILVDIDDIFVGKEGTRMNVKDVKALLETQNLLRTQVANFTFNLGFSGKFYHTGTEEEDEGDDLLLRSVDEFWWFPHMWSHMQPHLFHNESSLVEQMILNKEFALEHGIPINMGYAVAPHHSGVYPVHIQLYAAWKKVWGIQVTSTEEYPHLKPARYRKGFIHNSIMVLPRQTCGLFTHTIFYKEYPGGPQELDKSIRGGELFLTILLNPISIFMTHLSNYGNDRLGLYTFVNLVNFVQSWTNLKLQTLPPVQLAHQYFELFPEQKDPLWQNPCDDKRHKDIWSREKTCDHLPKFLVIGPQKTGTTALYLFLLMHPSIISNLPSPKTFEEVQFFNGNNYHKGIDWYMDFFPTPSNTTSDFLFEKSANYFHSEEAPRRAASLVPKAKIITILIDPSDRAYSWYQHQRSHEDPAALRFNFYEVISTGHWAPSDLKTLQRRCLVPGWYAVHIERWLTYFATSQLLIIDGQQLRSDPATVMDEVQKFLGVTPRYNYSEALTFDPQKGFWCQLLEGGKTKCLGKSKGRKYPPMDPESRTFLSNYYRDHNVELSKLLHRLGQPLPSWLRQELQKVR

SEQ ID NO: 32184 - protein, 369 aa, Homo sapiens
  ENSP00000423218
MWSHMQPHLFHNESSLVEQMILNKEFALEHGIPINMGYAVAPHHSGVYPVHIQLYAAWKKVWGIQVTSTEEYPHLKPARYRKGFIHNSIMVLPRQTCGLFTHTIFYKEYPGGPQELDKSIRGGELFLTILLNPISIFMTHLSNYGNDRLGLYTFVNLVNFVQSWTNLKLQTLPPVQLAHQYFELFPEQKDPLWQNPCDDKRHKDIWSREKTCDHLPKFLVIGPQKTGTTALYLFLLMHPSIISNLPSPKTFEEVQFFNGNNYHKGIDWYMDFFPTPSNTTSDFLFEKSANYFHSEEAPRRAASLVPKAKIITILIDPSDRAYSWYQVGVQWRDLGSLQPSPPRFMPFSCLSLLSSWDYSTNDHMKIQLL

SEQ ID NO: 32185 - protein, 369 aa, Homo sapiens; identical to SEQ ID NO: 32184
  ENSP00000483949

SEQ ID NO: 32186 - protein, 351 aa, Homo sapiens
  ENSP00000387380
MEDSQETSPSSNNSSEELSSALHLSKGMSIFLDILRRADKNDDGKLSFEEFKAYFADGVLSGEELHELFHTIDTHNTNNLDTEELCEYFSQHLGEYENVLAALEDLNLSILKAMGKTKKDYQEASNLEQFVTRFLLKETLNQLQSLQNSLECAMETTEEQTRQERQGPAKPEVLSIQWPGKRSSRRVQRHNSFSPNSPQFNVSGPGLLEEDNQWMTQINRLQKLIDRLEKKDLKLEPPEEEIIEGNTKSHIMLVQRQMSVIEEDLEEFQLALKHYVESASSQSGCLRISIQKLSNESRYMIYEFWENSSVWNSHLQTNYSKTFQRSNVDFLETPELTSTMLVPASWWILNN

SEQ ID NO: 32187 - protein, 100 aa, Homo sapiens
  ENSP00000428953
MLVQRQMSVIEEDLEEFQLALKHYVESASSQSGCLRISIQKLSNESRYMIYEFWENSSVWNSHLQTNYSKTFQRSNVDFLETPELTSTMLVPASWWILNN

SEQ ID NO: 32188 - protein, 100 aa, Homo sapiens; identical to SEQ ID NO: 32187
  ENSP00000428632

SEQ ID NO: 32189 - protein, 17 aa, Homo sapiens
  ENSP00000418691
MESTTTSFPNETATIIS

SEQ ID NO: 32190 - protein, 130 aa, Homo sapiens
  ENSP00000418327
MACSLGGALAGPIIVEPHVTAVWGKNVSLKCLIEVNETITQISWEKIHGKSSQTVAVHHPQYGFSVQGEYQGRVLFKNYSLNDATITLHNIGFSDSGKYICKAVTFPLGNAQSSTTVTVLVEPTVSLIKG

SEQ ID NO: 32191 - protein, 549 aa, Homo sapiens
  ENSP00000418070
MARTLRPSPLCPGGGKAQLSSASLLGAGLLLQPPTPPPLLLLLFPLLLFSRLCGALAGPIIVEPHVTAVWGKNVSLKCLIEVNETITQISWEKIHGKSSQTVAVHHPQYGFSVQGEYQGRVLFKNYSLNDATITLHNIGFSDSGKYICKAVTFPLGNAQSSTTVTVLVEPTVSLIKGPDSLIDGGNETVAAICIAATGKPVAHIDWEGDLGEMESTTTSFPNETATIISQYKLFPTRFARGRRITCVVKHPALEKDIRYSFILDIQYAPEVSVTGYDGNWFVGRKGVNLKCNADANPPPFKSVWSRLDGQWPDGLLASDNTLHFVHPLTFNYSGVYICKVTNSLGQRSDQKVIYISDPPTTTTLQPTIQWHPSTADIEDLATEPKKLPFPLSTLATIKDDTIATIIASVVGGALFIVLVSVLAGIFCYRRRRTFRGDYFAKNYIPPSDMQKESQIDVLQQDELDSYPDSVKKENKNPVNNLIRKDYLEEPEKTQWNNVENLNRFERPMDYYEDLKMGMKFVSDEHYDENEDDLVSHVDGSVISRREWYV

SEQ ID NO: 32192 - protein, 366 aa, Homo sapiens
  ENSP00000321514
MARTLRPSPLCPGGGKAQLSSASLLGAGLLLQPPTPPPLLLLLFPLLLFSRLCGALAGPIIVEPHVTAVWGKNVSLKCLIEVNETITQISWEKIHGKSSQTVAVHHPQYGFSVQGEYQGRVLFKNYSLNDATITLHNIGFSDSGKYICKAVTFPLGNAQSSTTVTVLVEPTVSLIKGPDSLIDGGNETVAAICIAATGKPVAHIDWEGDLGEMESTTTSFPNETATIISQYKLFPTRFARGRRITCVVKHPALEKDIRYSFILDIQYAPEVSVTGYDGNWFVGRKGVNLKCNADANPPPFKSVWSRLDGQWPDGLLASDNTLHFVHPLTFNYSGVYICKVTNSLGQRSDQKVIYISAYNSVASLNC

SEQ ID NO: 32193 - protein, 244 aa, Homo sapiens
  ENSP00000417572
  MOD_RES (1)..(1): Any amino acid
XARTLRPSPLCPGGGKAQLSSASLLGAGLLLQPPTPPPLLLLLFPLLLFSRLCGALAGPIIVEPHVTAVWGKNVSLKCLIEVNETITQISWEKIHGKSSQTVAVHHPQYGFSVQGEYQGRVLFKNYSLNDATITLHNIGFSDSGKYICKAVTFPLGNAQSSTTVTVLDAPEVSVTGYDGNWFVGRKGVNLKCNADANPPPFKSVWSRLDGQWPDGLLASDNTLHFVHPLTFNYSGVYICKVTNS

SEQ ID NO: 32194 - protein, 487 aa, Homo sapiens
  ENSP00000420579
MAEGWRWCFVRRTPGLLRGPLLPRSFSGNPRALAGPIIVEPHVTAVWGKNVSLKCLIEVNETITQISWEKIHGKSSQTVAVHHPQYGFSVQGEYQGRVLFKNYSLNDATITLHNIGFSDSGKYICKAVTFPLGNAQSSTTVTVLVEPTVSLIKGPDSLIDGGNETVAAICIAATGKPVAHIDWEGDLGEMESTTTSFPNETATIISQYKLFPTRFARGRRITCVVKHPALEKDIRYSFILDIQYAPEVSVTGYDGNWFVGRKGVNLKCNADANPPPFKSVWSRLDGQWPDGLLASDNTLHFVHPLTFNYSGVYICKVTNSLGQRSDQKVIYISDVPFKQTSSIAVAGAVIGAVLALFIIAIFVTVLLTPRKKRPSYLDKVIDLPPTHKPPPLYEERSPPLPQKDLFQPEHLPLQTQFKEREVGNLQHSNGLNSRSFDYEDENPVGEDGIQQMYPLYNQMCYQDRSPGKHHQNNDPKRVYIDPREHYV

SEQ ID NO: 32195 - protein, 168 aa, Homo sapiens
  ENSP00000420479
MEAKFSSIWHPGDCFSCKTIDCPPFILLNKLSREDLLHCALAGPIIVEPHVTAVWGKNVSLKCLIEVNETITQISWEKIHGKSSQTVAVHHPQYGFSVQGEYQGRVLFKNYSLNDATITLHNIGFSDSGKYICKAVTFPLGNAQSSTTVTVLVEPTVSLIKGPDSLID

SEQ ID NO: 32196 - protein, 31 aa, Homo sapiens
  ENSP00000419829
PEHLPLQTQFKEREVGNLQHSTYYNPGTKTH

SEQ ID NO: 32197 - protein, 910 aa, Homo sapiens
  ENSP00000422455
  MOD_RES (1)..(1): Any amino acid
XNGDCKPEMSEIKLNSDSEYIKLMHRTSACLPSSQNVDCQININGELERPHSQMNKNHGILRRSISLGGAYPNISCLSSLKHNCSKGGPSQLLIKFASGNEGKVDNLSRDSNRDCTNELSNSCKTENPRLERPYTFKDFVLHPRSHKSRVKGYLRLKMTYLPKTSGSEDDNAEQAEELEPGWVVLDQPDAACHLQQQQEPSPLPPGWEERQDILGRTYYVNHESRRTQWKRPTPQDNLTDAENGNIQLQAQRAFTTRRQISEETESVDNRESSENWEIIREDEATMYSNQAFPSPPPSSNLDVPTHLAEELNARLTIFGNSAVSQPASSSNHSSRRGSLQAYTFEEQPTLPVLLPTSSGLPPGWEEKQDERGRSYYVDHNSRTTTWTKPTVQATVETSQLTSSQSSAGPQSQASTSDSGQQVTQPSEIEQGFLPKGWEVRHAPNGRPFFIDHNTKTTTWEDPRLKIPAHLRGKTSLDTSNDLGPLPPGWEERTHTDGRIFYINHNIKRTQWEDPRLENVAITGPAVPYSRDYKRKYEFFRRKLKKQNDIPNKFEMKLRRATVLEDSYRRIMGVKRADFLKARLWIEFDGEKGLDYGGVAREWFFLISKEMFNPYYGLFEYSATDNYTLQINPNSGLCNEDHLSYFKFIGRVAGMAVYHGKLLDGFFIRPFYKMMLHKPITLHDMESVDSEYYNSLRWILENDPTELDLRFIIDEELFGQTHQHELKNGGSEIVVTNKNKKEYIYLVIQWRFVNRIQKQMAAFKEGFFELIPQDLIKIFDENELELLMCGLGDVDVNDWREHTKYKNGYSANHQVIQWFWKAVLMMDSEKRIRLLQFVTGTSRVPMNGFAELYGSNGPQSFTVEQWGTPEKLPRAHTCFNRLDLPPYESFEELWDKLQMAIENTQGFDGVD

SEQ ID NO: 32198 - protein, 401 aa, Homo sapiens
  ENSP00000426051
  MOD_RES (1)..(1): Any amino acid
XIYSSAVVDNELNAVNDGHLVSSPAICSGSLSNFSTSDNGSYSSNGSDFGSCASITSGGSYTNSVISDSSSYTFPPSDDTFLGGNLPSDSTSNRSVPNRNTTPCEIFSRSTSTDPFVQDDLEHGLEIMKLPVSRNTKIPLKRYSSLVIFPRSPSTTRPTSPTSLCTLLSKGSYQTSHQFIISPSEIAHNEDGTSAKGFLSTAVNGLRLSKTICTPGEVRDIRPLHRKGSLQKKIVLSNNTPRQTVCEKSSEGYSCVSVHFTQRKAATLDCETTNGDCKPEMSEIKLNSDSEYIKLMHRTSACLPSSQNVDCQININGELERPHSQMNKNHGILRRSISLGGAYPNISCLSSLKHNCSKGGPSQLLIKFASGNEGKVDNLSRDSNRDCTNELSNSCKSQIKS

SEQ ID NO: 32199 - protein, 1247 aa, Homo sapiens
  ENSP00000345530
MAQSLRLHFAARRSNTYPLSETSGDDLDSHVHMCFKRPTRISTSNVVQMKLTPRQTALAPLIKENVQSQERSSVPSSENVNKKSSCLQISLQPTRYSGYLQSSNVLADSDDASFTCILKDGIYSSAVVDNELNAVNDGHLVSSPAICSGSLSNFSTSDNGSYSSNGSDFGSCASITSGGSYTNSVISDSSSYTFPPSDDTFLGGNLPSDSTSNRSVPNRNTTPCEIFSRSTSTDPFVQDDLEHGLEIMKLPVSRNTKIPLKRYSSLVIFPRSPSTTRPTSPTSLCTLLSKGSYQTSHQFIISPSEIAHNEDGTSAKGFLSTAVNGLRLSKTICTPGEVRDIRPLHRKGSLQKKIVLSNNTPRQTVCEKSSEGYSCVSVHFTQRKAATLDCETTNGDCKPEMSEIKLNSDSEYIKLMHRTSACLPSSQNVDCQININGELERPHSQMNKNHGILRRSISLGGAYPNISCLSSLKHNCSKGGPSQLLIKFASGNEGKVDNLSRDSNRDCTNELSNSCKPGWVVLDQPDAACHLQQQQEPSPLPPGWEERQDILGRTYYVNHESRRTQWKRPTPQDNLTDAENGNIQLQAQRAFTTRRQISEETESVDNRESSENWEIIREDEATMYSNQAFPSPPPSSNLDVPTHLAEELNARLTIFGNSAVSQPASSSNHSSRRGSLQAYTFEEQPTLPVLLPTSSGLPPGWEEKQDERGRSYYVDHNSRTTTWTKPTVQATVETSQLTSSQSSAGPQSQASTSDSGQQVTQPSEIEQGFLPKGWEVRHAPNGRPFFIDHNTKTTTWEDPRLKIPAHLRGKTSLDTSNDLGPLPPGWEERTHTDGRIFYINHNIKRTQWEDPRLENVAITGPAVPYSRDYKRKYEFFRRKLKKQNDIPNKFEMKLRRATVLEDSYRRIMGVKRADFLKARLWIEFDGEKGLDYGGVAREWFFLISKEMFNPYYGLFEYSATDNYTLQINPNSGLCNEDHLSYFKFIGRVAGMAVYHGKLLDGFFIRPFYKMMLHKPITLHDMESVDSEYYNSLRWILENDPTELDLRFIIDEELFGQTHQHELKNGGSEIVVTNKNKKEYIYLVIQWRFVNRIQKQMAAFKEGFFELIPQDLIKIFDENELELLMCGLGDVDVNDWREHTKYKNGYSANHQVIQWFWKAVLMMDSEKRIRLLQFVTGTSRVPMNGFAELYGSNGPQSFTVEQWGTPEKLPRAHTCFNRLDLPPYESFEELWDKLQMAIENTQGFDGVD

SEQ ID NO: 32200 - protein, 1319 aa, Homo sapiens
  ENSP00000424827
MAQSLRLHFAARRSNTYPLSETSGDDLDSHVHMCFKRPTRISTSNVVQMKLTPRQTALAPLIKENVQSQERSSVPSSENVNKKSSCLQISLQPTRYSGYLQSSNVLADSDDASFTCILKDGIYSSAVVDNELNAVNDGHLVSSPAICSGSLSNFSTSDNGSYSSNGSDFGSCASITSGGSYTNSVISDSSSYTFPPSDDTFLGGNLPSDSTSNRSVPNRNTTPCEIFSRSTSTDPFVQDDLEHGLEIMKLPVSRNTKIPLKRYSSLVIFPRSPSTTRPTSPTSLCTLLSKGSYQTSHQFIISPSEIAHNEDGTSAKGFLSTAVNGLRLSKTICTPGEVRDIRPLHRKGSLQKKIVLSNNTPRQTVCEKSSEGYSCVSVHFTQRKAATLDCETTNGDCKPEMSEIKLNSDSEYIKLMHRTSACLPSSQNVDCQININGELERPHSQMNKNHGILRRSISLGGAYPNISCLSSLKHNCSKGGPSQLLIKFASGNEGKVDNLSRDSNRDCTNELSNSCKTRDDFLGQVDVPLYPLPTENPRLERPYTFKDFVLHPRSHKSRVKGYLRLKMTYLPKTSGSEDDNAEQAEELEPGWVVLDQPDAACHLQQQQEPSPLPPGWEERQDILGRTYYVNHESRRTQWKRPTPQDNLTDAENGNIQLQAQRAFTTRRQISEETESVDNRESSENWEIIREDEATMYSNQAFPSPPPSSNLDVPTHLAEELNARLTIFGNSAVSQPASSSNHSSRRGSLQAYTFEEQPTLPVLLPTSSGLPPGWEEKQDERGRSYYVDHNSRTTTWTKPTVQATVETSQLTSSQSSAGPQSQASTSDSGQQVTQPSEIEQGFLPKGWEVRHAPNGRPFFIDHNTKTTTWEDPRLKIPAHLRGKTSLDTSNDLGPLPPGWEERTHTDGRIFYINHNIKRTQWEDPRLENVAITGPAVPYSRDYKRKYEFFRRKLKKQNDIPNKFEMKLRRATVLEDSYRRIMGVKRADFLKARLWIEFDGEKGLDYGGVAREWFFLISKEMFNPYYGLFEYSATDNYTLQINPNSGLCNEDHLSYFKFIGRVAGMAVYHGKLLDGFFIRPFYKMMLHKPITLHDMESVDSEYYNSLRWILENDPTELDLRFIIDEELFGQTHQHELKNGGSEIVVTNKNKKEYIYLVIQWRFVNRIQKQMAAFKEGFFELIPQDLIKIFDENELELLMCGLGDVDVNDWREHTKYKNGYSANHQVIQWFWKAVLMMDSEKRIRLLQFVTGTSRVPMNGFAELYGSNGPQSFTVEQWGTPEKLPRAHTCFNRLDLPPYESFEELWDKLQMAIENTQGFDGVD

SEQ ID NO: 32201 - protein, 900 aa, Homo sapiens
  ENSP00000410613
MATCAVEVFGLLEDEENSRIVRVRVIAGIGLAKKDILGASDPYVRVTLYDPMNGVLTSVQTKTIKKSLNPKWNEEILFRVHPQQHRLLFEVFDENRLTRDDFLGQVDVPLYPLPTENPRLERPYTFKDFVLHPRSHKSRVKGYLRLKMTYLPKTSGSEDDNAEQAEELEPGWVVLDQPDAACHLQQQQEPSPLPPGWEERQDILGRTYYVNHESRRTQWKRPTPQDNLTDAENGNIQLQAQRAFTTRRQISEETESVDNRESSENWEIIREDEATMYSNQAFPSPPPSSNLDVPTHLAEELNARLTIFGNSAVSQPASSSNHSSRRGSLQAYTFEEQPTLPVLLPTSSGLPPGWEEKQDERGRSYYVDHNSRTTTWTKPTVQATVETSQLTSSQSSAGPQSQASTSDSGQQVTQPSEIEQGFLPKGWEVRHAPNGRPFFIDHNTKTTTWEDPRLKIPAHLRGKTSLDTSNDLGPLPPGWEERTHTDGRIFYINHNIKRTQWEDPRLENVAITGPAVPYSRDYKRKYEFFRRKLKKQNDIPNKFEMKLRRATVLEDSYRRIMGVKRADFLKARLWIEFDGEKGLDYGGVAREWFFLISKEMFNPYYGLFEYSATDNYTLQINPNSGLCNEDHLSYFKFIGRVAGMAVYHGKLLDGFFIRPFYKMMLHKPITLHDMESVDSEYYNSLRWILENDPTELDLRFIIDEELFGQTHQHELKNGGSEIVVTNKNKKEYIYLVIQWRFVNRIQKQMAAFKEGFFELIPQDLIKIFDENELELLMCGLGDVDVNDWREHTKYKNGYSANHQVIQWFWKAVLMMDSEKRIRLLQFVTGTSRVPMNGFAELYGSNGPQSFTVEQWGTPEKLPRAHTCFNRLDLPPYESFEELWDKLQMAIENTQGFDGVD

SEQ ID NO: 32202 - protein, 1303 aa, Homo sapiens
  ENSP00000422705
MAQSLRLHFAARRSNTYPLSETSGDDLDSHVHMCFKRPTRISTSNVVQMKLTPRQTALAPLIKENVQSQERSSVPSSENVNKKSSCLQISLQPTRYSGYLQSSNVLADSDDASFTCILKDGIYSSAVVDNELNAVNDGHLVSSPAICSGSLSNFSTSDNGSYSSNGSDFGSCASITSGGSYTNSVISDSSSYTFPPSDDTFLGGNLPSDSTSNRSVPNRNTTPCEIFSRSTSTDPFVQDDLEHGLEIMKLPVSRNTKIPLKRYSSLVIFPRSPSTTRPTSPTSLCTLLSKGSYQTSHQFIISPSEIAHNEDGTSAKGFLSTAVNGLRLSKTICTPGEVRDIRPLHRKGSLQKKIVLSNNTPRQTVCEKSSEGYSCVSVHFTQRKAATLDCETTNGDCKPEMSEIKLNSDSEYIKLMHRTSACLPSSQNVDCQININGELERPHSQMNKNHGILRRSISLGGAYPNISCLSSLKHNCSKGGPSQLLIKFASGNEGKVDNLSRDSNRDCTNELSNSCKTRDDFLGQVDVPLYPLPTENPRLERPYTFKDFVLHPRSHKSRVKGYLRLKMTYLPKTSGSEDDNAEQAEELEQQQEPSPLPPGWEERQDILGRTYYVNHESRRTQWKRPTPQDNLTDAENGNIQLQAQRAFTTRRQISEETESVDNRESSENWEIIREDEATMYSNQAFPSPPPSSNLDVPTHLAEELNARLTIFGNSAVSQPASSSNHSSRRGSLQAYTFEEQPTLPVLLPTSSGLPPGWEEKQDERGRSYYVDHNSRTTTWTKPTVQATVETSQLTSSQSSAGPQSQASTSDSGQQVTQPSEIEQGFLPKGWEVRHAPNGRPFFIDHNTKTTTWEDPRLKIPAHLRGKTSLDTSNDLGPLPPGWEERTHTDGRIFYINHNIKRTQWEDPRLENVAITGPAVPYSRDYKRKYEFFRRKLKKQNDIPNKFEMKLRRATVLEDSYRRIMGVKRADFLKARLWIEFDGEKGLDYGGVAREWFFLISKEMFNPYYGLFEYSATDNYTLQINPNSGLCNEDHLSYFKFIGRVAGMAVYHGKLLDGFFIRPFYKMMLHKPITLHDMESVDSEYYNSLRWILENDPTELDLRFIIDEELFGQTHQHELKNGGSEIVVTNKNKKEYIYLVIQWRFVNRIQKQMAAFKEGFFELIPQDLIKIFDENELELLMCGLGDVDVNDWREHTKYKNGYSANHQVIQWFWKAVLMMDSEKRIRLLQFVTGTSRVPMNGFAELYGSNGPQSFTVEQWGTPEKLPRAHTCFNRLDLPPYESFEELWDKLQMAIENTQGFDGVD

SEQ ID NO: 32203 - protein, 39 aa, Homo sapiens
  ENSP00000424471
  MOD_RES (1)..(1): Any amino acid
XCAVEVFGLLEDEENSRIVRVRVIAGIGLAKKDILGARV

SEQ ID NO: 32204 - protein, 35 aa, Homo sapiens
  ENSP00000421047
  MOD_RES (1)..(1): Any amino acid
XWNEEILFRVHPQQHRLLFEVFDENRLPWLVTNQE

SEQ ID NO: 32205 - protein, 911 aa, Homo sapiens
  ENSP00000348847
MATGLGEPVYGLSEDEGESRILRVKVVSGIDLAKKDIFGASDPYVKLSLYVADENRELALVQTKTIKKTLNPKWNEEFYFRVNPSNHRLLFEVFDENRLTRDDFLGQVDVPLSHLPTEDPTMERPYTFKDFLLRPRSHKSRVKGFLRLKMAYMPKNGGQDEENSDQRDDMEHGWEVVDSNDSASQHQEELPPPPLPPGWEEKVDNLGRTYYVNHNNRTTQWHRPSLMDVSSESDNNIRQINQEAAHRRFRSRRHISEDLEPEPSEGGDVPEPWETISEEVNIAGDSLGLALPPPPASPGSRTSPQELSEELSRRLQITPDSNGEQFSSLIQREPSSRLRSCSVTDAVAEQGHLPPLAEDGASGSATNSNNHLIEPQIRRPRSLSSPTVTLSAPLEGAKDSPVRRAVKDTLSNPQSPQPSPYNSPKPQHKVTQSFLPPGWEMRIAPNGRPFFIDHNTKTTTWEDPRLKFPVHMRSKTSLNPNDLGPLPPGWEERIHLDGRTFYIDHNSKITQWEDPRLQNPAITGPAVPYSREFKQKYDYFRKKLKKPADIPNRFEMKLHRNNIFEESYRRIMSVKRPDVLKARLWIEFESEKGLDYGGVAREWFFLLSKEMFNPYYGLFEYSATDNYTLQINPNSGLCNEDHLSYFTFIGRVAGLAVFHGKLLDGFFIRPFYKMMLGKQITLNDMESVDSEYYNSLKWILENDPTELDLMFCIDEENFGQTYQVDLKPNGSEIMVTNENKREYIDLVIQWRFVNRVQKQMNAFLEGFTELLPIDLIKIFDENELELLMCGLGDVDVNDWRQHSIYKNGYCPNHPVIQWFWKAVLLMDAEKRIRLLQFVTGTSRVPMNGFAELYGSNGPQLFTIEQWGSPEKLPRAHTCFNRLDLPPYETFEDLREKLLMAVENAQGFEGVD

SEQ ID NO: 32206 - protein, 975 aa, Homo sapiens
  ENSP00000383199
MATGLGEPVYGLSEDEGESRILRVKVVSGIDLAKKDIFGASDPYVKLSLYVADENRELALVQTKTIKKTLNPKWNEEFYFRVNPSNHRLLFEVFDENRLTRDDFLGQVDVPLSHLPTEDPTMERPYTFKDFLLRPRSHKSRVKGFLRLKMAYMPKNGGQDEENSDQRDDMEHGWEVVDSNDSASQHQEELPPPPLPPGWEEKVDNLGRTYYVNHNNRTTQWHRPSLMDVSSESDNNIRQINQEAAHRRFRSRRHISEDLEPEPSEGGDVPEPWETISEEVNIAGDSLGLALPPPPASPGSRTSPQELSEELSRRLQITPDSNGEQFSSLIQREPSSRLRSCSVTDAVAEQGHLPPPSAPAGRARSSTVTGGEEPTPSVAYVHTTPGLPSGWEERKDAKGRTYYVNHNNRTTTWTRPIMQLAEDGASGSATNSNNHLIEPQIRRPRSLSSPTVTLSAPLEGAKDSPVRRAVKDTLSNPQSPQPSPYNSPKPQHKVTQSFLPPGWEMRIAPNGRPFFIDHNTKTTTWEDPRLKFPVHMRSKTSLNPNDLGPLPPGWEERIHLDGRTFYIDHNSKITQWEDPRLQNPAITGPAVPYSREFKQKYDYFRKKLKKPADIPNRFEMKLHRNNIFEESYRRIMSVKRPDVLKARLWIEFESEKGLDYGGVAREWFFLLSKEMFNPYYGLFEYSATDNYTLQINPNSGLCNEDHLSYFTFIGRVAGLAVFHGKLLDGFFIRPFYKMMLGKQITLNDMESVDSEYYNSLKWILENDPTELDLMFCIDEENFGQTYQVDLKPNGSEIMVTNENKREYIDLVIQWRFVNRVQKQMNAFLEGFTELLPIDLIKIFDENELELLMCGLGDVDVNDWRQHSIYKNGYCPNHPVIQWFWKAVLLMDAEKRIRLLQFVTGTSRVPMNGFAELYGSNGPQLFTIEQWGSPEKLPRAHTCFNRLDLPPYETFEDLREKLLMAVENAQGFEGVD

SEQ ID NO: 32207 - protein, 106 aa, Homo sapiens
  ENSP00000465669
MATGLGEPVYGLSEDEAVLLMDAEKRIRLLQFVTGTSRVPMNGFAELYGSNGPQLFTIEQWGSPEKLPRAHTCFNRLDLPPYETFEDLREKLLMAVENAQGFEGVD

SEQ ID NO: 32208 - protein, 20 aa, Homo sapiens
  ENSP00000479462
MATGLGEPVYGLSEDEPGSP

SEQ ID NO: 32209 - protein, 955 aa, Homo sapiens
  ENSP00000372301
MATGLGEPVYGLSEDEGESRILRVKVVSGIDLAKKDIFGASDPYVKLSLYVADENRELALVQTKTIKKTLNPKWNEEFYFRVNPSNHRLLFEVFDENRLTRDDFLGQVDVPLSHLPTEDPTMERPYTFKDFLLRPRSHKSRVKGFLRLKMAYMPKNGGQDEENSDQRDDMEHGWEVVDSNDSASQHQEELPPPPLPPGWEEKVDNLGRTYYVNHNNRTTQWHRPSLMDVSSESDNNIRQINQEAAHRRFRSRRHISEDLEPEPSEGGDVPEPWETISEEVNIAGDSLGLALPPPPASPGSRTSPQELSEELSRRLQITPDSNGEQFSSLIQREPSSRLRSCSVTDAVAEQGHLPPPSVAYVHTTPGLPSGWEERKDAKGRTYYVNHNNRTTTWTRPIMQLAEDGASGSATNSNNHLIEPQIRRPRSLSSPTVTLSAPLEGAKDSPVRRAVKDTLSNPQSPQPSPYNSPKPQHKVTQSFLPPGWEMRIAPNGRPFFIDHNTKTTTWEDPRLKFPVHMRSKTSLNPNDLGPLPPGWEERIHLDGRTFYIDHNSKITQWEDPRLQNPAITGPAVPYSREFKQKYDYFRKKLKKPADIPNRFEMKLHRNNIFEESYRRIMSVKRPDVLKARLWIEFESEKGLDYGGVAREWFFLLSKEMFNPYYGLFEYSATDNYTLQINPNSGLCNEDHLSYFTFIGRVAGLAVFHGKLLDGFFIRPFYKMMLGKQITLNDMESVDSEYYNSLKWILENDPTELDLMFCIDEENFGQTYQVDLKPNGSEIMVTNENKREYIDLVIQWRFVNRVQKQMNAFLEGFTELLPIDLIKIFDENELELLMCGLGDVDVNDWRQHSIYKNGYCPNHPVIQWFWKAVLLMDAEKRIRLLQFVTGTSRVPMNGFAELYGSNGPQLFTIEQWGSPEKLPRAHTCFNRLDLPPYETFEDLREKLLMAVENAQGFEGVD

SEQ ID NO: 32210 - protein, 871 aa, Homo sapiens
  ENSP00000256830
MATGLGEPVYGLSEDEGESRILRVKVVSGIDLAKKDIFGASDPYVKLSLYVADENRELALVQTKTIKKTLNPKWNEEFYFRVNPSNHRLLFEVFDENRLTRDDFLGQVDVPLSHLPTEDPTMERPYTFKDFLLRPRSHKSRVKGFLRLKMAYMPKNGGQDEENSDQRDDMEHGWEVVDSNDSASQHQEELPPPPLPPGWEEKVDNLGRTYYVNHNNRTTQWHRPSLMDVSSESDNNIRQINQEAAHRRFRSRRHISEDLEPEPSEGGDVPEPWETISEEVNIAGDSLGLALPPPPASPGSRTSPQELSEELSRRLQITPDSNGEQFSSLIQREPSSRLRSCSVTDAVAEQGHLPPGAKDSPVRRAVKDTLSNPQSPQPSPYNSPKPQHKVTQSFLPPGWEMRIAPNGRPFFIDHNTKTTTWEDPRLKFPVHMRSKTSLNPNDLGPLPPGWEERIHLDGRTFYIDHNSKITQWEDPRLQNPAITGPAVPYSREFKQKYDYFRKKLKKPADIPNRFEMKLHRNNIFEESYRRIMSVKRPDVLKARLWIEFESEKGLDYGGVAREWFFLLSKEMFNPYYGLFEYSATDNYTLQINPNSGLCNEDHLSYFTFIGRVAGLAVFHGKLLDGFFIRPFYKMMLGKQITLNDMESVDSEYYNSLKWILENDPTELDLMFCIDEENFGQTYQVDLKPNGSEIMVTNENKREYIDLVIQWRFVNRVQKQMNAFLEGFTELLPIDLIKIFDENELELLMCGLGDVDVNDWRQHSIYKNGYCPNHPVIQWFWKAVLLMDAEKRIRLLQFVTGTSRVPMNGFAELYGSNGPQLFTIEQWGSPEKLPRAHTCFNRLDLPPYETFEDLREKLLMAVENAQGFEGVD

SEQ ID NO: 32211 - protein, 10 aa, Homo sapiens
  ENSP00000466776
MERPYTFKDF

SEQ ID NO: 32212 - protein, 834 aa, Homo sapiens
  ENSP00000393395
MERPYTFKDFLLRPRSHKSRVKGFLRLKMAYMPKNGGQDEENSDQRDDMEHGWEVVDSNDSASQHQEELPPPPLPPGWEEKVDNLGRTYYVNHNNRTTQWHRPSLMDVSSESDNNIRQINQEAAHRRFRSRRHISEDLEPEPSEGGDVPEPWETISEEVNIAGDSLGLALPPPPASPGSRTSPQELSEELSRRLQITPDSNGEQFSSLIQREPSSRLRSCSVTDAVAEQGHLPPPSVAYVHTTPGLPSGWEERKDAKGRTYYVNHNNRTTTWTRPIMQLAEDGASGSATNSNNHLIEPQIRRPRSLSSPTVTLSAPLEGAKDSPVRRAVKDTLSNPQSPQPSPYNSPKPQHKVTQSFLPPGWEMRIAPNGRPFFIDHNTKTTTWEDPRLKFPVHMRSKTSLNPNDLGPLPPGWEERIHLDGRTFYIDHNSKITQWEDPRLQNPAITGPAVPYSREFKQKYDYFRKKLKKPADIPNRFEMKLHRNNIFEESYRRIMSVKRPDVLKARLWIEFESEKGLDYGGVAREWFFLLSKEMFNPYYGLFEYSATDNYTLQINPNSGLCNEDHLSYFTFIGRVAGLAVFHGKLLDGFFIRPFYKMMLGKQITLNDMESVDSEYYNSLKWILENDPTELDLMFCIDEENFGQTYQVDLKPNGSEIMVTNENKREYIDLVIQWRFVNRVQKQMNAFLEGFTELLPIDLIKIFDENELELLMCGLGDVDVNDWRQHSIYKNGYCPNHPVIQWFWKAVLLMDAEKRIRLLQFVTGTSRVPMNGFAELYGSNGPQLFTIEQWGSPEKLPRAHTCFNRLDLPPYETFEDLREKLLMAVENAQGFEGVD

SEQ ID NO: 32213 - protein, 967 aa, Homo sapiens
  ENSP00000350569
MRRLAFEQGESRILRVKVVSGIDLAKKDIFGASDPYVKLSLYVADENRELALVQTKTIKKTLNPKWNEEFYFRVNPSNHRLLFEVFDENRLTRDDFLGQVDVPLSHLPTEDPTMERPYTFKDFLLRPRSHKSRVKGFLRLKMAYMPKNGGQDEENSDQRDDMEHGWEVVDSNDSASQHQEELPPPPLPPGWEEKVDNLGRTYYVNHNNRTTQWHRPSLMDVSSESDNNIRQINQEAAHRRFRSRRHISEDLEPEPSEGGDVPEPWETISEEVNIAGDSLGLALPPPPASPGSRTSPQELSEELSRRLQITPDSNGEQFSSLIQREPSSRLRSCSVTDAVAEQGHLPPPSAPAGRARSSTVTGGEEPTPSVAYVHTTPGLPSGWEERKDAKGRTYYVNHNNRTTTWTRPIMQLAEDGASGSATNSNNHLIEPQIRRPRSLSSPTVTLSAPLEGAKDSPVRRAVKDTLSNPQSPQPSPYNSPKPQHKVTQSFLPPGWEMRIAPNGRPFFIDHNTKTTTWEDPRLKFPVHMRSKTSLNPNDLGPLPPGWEERIHLDGRTFYIDHNSKITQWEDPRLQNPAITGPAVPYSREFKQKYDYFRKKLKKPADIPNRFEMKLHRNNIFEESYRRIMSVKRPDVLKARLWIEFESEKGLDYGGVAREWFFLLSKEMFNPYYGLFEYSATDNYTLQINPNSGLCNEDHLSYFTFIGRVAGLAVFHGKLLDGFFIRPFYKMMLGKQITLNDMESVDSEYYNSLKWILENDPTELDLMFCIDEENFGQTYQVDLKPNGSEIMVTNENKREYIDLVIQWRFVNRVQKQMNAFLEGFTELLPIDLIKIFDENELELLMCGLGDVDVNDWRQHSIYKNGYCPNHPVIQWFWKAVLLMDAEKRIRLLQFVTGTSRVPMNGFAELYGSNGPQLFTIEQWGSPEKLPRAHTCFNRLDLPPYETFEDLREKLLMAVENAQGFEGVD

SEQ ID NO: 32214 - protein, 947 aa, Homo sapiens
  ENSP00000468546
MRRLAFEQGESRILRVKVVSGIDLAKKDIFGASDPYVKLSLYVADENRELALVQTKTIKKTLNPKWNEEFYFRVNPSNHRLLFEVFDENRLTRDDFLGQVDVPLSHLPTEDPTMERPYTFKDFLLRPRSHKSRVKGFLRLKMAYMPKNGGQDEENSDQRDDMEHGWEVVDSNDSASQHQEELPPPPLPPGWEEKVDNLGRTYYVNHNNRTTQWHRPSLMDVSSESDNNIRQINQEAAHRRFRSRRHISEDLEPEPSEGGDVPEPWETISEEVNIAGDSLGLALPPPPASPGSRTSPQELSEELSRRLQITPDSNGEQFSSLIQREPSSRLRSCSVTDAVAEQGHLPPPSVAYVHTTPGLPSGWEERKDAKGRTYYVNHNNRTTTWTRPIMQLAEDGASGSATNSNNHLIEPQIRRPRSLSSPTVTLSAPLEGAKDSPVRRAVKDTLSNPQSPQPSPYNSPKPQHKVTQSFLPPGWEMRIAPNGRPFFIDHNTKTTTWEDPRLKFPVHMRSKTSLNPNDLGPLPPGWEERIHLDGRTFYIDHNSKITQWEDPRLQNPAITGPAVPYSREFKQKYDYFRKKLKKPADIPNRFEMKLHRNNIFEESYRRIMSVKRPDVLKARLWIEFESEKGLDYGGVAREWFFLLSKEMFNPYYGLFEYSATDNYTLQINPNSGLCNEDHLSYFTFIGRVAGLAVFHGKLLDGFFIRPFYKMMLGKQITLNDMESVDSEYYNSLKWILENDPTELDLMFCIDEENFGQTYQVDLKPNGSEIMVTNENKREYIDLVIQWRFVNRVQKQMNAFLEGFTELLPIDLIKIFDENELELLMCGLGDVDVNDWRQHSIYKNGYCPNHPVIQWFWKAVLLMDAEKRIRLLQFVTGTSRVPMNGFAELYGSNGPQLFTIEQWGSPEKLPRAHTCFNRLDLPPYETFEDLREKLLMAVENAQGFEGVD

SEQ ID NO: 32215 - protein, 834 aa, Homo sapiens; identical to SEQ ID NO: 32212
  ENSP00000405440

SEQ ID NO: 32216 - protein, 35 aa, Homo sapiens
  ENSP00000466789
MERPYTFKDFLLRPRSHKSRVKGFLRLKMAYMPKN

SEQ ID NO: 32217 - protein, 854 aa, Homo sapiens
  ENSP00000389406
MERPYTFKDFLLRPRSHKSRVKGFLRLKMAYMPKNGGQDEENSDQRDDMEHGWEVVDSNDSASQHQEELPPPPLPPGWEEKVDNLGRTYYVNHNNRTTQWHRPSLMDVSSESDNNIRQINQEAAHRRFRSRRHISEDLEPEPSEGGDVPEPWETISEEVNIAGDSLGLALPPPPASPGSRTSPQELSEELSRRLQITPDSNGEQFSSLIQREPSSRLRSCSVTDAVAEQGHLPPPSAPAGRARSSTVTGGEEPTPSVAYVHTTPGLPSGWEERKDAKGRTYYVNHNNRTTTWTRPIMQLAEDGASGSATNSNNHLIEPQIRRPRSLSSPTVTLSAPLEGAKDSPVRRAVKDTLSNPQSPQPSPYNSPKPQHKVTQSFLPPGWEMRIAPNGRPFFIDHNTKTTTWEDPRLKFPVHMRSKTSLNPNDLGPLPPGWEERIHLDGRTFYIDHNSKITQWEDPRLQNPAITGPAVPYSREFKQKYDYFRKKLKKPADIPNRFEMKLHRNNIFEESYRRIMSVKRPDVLKARLWIEFESEKGLDYGGVAREWFFLLSKEMFNPYYGLFEYSATDNYTLQINPNSGLCNEDHLSYFTFIGRVAGLAVFHGKLLDGFFIRPFYKMMLGKQITLNDMESVDSEYYNSLKWILENDPTELDLMFCIDEENFGQTYQVDLKPNGSEIMVTNENKREYIDLVIQWRFVNRVQKQMNAFLEGFTELLPIDLIKIFDENELELLMCGLGDVDVNDWRQHSIYKNGYCPNHPVIQWFWKAVLLMDAEKRIRLLQFVTGTSRVPMNGFAELYGSNGPQLFTIEQWGSPEKLPRAHTCFNRLDLPPYETFEDLREKLLMAVENAQGFEGVD

SEQ ID NO: 32218 - protein, 150 aa, Homo sapiens
  ENSP00000467072
MERPYTFKDFLLRPRSHKSRVKGFLRLKMAYMPKNGGQDEENSDQRDDMEHGWEVVDSNDSASQHQEELPPPPLPPGWEEKVDNLGRTYYVNHNNRTTQWHRPSLMDVSSESDNNIRQINQEAAHRRFRSRRHISEDLEPEPSEGGDVPE

SEQ ID NO: 32219 - protein, 15 aa, Homo sapiens
  ENSP00000467768
MERPYTFKDFLLRPR

SEQ ID NO: 32220 - protein, 1254 aa, Homo sapiens
  ENSP00000490696
MAHRLRFHFGSGRSNTAPESDILDQEREDDFFMAFHTLPRRSSPHPFAQNGGEDGGGGLQGGVGALKRSSSMFIPQLLTSIDARPTCSSSVQISLQRKATDGATDGCGPPEGADDGPPCATPDPRDQASATATTRASPQSGSREPSPRDTPGSSPPRAARDPGLQVNGTCGRRVRCSGPVDCAEEAAPGLRIQHRASSADVRQVRLLPLGPDGQGGPAAAEPRRWSLQHVPDASGSSGKRCFVFQLQQPQQGASGPGSDLNFGFTGTKGDRLVRYPRIRLERSTSYPTQPRSERGSPTEDRGALEASPRAGRMAPEIRRTNSAERTPQGQGCTFKIRQDQNAGQQHFRILVTRGPEEAPQNPEEKSAKSPVSTGADTTTRDDFLGQVDVPLSHLPTEDPTMERPYTFKDFLLRPRSHKSRVKGFLRLKMAYMPKNGGQDEENSDQRDDMEHGWEVVDSNDSASQHQEELPPPPLPPGWEEKVDNLGRTYYVNHNNRTTQWHRPSLMDVSSESDNNIRQINQEAAHRRFRSRRHISEDLEPEPSEGGDVPEPWETISEEVNIAGDSLGLALPPPPASPGSRTSPQELSEELSRRLQITPDSNGEQFSSLIQREPSSRLRSCSVTDAVAEQGHLPPPSAPAGRARSSTVTGGEEPTPSVAYVHTTPGLPSGWEERKDAKGRTYYVNHNNRTTTWTRPIMQLAEDGASGSATNSNNHLIEPQIRRPRSLSSPTVTLSAPLEGAKDSPVRRAVKDTLSNPQSPQPSPYNSPKPQHKVTQSFLPPGWEMRIAPNGRPFFIDHNTKTTTWEDPRLKFPVHMRSKTSLNPNDLGPLPPGWEERIHLDGRTFYIDHNSKITQWEDPRLQNPAITGPAVPYSREFKQKYDYFRKKLKKPADIPNRFEMKLHRNNIFEESYRRIMSVKRPDVLKARLWIEFESEKGLDYGGVAREWFFLLSKEMFNPYYGLFEYSATDNYTLQINPNSGLCNEDHLSYFTFIGRVAGLAVFHGKLLDGFFIRPFYKMMLGKQITLNDMESVDSEYYNSLKWILENDPTELDLMFCIDEENFGQTYQVDLKPNGSEIMVTNENKREYIDLVIQWRFVNRVQKQMNAFLEGFTELLPIDLIKIFDENELELLMCGLGDVDVNDWRQHSIYKNGYCPNHPVIQWFWKAVLLMDAEKRIRLLQFVTGTSRVPMNGFAELYGSNGPQLFTIEQWGSPEKLPRAHTCFNRLDLPPYETFEDLREKLLMAVENAQGFEGVD

SEQ ID NO: 32221 - protein, 639 aa, Homo sapiens
  ENSP00000468332
RDDMEHGWEVVDSNDSASQHQEELPPPPLPPGWEEKVDNLGRTYYVNHNNRTTQWHRPSLMDVSSESDNNIRQINQEAAHRRFRSRRHISEDLEPEPSEGGDVPEPWETISEEVNIAGDSLGLALPPPPASPGSRTSPQELSEELSRRLQITPDSNGEQFSSLIQREPSSRLRSCSVTDAVAEQGHLPPEDPRLKFPVHMRSKTSLNPNDLGPLPPGWEERIHLDGRTFYIDHNSKITQWEDPRLQNPAITGPAVPYSREFKQKYDYFRKKLKKPADIPNRFEMKLHRNNIFEESYRRIMSVKRPDVLKARLWIEFESEKGLDYGGVAREWFFLLSKEMFNPYYGLFEYSATDNYTLQINPNSGLCNEDHLSYFTFIGRVAGLAVFHGKLLDGFFIRPFYKMMLGKQITLNDMESVDSEYYNSLKWILENDPTELDLMFCIDEENFGQTYQVDLKPNGSEIMVTNENKREYIDLVIQWRFVNRVQKQMNAFLEGFTELLPIDLIKIFDENELELLMCGLGDVDVNDWRQHSIYKNGYCPNHPVIQWFWKAVLLMDAEKRIRLLQFVTGTSRVPMNGFAELYGSNGPQLFTIEQWGSPEKLPRAHTCFNRLDLPPYETFEDLREKLLMAVENAQGFEGVD

SEQ ID NO: 32222 - protein, 854 aa, Homo sapiens; identical to SEQ ID NO: 32217
  ENSP00000411947

SEQ ID NO: 32223 - protein, 1020 aa, Homo sapiens
  ENSP00000311997
MMSFGGADALLGAPFAPLHGGGSLHYALARKGGAGGTRSAAGSSSGFHSWTRTSVSSVSASPSRFRGAGAASSTDSLDTLSNGPEGCMVAVATSRSEKEQLQALNDRFAGYIDKVRQLEAHNRSLEGEAAALRQQQAGRSAMGELYEREVREMRGAVLRLGAARGQLRLEQEHLLEDIAHVRQRLDDEARQREEAEAAARALARFAQEAEAARVDLQKKAQALQEECGYLRRHHQEEVGELLGQIQGSGAAQAQMQAETRDALKCDVTSALREIRAQLEGHAVQSTLQSEEWFRVRLDRLSEAAKVNTDAMRSAQEEITEYRRQLQARTTELEALKSTKDSLERQRSELEDRHQADIASYQEAIQQLDAELRNTKWEMAAQLREYQDLLNVKMALDIEIAAYRKLLEGEECRIGFGPIPFSLPEGLPKIPSVSTHIKVKSEEKIKVVEKSEKETVIVEEQTEETQVTEEVTEEEEKEAKEEEGKEEEGGEEEEAEGGEEETKSPPAEEAASPEKEAKSPVKEEAKSPAEAKSPEKEEAKSPAEVKSPEKAKSPAKEEAKSPPEAKSPEKEEAKSPAEVKSPEKAKSPAKEEAKSPAEAKSPEKAKSPVKEEAKSPAEAKSPVKEEAKSPAEVKSPEKAKSPTKEEAKSPEKAKSPEKEEAKSPEKAKSPVKAEAKSPEKAKSPVKAEAKSPEKAKSPVKEEAKSPEKAKSPVKEEAKSPEKAKSPVKEEAKTPEKAKSPVKEEAKSPEKAKSPEKAKTLDVKSPEAKTPAKEEARSPADKFPEKAKSPVKEEVKSPEKAKSPLKEDAKAPEKEIPKKEEVKSPVKEEEKPQEVKVKEPPKKAEEEKAPATPKTEEKKDSKKEEAPKKEAPKPKVEEKKEPAVEKPKESKVEAKKEEAEDKKKVPTPEKEAPAKVEVKEDAKPKEKTEVAKKEPDDAKAKEPSKPAEKKEAAPEKKDTKEEKAKKPEEKPKTEAKAKEDDKTLSKEPSKPKAEKAEKSSSTDQKDSKPPEKATEDKAAKGK

SEQ ID NO: 32224 - protein, 543 aa, Homo sapiens
  ENSP00000482169
MSSFSYEPYYSTSYKRRYVETPRVHISSVRSGYSTARSAYSSYSAPVSSSLSVRRSYSSSSGSLMPSLENLDLSQVAAISNDLKSIRTQEKAQLQDLNDRFASFIERVHELEQQNKVLEAELLVLRQKHSEPSRFRALYEQEIRDLRLAAEDATNEKQALQGEREGLEETLRNLQARYEEEVLSREDAEGRLMEARKGADEAALARAELEKRIDSLMDEISFLKKVHEEEIAELQAQIQYAQISVEMDVTKPDLSAALKDIRAQYEKLAAKNMQNAEEWFKSRFTVLTESAAKNTDAVRAAKDEVSESRRLLKAKTLEIEACRGMNEALEKQLQELEDKQNADISAMQDTINKLENELRTTKSEMARYLKEYQDLLNVKMALDIEIAAYRKLLEGEETRLSFTSVGSITSGYSQSSQVFGRSAYGGLQTSSYLMSTRSFPSYYTSHVQEEQIEVEETIEAAKAEEAKDEPPSEGEAEEEEKDKEEAEEEEAAEEEEAAKEESEEAKEEEEGGEGEEGEETKEAEEEEKKVEGAGEEQAAKKKD

SEQ ID NO: 32225 - protein, 284 aa, Homo sapiens
  ENSP00000491612
MSSFSYEPYYSTSYKRRYVETPRVHISSVRSGYSTARSAYSSYSAPVSSSLSVRRSYSSSSGSLMPSLENLDLSQVAAISNDLKSIRTQEKAQLQDLNDRFASFIERVHELEQQNKVLEAELLVLRQKHSEPSRFRALYEQEIRDLRLAAEDATNEKQALQGEREGLEETLRNLQARYEEEVLSREDAEGRLMEARKGAKNTDAVRAAKDEVSESRRLLKAKTLEIEACRGMNEALEKQLQELEDKQNADISAMQDTINKLENELRTTKSEMARYLKEYQDLLN

SEQ ID NO: 32226 - protein, 284 aa, Homo sapiens
  ENSP00000483690
MSSFSYEPYYSTSYKRRYVETPRVHISSVRSGYSTARSAYSSYSAPVSSSLSVRRSYSSSSGSLMPSLENLDLSQVAAISNDLKSIRTQEKAQLQDLNDRFASFIERVHELEQQNKVLEAELLVLRQKHSEPSRFRALYEQEIRDLRLAAEDATNEKQALQGEREGLEETLRNLQARYEEEVLSREDAEGRLMEARKAAKNTDAVRAAKDEVSESRRLLKAKTLEIEACRGMNEALEKQLQELEDKQNADISAMQDTINKLENELRTTKSEMARYLKEYQDLLT

SEQ ID NO: 32227 - protein, 916 aa, Homo sapiens
  ENSP00000221166
MSYTLDSLGNPSAYRRVTETRSSFSRVSGSPSSGFRSQSWSRGSPSTVSSSYKRSMLAPRLAYSSAMLSSAESSLDFSQSSSLLNGGSGPGGDYKLSRSNEKEQLQGLNDRFAGYIEKVHYLEQQNKEIEAEIQALRQKQASHAQLGDAYDQEIRELRATLEMVNHEKAQVQLDSDHLEEDIHRLKERFEEEARLRDDTEAAIRALRKDIEEASLVKVELDKKVQSLQDEVAFLRSNHEEEVADLLAQIQASHITVERKDYLKTDISTALKEIRSQLESHSDQNMHQAEEWFKCRYAKLTEAAEQNKEAIRSAKEEIAEYRRQLQSKSIELESVRGTKESLERQLSDIEERHNHDLSSYQDTIQQLENELRGTKWEMARHLREYQDLLNVKMALDIEIAAYRKLLEGEETRFSTFAGSITGPLYTHRPPITISSKIQKPKVEAPKLKVQHKFVEEIIEETKVEDEKSEMEEALTAITEELAVSMKEEKKEAAEEKEEEPEAEEEEVAAKKSPVKATAPEVKEEEGEKEEEEGQEEEEEEDEGAKSDQAEEGGSEKEGSSEKEEGEQEEGETEAEAEGEEAEAKEEKKVEEKSEEVATKEELVADAKVEKPEKAKSPVPKSPVEEKGKSPVPKSPVEEKGKSPVPKSPVEEKGKSPVPKSPVEEKGKSPVSKSPVEEKAKSPVPKSPVEEAKSKAEVGKGEQKEEEEKEVKEAPKEEKVEKKEEKPKDVPEKKKAESPVKEEAVAEVVTITKSVKVHLEKETKEEGKPLQQEKEKEKAGGEGGSEEEGSDKGAKGSRKEDIAVNGEVEGKEEVEQETKEKGSGREEEKGVVTNGLDLSPADEKKGGDKSEEKVVVTKTVEKITSEGGDGATKYITKSVTVTQKVEEHEETFEEKLVSTKKVEKVTSHAIVKEVTQSD

SEQ ID NO: 32228 - protein, 698 aa, Homo sapiens
  ENSP00000427872
MSYTLDSLGNPSAYRRVTETRSSFSRVSGSPSSGFRSQSWSRGSPSTVSSSYKRSMLAPRLAYSSAMLSSAESSLDFSQSSSLLNGGSGPGGDYKLSRSNEKEQLQGLNDRFAGYIEKVHYLEQQNKEIEAEIQALRQKQASHAQLGDAYDQEIRELRATLEMVNHEKAQVQLDSDHLEEDIHRLKERFEEEARLRDDTEAAIRALRKDIEEASLVKVELDKKVQSLQDEVAFLRSNHEEEVADLLAQIQASHITVERKDYLKTDISTALKEIRSQLESHSDQNMHQAEEWFKCRYAKLTEAAEQNKEAIRSAKEEIAEYRRQLQSKSIELESVRGTKESLERQLSDIEERHNHDLSSYQDTIQQLENELRGTKWEMARHLREYQDLLNVKMALDIEIAAYRKLLEGEETRFSTFAGSITGPLYTHRPPITISSKIQKPKVEAPKLKVQHKFVEEIIEETKVEDEKSEMEEALTAITEELAVSMKEEKKEAAEEKEEEPEAEEEEVAAKKSPVKATAPEVKEEEGEKEEEEGQEEEEEEDEGAKSDQAEEGGSEKEGSSEKEEGEQEEGETEAEAEGEEAEAKEEKKVEGKEEVEQETKEKGSGREEEKGVVTNGLDLSPADEKKGGDKSEEKVVVTKTVEKITSEGGDGATKYITKSVTVTQKVEEHEETFEEKLVSTKKVEKVTSHAIVKEVTQSD

SEQ ID NO: 32229 - protein, 540 aa, Homo sapiens
  ENSP00000412295
MARHLREYQDLLNVKMALDIEIAAYRKLLEGEETRFSTFAGSITGPLYTHRPPITISSKIQKPKVEAPKLKVQHKFVEEIIEETKVEDEKSEMEEALTAITEELAVSMKEEKKEAAEEKEEEPEAEEEEVAAKKSPVKATAPEVKEEEGEKEEEEGQEEEEEEDEGAKSDQAEEGGSEKEGSSEKEEGEQEEGETEAEAEGEEAEAKEEKKVEEKSEEVATKEELVADAKVEKPEKAKSPVPKSPVEEKGKSPVPKSPVEEKGKSPVPKSPVEEKGKSPVPKSPVEEKGKSPVSKSPVEEKAKSPVPKSPVEEAKSKAEVGKGEQKEEEEKEVKEAPKEEKVEKKEEKPKDVPEKKKAESPVKEEAVAEVVTITKSVKVHLEKETKEEGKPLQQEKEKEKAGGEGGSEEEGSDKGAKGSRKEDIAVNGEVEGKEEVEQETKEKGSGREEEKGVVTNGLDLSPADEKKGGDKSEEKVVVTKTVEKITSEGGDGATKYITKSVTVTQKVEEHEETFEEKLVSTKKVEKVTSHAIVKEVTQSD

SEQ ID NO: 32230 - protein, 877 aa, Homo sapiens
  ENSP00000410137
MSYTLDSLGNPSAYRRVTETRSSFSRVSGSPSSGFRSQSWSRGSPSTVSSSYKRSMLAPRLAYSSAMLSSAESSLDFSQSSSLLNGGSGPGGDYKLSRSNEKEQLQGLNDRFAGYIEKVHYLEQQNKEIEAEIQALRQKQASHAQLGDAYDQEIRELRATLEMVNHEKAQVQLDSDHLEEDIHRLKERFEEEARLRDDTEAAIRALRKDIEEASLVKVELDKKVQSLQDEVAFLRSNHEEEVADLLAQIQASHITVERKDYLKTDISTALKEIRSQLESHSDQNMHQAEEWFKCRYAKLTEAAEQNKEAIRSAKEEIAEYRRQLQSKSIELESVRGTKESLERQLSDIEERHNHDLSSYQDTIQQLENELRGTKWEMARHLREYQDLLNVKMALDIEIAAYRKLLEGEETRFSTFAGSITGPLYTHRPPITISSKIQKPKVEAPKLKVQHKFVEEIIEETKVEDEKSEMEEALTAITEELAVSMKEEKKEAAEEKEEEPEAEEEEVAAKKSPVKATAPEVKEEEGEKEEEEGQEEEEEEDEGAKSDQAEEGGSEKEGSSEKEEGEQEEGETEAEAEGEEAEAKEEKKVEEKSEEVATKEELVADAKVEKPEKAKSPVPKSPVEEKGKSPVSKSPVEEKAKSPVPKSPVEEAKSKAEVGKGEQKEEEEKEVKEAPKEEKVEKKEEKPKDVPEKKKAESPVKEEAVAEVVTITKSVKVHLEKETKEEGKPLQQEKEKEKAGGEGGSEEEGSDKGAKGSRKEDIAVNGEVEGKEEVEQETKEKGSGREEEKGVVTNGLDLSPADEKKGGDKSEEKVVVTKTVEKITSEGGDGATKYITKSVTVTQKVEEHEETFEEKLVSTKKVEKVTSHAIVKEVTQSD

SEQ ID NO: 32231 - protein, 354 aa, Homo sapiens
  ENSP00000350364
MDMMLLVQGACCSNQWLAAVLLSLCCLLPSCLPAGQSVDFPWAAVDNMMVRKGDTAVLRCYLEDGASKGAWLNRSSIIFAGGDKWSVDPRVSISTLNKRDYSLQIQNVDVTDDGPYTCSVQTQHTPRTMQVHLTVQVPPKIYDISNDMTVNEGTNVTLTCLATGKPEPSISWRHISPSAKPFENGQYLDIYGITRDQAGEYECSAENDVSFPDVRKVKVVVNFAPTIQEIKSGTVTPGRSGLIRCEGAGVPPPAFEWYKGEKKLFNGQQGIIIQNFSTRSILTVTNVTQEHFGNYTCVAANKLGTTNASLPLNPPSTAQYGITGSADVLFSCWYLVLTLSSFTSIFYLKNAILQ

SEQ ID NO: 32232 - protein, 226 aa, Homo sapiens
  ENSP00000305938
MQVHLTVQVPPKIYDISNDMTVNEGTNVTLTCLATGKPEPSISWRHISPSAKPFENGQYLDIYGITRDQAGEYECSAENDVSFPDVRKVKVVVNFAPTIQEIKSGTVTPGRSGLIRCEGAGVPPPAFEWYKGEKKLFNGQQGIIIQNFSTRSILTVTNVTQEHFGNYTCVAANKLGTTNASLPLNPPSTAQYGITGSADVLFSCWYLVLTLSSFTSIFYLKNAILQ

SEQ ID NO: 32233 - protein, 445 aa, Homo sapiens
  ENSP00000355966
MPSRAEDYEVLYTIGTGSYGRCQKIRRKSDGKILVWKELDYGSMTEAEKQMLVSEVNLLRELKHPNIVRYYDRIIDRTNTTLYIVMEYCEGGDLASVITKGTKERQYLDEEFVLRVMTQLTLALKECHRRSDGGHTVLHRDLKPANVFLDGKQNVKLGDFGLARILNHDTSFAKTFVGTPYYMSPEQMNRMSYNEKSDIWSLGCLLYELCALMPPFTAFSQKELAGKIREGKFRRIPYRYSDELNEIITRMLNLKDYHRPSVEEILENPLIADLVADEQRRNLERRGRQLGEPEKSQDSSPVLSELKLKEIQLQERERALKAREERLEQKEQELCVRERLAEDKLARAENLLKNYSLLKERKFLSLASNPELLNLPSSVIKKKVHFSGESKENIMRSENSESQLTSKSKCKDLKKRLHAAQLRAQALSDIEKNYQLKSRQILGMR

SEQ ID NO: 32234 - protein, 384 aa, Homo sapiens
  ENSP00000355965
MPSRAEDYEVLYTIGTGSYGRCQKIRRKSDGKILVWKELDYGSMTEAEKQMLVSEVNLLRELKHPNIVRYYDRIIDRTNTTLYIVMEYCEGGDLASVITKGTKERQYLDEEFVLRVMTQLTLALKECHRRSDGGHTVLHRDLKPANVFLDGKQNVKLGDFGLARILNHDTSFAKTFVGTPYYMSPEQMNRMSYNEKSDIWSLGCLLYELCALMPPFTAFSQKELAGKIREGKFRRIPYRYSDELNEIITRMLNLKDYHRPSVEEILENPLIADLVADEQRRNLERRGRQLGEPEKSQDSSPVLSELKLKEIQLQERERALKAREERLEQKEQELCVRERLAEDKLARAENLLKNYSLLKERKFLSLASNPGMRINLVNRSWCYK

SEQ ID NO: 32235 - protein, 388 aa, Homo sapiens
  ENSP00000440237
MPSRAEDYEVLYTIGTGSYGRCQKIRRKSDGKILVWKELDYGSMTEAEKQMLVSEVNLLRELKHPNIVRYYDRIIDRTNTTLYIVMEYCEGGDLASVITKGTKERQYLDEEFVLRVMTQLTLALKECHRRSDGGHTVLHRDLKPANVFLDGKQNVKLGDFGLARILNHDTSFAKTFVGTPYYMSPEQMNRMSYNEKSDIWSLGCLLYELCALMPPFTAFSQKELAGKIREGKFRRIPYRYSDELNEIITRMLNLKDYHRPSVEEILENPLIADLVADEQRRNLERRGRQLGEPEKSQDSSPVLSELKLKEIQLQERERALKAREERLEQKEQELCVRERLAEDKLARAENLLKNYSLLKERKFLSLASNPESHFVAQAGMQWCDHSSM

SEQ ID NO: 32236 - protein, 841 aa, Homo sapiens
  ENSP00000233027
MPLAAYCYLRVVGKGSYGEVTLVKHRRDGKQYVIKKLNLRNASSRERRAAEQEAQLLSQLKHPNIVTYKESWEGGDGLLYIVMGFCEGGDLYRKLKEQKGQLLPENQVVEWFVQIAMALQYLHEKHILHRDLKTQNVFLTRTNIIKVGDLGIARVLENHCDMASTLIGTPYYMSPELFSNKPYNYKSDVWALGCCVYEMATLKHAFNAKDMNSLVYRIIEGKLPPMPRDYSPELAELIRTMLSKRPEERPSVRSILRQPYIKRQISFFLEATKIKTSKNNIKNGDSQSKPFATVVSGEAESNHEVIHPQPLSSEGSQTYIMGEGKCLSQEKPRASGLLKSPASLKAHTCKQDLSNTTELATISSVNIDILPAKGRDSVSDGFVQENQPRYLDASNELGGICSISQVEEEMLQDNTKSSAQPENLIPMWSSDIVTGEKNEPVKPLQPLIKEQKPKDQSLALSPKLECSGTILAHSNLRLLGSSDSPASASRVAGITGVCHHAQDQVAGECIIEKQGRIHPDLQPHNSGSEPSLSRQRRQKRREQTEHRGEKRQVRRDLFAFQESPPRFLPSHPIVGKVDVTSTQKEAENQRRVVTGSVSSSRSSEMSSSKDRPLSARERRRLKQSQEEMSSSGPSVRKASLSVAGPGKPQEEDQPLPARRLSSDCSVTQERKQIHCLSEDELSSSTSSTDKSDGDYGEGKGQTNEINALVQLMTQTLKLDSKESCEDVPVANPVSEFKLHRKYRDTLILHGKVAEEAEEIHFKELPSAIMPGSEKIRRLVEVLRTDVIRGLGVQLLEQVYDLLEEEDEFDREVRLREHMGEKYTTYSVKARQLKFFEENMNF

SEQ ID NO: 32237 - protein, 781 aa, Homo sapiens
  ENSP00000373227
MPLAAYCYLRVVGKGSYGEVTLVKHRRDGKQYVIKKLNLRNASSRERRAAEQEAQLLSQLKHPNIVTYKESWEGGDGLLYIVMGFCEGGDLYRKLKEQKGQLLPENQVVEWFVQIAMALQYLHEKHILHRDLKTQNVFLTRTNIIKVGDLGIARVLENHCDMASTLIGTPYYMSPELFSNKPYNYKSDVWALGCCVYEMATLKHAFNAKDMNSLVYRIIEGKLPPMPRDYSPELAELIRTMLSKRPEERPSVRSILRQPYIKRQISFFLEATKIKTSKNNIKNGDSQSKPFATVVSGEAESNHEVIHPQPLSSEGSQTYIMGEGKCLSQEKPRASGLLKSPASLKAHTCKQDLSNTTELATISSVNIDILPAKGRDSVSDGFVQENQPRYLDASNELGGICSISQVEEEMLQDNTKSSAQPENLIPMWSSDIVTGEKNEPVKPLQPLIKEQKPKDQDQVAGECIIEKQGRIHPDLQPHNSGSEPSLSRQRRQKRREQTEHRGEKRQVRRDLFAFQESPPRFLPSHPIVGKVDVTSTQKEAENQRRVVTGSVSSSRSSEMSSSKDRPLSARERRRLKQSQEEMSSSGPSVRKASLSVAGPGKPQEEDQPLPARRLSSDCSVTQERKQIHCLSEDELSSSTSSTDKSDGDYGEGKGQTNEINALVQLMTQTLKLDSKESCEDVPVANPVSEFKLHRKYRDTLILHGKVAEEAEEIHFKELPSAIMPGSEKIRRLVEVLRTDVIRGLGVQLLEQVYDLLEEEDEFDREVSVSLTVSRCLCYRIF

SEQ ID NO: 32238 - protein, 722 aa, Homo sapiens
  ENSP00000419666
MPLAAYCYLRVVGKGSYGEVTLVKHRRDGKQYLHEKHILHRDLKTQNVFLTRTNIIKVGDLGIARVLENHCDMASTLIGTPYYMSPELFSNKPYNYKSDVWALGCCVYEMATLKHAFNAKDMNSLVYRIIEGKLPPMPRDYSPELAELIRTMLSKRPEERPSVRSILRQPYIKRQISFFLEATKIKTSKNNIKNGDSQSKPFATVVSGEAESNHEVIHPQPLSSEGSQTYIMGEGKCLSQEKPRASGLLKSPASLKAHTCKQDLSNTTELATISSVNIDILPAKGRDSVSDGFVQENQPRYLDASNELGGICSISQVEEEMLQDNTKSSAQPENLIPMWSSDIVTGEKNEPVKPLQPLIKEQKPKDQSLALSPKLECSGTILAHSNLRLLGSSDSPASASRVAGITGVCHHAQDQVAGECIIEKQGRIHPDLQPHNSGSEPSLSRQRRQKRREQTEHRGEKRQVRRDLFAFQESPPRFLPSHPIVGKVDVTSTQKEAENQRRVVTGSVSSSRSSEMSSSKDRPLSARERRRLKQSQEEMSSSGPSVRKASLSVAGPGKPQEEDQPLPARRLSSDCSVTQERKQIHCLSEDELSSSTSSTDKSDGDYGEGKGQTNEINALVQLMTQTLKLDSKESCEDVPVANPVSEFKLHRKYRDTLILHGKVAEEAEEIHFKELPSAIMPGSEKIRRLVEVLRTDVIRGLGVQLLEQVYDLLEEEDEFDRE

SEQ ID NO: 32239 - protein, 142 aa, Homo sapiens
  ENSP00000420231
  MOD_RES (1)..(1): Any amino acid
XLQDNTKSSAQPENLIPMWSSDIVTGEKNEPVKPLQPLIKEQKPKDQSLALSPKLECSGTILAHSNLRLLGSSDSPASASRVAGITGVCHHAQMESHSVAQAGVQWCDLSLLQPPPPGFKQFFYLSLLSSWDYRIKLLVNVL

SEQ ID NO: 32240 - protein, 37 aa, Homo sapiens
  ENSP00000417119
MPLAAYCYLRVVGKGSYGEVTLVKHRRDGKQPRAASC

SEQ ID NO: 32241 - protein, 752 aa, Homo sapiens
  ENSP00000437703
MPLAAYCYLRVVGKGSYGEVTLVKHRRDGKQYLHEKHILHRDLKTQNVFLTRTNIIKVGDLGIARVLENHCDMASTLIGTPYYMSPELFSNKPYNYKSDVWALGCCVYEMATLKHAFNAKDMNSLVYRIIEGKLPPMPRDYSPELAELIRTMLSKRPEERPSVRSILRQPYIKRQISFFLEATKIKTSKNNIKNGDSQSKPFATVVSGEAESNHEVIHPQPLSSEGSQTYIMGEGKCLSQEKPRASGLLKSPASLKAHTCKQDLSNTTELATISSVNIDILPAKGRDSVSDGFVQENQPRYLDASNELGGICSISQVEEEMLQDNTKSSAQPENLIPMWSSDIVTGEKNEPVKPLQPLIKEQKPKDQSLALSPKLECSGTILAHSNLRLLGSSDSPASASRVAGITGVCHHAQDQVAGECIIEKQGRIHPDLQPHNSGSEPSLSRQRRQKRREQTEHRGEKRQVRRDLFAFQESPPRFLPSHPIVGKVDVTSTQKEAENQRRVVTGSVSSSRSSEMSSSKDRPLSARERRRLKQSQEEMSSSGPSVRKASLSVAGPGKPQEEDQPLPARRLSSDCSVTQERKQIHCLSEDELSSSTSSTDKSDGDYGEGKGQTNEINALVQLMTQTLKLDSKESCEDVPVANPVSEFKLHRKYRDTLILHGKVAEEAEEIHFKELPSAIMPGSEKIRRLVEVLRTDVIRGLGVQLLEQVYDLLEEEDEFDREVRLREHMGEKYTTYSVKARQLKFFEENMNF

SEQ ID NO: 32242 - protein, 838 aa, Homo sapiens
  ENSP00000298925
MPMDLILVVWFCVCTARTAEDMKPPVLSLIWRTRVLKSLLQQSLQGVVGFGMDPDLQMDIVTELDLVNTTLGVAQVSGMHNASKAFLFQDIEREIHAAPHVSEKLIQLFRNKSEFTILATVQQKPSTSGVILSIRELEHSYFELESSGLRDEIRYHYIHNGKPRTEALPYRMADGQWHKVALSVSASHLLLHVDCNRIYERVIDPPDTNLPPGINLWLGQRNQKHGLFKGIIQDGKIIFMPNGYITQCPNLNHTCPTCSDFLSLVQGIMDLQELLAKMTAKLNYAETRLSQLENCHCEKTCQVSGLLYRDQDSWVDGDHCRNCTCKSGAVECRRMSCPPLNCSPDSLPVHIAGQCCKVCRPKCIYGGKVLAEGQRILTKSCRECRGGVLVKITEMCPPLNCSEKDHILPENQCCRVCRGHNFCAEGPKCGENSECKNWNTKATCECKSGYISVQGDSAYCEDIDECAAKMHYCHANTVCVNLPGLYRCDCVPGYIRVDDFSCTEHDECGSGQHNCDENAICTNTVQGHSCTCKPGYVGNGTICRAFCEEGCRYGGTCVAPNKCVCPSGFTGSHCEKDIDECSEGIIECHNHSRCVNLPGWYHCECRSGFHDDGTYSLSGESCIDIDECALRTHTCWNDSACINLAGGFDCLCPSGPSCSGDCPHEGGLKHNGQVWTLKEDRCSVCSCKDGKIFCRRTACDCQNPSADLFCCPECDTRVTSQCLDQNGHKLYRSGDNWTHSCQQCRCLEGEVDCWPLTCPNLSCEYTAILEGECCPRCVSDPCLADNITYDIRKTCLDSYGVSRLSGSVWTMAGSPCTTCKCKNGRVCCSVDFECLQNN

SEQ ID NO: 32243 - protein, 810 aa, Homo sapiens
  ENSP00000349654
MPMDLILVVWFCVCTARTVVGFGMDPDLQMDIVTELDLVNTTLGVAQVSGMHNASKAFLFQDIEREIHAAPHVSEKLIQLFRNKSEFTILATVQQKPSTSGVILSIRELEHSYFELESSGLRDEIRYHYIHNGKPRTEALPYRMADGQWHKVALSVSASHLLLHVDCNRIYERVIDPPDTNLPPGINLWLGQRNQKHGLFKGIIQDGKIIFMPNGYITQCPNLNHTCPTCSDFLSLVQGIMDLQELLAKMTAKLNYAETRLSQLENCHCEKTCQVSGLLYRDQDSWVDGDHCRNCTCKSGAVECRRMSCPPLNCSPDSLPVHIAGQCCKVCRPKCIYGGKVLAEGQRILTKSCRECRGGVLVKITEMCPPLNCSEKDHILPENQCCRVCRGHNFCAEGPKCGENSECKNWNTKATCECKSGYISVQGDSAYCEDIDECAAKMHYCHANTVCVNLPGLYRCDCVPGYIRVDDFSCTEHDECGSGQHNCDENAICTNTVQGHSCTCKPGYVGNGTICRAFCEEGCRYGGTCVAPNKCVCPSGFTGSHCEKDIDECSEGIIECHNHSRCVNLPGWYHCECRSGFHDDGTYSLSGESCIDIDECALRTHTCWNDSACINLAGGFDCLCPSGPSCSGDCPHEGGLKHNGQVWTLKEDRCSVCSCKDGKIFCRRTACDCQNPSADLFCCPECDTRVTSQCLDQNGHKLYRSGDNWTHSCQQCRCLEGEVDCWPLTCPNLSCEYTAILEGECCPRCVSDPCLADNITYDIRKTCLDSYGVSRLSGSVWTMAGSPCTTCKCKNGRVCCSVDFECLQNN

SEQ ID NO: 32244 - protein, 763 aa, Homo sapiens
  ENSP00000437170
MPMDLILVVWFCVCTARTVVGFGMDPDLQMDIVTELDLVNTTLGVAQVSGMHNASKAFLFQDIEREIHAAPHVSEKLIQLFRNKSEFTILATVQQKPSTSGVILSIRELEHSYFELESSGLRDEIRYHYIHNGKPRTEALPYRMADGQWHKVALSVSASHLLLHVDCNRIYERVIDPPDTNLPPGINLWLGQRNQKHGLFKGIIQDGKIIFMPNGYITQCPNLNHTCPTCSDFLSLVQGIMDLQELLAKMTAKLNYAETRLSQLENCHCEKTCQVSGLLYRDQDSWVDGDHCRNCTCKSGAVECRRMSCPPLNCSPDSLPVHIAGQCCKVCRPKCIYGGKVLAEGQRILTKSCRECRGGVLVKITEMCPPLNCSEKDHILPENQCCRVCRGHNFCAEGPKCGENSECKNWNTKATCECKSGYISVQGDSAYCEDIDECAAKMHYCHANTVCVNLPGLYRCDCVPGYIRVDDFSCTEHDECGSGQHNCDENAICTNTVQGHSCTCKPGYVGNGTICRAFCEEGCRYGGTCVAPNKCVCPSGFTGSHCEKDIDECALRTHTCWNDSACINLAGGFDCLCPSGPSCSGDCPHEGGLKHNGQVWTLKEDRCSVCSCKDGKIFCRRTACDCQNPSADLFCCPECDTRVTSQCLDQNGHKLYRSGDNWTHSCQQCRCLEGEVDCWPLTCPNLSCEYTAILEGECCPRCVSDPCLADNITYDIRKTCLDSYGVSRLSGSVWTMAGSPCTTCKCKNGRVCCSVDFECLQNN

SEQ ID NO: 32245 - protein, 753 aa, Homo sapiens
  ENSP00000317837
MPMDLILVVWFCVCTARTVVGFGMDPDLQMDIVTELDLVNTTLGVAQVSGMHNASKAFLFQDIEREIHAAPHVSEKLIQLFRNKSEFTILATVQQKPSTSGVILSIRELEHRIYERVIDPPDTNLPPGINLWLGQRNQKHGLFKGIIQDGKIIFMPNGYITQCPNLNHTCPTCSDFLSLVQGIMDLQELLAKMTAKLNYAETRLSQLENCHCEKTCQVSGLLYRDQDSWVDGDHCRNCTCKSGAVECRRMSCPPLNCSPDSLPVHIAGQCCKVCRPKCIYGGKVLAEGQRILTKSCRECRGGVLVKITEMCPPLNCSEKDHILPENQCCRVCRGHNFCAEGPKCGENSECKNWNTKATCECKSGYISVQGDSAYCEDIDECAAKMHYCHANTVCVNLPGLYRCDCVPGYIRVDDFSCTEHDECGSGQHNCDENAICTNTVQGHSCTCKPGYVGNGTICRAFCEEGCRYGGTCVAPNKCVCPSGFTGSHCEKDIDECSEGIIECHNHSRCVNLPGWYHCECRSGFHDDGTYSLSGESCIDIDECALRTHTCWNDSACINLAGGFDCLCPSGPSCSGDCPHEGGLKHNGQVWTLKEDRCSVCSCKDGKIFCRRTACDCQNPSADLFCCPECDTRVTSQCLDQNGHKLYRSGDNWTHSCQQCRCLEGEVDCWPLTCPNLSCEYTAILEGECCPRCVSDPCLADNITYDIRKTCLDSYGVSRLSGSVWTMAGSPCTTCKCKNGRVCCSVDFECLQNN

SEQ ID NO: 32246 - protein, 1461 aa, Homo sapiens
  ENSP00000341198
MAAERGARRLLSTPSFWLYCLLLLGRRAPGAAAARSGSAPQSPGASIRTFTPFYFLVEPVDTLSVRGSSVILNCSAYSEPSPKIEWKKDGTFLNLVSDDRRQLLPDGSLFISNVVHSKHNKPDEGYYQCVATVESLGTIISRTAKLIVAGLPRFTSQPEPSSVYAGNNAILNCEVNADLVPFVRWEQNRQPLLLDDRVIKLPSGMLVISNATEGDGGLYRCVVESGGPPKYSDEVELKVLPDPEVISDLVFLKQPSPLVRVIGQDVVLPCVASGLPTPTIKWMKNEEALDTESSERLVLLAGGSLEISDVTEDDAGTYFCIADNGNETIEAQAELTVQAQPEFLKQPTNIYAHESMDIVFECEVTGKPTPTVKWVKNGDMVIPSDYFKIVKEHNLQVLGLVKSDEGFYQCIAENDVGNAQAGAQLIILEHAPATTGPLPSAPRDVVASLVSTRFIKLTWRTPASDPHGDNLTYSVFYTKEGIARERVENTSHPGEMQVTIQNLMPATVYIFRVMAQNKHGSGESSAPLRVETQPEVQLPGPAPNLRAYAASPTSITVTWETPVSGNGEIQNYKLYYMEKGTDKEQDVDVSSHSYTINGLKKYTEYSFRVVAYNKHGPGVSTPDVAVRTLSDVPSAAPQNLSLEVRNSKSIMIHWQPPAPATQNGQITGYKIRYRKASRKSDVTETLVSGTQLSQLIEGLDRGTEYNFRVAALTINGTGPATDWLSAETFESDLDETRVPEVPSSLHVRPLVTSIVVSWTPPENQNIVVRGYAIGYGIGSPHAQTIKVDYKQRYYTIENLDPSSHYVITLKAFNNVGEGIPLYESAVTRPHTDTSEVDLFVINAPYTPVPDPTPMMPPVGVQASILSHDTIRITWADNSLPKHQKITDSRYYTVRWKTNIPANTKYKNANATTLSYLVTGLKPNTLYEFSVMVTKGRRSSTWSMTAHGTTFELVPTSPPKDVTVVSKEGKPKTIIVNWQPPSEANGKITGYIIYYSTDVNAEIHDWVIEPVVGNRLTHQIQELTLDTPYYFKIQARNSKGMGPMSEAVQFRTPKADSSDKMPNDQASGSGGKGSRLPDLGSDYKPPMSGSNSPHGSPTSPLDSNMLLVIIVSVGVITIVVVVIIAVFCTRRTTSHQKKKRAACKSVNGSHKYKGNSKDVKPPDLWIHHERLELKPIDKSPDPNPIMTDTPIPRNSQDITPVDNSMDSNIHQRRNSYRGHESEDSMSTLAGRRGMRPKMMMPFDSQPPQPVISAHPIHSLDNPHHHFHSSSLASPARSHLYHPGSPWPIGTSMSLSDRANSTESVRNTPSTDTMPASSSQTCCTDHQDPEGATSSSYLASSQEEDSGQSLPTAHVRPSHPLKSFAVPAIPPPGPPTYDPALPSTPLLSQQALNHHIHSVKTASIGTLGRSRPPMPVVVPSAPEVQETTRMLEDSESSYEPDELTKEMAHLEGLMKDLNAITTA

SEQ ID NO: 32247 - protein, 1408 aa, Homo sapiens
  ENSP00000453317
MAAERGARRLLSTPSFWLYCLLLLGRRAPGAAAARSGSAPQSPGASIRTFTPFYFLVEPVDTLSVRGSSVILNCSAYSEPSPKIEWKKDGTFLNLVSDDRRQLLPDGSLFISNVVHSKHNKPDEGYYQCVATVESLGTIISRTAKLIVAGLPRFTSQPEPSSVYAGNNAILNCEVNADLVPFVRWEQNRQPLLLDDRVIKLPSGMLVISNATEGDGGLYRCVVESGGPPKYSDEVELKVLPDPEVISDLVFLKQPSPLVRVIGQDVVLPCVASGLPTPTIKWMKNEEALDTESSERLVLLAGGSLEISDVTEDDAGTYFCIADNGNETIEAQAELTVQAQPEFLKQPTNIYAHESMDIVFECEVTGKPTPTVKWVKNGDMVIPSDYFKIVKEHNLQVLGLVKSDEGFYQCIAENDVGNAQAGAQLIILEHAPATTGPLPSAPRDVVASLVSTRFIKLTWRTPASDPHGDNLTYSVFYTKEGIARERVENTSHPGEMQVTIQNLMPATVYIFRVMAQNKHGSGESSAPLRVETQPEVQLPGPAPNLRAYAASPTSITVTWETPVSGNGEIQNYKLYYMEKGTDKEQDVDVSSHSYTINGLKKYTEYSFRVVAYNKHGPGVSTPDVAVRTLSDVPSAAPQNLSLEVRNSKSIMIHWQPPAPATQNGQITGYKIRYRKASRKSDVTETLVSGTQLSQLIEGLDRGTEYNFRVAALTINGTGPATDWLSAETFESDLDETRVPEVPSSLHVRPLVTSIVVSWTPPENQNIVVRGYAIGYGIGSPHAQTIKVDYKQRYYTIENLDPSSHYVITLKAFNNVGEGIPLYESAVTRPHTDTSEVDLFVINAPYTPVPDPTPMMPPVGVQASILSHDTIRITWADNSLPKHQKITDSRYYTVRWKTNIPANTKYKNANATTLSYLVTGLKPNTLYEFSVMVTKGRRSSTWSMTAHGTTFELVPTSPPKDVTVVSKEGKPKTIIVNWQPPSEANGKITGYIIYYSTDVNAEIHDWVIEPVVGNRLTHQIQELTLDTPYYFKIQARNSKGMGPMSEAVQFRTPKADSSDKMPNDQASGSGGKGSRLPDLGSDYKPPMSGSNSPHGSPTSPLDSNMLLVIIVSVGVITIVVVVIIAVFCTRRTTSHQKKKRAACKSVNGSHKYKGNSKDVKPPDLWIHHERLELKPIDKSPDPNPIMTDTPIPRNSQDITPVDNSMDSNIHQRRNSYRGHESEDSMSTLAGRRGMRPKMMMPFDSQPPQQSVRNTPSTDTMPASSSQTCCTDHQDPEGATSSSYLASSQEEDSGQSLPTAHVRPSHPLKSFAVPAIPPPGPPTYDPALPSTPLLSQQALNHHIHSVKTASIGTLGRSRPPMPVVVPSAPEVQETTRMLEDSESSYEPDELTKEMAHLEGLMKDLNAITTA

SEQ ID NO: 32248 - protein, 1450 aa, Homo sapiens
  ENSP00000453200
MAAERGARRLLSTPSFWLYCLLLLGRRAPGAAAARSGSAPQSPGASIRTFTPFYFLVEPVDTLSVRGSSVILNCSAYSEPSPKIEWKKDGTFLNLVSDDRRQLLPDGSLFISNVVHSKHNKPDEGYYQCVATVESLGTIISRTAKLIVAGLPRFTSQPEPSSVYAGNNAILNCEVNADLVPFVRWEQNRQPLLLDDRVIKLPSGMLVISNATEGDGGLYRCVVESGGPPKYSDEVELKVLPDPEVISDLVFLKQPSPLVRVIGQDVVLPCVASGLPTPTIKWMKNEEALDTESSERLVLLAGGSLEISDVTEDDAGTYFCIADNGNETIEAQAELTVQAQPEFLKQPTNIYAHESMDIVFECEVTGKPTPTVKWVKNGDMVIPSDYFKIVKEHNLQVLGLVKSDEGFYQCIAENDVGNAQAGAQLIILEHAPATTGPLPSAPRDVVASLVSTRFIKLTWRTPASDPHGDNLTYSVFYTKEGIARERVENTSHPGEMQVTIQNLMPATVYIFRVMAQNKHGSGESSAPLRVETQPEVQLPGPAPNLRAYAASPTSITVTWETPVSGNGEIQNYKLYYMEKGTDKEQDVDVSSHSYTINGLKKYTEYSFRVVAYNKHGPGVSTPDVAVRTLSDVPSAAPQNLSLEVRNSKSIMIHWQPPAPATQNGQITGYKIRYRKASRKSDVTETLVSGTQLSQLIEGLDRGTEYNFRVAALTINGTGPATDWLSAETFESDLDETRVPEVPSSLHVRPLVTSIVVSWTPPENQNIVVRGYAIGYGIGSPHAQTIKVDYKQRYYTIENLDPSSHYVITLKAFNNVGEGIPLYESAVTRPHTDTSEVDLFVINAPYTPVPDPTPMMPPVGVQASILSHDTIRITWADNSLPKHQKITDSRYYTVRWKTNIPANTKYKNANATTLSYLVTGLKPNTLYEFSVMVTKGRRSSTWSMTAHGTTFELVPTSPPKDVTVVSKEGKPKTIIVNWQPPSEANGKITGYIIYYSTDVNAEIHDWVIEPVVGNRLTHQIQELTLDTPYYFKIQARNSKGMGPMSEAVQFRTPKASGSGGKGSRLPDLGSDYKPPMSGSNSPHGSPTSPLDSNMLLVIIVSVGVITIVVVVIIAVFCTRRTTSHQKKKRAACKSVNGSHKYKGNSKDVKPPDLWIHHERLELKPIDKSPDPNPIMTDTPIPRNSQDITPVDNSMDSNIHQRRNSYRGHESEDSMSTLAGRRGMRPKMMMPFDSQPPQPVISAHPIHSLDNPHHHFHSSSLASPARSHLYHPGSPWPIGTSMSLSDRANSTESVRNTPSTDTMPASSSQTCCTDHQDPEGATSSSYLASSQEEDSGQSLPTAHVRPSHPLKSFAVPAIPPPGPPTYDPALPSTPLLSQQALNHHIHSVKTASIGTLGRSRPPMPVVVPSAPEVQETTRMLEDSESSYEPDELTKEMAHLEGLMKDLNAITTA

SEQ ID NO: 32249 - protein, 1130 aa, Homo sapiens
  ENSP00000454024
GNETIEAQAELTVQAQPEFLKQPTNIYAHESMDIVFECEVTGKPTPTVKWVKNGDMVIPSDYFKIVKEHNLQVLGLVKSDEGFYQCIAENDVGNAQAGAQLIILEHDVAIPTLPPTSLTSATTDHLAPATTGPLPSAPRDVVASLVSTRFIKLTWRTPASDPHGDNLTYSVFYTKEGIARERVENTSHPGEMQVTIQNLMPATVYIFRVMAQNKHGSGESSAPLRVETQPEVQLPGPAPNLRAYAASPTSITVTWETPVSGNGEIQNYKLYYMEKGTDKEQDVDVSSHSYTINGLKKYTEYSFRVVAYNKHGPGVSTPDVAVRTLSDVPSAAPQNLSLEVRNSKSIMIHWQPPAPATQNGQITGYKIRYRKASRKSDVTETLVSGTQLSQLIEGLDRGTEYNFRVAALTINGTGPATDWLSAETFESDLDETRVPEVPSSLHVRPLVTSIVVSWTPPENQNIVVRGYAIGYGIGSPHAQTIKVDYKQRYYTIENLDPSSHYVITLKAFNNVGEGIPLYESAVTRPHTVPDPTPMMPPVGVQASILSHDTIRITWADNSLPKHQKITDSRYYTVRWKTNIPANTKYKNANATTLSYLVTGLKPNTLYEFSVMVTKGRRSSTWSMTAHGTTFELVPTSPPKDVTVVSKEGKPKTIIVNWQPPSEANGKITGYIIYYSTDVNAEIHDWVIEPVVGNRLTHQIQELTLDTPYYFKIQARNSKGMGPMSEAVQFRTPKASGSGGKGSRLPDLGSDYKPPMSGSNSPHGSPTSPLDSNMLLVIIVSVGVITIVVVVIIAVFCTRRTTSHQKKKRAACKSVNGSHKYKGNSKDVKPPDLWIHHERLELKPIDKSPDPNPIMTDTPIPRNSQDITPVDNSMDSNIHQRRNSYRGHESEDSMSTLAGRRGMRPKMMMPFDSQPPQPVISAHPIHSLDNPHHHFHSSSLASPARSHLYHPGSPWPIGTSMSLSDRANSTESVRNTPSTDTMPASSSQTCCTDHQDPEGATSSSYLASSQEEDSGQSLPTAHVRPSHPLKSFAVPAIPPPGPPTYDPALPSTPLLSQQALNHHIHSVKTASIGTLGRSRPPMPVVVPSAPEVQETTRMLEDSESSYEPDELTKEMAHLEGLMKDLNAITTA

SEQ ID NO: 32250 - protein, 1461 aa, Homo sapiens; identical to SEQ ID NO: 32246
  ENSP00000261908

SEQ ID NO: 32251 - protein, 1621 aa, Homo sapiens
  ENSP00000357206
MEGCMGEESFQMWELNRRLEAYLARVKALEEQNELLSAELGGLRAQSADTSWRAHADDELAALRALVDQRWREKHAAEVARDNLAEELEGVAGRCQQLRLARERTTEEVARNRRAVEAEKCARAWLSSQVAELERELEALRVAHEEERVGLNAQAACAPRCPAPPRGPPAPAPEVEELARRLGEAWRGAVRGYQERVAHMETSLGQARERLGRAVQGAREGRLELQQLQAERGGLLERRAALEQRLEGRWQERLRATEKFQLAVEALEQEKQGLQSQIAQVLEGRQQLAHLKMSLSLEVATYRTLLEAENSRLQTPGGGSKTSLSFQDPKLELQFPRTPEGRRLGSLLPVLSPTSLPSPLPATLETPVPAFLKNQEFLQARTPTLASTPIPPTPQAPSPAVDAEIRAQDAPLSLLQTQGGRKQAPEPLRAEARVAIPASVLPGPEEPGGQRQEASTGQSPEDHASLAPPLSPDHSSLEAKDGESGGSRVFSICRGEGEGQIWGLVEKETAIEGKVVSSLQQEIWEEEDLNRKEIQDSQVPLEKETLKSLGEEIQESLKTLENQSHETLERENQECPRSLEEDLETLKSLEKENKELLKDVEVVRPLEKEAVGQLKPTGKEDTQTLQSLQKENQELMKSLEGNLETFLFPGTENQELVSSLQENLESLTALEKENQEPLRSPEVGDEEALRPLTKENQEPLRSLEDENKEAFRSLEKENQEPLKTLEEEDQSIVRPLETENHKSLRSLEEQDQETLRTLEKETQQRRRSLGEQDQMTLRPPEKVDLEPLKSLDQEIARPLENENQEFLKSLKEESVEAVKSLETEILESLKSAGQENLETLKSPETQAPLWTPEEINQGAMNPLEKEIQEPLESVEVNQETFRLLEEENQESLRSLGAWNLENLRSPEEVDKESQRNLEEEENLGKGEYQESLRSLEEEGQELPQSADVQRWEDTVEKDQELAQESPPGMAGVENEDEAELNLREQDGFTGKEEVVEQGELNATEEVWIPGEGHPESPEPKEQRGLVEGASVKGGAEGLQDPEGQSQQVGAPGLQAPQGLPEAIEPLVEDDVAPGGDQASPEVMLGSEPAMGESAAGAEPGPGQGVGGLGDPGHLTREEVMEPPLEEESLEAKRVQGLEGPRKDLEEAGGLGTEFSELPGKSRDPWEPPREGREESEAEAPRGAEEAFPAETLGHTGSDAPSPWPLGSEEAEEDVPPVLVSPSPTYTPILEDAPGPQPQAEGSQEASWGVQGRAEALGKVESEQEELGSGEIPEGPQEEGEESREESEEDELGETLPDSTPLGFYLRSPTSPRWDPTGEQRPPPQGETGKEGWDPAVLASEGLEAPPSEKEEGEEGEEECGRDSDLSEEFEDLGTEAPFLPGVPGEVAEPLGQVPQLLLDPAAWDRDGESDGFADEEESGEEGEEDQEEGREPGAGRWGPGSSVGSLQALSSSQRGEFLESDSVSVSVPWDDSLRGAVAGAPKTALETESQDSAEPSGSEEESDPVSLEREDKVPGPLEIPSGMEDAGPGADIIGVNGQGPNLEGKSQHVNGGVMNGLEQSEEVGQGMPLVSEGDRGSPFQEEEGSALKTSWAGAPVHLGQGQFLKFTQREGDRESWSSGED

SEQ ID NO: 32252 - protein, 533 aa, Homo sapiens
  ENSP00000464312
MIHGRSVLHIVASLIILHLSGATKKGTEKQTTSETQKSVQCGTWTKHAEGGIFTSPNYPSKYPPDRECIYIIEAAPRQCIELYFDEKYSIEPSWECKFDHIEVRDGPFGFSPIIGRFCGQQNPPVIKSSGRFLWIKFFADGELESMGFSARYNFTPDPDFKDLGALKPLPACEFEMGGSEGIVESIQIMKEGKATASEAVDCKWYIRAPPRSKIYLRFLDYEMQNSNECKRNFVAVYDGSSSVEDLKAKFCSTVANDVMLRTGLGVIRMWADEGSRNSRFQMLFTSFQEPPCEGNTFFCHSNMCINNTLVCNGLQNCVYPWDENHCKEKRKTSLLDQLTNTSGTVIGVTSCIVIILIIISVIVQIKQPRKKYVQRKSDFDQTVFQEVFEPPHYELCTLRGTGATADFADVADDFENYHKLRRSSSKCIHDHHCGSQLSSTKGSRSNLSTRDASILTEMPTQPGKPLIPPMNRRNILVMKHSYSQDAADACDIDEIEEVPTTSHRLSRHDKAVQRFCLIGSLSKHESEYNTTRV

SEQ ID NO: 32253 - protein, 3 aa, Homo sapiens
  ENSP00000462993
  MOD_RES (1)..(1): Any amino acid
XRV

SEQ ID NO: 32254 - protein, 533 aa, Homo sapiens; identical to SEQ ID NO: 32252
  ENSP00000313088

SEQ ID NO: 32255 - protein, 156 aa, Homo sapiens
  ENSP00000381024
MLAEPFPKVVASLIILHLSGATKKGTEKQTTSETQKSVQCGTWTKHAEGGIFTSPNYPSKYPPDRECIYIIEAAPRQCIELYFDEKYSIEPSWECKFDHIEVRDGPFGFSPIIGRFCGQQNPPVIKSSGRFLWIKFFADGELESMGFSARYNFTPE

SEQ ID NO: 32256 - protein, 101 aa, Homo sapiens
  ENSP00000464188
MSLYGFVASLIILHLSGATKKGTEKQTTSETQKSVQCGTWTKHAEGGIFTSPNYPSKYPPDRECIYIIEAAPRQCIELYFDEKYSIEPSWECKFDHIEVRD

SEQ ID NO: 32257 - protein, 484 aa, Homo sapiens
  ENSP00000385402
MGVPRTPSRTVLFERERTGLTYRVPSLLPVPPGPTLLAFVEQRLSPDDSHAHRLVLRRGTLAGGSVRWGALHVLGTAALAEHRSMNPCPVHDAGTGTVFLFFIAVLGHTPEAVQIATGRNAARLCCVASRDAGLSWGSARDLTEEAIGGAVQDWATFAVGPGHGVQLPSGRLLVPAYTYRVDRRECFGKICRTSPHSFAFYSDDHGRTWRCGGLVPNLRSGECQLAAVDGGQAGSFLYCNARSPLGSRVQALSTDEGTSFLPAERVASLPETAWGCQGSIVGFPAPAPNRPRDDSWSVGPGSPLQPPLLGPGVHEPPEEAAVDPRGGQVPGGPFSRLQPRGDGPRQPGPRPGVSGDVGSWTLALPMPFAAPPQSPTWLLYSHPVGRRARLHMGIRLSQSPLDPRSWTEPWVIYEGPSGYSDLASIGPAPEGGLVFACLYESGARTSYDEISFCTFSLREVLENVPASPKPPNLGDKPRGCCWPS

SEQ ID NO: 32258 - protein, 214 aa, Homo sapiens
  ENSP00000397167
MGVPRTPSRTVLFERERTGLTYRVPSLLPVPPGPTLLAFVEQRLSPDDSHAHRLVLRRGTLAGGSVRTGPHSLWVPATVCSCPQAACWYPPTPTAWTAESVLARSAGPALTPSPSTAMTTAAPGAVEASCPTCAQASASWQRWTVGRPAASSTAMPGAHWAAVCRRSALTRAPPSCPQSAWLPCPRLPGAARAASWASQPPPPTGHGMTVGQWA

SEQ ID NO: 32259 - protein, 484 aa, Homo sapiens; identical to SEQ ID NO: 32257
  ENSP00000384804

SEQ ID NO: 32260 - protein, 158 aa, Homo sapiens
  ENSP00000394769
MGVPRTPSRTVLFERERTGLTYRVPSLLPVPPGPTLLAFVEQRLSPDDSHAHRLVLRRGTLAGGSVRWGALHVLGTAALAEHRSMNPCPVHDAGTGTVFLFFIAVLGHTPEAVQIATGRNAARLCCVASRDAGLSWGSARDLTEEAIGGAVQEEKAGR

SEQ ID NO: 32261 - protein, 188 aa, Homo sapiens
  ENSP00000397860
MGVPRTPSRTVLFERERTGLTYRVPSLLPVPPGPTLLAFVEQRLSPDDSHAHRLVLRRGTLAGGSVRWGALHVLGTAALAEHRSMNPCPVHDAGTGTVFLFFIAVLGHTPEAVQIATGRNAARLCCVASRDAGLSWGSARDLTEEAIGGAVQDWATFAVGPGHGVQLPSGRLLVPAYTYRVDRRECFG

SEQ ID NO: 32262 - protein, 496 aa, Homo sapiens
  ENSP00000385149
MMSSAAFPRWLSMGVPRTPSRTVLFERERTGLTYRVPSLLPVPPGPTLLAFVEQRLSPDDSHAHRLVLRRGTLAGGSVRWGALHVLGTAALAEHRSMNPCPVHDAGTGTVFLFFIAVLGHTPEAVQIATGRNAARLCCVASRDAGLSWGSARDLTEEAIGGAVQDWATFAVGPGHGVQLPSGRLLVPAYTYRVDRRECFGKICRTSPHSFAFYSDDHGRTWRCGGLVPNLRSGECQLAAVDGGQAGSFLYCNARSPLGSRVQALSTDEGTSFLPAERVASLPETAWGCQGSIVGFPAPAPNRPRDDSWSVGPGSPLQPPLLGPGVHEPPEEAAVDPRGGQVPGGPFSRLQPRGDGPRQPGPRPGVSGDVGSWTLALPMPFAAPPQSPTWLLYSHPVGRRARLHMGIRLSQSPLDPRSWTEPWVIYEGPSGYSDLASIGPAPEGGLVFACLYESGARTSYDEISFCTFSLREVLENVPASPKPPNLGDKPRGCCWPS

SEQ ID NO: 32263 - protein, 484 aa, Homo sapiens; identical to SEQ ID NO: 32257
  ENSP00000375830

SEQ ID NO: 32264 - protein, 497 aa, Homo sapiens
  ENSP00000320318
MMSSAAFPRWLQSMGVPRTPSRTVLFERERTGLTYRVPSLLPVPPGPTLLAFVEQRLSPDDSHAHRLVLRRGTLAGGSVRWGALHVLGTAALAEHRSMNPCPVHDAGTGTVFLFFIAVLGHTPEAVQIATGRNAARLCCVASRDAGLSWGSARDLTEEAIGGAVQDWATFAVGPGHGVQLPSGRLLVPAYTYRVDRRECFGKICRTSPHSFAFYSDDHGRTWRCGGLVPNLRSGECQLAAVDGGQAGSFLYCNARSPLGSRVQALSTDEGTSFLPAERVASLPETAWGCQGSIVGFPAPAPNRPRDDSWSVGPGSPLQPPLLGPGVHEPPEEAAVDPRGGQVPGGPFSRLQPRGDGPRQPGPRPGVSGDVGSWTLALPMPFAAPPQSPTWLLYSHPVGRRARLHMGIRLSQSPLDPRSWTEPWVIYEGPSGYSDLASIGPAPEGGLVFACLYESGARTSYDEISFCTFSLREVLENVPASPKPPNLGDKPRGCCWPS

SEQ ID NO: 32265 - protein, 52 aa, Homo sapiens
  ENSP00000412688
MPPHPGPALVGVAWEQTPRMAAGPHSALELLIPVGASQSMGVPRTPSRTVLF

SEQ ID NO: 32266 - protein, 77 aa, Homo sapiens
  ENSP00000398571
MGVPRTPSRTVLFERERTGLTYRVPSLLPVPPGPTLLAFVEQRLSPDDSHAHRLVLRRGTLAGGSVRWGALHVLGTA

SEQ ID NO: 32267 - protein, 214 aa, Homo sapiens
  ENSP00000406678
MMSSAAFPRWLSMGVPRTPSRTVLFERERTGLTYRVPSLLPVPPGPTLLAFVEQRLSPDDSHAHRLVLRRGTLAGGSVRTGPHSLWVPATVCSCPQAACWYPPTPTAWTAESVLARSAGPALTPSPSTAMTTAAPGAVEASCPTCAQASASWQRWTVGRPAASSTAMPGAHWAAVCRRSALTRAPPSCPQSAWLPCPRLPGAARAASWASQPPP

SEQ ID NO: 32268 - protein, 260 aa, Homo sapiens
  ENSP00000388707
MGVPRTPSRTVLFERERTGLTYRVPSLLPVPPGPTLLAFVEQRLSPDDSHAHRLVLRRGTLAGGSVRWGALHVLGTAALAEHRSMNPCPVHDAGTGTVFLFFIAVLGHTPEAVQIATGRNAARLCCVASRDAGLSWGSARDLTEEAIGGAVQDWATFAVGPGHGVQLPSGRLLVPAYTYRVDRRECFGKICRTSPHSFAFYSDDHGRTWRCGGLVPNLRSGECQLAAVDGGQAGSFLYCNARSPLGSRVQALSTDEGTSF

SEQ ID NO: 32269 - protein, 144 aa, Homo sapiens
  ENSP00000396197
MTSCWANSGMTLCPGHMAGRVPGALWPASPAPWHQPAWPRSMGVPRTPSRTVLFERERTGLTYRVPSLLPVPPGPTLLAFVEQRLSPDDSHAHRLVLRRGTLAGGSVRWGALHVLGTAALAEHRSMNPCPVHDAGTGTVFLFFI

SEQ ID NO: 32270 - protein, 484 aa, Homo sapiens; identical to SEQ ID NO: 32257
  ENSP00000486602

SEQ ID NO: 32271 - protein, 214 aa, Homo sapiens; identical to SEQ ID NO: 32258
  ENSP00000486591

SEQ ID NO: 32272 - protein, 484 aa, Homo sapiens; identical to SEQ ID NO: 32257
  ENSP00000478409

SEQ ID NO: 32273 - protein, 158 aa, Homo sapiens; identical to SEQ ID NO: 32260
  ENSP00000487192

SEQ ID NO: 32274 - protein, 188 aa, Homo sapiens; identical to SEQ ID NO: 32261
  ENSP00000485788

SEQ ID NO: 32275 - protein, 496 aa, Homo sapiens; identical to SEQ ID NO: 32262
  ENSP00000482722

SEQ ID NO: 32276 - protein, 484 aa, Homo sapiens; identical to SEQ ID NO: 32257
  ENSP00000483726

SEQ ID NO: 32277 - protein, 497 aa, Homo sapiens; identical to SEQ ID NO: 32264
  ENSP00000485701

SEQ ID NO: 32278 - protein, 52 aa, Homo sapiens; identical to SEQ ID NO: 32265
  ENSP00000486118

SEQ ID NO: 32279 - protein, 77 aa, Homo sapiens; identical to SEQ ID NO: 32266
  ENSP00000487199

SEQ ID NO: 32280 - protein, 214 aa, Homo sapiens; identical to SEQ ID NO: 32267
  ENSP00000485934

SEQ ID NO: 32281 - protein, 260 aa, Homo sapiens; identical to SEQ ID NO: 32268
  ENSP00000487103

SEQ ID NO: 32282 - protein, 144 aa, Homo sapiens; identical to SEQ ID NO: 32269
  ENSP00000485992

SEQ ID NO: 32283 - protein, 358 aa, Homo sapiens
  ENSP00000464186
MAQPYPPAQYPPPPQNGIPAEYAPPPPHPTQDYSGQTPVPTEHGMTLYTPAQTHPEQPGSEASTQPIAGTQTVPTDEAAQTDSQPLHPSDPTEKQQPKRLHVSNIPFRFRDPDLRQMFGQFGKILDVEIIFNERGSKGFGFVTFETSSDADRAREKLNGTIVEGRKIEVNNATARVMTNKKTGNPYTNGWKLNPVVGAVYGPEFYAVTGFPYPTTGTAVAYRGAHLRGRGRAVYNTFRAAPPPPPIPTYGAALEQTLVKMPVPWAGLAPCPLPPQQTPEPAYPTSPAFPPLSCPFASRVVYQDGFYGAEIYGGYAAYRYAQPAAAAAAYSDSYGRVYAAADPYHHTIGPAATYSIGTM

SEQ ID NO: 32284 - protein, 328 aa, Homo sapiens
  ENSP00000463964
MAQPYPPAQYPPPPQNGIPAEYAPPPPHPTQDYSGQTPVPTEHGMTLYTPAQTHPEQPGSEASTQPIAGTQTVPQTDEAAQTDSQPLHPSDPTEKQQPKRLHVSNIPFRFRDPDLRQMFGQFGKILDVEIIFNERGSKVNNATARVMTNKKTGNPYTNGWKLNPVVGAVYGPEFYAVTGFPYPTTGTAVAYRGAHLRGRGRAVYNTFRAAPPPPPIPTYGAALEQTLVKMPVPWAGLAPCPLPPQQTPEPAYPTSPAFPPLSCPFASRVVYQDGFYGAEIYGGYAAYRYAQPAAAAAAYSDSYGRVYAAADPYHHTIGPAATYSIGTM

SEQ ID NO: 32285 - protein, 312 aa, Homo sapiens
  ENSP00000463653
MAQPYPPAQYPPPPQNGIPAEYAPPPPHPTQDYSGQTPVPTEHGMTLYTPAQTHPEQPGSEASTQPIAGTQTVPQTDEAAQTDSQPLHPSDPTEKQQPKRLHVSNIPFRFRDPDLRQMFGQFGKILDVEIIFNERGSKGFGFVTFETSSDADRAREKLNGTIVEGRKIEVNNATARVMTNKKTGNPYTNGWKLNPVVGAVYGPEFYAVTGFPYPTTGTAVAYRGAHLRGRGRAVYNTFRAAPPPPPIPTYGAVVYQDGFYGAEIYGGYAAYRYAQPAAAAAAYSDSYGRVYAAADPYHHTIGPAATYSIGTM

SEQ ID NO: 32286 - protein, 75 aa, Homo sapiens
  ENSP00000465367
  MOD_RES (1)..(1): Any amino acid
XVVYQDGFYGAEIYGGYAAYRYAQPAAAAAAYSDSYGRVYAAADPYHHTIGPAATYSIGTMASLCRGGYSRFTPY

SEQ ID NO: 32287 - protein, 131 aa, Homo sapiens
  ENSP00000468693
  MOD_RES (1)..(1): Any amino acid
XVGAVYGPEFYAVTGFPYPTTGTAVAYRGAHLRGRGRAVYNTFRAAPPPPPIPTYGAVVYQDGFYGAEIYGGYAAYRYAQPAAAAAAYSDSYGRVYAAADPYHHTIGPAATYSIGTMASLCRGGYSRFTPY

SEQ ID NO: 32288 - protein, 325 aa, Homo sapiens
  ENSP00000462007
MAQPYPPAQYPPPPQNGIPAEYAPPPPHPTQDYSGQTPVPTEHGMTLYTPAQTHPEQPGSEASTQPIAGTQTVPQTDEAAQTDSQPLHPSDPTEKQQPKRLHVSNIPFRFRDPDLRQMFGQFGKILDVEIIFNERGSKGFGFVTFETSSDADRAREKLNGTIVEGRKIEVNNATARVMTNKKTGNPYTNGWKLNPVVGAVYGPEFYAVTGFPYPTTGTAVAYRGAHLRGRGRAVYNTFRAAPPPPPIPTYGAVVYQDGFYGAEIYGGYAAYRYAQPAAAAAAYSDSYGRVYAAADPYHHTIGPAATYSIGTMVRSPGPPSPGCQS

SEQ ID NO: 32289 - protein, 52 aa, Homo sapiens
  ENSP00000467872
MLCSMANSGCLLLSNSGSMLPHSVPCPPAFLYLQQSDQDATAPPEAMAQPYP

SEQ ID NO: 32290 - protein, 4 aa, Homo sapiens
  ENSP00000464946
MAQP

SEQ ID NO: 32291 - protein, 358 aa, Homo sapiens; identical to SEQ ID NO: 32283
  ENSP00000464186

SEQ ID NO: 32292 - protein, 328 aa, Homo sapiens; identical to SEQ ID NO: 32284
  ENSP00000463964

SEQ ID NO: 32293 - protein, 312 aa, Homo sapiens; identical to SEQ ID NO: 32285
  ENSP00000463653

SEQ ID NO: 32294 - protein, 75 aa, Homo sapiens; identical to SEQ ID NO: 32286
  ENSP00000465367
  MOD_RES (1)..(1): Any amino acid

SEQ ID NO: 32295 - protein, 131 aa, Homo sapiens; identical to SEQ ID NO: 32287
  ENSP00000468693
  MOD_RES (1)..(1): Any amino acid

SEQ ID NO: 32296 - protein, 325 aa, Homo sapiens; identical to SEQ ID NO: 32288
  ENSP00000462007

SEQ ID NO: 32297 - protein, 52 aa, Homo sapiens; identical to SEQ ID NO: 32289
  ENSP00000467872

SEQ ID NO: 32298 - protein, 4 aa, Homo sapiens
  ENSP00000464946
MAQP

SEQ ID NO: 32299 - protein, 574 aa, Homo sapiens
  ENSP00000358795
MGNNFSSIPSLPRGNPSRAPRGHPQNLKDSIGGPFPVTSHRCHHKQKHCPAVLPSGGLPATPLLFHPHTKGSQILMDLSHKAVKRQASFCNAITFSNRPVLIYEQVRLKITKKQCCWSGALRLGFTSKDPSRIHPDSLPKYACPDLVSQSGFWAKALPEEFANEGNIIAFWVDKKGRVFHRINDSAVMLFFSGVRTADPLWALVDVYGLTRGVQLLDSELVLPDCLRPRSFTALRRPSLRREADDARLSVSLCDLNVPGADGDEAAPAAGCPIPQNSLNSQHSRALPAQLDGDLRFHALRAGAHVRILDEQTVARVEHGRDERALVFTSRPVRVAETIFVKVTRSGGARPGALSFGVTTCDPGTLRPADLPFSPEALVDRKEFWAVCRVPGPLHSGDILGLVVNADGELHLSHNGAAAGMQLCVDASQPLWMLFGLHGTITQIRILGSTILAERGIPSLPCSPASTPTSPSALGSRLSDPLLSTCSSGPLGSSAGGTAPNSPVSLPESPVTPGLGQWSDECTICYEHAVDTVIYTCGHMCLCYACGLRLKKALHACCPICRRPIKDIIKTYRSS

SEQ ID NO: 32300 - protein, 199 aa, Homo sapiens
  ENSP00000416709
MGGQITRSTLHDSIGGPFPVTSHRCHHKQKHCPAVLPSGGLPATPLLFHPHTKGSQILMDLSHKAVKRQASFCNAITFSNRPVLIYEQVRLKITKKQCCWSGALRLGFTSKDPSRIHPDSLPKYACPDLVSQSGFWAKALPEEFANEGNIIAFWVDKKGRVFHRINDSAVMLFFSGVRTADPLWALVDVYGLTRGVQLL

SEQ ID NO: 32301 - protein, 108 aa, Homo sapiens
  ENSP00000387714
MDLSHKAVKRQASFCNAITFSNRPVLIYEQVRLKITKKQCCWSGALRLGFTSKDPSRIHPDSLPKYACPDLVSQSGFWAKALPEEFANEGNIIAFWVDKKGRVFHRIN

SEQ ID NO: 32302 - protein, 356 aa, Homo sapiens
  ENSP00000295108
MTKSYSESGLMGEPQPQGPPSWTDECLSSQDEEHEADKKEDDLETMNAEEDSLRNGGEEEDEDEDLEEEEEEEEEDDDQKPKRRGPKKKKMTKARLERFKLRRMKANARERNRMHGLNAALDNLRKVVPCYSKTQKLSKIETLRLAKNYIWALSEILRSGKSPDLVSFVQTLCKGLSQPTTNLVAGCLQLNPRTFLPEQNQDMPPHLPTASASFPVHPYSYQSPGLPSPPYGTMDSSHVFHVKPPPHAYSAALEPFFESPLTDCTSPSFDGPLSPPLSINGNFSFKHEPSAEFEKNYAFTMHYPAATLAGAQSHGSIFSGTAAPRCEIPIDNIMSFDSHSHHERVMSAQLNAIFHD

SEQ ID NO: 32303 - protein, 337 aa, Homo sapiens
  ENSP00000297142
MLTLPFDESVVMPESQMCRKFSRECEDQKQIKKPESFSKQIVLRGKSIKRAPGEETEKEEEEEDREEEDENGLPRRRGLRKKKTTKLRLERVKFRRQEANARERNRMHGLNDALDNLRKVVPCYSKTQKLSKIETLRLAKNYIWALSEILRIGKRPDLLTFVQNLCKGLSQPTTNLVAGCLQLNARSFLMGQGGEAAHHTRSPYSTFYPPYHSPELTTPPGHGTLDNSKSMKPYNYCSAYESFYESTSPECASPQFEGPLSPPPINYNGIFSLKQEETLDYGKNYNYGMHYCAVPPRGPLGQGAMFRLPTDSHFPYDLHLRSQSLTMQDELNAVFHN

SEQ ID NO: 32304 - protein, 321 aa, Homo sapiens
  ENSP00000383814
MNDISQKAEIKEMLASDDEEDVSSKVEKAYVPKLTGTVKGRFAEMEKQRQEEQRKRTEEERKRRIEQDMLEKRKIQRELAKRAEQIEDINNTGTESASEEGDDSLLITVVPVKSYKTSGKMKKNFEDLEKEREEKERIKYEEDKRIRYEEQRPSLKEAKCLSLVMDDEIESEAKKESLSPGKLKLTFEELERQRQENRKKQAEEEARKRLEEEKRAFEEARRQMVNEDEENQDTAKIFKGYRPGKLKLSFEEMERQRREDEKRKAEEEARRRIEEEKKAFAEARRNMVVDDDSPEMYKTISQEFLTPGKLEINFEELLKQK

SEQ ID NO: 32305 - protein, 675 aa, Homo sapiens
  ENSP00000333938
MNDISQKAEILLSSSKPVPKTYVPKLGKGDVKDKFEAMQRAREERNQRRSRDEKQRRKEQYIREREWNRRKQEIKEMLASDDEEDVSSKVEKAYVPKLTGTVKGRFAEMEKQRQEEQRKRTEEERKRRIEQDMLEKRKIQRELAKRAEQIEDINNTGTESASEEGDDSLLITVVPVKSYKTSGKMKKNFEDLEKEREEKERIKYEEDKRIRYEEQRPSLKEAKCLSLVMDDEIESEAKKESLSPGKLKLTFEELERQRQENRKKQAEEEARKRLEEEKRAFEEARRQMVNEDEENQDTAKIFKGYRPGKLKLSFEEMERQRREDEKRKAEEEARRRIEEEKKAFAEARRNMVVDDDSPEMYKTISQEFLTPGKLEINFEELLKQKMEEEKRRTEEERKHKLEMEKQEFEQLRQEMGEEEEENETFGLSREYEELIKLKRSGSIQAKNLKSKFEKIGQLSEKEIQKKIEEERARRRAIDLEIKEREAENFHEEDDVDVRPARKSEAPFTHKVNMKARFEQMAKAREEEEQRRIEEQKLLRMQFEQREIDAALQKKREEEEEEEGSIMNGSTAEDEEQTRSGAPWFKKPLKNTSVVDSEPVRFTVKVTGEPKPEITWWFEGEILQDGEDYQYIERGETYCLYLPETFPEDGGEYMCKAVNNKGSAASTCILTIESKN

SEQ ID NO: 32306 - protein, 435 aa, Homo sapiens
  ENSP00000411902
MNDISQKAEILLSSSKPVPKTYVPKLGKGDVKDKFEAMQRAREERNQRRSRDEKQRRKEQYIREREWNRRKQEIKEMLASDDEEDVSSKVEKAYVPKLTGTVKGRFAEMEKQRQEEQRKRTEEERKRRIEQDMLEKRKIQRELAKRAEQEGDDSLLITVVPVKSYKTSGKMKKNFEDLEKEREEKERIKYEEDKRIRYEEQRPSLKEAKCLSLVMDDEIESEAKKESLSPGKLKLTFEELERQRQENRKKQAEEEARKRLEEEKRAFEEARRQMVNEDEENQDTAKIFKGYRPGKLKLSFEEMERQRREDEKRKAEEEARRRIEEEKKAFAEARRNMVVDDDSPEMYKTISQEFLTPGKLEINFEELLKQKMEEEKRRTEEERKHKLEMEKQEFEQLRQEMGEEEEENETFGLSREYEELIKLKRSGSIQAKNLK

SEQ ID NO: 32307 - protein, 576 aa, Homo sapiens
  ENSP00000343928
  MOD_RES (1)..(1): Any amino acid
XVKGRFAEMEKQRQEEQRKRTEEERKRRIEQDMLEKRKIQRELAKRAEQIEDINNTGTESASEEGDDSLLITVVPVKSYKTSGKMKKNFEDLEKEREEKERIKYEEDKRIRYEEQRPSLKEAKCLSLVMDDEIESEAKKESLSPGKLKLTFEELERQRQENRKKQAEEEARKRLEEEKRAFEEARRQMVNEDEENQDTAKIFKGYRPGKLKLSFEEMERQRREDEKRKAEEEARRRIEEEKKAFAEARRNMVVDDDSPEMYKTISQEFLTPGKLEINFEELLKQKMEEEKRRTEEERKHKLEMEKQEFEQLRQEMGEEEEENETFGLSREYEELIKLKRSGSIQAKNLKSKFEKIGQLSEKEIQKKIEEERARRRAIDLEIKEREAENFHEEDDVDVRPARKSEAPFTHKVNMKARFEQMAKAREEEEQRRIEEQKLLRMQFEQREIDAALQKKREEEEEEEGSIMNGSTAEDEEQTRSGAPWFKKPLKNTSVVDSEPVRFTVKVTGEPKPEITWWFEGEILQDGEDYQYIERGETYCLYLPETFPEDGGEYMCKAVNNKGSAASTCILTIETDDY

SEQ ID NO: 32308 - protein, 611 aa, Homo sapiens
  ENSP00000327363
MNDISQKAEIKEMLASDDEEDVSSKVEKAYVPKLTGTVKGRFAEMEKQRQEEQRKRTEEERKRRIEQDMLEKRKIQRELAKRAEQIEDINNTGTESASEEGDDSLLITVVPVKSYKTSGKMKKNFEDLEKEREEKERIKYEEDKRIRYEEQRPSLKEAKCLSLVMDDEIESEAKKESLSPGKLKLTFEELERQRQENRKKQAEEEARKRLEEEKRAFEEARRQMVNEDEENQDTAKIFKGYRPGKLKLSFEEMERQRREDEKRKAEEEARRRIEEEKKAFAEARRNMVVDDDSPEMYKTISQEFLTPGKLEINFEELLKQKMEEEKRRTEEERKHKLEMEKQEFEQLRQEMGEEEEENETFGLSREYEELIKLKRSGSIQAKNLKSKFEKIGQLSEKEIQKKIEEERARRRAIDLEIKEREAENFHEEDDVDVRPARKSEAPFTHKVNMKARFEQMAKAREEEEQRRIEEQKLLRMQFEQREIDAALQKKREEEEEEEGSIMNGSTAEDEEQTRSGAPWFKKPLKNTSVVDSEPVRFTVKVTGEPKPEITWWFEGEILQDGEDYQYIERGETYCLYLPETFPEDGGEYMCKAVNNKGSAASTCILTIESKN

SEQ ID NO: 32309 - protein, 270 aa, Homo sapiens
  ENSP00000333680
MENQPVRWRALPGLPRPPGLPAAPWLLLGVLLLPGTLRLAGGQSVTHTGLPIMASLANTAISFSCRITYPYTPQFKVFTVSYFHEDLQGQRSPKKPTNCHPGLGTENQSHTLDCQVTLVLPGASATGTYYCSVHWPHSTVRGSGTFILVRDAGYREPPQSPQKLLLFGFTGLLSVLSVVGTALLLWNKKRMRGPGKDPTRKCPDPRSASSPKQHPSESVYTALQRRETEVYACIENEDGSSPTAKQSPLSQERPHRFEDDGELNLVYENL

SEQ ID NO: 32310 - protein, 164 aa, Homo sapiens
  ENSP00000347650
MENQPVRWRALPGLPRPPGLPAAPWLLLGVLLLPGTLRLAGGQSVTHTGLPIMASLANTAISFSCRITYPYTPQFKVFTVSYFHEDLQGQRSPKKPTNCHPGLGTENQSHTLDCQVTLVLPGASATGTYYCSVHWPHSTVRGSGTFILVRETRFRHVGQAGLES

SEQ ID NO: 32311 - protein, 921 aa, Homo sapiens
  ENSP00000360619
MNAPERQPQPDGGDAPGHEPGGSPQDELDFSILFDYEYLNPNEEEPNAHKVASPPSGPAYPDDVLDYGLKPYSPLASLSGEPPGRFGEPDRVGPQKFLSAAKPAGASGLSPRIEITPSHELIQAVGPLRMRDAGLLVEQPPLAGVAASPRFTLPVPGFEGYREPLCLSPASSGSSASFISDTFSPYTSPCVSPNNGGPDDLCPQFQNIPAHYSPRTSPIMSPRTSLAEDSCLGRHSPVPRPASRSSSPGAKRRHSCAEALVALPPGASPQRSRSPSPQPSSHVAPQDHGSPAGYPPVAGSAVIMDALNSLATDSPCGIPPKMWKTSPDPSPVSAAPSKAGLPRHIYPAVEFLGPCEQGERRNSAPESILLVPPTWPKPLVPAIPICSIPVTASLPPLEWPLSSQSGSYELRIEVQPKPHHRAHYETEGSRGAVKAPTGGHPVVQLHGYMENKPLGLQIFIGTADERILKPHAFYQVHRITGKTVTTTSYEKIVGNTKVLEIPLEPKNNMRATIDCAGILKLRNADIELRKGETDIGRKNTRVRLVFRVHIPESSGRIVSLQTASNPIECSQRSAHELPMVERQDTDSCLVYGGQQMILTGQNFTSESKVVFTEKTTDGQQIWEMEATVDKDKSQPNMLFVEIPEYRNKHIRTPVKVNFYVINGKRKRSQPQHFTYHPVPAIKTEPTDEYDPTLICSPTHGGLGSQPYYPQHPMVAESPSCLVATMAPCQQFRTGLSSPDARYQQQNPAAVLYQRSKSLSPSLLGYQQPALMAAPLSLADAHRSVLVHAGSQGQSSALLHPSPTNQQASPVIHYSPTNQQLRCGSHQEFQHIMYCENFAPGTTRPGPPPVSQGQRLSPGSYPTVIQQQNATSQRAAKNGPPVSDQKEVLPAGVTIKQEQNLDQTYLDDELIDTHLSWIQNIL

SEQ ID NO: 32312 - protein, 925 aa, Homo sapiens
  ENSP00000379330
MNAPERQPQPDGGDAPGHEPGGSPQDELDFSILFDYEYLNPNEEEPNAHKVASPPSGPAYPDDVLDYGLKPYSPLASLSGEPPGRFGEPDRVGPQKFLSAAKPAGASGLSPRIEITPSHELIQAVGPLRMRDAGLLVEQPPLAGVAASPRFTLPVPGFEGYREPLCLSPASSGSSASFISDTFSPYTSPCVSPNNGGPDDLCPQFQNIPAHYSPRTSPIMSPRTSLAEDSCLGRHSPVPRPASRSSSPGAKRRHSCAEALVALPPGASPQRSRSPSPQPSSHVAPQDHGSPAGYPPVAGSAVIMDALNSLATDSPCGIPPKMWKTSPDPSPVSAAPSKAGLPRHIYPAVEFLGPCEQGERRNSAPESILLVPPTWPKPLVPAIPICSIPVTASLPPLEWPLSSQSGSYELRIEVQPKPHHRAHYETEGSRGAVKAPTGGHPVVQLHGYMENKPLGLQIFIGTADERILKPHAFYQVHRITGKTVTTTSYEKIVGNTKVLEIPLEPKNNMRATIDCAGILKLRNADIELRKGETDIGRKNTRVRLVFRVHIPESSGRIVSLQTASNPIECSQRSAHELPMVERQDTDSCLVYGGQQMILTGQNFTSESKVVFTEKTTDGQQIWEMEATVDKDKSQPNMLFVEIPEYRNKHIRTPVKVNFYVINGKRKRSQPQHFTYHPVPAIKTEPTDEYDPTLICSPTHGGLGSQPYYPQHPMVAESPSCLVATMAPCQQFRTGLSSPDARYQQQNPAAVLYQRSKSLSPSLLGYQQPALMAAPLSLADAHRSVLVHAGSQGQSSALLHPSPTNQQASPVIHYSPTNQQLRCGSHQEFQHIMYCENFAPGTTRPGPPPVSQGQRLSPGSYPTVIQQQNATSQRAAKNGPPVSDQKEVLPAGVTIKQEQNLDQTYLDDVNEIIRKEFSGPPARNQT

SEQ ID NO: 32313 - protein, 905 aa, Homo sapiens
  ENSP00000477370
MQREAAFRLGHCHPLRIMGSVDQEEPNAHKVASPPSGPAYPDDVLDYGLKPYSPLASLSGEPPGRFGEPDRVGPQKFLSAAKPAGASGLSPRIEITPSHELIQAVGPLRMRDAGLLVEQPPLAGVAASPRFTLPVPGFEGYREPLCLSPASSGSSASFISDTFSPYTSPCVSPNNGGPDDLCPQFQNIPAHYSPRTSPIMSPRTSLAEDSCLGRHSPVPRPASRSSSPGAKRRHSCAEALVALPPGASPQRSRSPSPQPSSHVAPQDHGSPAGYPPVAGSAVIMDALNSLATDSPCGIPPKMWKTSPDPSPVSAAPSKAGLPRHIYPAVEFLGPCEQGERRNSAPESILLVPPTWPKPLVPAIPICSIPVTASLPPLEWPLSSQSGSYELRIEVQPKPHHRAHYETEGSRGAVKAPTGGHPVVQLHGYMENKPLGLQIFIGTADERILKPHAFYQVHRITGKTVTTTSYEKIVGNTKVLEIPLEPKNNMRATIDCAGILKLRNADIELRKGETDIGRKNTRVRLVFRVHIPESSGRIVSLQTASNPIECSQRSAHELPMVERQDTDSCLVYGGQQMILTGQNFTSESKVVFTEKTTDGQQIWEMEATVDKDKSQPNMLFVEIPEYRNKHIRTPVKVNFYVINGKRKRSQPQHFTYHPVPAIKTEPTDEYDPTLICSPTHGGLGSQPYYPQHPMVAESPSCLVATMAPCQQFRTGLSSPDARYQQQNPAAVLYQRSKSLSPSLLGYQQPALMAAPLSLADAHRSVLVHAGSQGQSSALLHPSPTNQQASPVIHYSPTNQQLRCGSHQEFQHIMYCENFAPGTTRPGPPPVSQGQRLSPGSYPTVIQQQNATSQRAAKNGPPVSDQKEVLPAGVTIKQEQNLDQTYLDDVNEIIRKEFSGPPARNQT

SEQ ID NO: 32314 - protein, 702 aa, Homo sapiens
  ENSP00000477142
MSPRTSLAEDSCLGRHSPVPRPASRSSSPGAKRRHSCAEALVALPPGASPQRSRSPSPQPSSHVAPQDHGSPAGYPPVAGSAVIMDALNSLATDSPCGIPPKMWKTSPDPSPVSAAPSKAGLPRHIYPAVEFLGPCEQGERRNSAPESILLVPPTWPKPLVPAIPICSIPVTASLPPLEWPLSSQSGSYELRIEVQPKPHHRAHYETEGSRGAVKAPTGGHPVVQLHGYMENKPLGLQIFIGTADERILKPHAFYQVHRITGKTVTTTSYEKIVGNTKVLEIPLEPKNNMRATIDCAGILKLRNADIELRKGETDIGRKNTRVRLVFRVHIPESSGRIVSLQTASNPIECSQRSAHELPMVERQDTDSCLVYGGQQMILTGQNFTSESKVVFTEKTTDGQQIWEMEATVDKDKSQPNMLFVEIPEYRNKHIRTPVKVNFYVINGKRKRSQPQHFTYHPVPAIKTEPTDEYDPTLICSPTHGGLGSQPYYPQHPMVAESPSCLVATMAPCQQFRTGLSSPDARYQQQNPAAVLYQRSKSLSPSLLGYQQPALMAAPLSLADAHRSVLVHAGSQGQSSALLHPSPTNQQASPVIHYSPTNQQLRCGSHQEFQHIMYCENFAPGTTRPGPPPVSQGQRLSPGSYPTVIQQQNATSQRAAKNGPPVSDQKEVLPAGVTIKQEQNLDQTYLDDELIDTHLSWIQNIL

SEQ ID NO: 32315 - protein, 901 aa, Homo sapiens
  ENSP00000396471
MQREAAFRLGHCHPLRIMGSVDQEEPNAHKVASPPSGPAYPDDVLDYGLKPYSPLASLSGEPPGRFGEPDRVGPQKFLSAAKPAGASGLSPRIEITPSHELIQAVGPLRMRDAGLLVEQPPLAGVAASPRFTLPVPGFEGYREPLCLSPASSGSSASFISDTFSPYTSPCVSPNNGGPDDLCPQFQNIPAHYSPRTSPIMSPRTSLAEDSCLGRHSPVPRPASRSSSPGAKRRHSCAEALVALPPGASPQRSRSPSPQPSSHVAPQDHGSPAGYPPVAGSAVIMDALNSLATDSPCGIPPKMWKTSPDPSPVSAAPSKAGLPRHIYPAVEFLGPCEQGERRNSAPESILLVPPTWPKPLVPAIPICSIPVTASLPPLEWPLSSQSGSYELRIEVQPKPHHRAHYETEGSRGAVKAPTGGHPVVQLHGYMENKPLGLQIFIGTADERILKPHAFYQVHRITGKTVTTTSYEKIVGNTKVLEIPLEPKNNMRATIDCAGILKLRNADIELRKGETDIGRKNTRVRLVFRVHIPESSGRIVSLQTASNPIECSQRSAHELPMVERQDTDSCLVYGGQQMILTGQNFTSESKVVFTEKTTDGQQIWEMEATVDKDKSQPNMLFVEIPEYRNKHIRTPVKVNFYVINGKRKRSQPQHFTYHPVPAIKTEPTDEYDPTLICSPTHGGLGSQPYYPQHPMVAESPSCLVATMAPCQQFRTGLSSPDARYQQQNPAAVLYQRSKSLSPSLLGYQQPALMAAPLSLADAHRSVLVHAGSQGQSSALLHPSPTNQQASPVIHYSPTNQQLRCGSHQEFQHIMYCENFAPGTTRPGPPPVSQGQRLSPGSYPTVIQQQNATSQRAAKNGPPVSDQKEVLPAGVTIKQEQNLDQTYLDDELIDTHLSWIQNIL

SEQ ID NO: 32316 - protein, 702 aa, Homo sapiens; identical to SEQ ID NO: 32314
  ENSP00000477342

SEQ ID NO: 32317 - protein, 964 aa, Homo sapiens
  ENSP00000388910
MITTLPSLLPASLASISHRVTNLPSNSLSHNPGLSKPDFPGNSSPGLPSSSSPGRDLGAPAGSMGAASCEDEELEFKLVFGEEKEAPPLGAGGLGEELDSEDAPPCCRLALGEPPPYGAAPIGIPRPPPPRPGMHSPPPRPAPSPGTWESQPARSVRLGGPGGGAGGAGGGRVLECPSIRITSISPTPEPPAALEDNPDAWGDGSPRDYPPPEGFGGYREAGGQGGGAFFSPSPGSSSLSSWSFFSDASDEAALYAACDEVESELNEAASRFGLGSPLPSPRASPRPWTPEDPWSLYGPSPGGRGPEDSWLLLSAPGPTPASPRPASPCGKRRYSSSGTPSSASPALSRRGSLGEEGSEPPPPPPLPLARDPGSPGPFDYVGAPPAESIPQKTRRTSSEQAVALPRSEEPASCNGKLPLGAEESVAPPGGSRKEVAGMDYLAVPSPLAWSKARIGGHSPIFRTSALPPLDWPLPSQYEQLELRIEVQPRAHHRAHYETEGSRGAVKAAPGGHPVVKLLGYSEKPLTLQMFIGTADERNLRPHAFYQVHRITGKMVATASYEAVVSGTKVLEMTLLPENNMAANIDCAGILKLRNSDIELRKGETDIGRKNTRVRLVFRVHVPQGGGKVVSVQAASVPIECSQRSAQELPQVEAYSPSACSVRGGEELVLTGSNFLPDSKVVFIERGPDGKLQWEEEATVNRLQSNEVTLTLTVPEYSNKRVSRPVQVYFYVSNGRRKRSPTQSFRFLPVICKEEPLPDSSLRGFPSASATPFGTDMDFSPPRPPYPSYPHEDPACETPYLSEGFGYGMPPLYPQTGPPPSYRPGLRMFPETRGTTGCAQPPAVSFLPRPFPSDPYGGRGSSFSLGLPFSPPAPFRPPPLPASPPLEGPFPSQSDVHPLPAEGYNKVGPGYGPGEGAPEQEKSRGGYSSGFRDSVPIQGITLEEGGCGTGGCECECVQEIALHVC

SEQ ID NO: 32318 - protein, 857 aa, Homo sapiens
  ENSP00000452039
MITTLPSLLPASLASISHRVTNLPSNSLSHNPGLSKPDFPGNSSPGLPSSSSPGRDLGAPAGSMGAASCEDEELEFKLVFGEEKEAPPLGAGGLGEELDSEDAPPCCRLALGEPPPYGAAPIGIPRPPPPRPGMHSPPPRPAPSPGTWESQPARSVRLGGPGGGAGGAGGGRVLECPSIRITSISPTPEPPAALEDNPDAWGDGSPRDYPPPEGFGGYREAGGQGGGAFFSPSPGSSSLSSWSFFSDASDEAALYAACDEVESELNEAASRFGLGSPLPSPRASPRPWTPEDPWSLYGPSPGGRGPEDSWLLLSAPGPTPASPRPASPCGKRRYSSSGTPSSASPALSRRGSLGEEGSEPPPPPPLPLARDPGSPGPFDYVGAPPAESIPQKTRRTSSEQAVALPRSEEPASCNGKLPLGAEESVAPPGGSRKEVAGMDYLAVPSPLAWSKARIGGHSPIFRTSALPPLDWPLPSQYEQLELRIEVQPRAHHRAHYETEGSRGAVKAAPGGHPVVKLLGYSEKPLTLQMFIGTADERNLRPHAFYQVHRITGKMVATASYEAVVSGTKVLEMTLLPENNMAANIDCAGILKLRNSDIELRKGETDIGRKNTRVRLVFRVHVPQGGGKVVSVQAASVPIECSQRSAQELPQVEAYSPSACSVRGGEELVLTGSNFLPDSKVVFIERGPDGKLQWEEEATVNRLQSNEVTLTLTVPEYSNKRVSRPVQVYFYVSNGRRKRSPTQSFRFLPVICKEEPLPDSSLRGFPSASATPFGTDMDFSPPRPPYPSYPHEDPACETPYLSEGFGYGMPPLYPQTGPPPSYRPGLRMFPETRGTTVSEIIGRDLSGFPAPPGEEPPA

SEQ ID NO: 32319 - protein, 915 aa, Homo sapiens
  ENSP00000451224
MLSGRDLGAPAGSMGAASCEDEELEFKLVFGEEKEAPPLGAGGLGEELDSEDAPPCCRLALGEPPPYGAAPIGIPRPPPPRPGMHSPPPRPAPSPGTWESQPARSVRLGGPGGGAGGAGGGRVLECPSIRITSISPTPEPPAALEDNPDAWGDGSPRDYPPPEGFGGYREAGGQGGGAFFSPSPGSSSLSSWSFFSDASDEAALYAACDEVESELNEAASRFGLGSPLPSPRASPRPWTPEDPWSLYGPSPGGRGPEDSWLLLSAPGPTPASPRPASPCGKRRYSSSGTPSSASPALSRRGSLGEEGSEPPPPPPLPLARDPGSPGPFDYVGAPPAESIPQKTRRTSSEQAVALPRSEEPASCNGKLPLGAEESVAPPGGSRKEVAGMDYLAVPSPLAWSKARIGGHSPIFRTSALPPLDWPLPSQYEQLELRIEVQPRAHHRAHYETEGSRGAVKAAPGGHPVVKLLGYSEKPLTLQMFIGTADERNLRPHAFYQVHRITGKMVATASYEAVVSGTKVLEMTLLPENNMAANIDCAGILKLRNSDIELRKGETDIGRKNTRVRLVFRVHVPQGGGKVVSVQAASVPIECSQRSAQELPQVEAYSPSACSVRGGEELVLTGSNFLPDSKVVFIERGPDGKLQWEEEATVNRLQSNEVTLTLTVPEYSNKRVSRPVQVYFYVSNGRRKRSPTQSFRFLPVICKEEPLPDSSLRGFPSASATPFGTDMDFSPPRPPYPSYPHEDPACETPYLSEGFGYGMPPLYPQTGPPPSYRPGLRMFPETRGTTGCAQPPAVSFLPRPFPSDPYGGRGSSFSLGLPFSPPAPFRPPPLPASPPLEGPFPSQSDVHPLPAEGYNKVGPGYGPGEGAPEQEKSRGGYSSGFRDSVPIQGITLEEVSEIIGRDLSGFPAPPGEEPPA

SEQ ID NO: 32320 - protein, 807 aa, Homo sapiens
  ENSP00000450644
MLSGRDLGAPAGSMGAASCEDEELEFKLVFGEEKEAPPLGAGGLGEELDSEDAPPCCRLALGEPPPYGAAPIGIPRPPPPRPGMHSPPPRPAPSPGTWESQPARSVRLGGPGGGAGGAGGGRVLECPSIRITSISPTPEPPAALEDNPDAWGDGSPRDYPPPEGFGGYREAGGQGGGAFFSPSPGSSSLSSWSFFSDASDEAALYAACDEVESELNEAASRFGLGSPLPSPRASPRPWTPEDPWSLYGPSPGGRGPEDSWLLLSAPGPTPASPRPASPCGKRRYSSSGTPSSASPALSRRGSLGEEGSEPPPPPPLPLARDPGSPGPFDYVGAPPAESIPQKTRRTSSEQAVALPRSEEPASCNGKLPLGAEESVAPPGGSRKEVAGMDYLAVPSPLAWSKARIGGHSPIFRTSALPPLDWPLPSQYEQLELRIEVQPRAHHRAHYETEGSRGAVKAAPGGHPVVKLLGYSEKPLTLQMFIGTADERNLRPHAFYQVHRITGKMVATASYEAVVSGTKVLEMTLLPENNMAANIDCAGILKLRNSDIELRKGETDIGRKNTRVRLVFRVHVPQGGGKVVSVQAASVPIECSQRSAQELPQVEAYSPSACSVRGGEELVLTGSNFLPDSKVVFIERGPDGKLQWEEEATVNRLQSNEVTLTLTVPEYSNKRVSRPVQVYFYVSNGRRKRSPTQSFRFLPVICKEEPLPDSSLRGFPSASATPFGTDMDFSPPRPPYPSYPHEDPACETPYLSEGFGYGMPPLYPQTGPPPSYRPGLRMFPETRGTTVSEIIGRDLSGFPAPPGEEPPA

SEQ ID NO: 32321 - protein, 914 aa, Homo sapiens
  ENSP00000388668
MLSGRDLGAPAGSMGAASCEDEELEFKLVFGEEKEAPPLGAGGLGEELDSEDAPPCCRLALGEPPPYGAAPIGIPRPPPPRPGMHSPPPRPAPSPGTWESQPARSVRLGGPGGGAGGAGGGRVLECPSIRITSISPTPEPPAALEDNPDAWGDGSPRDYPPPEGFGGYREAGGQGGGAFFSPSPGSSSLSSWSFFSDASDEAALYAACDEVESELNEAASRFGLGSPLPSPRASPRPWTPEDPWSLYGPSPGGRGPEDSWLLLSAPGPTPASPRPASPCGKRRYSSSGTPSSASPALSRRGSLGEEGSEPPPPPPLPLARDPGSPGPFDYVGAPPAESIPQKTRRTSSEQAVALPRSEEPASCNGKLPLGAEESVAPPGGSRKEVAGMDYLAVPSPLAWSKARIGGHSPIFRTSALPPLDWPLPSQYEQLELRIEVQPRAHHRAHYETEGSRGAVKAAPGGHPVVKLLGYSEKPLTLQMFIGTADERNLRPHAFYQVHRITGKMVATASYEAVVSGTKVLEMTLLPENNMAANIDCAGILKLRNSDIELRKGETDIGRKNTRVRLVFRVHVPQGGGKVVSVQAASVPIECSQRSAQELPQVEAYSPSACSVRGGEELVLTGSNFLPDSKVVFIERGPDGKLQWEEEATVNRLQSNEVTLTLTVPEYSNKRVSRPVQVYFYVSNGRRKRSPTQSFRFLPVICKEEPLPDSSLRGFPSASATPFGTDMDFSPPRPPYPSYPHEDPACETPYLSEGFGYGMPPLYPQTGPPPSYRPGLRMFPETRGTTGCAQPPAVSFLPRPFPSDPYGGRGSSFSLGLPFSPPAPFRPPPLPASPPLEGPFPSQSDVHPLPAEGYNKVGPGYGPGEGAPEQEKSRGGYSSGFRDSVPIQGITLEEGGCGTGGCECECVQEIALHVC

SEQ ID NO: 32322 - protein, 933 aa, Homo sapiens
  ENSP00000439350
MADGGADSAAQRLPEGPGRVAPGRDLGAPAGSMGAASCEDEELEFKLVFGEEKEAPPLGAGGLGEELDSEDAPPCCRLALGEPPPYGAAPIGIPRPPPPRPGMHSPPPRPAPSPGTWESQPARSVRLGGPGGGAGGAGGGRVLECPSIRITSISPTPEPPAALEDNPDAWGDGSPRDYPPPEGFGGYREAGGQGGGAFFSPSPGSSSLSSWSFFSDASDEAALYAACDEVESELNEAASRFGLGSPLPSPRASPRPWTPEDPWSLYGPSPGGRGPEDSWLLLSAPGPTPASPRPASPCGKRRYSSSGTPSSASPALSRRGSLGEEGSEPPPPPPLPLARDPGSPGPFDYVGAPPAESIPQKTRRTSSEQAVALPRSEEPASCNGKLPLGAEESVAPPGGSRKEVAGMDYLAVPSPLAWSKARIGGHSPIFRTSALPPLDWPLPSQYEQLELRIEVQPRAHHRAHYETEGSRGAVKAAPGGHPVVKLLGYSEKPLTLQMFIGTADERNLRPHAFYQVHRITGKMVATASYEAVVSGTKVLEMTLLPENNMAANIDCAGILKLRNSDIELRKGETDIGRKNTRVRLVFRVHVPQGGGKVVSVQAASVPIECSQRSAQELPQVEAYSPSACSVRGGEELVLTGSNFLPDSKVVFIERGPDGKLQWEEEATVNRLQSNEVTLTLTVPEYSNKRVSRPVQVYFYVSNGRRKRSPTQSFRFLPVICKEEPLPDSSLRGFPSASATPFGTDMDFSPPRPPYPSYPHEDPACETPYLSEGFGYGMPPLYPQTGPPPSYRPGLRMFPETRGTTGCAQPPAVSFLPRPFPSDPYGGRGSSFSLGLPFSPPAPFRPPPLPASPPLEGPFPSQSDVHPLPAEGYNKVGPGYGPGEGAPEQEKSRGGYSSGFRDSVPIQGITLEEGGCGTGGCECECVQEIALHVC

SEQ ID NO: 32323 - protein, 934 aa, Homo sapiens
  ENSP00000452270
MADGGADSAAQRLPEGPGRVAPGRDLGAPAGSMGAASCEDEELEFKLVFGEEKEAPPLGAGGLGEELDSEDAPPCCRLALGEPPPYGAAPIGIPRPPPPRPGMHSPPPRPAPSPGTWESQPARSVRLGGPGGGAGGAGGGRVLECPSIRITSISPTPEPPAALEDNPDAWGDGSPRDYPPPEGFGGYREAGGQGGGAFFSPSPGSSSLSSWSFFSDASDEAALYAACDEVESELNEAASRFGLGSPLPSPRASPRPWTPEDPWSLYGPSPGGRGPEDSWLLLSAPGPTPASPRPASPCGKRRYSSSGTPSSASPALSRRGSLGEEGSEPPPPPPLPLARDPGSPGPFDYVGAPPAESIPQKTRRTSSEQAVALPRSEEPASCNGKLPLGAEESVAPPGGSRKEVAGMDYLAVPSPLAWSKARIGGHSPIFRTSALPPLDWPLPSQYEQLELRIEVQPRAHHRAHYETEGSRGAVKAAPGGHPVVKLLGYSEKPLTLQMFIGTADERNLRPHAFYQVHRITGKMVATASYEAVVSGTKVLEMTLLPENNMAANIDCAGILKLRNSDIELRKGETDIGRKNTRVRLVFRVHVPQGGGKVVSVQAASVPIECSQRSAQELPQVEAYSPSACSVRGGEELVLTGSNFLPDSKVVFIERGPDGKLQWEEEATVNRLQSNEVTLTLTVPEYSNKRVSRPVQVYFYVSNGRRKRSPTQSFRFLPVICKEEPLPDSSLRGFPSASATPFGTDMDFSPPRPPYPSYPHEDPACETPYLSEGFGYGMPPLYPQTGPPPSYRPGLRMFPETRGTTGCAQPPAVSFLPRPFPSDPYGGRGSSFSLGLPFSPPAPFRPPPLPASPPLEGPFPSQSDVHPLPAEGYNKVGPGYGPGEGAPEQEKSRGGYSSGFRDSVPIQGITLEEVSEIIGRDLSGFPAPPGEEPPA

SEQ ID NO: 32324 - protein, 826 aa, Homo sapiens
  ENSP00000451502
MADGGADSAAQRLPEGPGRVAPGRDLGAPAGSMGAASCEDEELEFKLVFGEEKEAPPLGAGGLGEELDSEDAPPCCRLALGEPPPYGAAPIGIPRPPPPRPGMHSPPPRPAPSPGTWESQPARSVRLGGPGGGAGGAGGGRVLECPSIRITSISPTPEPPAALEDNPDAWGDGSPRDYPPPEGFGGYREAGGQGGGAFFSPSPGSSSLSSWSFFSDASDEAALYAACDEVESELNEAASRFGLGSPLPSPRASPRPWTPEDPWSLYGPSPGGRGPEDSWLLLSAPGPTPASPRPASPCGKRRYSSSGTPSSASPALSRRGSLGEEGSEPPPPPPLPLARDPGSPGPFDYVGAPPAESIPQKTRRTSSEQAVALPRSEEPASCNGKLPLGAEESVAPPGGSRKEVAGMDYLAVPSPLAWSKARIGGHSPIFRTSALPPLDWPLPSQYEQLELRIEVQPRAHHRAHYETEGSRGAVKAAPGGHPVVKLLGYSEKPLTLQMFIGTADERNLRPHAFYQVHRITGKMVATASYEAVVSGTKVLEMTLLPENNMAANIDCAGILKLRNSDIELRKGETDIGRKNTRVRLVFRVHVPQGGGKVVSVQAASVPIECSQRSAQELPQVEAYSPSACSVRGGEELVLTGSNFLPDSKVVFIERGPDGKLQWEEEATVNRLQSNEVTLTLTVPEYSNKRVSRPVQVYFYVSNGRRKRSPTQSFRFLPVICKEEPLPDSSLRGFPSASATPFGTDMDFSPPRPPYPSYPHEDPACETPYLSEGFGYGMPPLYPQTGPPPSYRPGLRMFPETRGTTVSEIIGRDLSGFPAPPGEEPPA

SEQ ID NO: 32325 - protein, 794 aa, Homo sapiens
  ENSP00000451151
MGAASCEDEELEFKLVFGEEKEAPPLGAGGLGEELDSEDAPPCCRLALGEPPPYGAAPIGIPRPPPPRPGMHSPPPRPAPSPGTWESQPARSVRLGGPGGGAGGAGGGRVLECPSIRITSISPTPEPPAALEDNPDAWGDGSPRDYPPPEGFGGYREAGGQGGGAFFSPSPGSSSLSSWSFFSDASDEAALYAACDEVESELNEAASRFGLGSPLPSPRASPRPWTPEDPWSLYGPSPGGRGPEDSWLLLSAPGPTPASPRPASPCGKRRYSSSGTPSSASPALSRRGSLGEEGSEPPPPPPLPLARDPGSPGPFDYVGAPPAESIPQKTRRTSSEQAVALPRSEEPASCNGKLPLGAEESVAPPGGSRKEVAGMDYLAVPSPLAWSKARIGGHSPIFRTSALPPLDWPLPSQYEQLELRIEVQPRAHHRAHYETEGSRGAVKAAPGGHPVVKLLGYSEKPLTLQMFIGTADERNLRPHAFYQVHRITGKMVATASYEAVVSGTKVLEMTLLPENNMAANIDCAGILKLRNSDIELRKGETDIGRKNTRVRLVFRVHVPQGGGKVVSVQAASVPIECSQRSAQELPQVEAYSPSACSVRGGEELVLTGSNFLPDSKVVFIERGPDGKLQWEEEATVNRLQSNEVTLTLTVPEYSNKRVSRPVQVYFYVSNGRRKRSPTQSFRFLPVICKEEPLPDSSLRGFPSASATPFGTDMDFSPPRPPYPSYPHEDPACETPYLSEGFGYGMPPLYPQTGPPPSYRPGLRMFPETRGTTVSEIIGRDLSGFPAPPGEEPPA

SEQ ID NO: 32326 - protein, 143 aa, Homo sapiens
  ENSP00000451853
MGAASCEDEELEFKLVFGEEKEAPPLGAGGLGEELDSEDAPPCCRLALGEPPPYGAAPIGIPRPPPPRPGMHSPPPRPAPSPGTWESQPARSVRLGGPGGGAGGAGGGRVLECPSIRITSISPTPEPPAALEDNPDAWGDGSP

SEQ ID NO: 32327 - protein, 139 aa, Homo sapiens
  ENSP00000451992
MGAASCEDEELEFKLVFGEEKEAPPLGAGGLGEELDSEDAPPCCRLALGEPPPYGAAPIGIPRPPPPRPGMHSPPPRPAPSPGTWESQPARTSALPPLDWPLPSQYEQLELRIEVQPRAHHRAHYETEGSRGAVKAAPG

SEQ ID NO: 32328 - protein, 902 aa, Homo sapiens
  ENSP00000250373
MGAASCEDEELEFKLVFGEEKEAPPLGAGGLGEELDSEDAPPCCRLALGEPPPYGAAPIGIPRPPPPRPGMHSPPPRPAPSPGTWESQPARSVRLGGPGGGAGGAGGGRVLECPSIRITSISPTPEPPAALEDNPDAWGDGSPRDYPPPEGFGGYREAGGQGGGAFFSPSPGSSSLSSWSFFSDASDEAALYAACDEVESELNEAASRFGLGSPLPSPRASPRPWTPEDPWSLYGPSPGGRGPEDSWLLLSAPGPTPASPRPASPCGKRRYSSSGTPSSASPALSRRGSLGEEGSEPPPPPPLPLARDPGSPGPFDYVGAPPAESIPQKTRRTSSEQAVALPRSEEPASCNGKLPLGAEESVAPPGGSRKEVAGMDYLAVPSPLAWSKARIGGHSPIFRTSALPPLDWPLPSQYEQLELRIEVQPRAHHRAHYETEGSRGAVKAAPGGHPVVKLLGYSEKPLTLQMFIGTADERNLRPHAFYQVHRITGKMVATASYEAVVSGTKVLEMTLLPENNMAANIDCAGILKLRNSDIELRKGETDIGRKNTRVRLVFRVHVPQGGGKVVSVQAASVPIECSQRSAQELPQVEAYSPSACSVRGGEELVLTGSNFLPDSKVVFIERGPDGKLQWEEEATVNRLQSNEVTLTLTVPEYSNKRVSRPVQVYFYVSNGRRKRSPTQSFRFLPVICKEEPLPDSSLRGFPSASATPFGTDMDFSPPRPPYPSYPHEDPACETPYLSEGFGYGMPPLYPQTGPPPSYRPGLRMFPETRGTTGCAQPPAVSFLPRPFPSDPYGGRGSSFSLGLPFSPPAPFRPPPLPASPPLEGPFPSQSDVHPLPAEGYNKVGPGYGPGEGAPEQEKSRGGYSSGFRDSVPIQGITLEEVSEIIGRDLSGFPAPPGEEPPA

SEQ ID NO: 32329 - protein, 901 aa, Homo sapiens
  ENSP00000450590
MGAASCEDEELEFKLVFGEEKEAPPLGAGGLGEELDSEDAPPCCRLALGEPPPYGAAPIGIPRPPPPRPGMHSPPPRPAPSPGTWESQPARSVRLGGPGGGAGGAGGGRVLECPSIRITSISPTPEPPAALEDNPDAWGDGSPRDYPPPEGFGGYREAGGQGGGAFFSPSPGSSSLSSWSFFSDASDEAALYAACDEVESELNEAASRFGLGSPLPSPRASPRPWTPEDPWSLYGPSPGGRGPEDSWLLLSAPGPTPASPRPASPCGKRRYSSSGTPSSASPALSRRGSLGEEGSEPPPPPPLPLARDPGSPGPFDYVGAPPAESIPQKTRRTSSEQAVALPRSEEPASCNGKLPLGAEESVAPPGGSRKEVAGMDYLAVPSPLAWSKARIGGHSPIFRTSALPPLDWPLPSQYEQLELRIEVQPRAHHRAHYETEGSRGAVKAAPGGHPVVKLLGYSEKPLTLQMFIGTADERNLRPHAFYQVHRITGKMVATASYEAVVSGTKVLEMTLLPENNMAANIDCAGILKLRNSDIELRKGETDIGRKNTRVRLVFRVHVPQGGGKVVSVQAASVPIECSQRSAQELPQVEAYSPSACSVRGGEELVLTGSNFLPDSKVVFIERGPDGKLQWEEEATVNRLQSNEVTLTLTVPEYSNKRVSRPVQVYFYVSNGRRKRSPTQSFRFLPVICKEEPLPDSSLRGFPSASATPFGTDMDFSPPRPPYPSYPHEDPACETPYLSEGFGYGMPPLYPQTGPPPSYRPGLRMFPETRGTTGCAQPPAVSFLPRPFPSDPYGGRGSSFSLGLPFSPPAPFRPPPLPASPPLEGPFPSQSDVHPLPAEGYNKVGPGYGPGEGAPEQEKSRGGYSSGFRDSVPIQGITLEEGGCGTGGCECECVQEIALHVC

SEQ ID NO: 32330 - protein, 196 aa, Homo sapiens
  ENSP00000452352
MPASISSIFPELDSEDAPPCCRLALGEPPPYGAAPIGIPRPPPPRPGMHSPPPRPAPSPGTWESQPARSVRLGGPGGGAGGAGGGRVLECPSIRITSISPTPEPPAALEDNPDAWGDGSPRDYPPPEGFGGYREAGGQGGGAFFSPSPGSSSLSSWSFFSDASDEAALYAACDEVESELNEAASRFGLGSPLPSPR

SEQ ID NO: 32331 - protein, 832 aa, Homo sapiens
  ENSP00000452349
MHSPPPRPAPSPGTWESQPARSVRLGGPGGGAGGAGGGRVLECPSIRITSISPTPEPPAALEDNPDAWGDGSPRDYPPPEGFGGYREAGGQGGGAFFSPSPGSSSLSSWSFFSDASDEAALYAACDEVESELNEAASRFGLGSPLPSPRASPRPWTPEDPWSLYGPSPGGRGPEDSWLLLSAPGPTPASPRPASPCGKRRYSSSGTPSSASPALSRRGSLGEEGSEPPPPPPLPLARDPGSPGPFDYVGAPPAESIPQKTRRTSSEQAVALPRSEEPASCNGKLPLGAEESVAPPGGSRKEVAGMDYLAVPSPLAWSKARIGGHSPIFRTSALPPLDWPLPSQYEQLELRIEVQPRAHHRAHYETEGSRGAVKAAPGGHPVVKLLGYSEKPLTLQMFIGTADERNLRPHAFYQVHRITGKMVATASYEAVVSGTKVLEMTLLPENNMAANIDCAGILKLRNSDIELRKGETDIGRKNTRVRLVFRVHVPQGGGKVVSVQAASVPIECSQRSAQELPQVEAYSPSACSVRGGEELVLTGSNFLPDSKVVFIERGPDGKLQWEEEATVNRLQSNEVTLTLTVPEYSNKRVSRPVQVYFYVSNGRRKRSPTQSFRFLPVICKEEPLPDSSLRGFPSASATPFGTDMDFSPPRPPYPSYPHEDPACETPYLSEGFGYGMPPLYPQTGPPPSYRPGLRMFPETRGTTGCAQPPAVSFLPRPFPSDPYGGRGSSFSLGLPFSPPAPFRPPPLPASPPLEGPFPSQSDVHPLPAEGYNKVGPGYGPGEGAPEQEKSRGGYSSGFRDSVPIQGITLEEVSEIIGRDLSGFPAPPGEEPPA

SEQ ID NO: 32332 - protein, 832 aa, Homo sapiens; identical to SEQ ID NO: 32331
  ENSP00000450469

SEQ ID NO: 32333 - protein, 724 aa, Homo sapiens
  ENSP00000450733
MHSPPPRPAPSPGTWESQPARSVRLGGPGGGAGGAGGGRVLECPSIRITSISPTPEPPAALEDNPDAWGDGSPRDYPPPEGFGGYREAGGQGGGAFFSPSPGSSSLSSWSFFSDASDEAALYAACDEVESELNEAASRFGLGSPLPSPRASPRPWTPEDPWSLYGPSPGGRGPEDSWLLLSAPGPTPASPRPASPCGKRRYSSSGTPSSASPALSRRGSLGEEGSEPPPPPPLPLARDPGSPGPFDYVGAPPAESIPQKTRRTSSEQAVALPRSEEPASCNGKLPLGAEESVAPPGGSRKEVAGMDYLAVPSPLAWSKARIGGHSPIFRTSALPPLDWPLPSQYEQLELRIEVQPRAHHRAHYETEGSRGAVKAAPGGHPVVKLLGYSEKPLTLQMFIGTADERNLRPHAFYQVHRITGKMVATASYEAVVSGTKVLEMTLLPENNMAANIDCAGILKLRNSDIELRKGETDIGRKNTRVRLVFRVHVPQGGGKVVSVQAASVPIECSQRSAQELPQVEAYSPSACSVRGGEELVLTGSNFLPDSKVVFIERGPDGKLQWEEEATVNRLQSNEVTLTLTVPEYSNKRVSRPVQVYFYVSNGRRKRSPTQSFRFLPVICKEEPLPDSSLRGFPSASATPFGTDMDFSPPRPPYPSYPHEDPACETPYLSEGFGYGMPPLYPQTGPPPSYRPGLRMFPETRGTTVSEIIGRDLSGFPAPPGEEPPA

SEQ ID NO: 32334 - protein, 782 aa, Homo sapiens
  ENSP00000451454
MPASISSIFPGPTLLLSCGSEELDSEDAPPCCRLALGEPPPYGAAPIGIPRPPPPRPGMHSPPPRPAPSPGTWESQPARSVRLGGPGGGAGGAGGGRVLECPSIRITSISPTPEPPAALEDNPDAWGDGSPRDYPPPEGFGGYREAGGQGGGAFFSPSPGSSSLSSWSFFSDASDEAALYAACDEVESELNEAASRFGLGSPLPSPRASPRPWTPEDPWSLYGPSPGGRGPEDSWLLLSAPGPTPASPRPASPCGKRRYSSSGTPSSASPALSRRGSLGEEGSEPPPPPPLPLARDPGSPGPFDYVGAPPAESIPQKTRRTSSEQAVALPRSEEPASCNGKLPLGAEESVAPPGGSRKEVAGMDYLAVPSPLAWSKARIGGHSPIFRTSALPPLDWPLPSQYEQLELRIEVQPRAHHRAHYETEGSRGAVKAAPGGHPVVKLLGYSEKPLTLQMFIGTADERNLRPHAFYQVHRITGKMVATASYEAVVSGTKVLEMTLLPENNMAANIDCAGILKLRNSDIELRKGETDIGRKNTRVRLVFRVHVPQGGGKVVSVQAASVPIECSQRSAQELPQVEAYSPSACSVRGGEELVLTGSNFLPDSKVVFIERGPDGKLQWEEEATVNRLQSNEVTLTLTVPEYSNKRVSRPVQVYFYVSNGRRKRSPTQSFRFLPVICKEEPLPDSSLRGFPSASATPFGTDMDFSPPRPPYPSYPHEDPACETPYLSEGFGYGMPPLYPQTGPPPSYRPGLRMFPETRGTTVSEIIGRDLSGFPAPPGEEPPA

SEQ ID NO: 32335 - protein, 831 aa, Homo sapiens
  ENSP00000451284
MHSPPPRPAPSPGTWESQPARSVRLGGPGGGAGGAGGGRVLECPSIRITSISPTPEPPAALEDNPDAWGDGSPRDYPPPEGFGGYREAGGQGGGAFFSPSPGSSSLSSWSFFSDASDEAALYAACDEVESELNEAASRFGLGSPLPSPRASPRPWTPEDPWSLYGPSPGGRGPEDSWLLLSAPGPTPASPRPASPCGKRRYSSSGTPSSASPALSRRGSLGEEGSEPPPPPPLPLARDPGSPGPFDYVGAPPAESIPQKTRRTSSEQAVALPRSEEPASCNGKLPLGAEESVAPPGGSRKEVAGMDYLAVPSPLAWSKARIGGHSPIFRTSALPPLDWPLPSQYEQLELRIEVQPRAHHRAHYETEGSRGAVKAAPGGHPVVKLLGYSEKPLTLQMFIGTADERNLRPHAFYQVHRITGKMVATASYEAVVSGTKVLEMTLLPENNMAANIDCAGILKLRNSDIELRKGETDIGRKNTRVRLVFRVHVPQGGGKVVSVQAASVPIECSQRSAQELPQVEAYSPSACSVRGGEELVLTGSNFLPDSKVVFIERGPDGKLQWEEEATVNRLQSNEVTLTLTVPEYSNKRVSRPVQVYFYVSNGRRKRSPTQSFRFLPVICKEEPLPDSSLRGFPSASATPFGTDMDFSPPRPPYPSYPHEDPACETPYLSEGFGYGMPPLYPQTGPPPSYRPGLRMFPETRGTTGCAQPPAVSFLPRPFPSDPYGGRGSSFSLGLPFSPPAPFRPPPLPASPPLEGPFPSQSDVHPLPAEGYNKVGPGYGPGEGAPEQEKSRGGYSSGFRDSVPIQGITLEEGGCGTGGCECECVQEIALHVC

SEQ ID NO: 32336 - protein, 889 aa, Homo sapiens
  ENSP00000396788
MPASISSIFPGPTLLLSCGSEELDSEDAPPCCRLALGEPPPYGAAPIGIPRPPPPRPGMHSPPPRPAPSPGTWESQPARSVRLGGPGGGAGGAGGGRVLECPSIRITSISPTPEPPAALEDNPDAWGDGSPRDYPPPEGFGGYREAGGQGGGAFFSPSPGSSSLSSWSFFSDASDEAALYAACDEVESELNEAASRFGLGSPLPSPRASPRPWTPEDPWSLYGPSPGGRGPEDSWLLLSAPGPTPASPRPASPCGKRRYSSSGTPSSASPALSRRGSLGEEGSEPPPPPPLPLARDPGSPGPFDYVGAPPAESIPQKTRRTSSEQAVALPRSEEPASCNGKLPLGAEESVAPPGGSRKEVAGMDYLAVPSPLAWSKARIGGHSPIFRTSALPPLDWPLPSQYEQLELRIEVQPRAHHRAHYETEGSRGAVKAAPGGHPVVKLLGYSEKPLTLQMFIGTADERNLRPHAFYQVHRITGKMVATASYEAVVSGTKVLEMTLLPENNMAANIDCAGILKLRNSDIELRKGETDIGRKNTRVRLVFRVHVPQGGGKVVSVQAASVPIECSQRSAQELPQVEAYSPSACSVRGGEELVLTGSNFLPDSKVVFIERGPDGKLQWEEEATVNRLQSNEVTLTLTVPEYSNKRVSRPVQVYFYVSNGRRKRSPTQSFRFLPVICKEEPLPDSSLRGFPSASATPFGTDMDFSPPRPPYPSYPHEDPACETPYLSEGFGYGMPPLYPQTGPPPSYRPGLRMFPETRGTTGCAQPPAVSFLPRPFPSDPYGGRGSSFSLGLPFSPPAPFRPPPLPASPPLEGPFPSQSDVHPLPAEGYNKVGPGYGPGEGAPEQEKSRGGYSSGFRDSVPIQGITLEEGGCGTGGCECECVQEIALHVC

SEQ ID NO: 32337 - protein, 890 aa, Homo sapiens
  ENSP00000450686
MPASISSIFPGPTLLLSCGSEELDSEDAPPCCRLALGEPPPYGAAPIGIPRPPPPRPGMHSPPPRPAPSPGTWESQPARSVRLGGPGGGAGGAGGGRVLECPSIRITSISPTPEPPAALEDNPDAWGDGSPRDYPPPEGFGGYREAGGQGGGAFFSPSPGSSSLSSWSFFSDASDEAALYAACDEVESELNEAASRFGLGSPLPSPRASPRPWTPEDPWSLYGPSPGGRGPEDSWLLLSAPGPTPASPRPASPCGKRRYSSSGTPSSASPALSRRGSLGEEGSEPPPPPPLPLARDPGSPGPFDYVGAPPAESIPQKTRRTSSEQAVALPRSEEPASCNGKLPLGAEESVAPPGGSRKEVAGMDYLAVPSPLAWSKARIGGHSPIFRTSALPPLDWPLPSQYEQLELRIEVQPRAHHRAHYETEGSRGAVKAAPGGHPVVKLLGYSEKPLTLQMFIGTADERNLRPHAFYQVHRITGKMVATASYEAVVSGTKVLEMTLLPENNMAANIDCAGILKLRNSDIELRKGETDIGRKNTRVRLVFRVHVPQGGGKVVSVQAASVPIECSQRSAQELPQVEAYSPSACSVRGGEELVLTGSNFLPDSKVVFIERGPDGKLQWEEEATVNRLQSNEVTLTLTVPEYSNKRVSRPVQVYFYVSNGRRKRSPTQSFRFLPVICKEEPLPDSSLRGFPSASATPFGTDMDFSPPRPPYPSYPHEDPACETPYLSEGFGYGMPPLYPQTGPPPSYRPGLRMFPETRGTTGCAQPPAVSFLPRPFPSDPYGGRGSSFSLGLPFSPPAPFRPPPLPASPPLEGPFPSQSDVHPLPAEGYNKVGPGYGPGEGAPEQEKSRGGYSSGFRDSVPIQGITLEEVSEIIGRDLSGFPAPPGEEPPA

SEQ ID NO: 32338 - protein, 329 aa, Homo sapiens
  ENSP00000450810
MFIGTADERNLRPHAFYQVHRITGKMVATASYEAVVSGTKVLEMTLLPENNMAANIDCAGILKLRNSDIELRKGETDIGRKNTRVRLVFRVHVPQGGGKVVSVQAASVPIECSQRSAQELPQVEAYSPSACSVRGGEELVLTGSNFLPDSKVVFIERGPDGKLQWEEEATVNRLQSNEVTLTLTVPEYSNKRVSRPVQVYFYVSNGRRKRSPTQSFRFLPVICKEEPLPDSSLRGFPSASATPFGTDMDFSPPRPPYPSYPHEDPACETPYLSEGFGYGMPPLYPQTGPPPSYRPGLRMFPETRGTTVSEIIGRDLSGFPAPPGEEPPA

SEQ ID NO: 32339 - protein, 437 aa, Homo sapiens
  ENSP00000451183
MFIGTADERNLRPHAFYQVHRITGKMVATASYEAVVSGTKVLEMTLLPENNMAANIDCAGILKLRNSDIELRKGETDIGRKNTRVRLVFRVHVPQGGGKVVSVQAASVPIECSQRSAQELPQVEAYSPSACSVRGGEELVLTGSNFLPDSKVVFIERGPDGKLQWEEEATVNRLQSNEVTLTLTVPEYSNKRVSRPVQVYFYVSNGRRKRSPTQSFRFLPVICKEEPLPDSSLRGFPSASATPFGTDMDFSPPRPPYPSYPHEDPACETPYLSEGFGYGMPPLYPQTGPPPSYRPGLRMFPETRGTTGCAQPPAVSFLPRPFPSDPYGGRGSSFSLGLPFSPPAPFRPPPLPASPPLEGPFPSQSDVHPLPAEGYNKVGPGYGPGEGAPEQEKSRGGYSSGFRDSVPIQGITLEEVSEIIGRDLSGFPAPPGEEPPA

SEQ ID NO: 32340 - protein, 436 aa, Homo sapiens
  ENSP00000451395
MFIGTADERNLRPHAFYQVHRITGKMVATASYEAVVSGTKVLEMTLLPENNMAANIDCAGILKLRNSDIELRKGETDIGRKNTRVRLVFRVHVPQGGGKVVSVQAASVPIECSQRSAQELPQVEAYSPSACSVRGGEELVLTGSNFLPDSKVVFIERGPDGKLQWEEEATVNRLQSNEVTLTLTVPEYSNKRVSRPVQVYFYVSNGRRKRSPTQSFRFLPVICKEEPLPDSSLRGFPSASATPFGTDMDFSPPRPPYPSYPHEDPACETPYLSEGFGYGMPPLYPQTGPPPSYRPGLRMFPETRGTTGCAQPPAVSFLPRPFPSDPYGGRGSSFSLGLPFSPPAPFRPPPLPASPPLEGPFPSQSDVHPLPAEGYNKVGPGYGPGEGAPEQEKSRGGYSSGFRDSVPIQGITLEEGGCGTGGCECECVQEIALHVC

SEQ ID NO: 32341 - protein, 82 aa, Homo sapiens
  ENSP00000451496
MDFSPPRPPYPSYPHEDPACETPYLSEGFGYGMPPLYPQTGPPPSYRPGLRMFPETRGTTVSEIIGRDLSGFPAPPGEEPPA

SEQ ID NO: 32342 - protein, 189 aa, Homo sapiens
  ENSP00000451801
MDFSPPRPPYPSYPHEDPACETPYLSEGFGYGMPPLYPQTGPPPSYRPGLRMFPETRGTTGCAQPPAVSFLPRPFPSDPYGGRGSSFSLGLPFSPPAPFRPPPLPASPPLEGPFPSQSDVHPLPAEGYNKVGPGYGPGEGAPEQEKSRGGYSSGFRDSVPIQGITLEEGGCGTGGCECECVQEIALHVC

SEQ ID NO: 32343 - protein, 190 aa, Homo sapiens
  ENSP00000451590
MDFSPPRPPYPSYPHEDPACETPYLSEGFGYGMPPLYPQTGPPPSYRPGLRMFPETRGTTGCAQPPAVSFLPRPFPSDPYGGRGSSFSLGLPFSPPAPFRPPPLPASPPLEGPFPSQSDVHPLPAEGYNKVGPGYGPGEGAPEQEKSRGGYSSGFRDSVPIQGITLEEVSEIIGRDLSGFPAPPGEEPPA

SEQ ID NO: 32344 - protein, 462 aa, Homo sapiens
  ENSP00000297689
MQLRKMQTVKKEQASLDASSNVDKMMVLNSALTEVSEDSTTGEELLLSEGSVGKNKSSACRRKREFIPDEKKDAMYWEKRRKNNEAAKRSREKRRLNDLVLENKLIALGEENATLKAELLSLKLKFGLISSTAYAQEIQKLSNSTAVYFQDYQTSKSNVSSFVDEHEPSMVSSSCISVIKHSPQSSLSDVSEVSSVEHTQESSVQGSCRSPENKFQIIKQEPMELESYTREPRDDRGSYTASIYQNYMGNSFSGYSHSPPLLQVNRSSSNSPRTSETDDGVVGKSSDGEDEQQVPKGPIHSPVELKHVHATVVKVPEVNSSALPHKLRIKAKAMQIKVEAFDNEFEATQKLSSPIDMTSKRHFELEKHSAPSMVHSSLTPFSVQVTNIQDWSLKSEHWHQKELSGKTQNSFKTGVVEMKDSGYKVSDPENLYLKQGIANLSAEVVSLKRLIATQPISASDSG

SEQ ID NO: 32345 - protein, 65 aa, Homo sapiens
  ENSP00000467127
  MOD_RES (1)..(1): Any amino acid
XSGVQVDLEARDFEGLTPLHTAILALNVAMRPSDLCPRVLSTQARDRLDCVHMLLQMGANHTSQR

SEQ ID NO: 32346 - protein, 455 aa, Homo sapiens
  ENSP00000493265
LAQRRGRGPGGPQSTPRNPRVSRGERSHCPTQTVKKLLEEQRRRQQQQPDAGGVQGQFLPPPEQPLTPSVNEAVTGHPPFPAHSETVGSGPSSLGFPDWDPNTHAAYTDSPYSCPASAAENFLPPDFYPPSDPGQPCPFPQGMEAGPWRVSAPPSGPPQFPAVVPGPSLEVARAHMLALGPQQLLAQDEEGDTLLHLFAARGLRWAAYAAAEVLQVYRRLDIREHKGKTPLLVAAAANQPLIVEDLLNLGAEPNAADHQGRSVLHVAATYGLPGVLLAVLNSGVQVDLEARDFEGLTPLHTAILALNVAMRPSDLCPRVLSTQARDRLDCVHMLLQMGANHTSQEIKSNKTVLHLAVQAANPTLVQLLLELPRGDLRTFVNMKAHGNTALHMAAALPPGPAQEAIVRHLLAAGADPTLRNLENEQPVHLLRPGPGPEGLRQLLKRSRVAPPGLSS

SEQ ID NO: 32347 - protein, 465 aa, Homo sapiens
  ENSP00000475712
MWVCLRGILDSQAFWHETLRRWECLLAEMKVSRGERSHCPTQTVKKLLEEQRRRQQQQPDAGGVQGQFLPPPEQPLTPSVNEAVTGHPPFPAHSETVGSGPSSLGFPDWDPNTHAAYTDSPYSCPASAAENFLPPDFYPPSDPGQPCPFPQGMEAGPWRVSAPPSGPPQFPAVVPGPSLEVARAHMLALGPQQLLAQDEEGDTLLHLFAARGLRWAAYAAAEVLQVYRRLDIREHKGKTPLLVAAAANQPLIVEDLLNLGAEPNAADHQGRSVLHVAATYGLPGVLLAVLNSGVQVDLEARDFEGLTPLHTAILALNVAMRPSDLCPRVLSTQARDRLDCVHMLLQMGANHTSQEIKSNKTVLHLAVQAANPTLVQLLLELPRGDLRTFVNMKAHGNTALHMAAALPPGPAQEAIVRHLLAAGADPTLRNLENEQPVHLLRPGPGPEGLRQLLKRSRVAPPGLSS

SEQ ID NO: 32348 - protein, 292 aa, Homo sapiens
  ENSP00000465684
LAQRRGRGPGGPQSTPRNPRVSRGERSHCPTQTVKKLLEEQRRRQQQQPDAGGVQGQFLPPPEQPLTPSVNEAVTGHPPFPAHSETVGSGPSSLGFPDWDPNTHAAYTDSPYSCPASAAENFLPPDFYPPSDPGQPCPFPQGMEDPPDTQFYVGSSLPQAGPWRVSAPPSGPPQFPAVVPGPSLEVARAHMLALGPQQLLAQDEEGDTLLHLFAARGLRWAAYAAAEVLQVYRRLDIREHKGKTPLLVAAAANQPLIVEDLLNLGAEPNAADHQGRSVLHVAATYGLPGVLL

SEQ ID NO: 32349 - protein, 313 aa, Homo sapiens
  ENSP00000380109
MEAGPWRVSAPPSGPPQFPAVVPGPSLEVARAHMLALGPQQLLAQDEEGDTLLHLFAARGLRWAAYAAAEVLQVYRRLDIREHKGKTPLLVAAAANQPLIVEDLLNLGAEPNAADHQGRSVLHVAATYGLPGVLLAVLNSGVQVDLEARDFEGLTPLHTAILALNVAMRPSDLCPRVLSTQARDRLDCVHMLLQMGANHTSQEIKSNKTVLHLAVQAANPTLVQLLLELPRGDLRTFVNMKAHGNTALHMAAALPPGPAQEAIVRHLLAAGADPTLRNLENEQPVHLLRPGPGPEGLRQLLKRSRVAPPGLSS

SEQ ID NO: 32350 - protein, 1630 aa, Homo sapiens
  ENSP00000369400
MPFAKRIVEPQWLCRQRRPAPGPAVDASGGSAEPPPPLQPPGRRDLDEVEAPGPEEPARAVPAPSGLPPPPPPLPAPADQTQPPHGEASVAGEESTAGIPEAAPAAGEASSAAAAAAVLLMLDLCAVSNAALARVLRQLSDVARHACSLFQELESDIQLTHRRVWALQGKLGGVQRVLSTLDPKQEAVPVSNLDIESKLSVYYRAPWHQQRNIFLPATRPPCVEELHRHARQSLQALRREHRSRSDRREQRAAAPLSIAAPPLPAYPPAHSQRRREFKDRHFLTSHPPEDEDTDVMLGQRPKNPIHNIPSTLDKQTNWSKALPLPTPEEKMKQDAQVISSCIIPINVTGVGFDREASIRCSLVHSQSVLQRRRKLRRRKTISGIPRRVQQEIDSDESPVARERNVIVHTNPDPSNTVNRISGTRDSECQTEDILIAAPSRRRIRAQRGQSIAASLSHSAGNISALADKGDTMFTPAVSSRTRSRSLPREGNRGGDAEPKVGAKPSAYEEGESFVGDHERTPNDFSEAPSSPSAQDHQPTLGLACSQHLHSPQHKLSERGRSRLSRMAADSGSCDISSNSDTFGSPIHCISTAGVLLSSHMDQKDDHQSSSGNWSGSSSTCPSQTSETIPPAASPPLTGSSHCDSELSLNTAPHANEDASVFVTEQYNDHLDKVRGHRANSFTSTVADLLDDPNNSNTSDSEWNYLHHHHDASCRQDFSPERPKADSLGCPSFTSMATYDSFLEKSPSDKADTSSHFSVDTEGYYTSMHFDCGLKGNKSYVCHYAALGPENGQGVGASPGLPDCAWQDYLDHKRQGRPSISFRKPKAKPTPPKRSSSLRKSDGNADISEKKEPKISSGQHLPHSSREMKLPLDFANTPSRMENANLPTKQEPSWINQSEQGIKEPQLDASDIPPFKDEVAESTHYADLWLLNDLKTNDPYRSLSNSSTATGTTVIECIKSPESSESQTSQSESRATTPSLPSVDNEFKLASPEKLAGLASPSSGYSSQSETPTSSFPTAFFSGPLSPGGSKRKPKVPERKSSLQQPSLKDGTISLSKDLELPIIPPTHLDLSALHNVLNKPFHHRHPLHVFTHNKQNTVGETLRSNPPPSLAITPTILKSVNLRSINKSEEVKQKEENNTDLPYLEESTLTTAALSPSKIRPHTANKSVSRQYSTEDTILSFLDSSAVEMGPDKLHLEKNSTFDVKNRCDPETITSAGSSLLDSNVTKDQVRTETEPIPENTPTKNCAFPTEGFQRVSAARPNDLDGKIIQYGPGPDETLEQVQKAPSAGLEEVAQPESVDVITSQSDSPTRATDVSNQFKHQFVMSRHHDKVPGTISYESEITSVNSFPEKCSKQENIASGISAKSASDNSKAEETQGNVDEASLKESSPSDDSIISPLSEDSQAEAEGVFVSPNKPRTTEDLFAVIHRSKRKVLGRKDSGDMSVRSKSRAPLSSSSSSASSITSPSSNVTTPNSQRSPGLIYRNAKKSNTSNEEFKLLLLKKGSRSDSSYRMSATEILKSPILPKPPGELTAESPQSTDDAHQGSQGAEALSPLSPCSPRVNAEGFSSKSFATSASARVGRSRAPPAASSSRYSVRCRLYNTPMQAISEGETENSDGSPHDDRSSQSST

SEQ ID NO: 32351 - protein, 1474 aa, Homo sapiens
  ENSP00000381170
MALACCMPKNAAVSNLDIESKLSVYYRAPWHQQRNIFLPATRPPCVEELHRHARQSLQALRREHRSRSDRREQRAAAPLSIAAPPLPAYPPAHSQRRREFKDRHFLTFNSTRSPSPTECCHMTPWSRKSHPPEDEDTDVMLGQRPKNPIHNIPSTLDKQTNWSKALPLPTPEEKMKQDAQVISSCIIPINVTGVGFDREASIRCSLVHSQSVLQRRRKLRRRKTISGIPRRVQQEIDSDESPVARERNVIVHTNPDPSNTVNRISGTRDSECQTEDILIAAPSRRRIRAQRGQSIAASLSHSAGNISALADKGDTMFTPAVSSRTRSRSLPREGNRGGDAEPKVGAKPSAYEEGESFVGDHERTPNDFSEAPSSPSAQDHQPTLGLACSQHLHSPQHKLSERGRSRLSRMAADSGSCDISSNSDTFGSPIHCISTAGVLLSSHMDQKDDHQSSSGNWSGSSSTCPSQTSETIPPAASPPLTGSSHCDSELSLNTAPHANEDASVFVTEQYNDHLDKVRGHRANSFTSTVADLLDDPNNSNTSDSEWNYLHHHHDASCRQDFSPERPKADSLGCPSFTSMATYDSFLEKSPSDKADTSSHFSVDTEGYYTSMHFDCGLKGNKSYVCHYAALGPENGQGVGASPGLPDCAWQDYLDHKRQGRPSISFRKPKAKPTPPKRSSSLRKSDGNADISEKKEPKISSGQHLPHSSREMKLPLDFANTPSRMENANLPTKQEPSWINQSEQGIKEPQLDASDIPPFKDEVAESTHYADLWLLNDLKTNDPYRSLSNSSTATGTTVIECIKSPESSESQTSQSESRATTPSLPSVDNEFKLASPEKLAGLASPSSGYSSQSETPTSSFPTAFFSGPLSPGGSKRKPKVPERKSSLQQPSLKDGTISLSKDLELPIIPPTHLDLSALHNVLNKPFHHRHPLHVFTHNKQNTVGETLRSNPPPSLAITPTILKSVNLRSINKSEEVKQKEENNTDLPYLEESTLTTAALSPSKIRPHTANKSVSRQYSTEDTILSFLDSSAVEMGPDKLHLEKNSTFDVKNRCDPETITSAGSSLLDSNVTKDQVRTETEPIPENTPTKNCAFPTEGFQRVSAARPNDLDGKIIQYGPGPDETLEQVQKAPSAGLEEVAQPESVDVITSQSDSPTRATDVSNQFKHQFVMSRHHDKVPGTISYESEITSVNSFPEKCSKQENIASGISAKSASDNSKAEETQGNVDEASLKESSPSDDSIISPLSEDSQAEAEGVFVSPNKPRTTEDLFAVIHRSKRKVLGRKDSGDMSVRSKSRAPLSSSSSSASSITSPSSNVTTPNSQRSPGLIYRNAKKSNTSNEEFKLLLLKKGSRSDSSYRMSATEILKSPILPKPPGELTAESPQSTDDAHQGSQGAEALSPLSPCSPRVNAEGFSSKSFATSASARVGRSRAPPAASSSRYSVRCRLYNTPMQAISEGETENSDGSPHDDRSSQSST

SEQ ID NO: 32352 - protein, 1471 aa, Homo sapiens
  ENSP00000480113
MDNALFLAAVSNLDIESKLSVYYRAPWHQQRNIFLPATRPPCVEELHRHARQSLQALRREHRSRSDRREQRAAAPLSIAAPPLPAYPPAHSQRRREFKDRHFLTFNSTRSPSPTECCHMTPWSRKSHPPEDEDTDVMLGQRPKNPIHNIPSTLDKQTNWSKALPLPTPEEKMKQDAQVISSCIIPINVTGVGFDREASIRCSLVHSQSVLQRRRKLRRRKTISGIPRRVQQEIDSDESPVARERNVIVHTNPDPSNTVNRISGTRDSECQTEDILIAAPSRRRIRAQRGQSIAASLSHSAGNISALADKGDTMFTPAVSSRTRSRSLPREGNRGGDAEPKVGAKPSAYEEGESFVGDHERTPNDFSEAPSSPSAQDHQPTLGLACSQHLHSPQHKLSERGRSRLSRMAADSGSCDISSNSDTFGSPIHCISTAGVLLSSHMDQKDDHQSSSGNWSGSSSTCPSQTSETIPPAASPPLTGSSHCDSELSLNTAPHANEDASVFVTEQYNDHLDKVRGHRANSFTSTVADLLDDPNNSNTSDSEWNYLHHHHDASCRQDFSPERPKADSLGCPSFTSMATYDSFLEKSPSDKADTSSHFSVDTEGYYTSMHFDCGLKGNKSYVCHYAALGPENGQGVGASPGLPDCAWQDYLDHKRQGRPSISFRKPKAKPTPPKRSSSLRKSDGNADISEKKEPKISSGQHLPHSSREMKLPLDFANTPSRMENANLPTKQEPSWINQSEQGIKEPQLDASDIPPFKDEVAESTHYADLWLLNDLKTNDPYRSLSNSSTATGTTVIECIKSPESSESQTSQSESRATTPSLPSVDNEFKLASPEKLAGLASPSSGYSSQSETPTSSFPTAFFSGPLSPGGSKRKPKVPERKSSLQQPSLKDGTISLSKDLELPIIPPTHLDLSALHNVLNKPFHHRHPLHVFTHNKQNTVGETLRSNPPPSLAITPTILKSVNLRSINKSEEVKQKEENNTDLPYLEESTLTTAALSPSKIRPHTANKSVSRQYSTEDTILSFLDSSAVEMGPDKLHLEKNSTFDVKNRCDPETITSAGSSLLDSNVTKDQVRTETEPIPENTPTKNCAFPTEGFQRVSAARPNDLDGKIIQYGPGPDETLEQVQKAPSAGLEEVAQPESVDVITSQSDSPTRATDVSNQFKHQFVMSRHHDKVPGTISYESEITSVNSFPEKCSKQENIASGISAKSASDNSKAEETQGNVDEASLKESSPSDDSIISPLSEDSQAEAEGVFVSPNKPRTTEDLFAVIHRSKRKVLGRKDSGDMSVRSKSRAPLSSSSSSASSITSPSSNVTTPNSQRSPGLIYRNAKKSNTSNEEFKLLLLKKGSRSDSSYRMSATEILKSPILPKPPGELTAESPQSTDDAHQGSQGAEALSPLSPCSPRVNAEGFSSKSFATSASARVGRSRAPPAASSSRYSVRCRLYNTPMQAISEGETENSDGSPHDDRSSQSST

SEQ ID NO: 32353 - protein, 1447 aa, Homo sapiens
  ENSP00000478433
MPKNAAVSNLDIESKLSVYYRAPWHQQRNIFLPATRPPCVEELHRHARQSLQALRREHRSRSDRREQRAAAPLSIAAPPLPAYPPAHSQRRREFKDRHFLTSHPPEDEDTDVMLGQRPKNPIHNIPSTLDKQTNWSKALPLPTPEEKMKQDAQVISSCIIPINVTGVGFDREASIRCSLVHSQSVLQRRRKLRRRKTISGIPRRVQQEIDSDESPVARERNVIVHTNPDPSNTVNRISGTRDSECQTEDILIAAPSRRRIRAQRGQSIAASLSHSAGNISALADKGDTMFTPAVSSRTRSRSLPREGNRGGDAEPKVGAKPSAYEEGESFVGDHERTPNDFSEAPSSPSAQDHQPTLGLACSQHLHSPQHKLSERGRSRLSRMAADSGSCDISSNSDTFGSPIHCISTAGVLLSSHMDQKDDHQSSSGNWSGSSSTCPSQTSETIPPAASPPLTGSSHCDSELSLNTAPHANEDASVFVTEQYNDHLDKVRGHRANSFTSTVADLLDDPNNSNTSDSEWNYLHHHHDASCRQDFSPERPKADSLGCPSFTSMATYDSFLEKSPSDKADTSSHFSVDTEGYYTSMHFDCGLKGNKSYVCHYAALGPENGQGVGASPGLPDCAWQDYLDHKRQGRPSISFRKPKAKPTPPKRSSSLRKSDGNADISEKKEPKISSGQHLPHSSREMKLPLDFANTPSRMENANLPTKQEPSWINQSEQGIKEPQLDASDIPPFKDEVAESTHYADLWLLNDLKTNDPYRSLSNSSTATGTTVIECIKSPESSESQTSQSESRATTPSLPSVDNEFKLASPEKLAGLASPSSGYSSQSETPTSSFPTAFFSGPLSPGGSKRKPKVPERKSSLQQPSLKDGTISLSKDLELPIIPPTHLDLSALHNVLNKPFHHRHPLHVFTHNKQNTVGETLRSNPPPSLAITPTILKSVNLRSINKSEEVKQKEENNTDLPYLEESTLTTAALSPSKIRPHTANKSVSRQYSTEDTILSFLDSSAVEMGPDKLHLEKNSTFDVKNRCDPETITSAGSSLLDSNVTKDQVRTETEPIPENTPTKNCAFPTEGFQRVSAARPNDLDGKIIQYGPGPDETLEQVQKAPSAGLEEVAQPESVDVITSQSDSPTRATDVSNQFKHQFVMSRHHDKVPGTISYESEITSVNSFPEKCSKQENIASGISAKSASDNSKAEETQGNVDEASLKESSPSDDSIISPLSEDSQAEAEGVFVSPNKPRTTEDLFAVIHRSKRKVLGRKDSGDMSVRSKSRAPLSSSSSSASSITSPSSNVTTPNSQRSPGLIYRNAKKSNTSNEEFKLLLLKKGSRSDSSYRMSATEILKSPILPKPPGELTAESPQSTDDAHQGSQGAEALSPLSPCSPRVNAEGFSSKSFATSASARVGRSRAPPAASSSRYSVRCRLYNTPMQAISEGETENSDGSPHDDRSSQSST

SEQ ID NO: 32354 - protein, 1610 aa, Homo sapiens
  ENSP00000394546
MKKEGSSGSFRLQPNTGSLSRAVSWINFSSLSRQTKRLFRSDGELSVCGQQVEVDDENWIYRAQPRKAVSNLDEESRWTVHYTAPWHQQENVFLPTTRPPCVEDLHRQAKLNLKSVLRECDKLRHDGYRSSQYYSQGPTFAANASPFCDDYQDEDEETDQKCSLSSSEEERFISIRRPKTPASSDFSDLNTQTNWTKSLPLPTPEEKMRQQAQTVQADVVPINITASGTGQDDADGHSVYTPDHYSTLGRFNSCRSAGQRSETRDSSCQTEDVKVVPPSMRRIRAQKGQGIAAQMGHFSGSSGNMSVLSDSAGIVFPSRLDSDAGFHSLPRSGARANIQSLEPRLGALGPAGDMNGTFLYQRGHPQADENLGHLGGASGTGTLLRPKSQELRHFESENIMSPACVVSPHATYSTSIIPNATLSSSSEVIAIPTAQSAGQRESKSSGSSHARIKSRDHLISRHAVKGDPQSPGRHWNEGHATILSQDLDPHSPGEPALLSLCDSAVPLNAPANRENGSQAMPYNCRNNLAFPAHPQDVDGKSESSYSGGGGHSSSEPWEYKSSGNGRASPLKPHLATPGYSTPTSNMSSCSLDQTSNKEDAGSLYSEDHDGYCASVHTDSGHGSGNLCNSSDGFGNPRHSVINVFVGRAQKNQGDRSNYQDKSLSRNISLKKAKKPPLPPSRTDSLRRIPKKSSQCNGQVLNESLIATLQHSLQLSLPGKSGSSPSQSPCSDLEEPWLPRSRSQSTVSAGSSMTSATTPNVYSLCGATPSQSDTSSVKSEYTDPWGYYIDYTGMQEDPGNPAGGCSTSSGVPTGNGPVRHVQEGSRATMPQVPGGSVKPKIMSPEKSHRVISPSSGYSSQSNTPTALTPVPVFLKSVSPANGKGKPKPKVPERKSSLISSVSISSSSTSLSSSTSTEGSGTMKKLDPAVGSPPAPPPPPVPSPPFPCPADRSPFLPPPPPVTDCSQGSPLPHSPVFPPPPPEALIPFCSPPDWCLSPPRPALSPILPDSPVSLPLPPPLLPSSEPPPAPPLDPKFMKDTRPPFTNSGQPESSRGSLRPPSTKEETSRPPMPLITTEALQMVQLRPVRKNSGAEAAQLSERTAQEQRTPVAPQYHLKPSAFLKSRNSTNEMESESQPASVTSSLPTPAKSSSQGDHGSAAERGGPVSRSPGAPSAGEAEARPSPSTTPLPDSSPSRKPPPISKKPKLFLVVPPPQKDFAVEPAENVSEALRAVPSPTTGEEGSVHSREAKESSAAQAGSHATHPGTSVLEGGAAGSMSPSRVEANVPMVQPDVSPAPKQEEPAENSADTGGDGESCLSQQDGAAGVPETNAAGSSSEACDFLKEDGNDEVMTPSRPRTTEDLFAAIHRSKRKVLGRRDSDDDHSRNHSPSPPVTPTGAAPSLASPKQVGSIQRSIRKSSTSSDNFKALLLKKGSRSDTSARMSAAEMLKNTDPRFQRSRSEPSPDAPESPSSCSPSKNRRAQEEWAKNEGLMPRSLSFSGPRYGRSRTPPSAASSRYSMRNRIQSSPMTVISEGEGEAVEPVDSIARGALGAAEGCSLDGLAREEMDEGGLLCGEGPAASLQPQAPGPVDGTASAEGREPSPQCGGSLSEES

SEQ ID NO: 32355 - protein, 1606 aa, Homo sapiens
  ENSP00000344672
MVVFINAKIKSLIKLFKKKTVSNLDEESRWTVHYTAPWHQQENVFLPTTRPPCVEDLHRQAKLNLKSVLRECDKLRHDGYRSSQYYSQGPTFAANASPFCDDYQDEDEETDQKCSLSSSEEERFISIRRPKTPASSDFSDLNTQTNWTKSLPLPTPEEKMRQQAQTVQADVVPINITGENFDRQASLRRSLIYTDTLVRRPKKVKRRKTITGVPDNIQKELASGTGQDDADGHSVYTPDHYSTLGRFNSCRSAGQRSETRDSSCQTEDVKVVPPSMRRIRAQKGQGIAAQMGHFSGSSGNMSVLSDSAGIVFPSRLDSDAGFHSLPRSGARANIQSLEPRLGALGPAGDMNGTFLYQRGHPQADENLGHLGGASGTGTLLRPKSQELRHFESENIMSPACVVSPHATYSTSIIPNATLSSSSEVIAIPTAQSAGQRESKSSGSSHARIKSRDHLISRHAVKGDPQSPGRHWNEGHATILSQDLDPHSPGEPALLSLCDSAVPLNAPANRENGSQAMPYNCRNNLAFPAHPQDVDGKSESSYSGGGGHSSSEPWEYKSSGNGRASPLKPHLATPGYSTPTSNMSSCSLDQTSNKEDAGSLYSEDHDGYCASVHTDSGHGSGNLCNSSDGFGNPRHSVINVFVGRAQKNQGDRSNYQDKSLSRNISLKKAKKPPLPPSRTDSLRRIPKKSSQCNGQVLNESLIATLQHSLQLSLPGKSGSSPSQSPCSDLEEPWLPRSRSQSTVSAGSSMTSATTPNVYSLCGATPSQSDTSSVKSEYTDPWGYYIDYTGMQEDPGNPAGGCSTSSGVPTGNGPVRHVQEGSRATMPQVPGGSVKPKIMSPEKSHRVISPSSGYSSQSNTPTALTPVPVFLKSVSPANGKGKPKPKVPERKSSLISSVSISSSSTSLSSSTSTEGSGTMKKLDPAVGSPPAPPPPPVPSPPFPCPADRSPFLPPPPPVTDCSQGSPLPHSPVFPPPPPEALIPFCSPPDWCLSPPRPALSPILPDSPVSLPLPPPLLPSSEPPPAPPLDPKFMKDTRPPFTNSGQPESSRGSLRPPSTKEETSRPPMPLITTEALQMVQLRPVRKNSGAEAAQLSERTAQEQRTPVAPQYHLKPSAFLKSRNSTNEMESESQPASVTSSLPTPAKSSSQGDHGSAAERGGPVSRSPGAPSAGEAEARPSPSTTPLPDSSPSRKPPPISKKPKLFLVVPPPQKDFAVEPAENVSEALRAVPSPTTGEEGSVHSREAKESSAAQAGSHATHPGTSVLEGGAAGSMSPSRVEANVPMVQPDVSPAPKQEEPAENSADTGGDGESCLSQQDGAAGVPETNAAGSSSEACDFLKEDGNDEVMTPSRPRTTEDLFAAIHRSKRKVLGRRDSDDDHSRNHSPSPPVTPTGAAPSLASPKQVGSIQRSIRKSSTSSDNFKALLLKKGSRSDTSARMSAAEMLKNTDPRFQRSRSEPSPDAPESPSSCSPSKNRRAQEEWAKNEGLMPRSLSFSGPRYGRSRTPPSAASSRYSMRNRIQSSPMTVISEGEGEAVEPVDSIARGALGAAEGCSLDGLAREEMDEGGLLCGEGPAASLQPQAPGPVDGTASAEGREPSPQCGGSLSEES

SEQ ID NO: 32356 - protein, 221 aa, Homo sapiens
  ENSP00000344582
MFCLKAVSNLDEESRWTVHYTAPWHQQENVFLPTTRPPCVEDLHRQAKLNLKSVLRECDKLRHDGYRSSQYYSQGPTFAANASPFCDDYQDEDEETDQKCSLSSSEEERFISIRRPKTPASSDFSDLNTQTNWTKSLPLPTPEEKMRQQAQTVQADVVPINITASGTGQDDADGHSVYTPDHYSTLGRFNSCRSAGQRSETRDSSCQTEDVKVVPPSMRRI

SEQ ID NO: 32357 - protein, 169 aa, Homo sapiens
  ENSP00000433523
  MOD_RES (1)..(1): Any amino acid
XAALGHRTAALHRRLDALQAAAARLDHRRVKIPVSNLDEESRWTVHYTAPWHQQENVFLPTTRPPCVEDLHRQAKLNLKSVLRECDKLRHDGYRSSQYYSQGPTFAANASPFCDDYQDEDEETDQKCSLSSSEEERFISIRRPKTPASSDFSDLNTQTNWTKSLPLPTP

SEQ ID NO: 32358 - protein, 137 aa, Homo sapiens
  ENSP00000434958
MNVIYCLESVTDSSFPWGAVAVSNLDEESRWTVHYTAPWHQQENVFLPTTRPPCVEDLHRQAKLNLKSVLRECDKLRHDGYRSSQYYSQGPTFAANASPFCDDYQDEDEETDQKCSLSSSEEERFISIRRPKTPASS

SEQ ID NO: 32359 - protein, 709 aa, Homo sapiens
  ENSP00000424079
MESMGMVYSVPSSCNGPTESTFSTSWKGDAFTYMTPSATSQSNQVNENGKNPSCGNSWVSLNKVPPLVPKEAATLLVARDNPAGCSGSAGYPERLIQQRHMPERPSKIGLLTSGTSRLETGPGGASRFRERSLSVPTDSGTTDVDYDEEQKANEACALPFASTSSEGSNSADNIASLSAQQEAQHRRQRSKSISLRKAKKKPSPPTRSVSLVKDEPGLLPEGGSALPKDQRPKSLCLSLEHQGHHSSHPDAQGHPAIPNHKDPESTQFSHHWYLTDWKSGDTYQSLSSSSTATGTTVIECTQVQGSSESLASPSTSRATTPSQLSIEVEAREISSPGRPPGLMSPSSGYSSQSETPTPTVSMSLTLGHLPPPSSSVRVRPVVPERKSSLPPTSPMEKFPKSRLSFDLPLTSSPNLDLSGMSISIRSKTKVSRHHSETNFGVKLAQKTNPNQPIMPMVTQSDLRSVRLRSVSKSEPEDDIESPEYAEEPRAEEVFTLPERKTKPPVAEKPPVARRPPSLVHKPPSVPEEYALTSPTLAMPPRSSIQHARPLPQDSYTVVRKPKPSSFPDGRSPGESTAPSSLVFTPFASSSDAFFSGTQQPPQGSVEDEGPKVRVLPERISLQSQEEAEKKKGKIPPPVPKKPSVLYLPLTSPTAQMEAYVAEPRLPLSPIITLEEDTKCPATGDDLQSLGQRVTSTPQADSEREASPLG

SEQ ID NO: 32360 - protein, 1133 aa, Homo sapiens
  ENSP00000492082
LAAANSGRENATATAHSRSSWRQPVNVFLSSGRPPSVEELLREAQLNLQSLLQEEYEEQYSEARLVGQTFRSSDEATKPTPNPRPQSARRLEFILMPTKRQLSEDETTTQGVRAPEASLSLSTTADKQTAWNSLFPLPILEEKRWPQLCSTQSDIVPINISGQQFDKHASLRHSLFNTETAVNPKSTLRRRRTIIGFSNFSQRDQGHSNSPAGSVAHSTTSDIRPSHSVPEGVHGRVAVGQDARFPSLTSPVLRTPSSEPDEPHQARSGPNPPGMESMGMVYSVPSSCNGPTESTFSTSWKGDAFTYMTPSATSQSNQVNENGKNPSCGNSWVSLNKVPPLVPKEAATLLVARDNPAGCSGSAGYPERLIQQRHMPERPSKIGLLTSGTSRLETGPGGASRFRERSLSVPTDSGTTDVDYDEEQKANEACALPFASTSSEGSNSADNIASLSAQQEAQHRRQRSKSISLRKAKKKPSPPTRSVSLVKDEPGLLPEGGSALPKDQRPKSLCLSLEHQGHHSSHPDAQGHPAIPNHKDPESTQFSHHWYLTDWKSGDTYQSLSSSSTATGTTVIECTQVQGSSESLASPSTSRATTPSQLSIEVEAREISSPGRPPGLMSPSSGYSSQSETPTPTVSMSLTLGHLPPPSSSVRVRPVVPERKSSLPPTSPMEKFPKSRLSFDLPLTSSPNLDLSGMSISIRSKTKVSRHHSETNFGVKLAQKTNPNQPIMPMVTQSDLRSVRLRSVSKSEPEDDIESPEYAEEPRAEEVFTLPERKTKPPVAEKPPVARRPPSLVHKPPSVPEEYALTSPTLAMPPRSSIQHARPLPQDSYTVVRKPKPSSFPDGRSPGESTAPSSLVFTPFASSSDAFFSGTQQPPQGSVEDEGPKVRVLPERISLQSQEEAEKKKGKIPPPVPKKPSVLYLPLTSPTAQMEAYVAEPRLPLSPIITLEEDTKCPATGDDLQSLGQRVTSTPQADSEREASPLGSSVEPGTEEKSLISDKTAEWIAEDDDDVFVASRTTEDLFTVIHRSKRKLLGWKEPGEAFVGGRTSSHSPIKNTAESPISESTATAGSGSSANLDAGRNDDFKALLQKKGSKATPRSRPSAAELLKTTNPLARRIIAQFSKDYETTDNPST

SEQ ID NO: 32361 - protein, 835 aa, Homo sapiens
  ENSP00000487835
MERTDSVTLFWIRGGHSNSPAGSVAHSTTSDIRPSHSVPEGVHGRVAVGQDARFPSLTSPVLRTPSSEPDEPHQARSGPNPPGMESMGMVYSVPSSCNGPTESTFSTSWKGDAFTYMTPSATSQSNQVNENGKNPSCGNSWVSLNKVPPLVPKEAATLLVARDNPAGCSGSAGYPERLIQQRHMPERPSKIGLLTSGTSRLETGPGGASRFRERSLSVPTDSGTTDVDYDEEQKANEACALPFASTSSEGSNSADNIASLSAQQEAQHRRQRSKSISLRKAKKKPSPPTRSVSLVKDEPGLLPEGGSALPKDQRPKSLCLSLEHQGHHSSHPDAQGHPAIPNHKDPESTQFSHHWYLTDWKSGDTYQSLSSSSTATGTTVIECTQVQGSSESLASPSTSRATTPSQLSIEVEAREISSPGRPPGLMSPSSGYSSQSETPTPTVSMSLTLGHLPPPSSSVRVRPVVPERKSSLPPTSPMEKFPKSRLSFDLPLTSSPNLDLSGMSISIRSKTKVSRHHSETNFGVKLAQKTNPNQPIMPMVTQSDLRSVRLRSVSKSEPEDDIESPEYAEEPRAEEVFTLPERKTKPPVAEKPPVARRPPSLVHKPPSVPEEYALTSPTLAMPPRSSIQHARPLPQDSYTVVRKPKPSSFPDGRSPGESTAPSSLVFTPFASSSDAFFSGTQQPPQGSVEDEGPKVRVLPERISLQSQEEAEKKKGKIPPPVPKKPSVLYLPLTSPTAQMEAYVAEPRLPLSPIITLEEDTKCPATGDDLQSLGQRVTSTPQADSEREASPLGSSVEPGTEEKSLISDKTAEWIAEDDDDVFVASRTTEDLFTVIH

SEQ ID NO: 32362 - protein, 950 aa, Homo sapiens
  ENSP00000488715
MMGNSHHKQPRSKSQSRMHSATGHSNSPAGSVAHSTTSDIRPSHSVPEGVHGRVAVGQDARFPSLTSPVLRTPSSEPDEPHQARSGPNPPGMESMGMVYSVPSSCNGPTESTFSTSWKGDAFTYMTPSATSQSNQVNENGKNPSCGNSWVSLNKVPPLVPKEAATLLVARDNPAGCSGSAGYPERLIQQRHMPERPSKIGLLTSGTSRLETGPGGASRFRERSLSVPTDSGTTDVDYDEEQKANEACALPFASTSSEGSNSADNIASLSAQQEAQHRRQRSKSISLRKAKKKPSPPTRSVSLVKDEPGLLPEGGSALPKDQRPKSLCLSLEHQGHHSSHPDAQGHPAIPNHKDPESTQFSHHWYLTDWKSGDTYQSLSSSSTATGTTVIECTQVQGSSESLASPSTSRATTPSQLSIEVEAREISSPGRPPGLMSPSSGYSSQSETPTPTVSMSLTLGHLPPPSSSVRVRPVVPERKSSLPPTSPMEKFPKSRLSFDLPLTSSPNLDLSGMSISIRSKTKVSRHHSETNFGVKLAQKTNPNQPIMPMVTQSDLRSVRLRSVSKSEPEDDIESPEYAEEPRAEEVFTLPERKTKPPVAEKPPVARRPPSLVHKPPSVPEEYALTSPTLAMPPRSSIQHARPLPQDSYTVVRKPKPSSFPDGRSPGESTAPSSLVFTPFASSSDAFFSGTQQPPQGSVEDEGPKVRVLPERISLQSQEEAEKKKGKIPPPVPKKPSVLYLPLTSPTAQMEAYVAEPRLPLSPIITLEEDTKCPATGDDLQSLGQRVTSTPQADSEREASPLGSSVEPGTEEKSLISDKTAEWIAEDDDDVFVASRTTEDLFTVIHRSKRKLLGWKEPGEAFVGGRTSSHSPIKNTAESPISESTATAGSGSSANLDAGRNDDFKALLQKKGSKATPRSRPSAAELLKTTNPLARRIIAQFSKDYETTDNPST

SEQ ID NO: 32363 - protein, 1225 aa, Homo sapiens
  ENSP00000488668
MPFYRRTVVPQRLCPRNPPQQLAELRDVSHLAALSLLRQLADLCGHSLALLEDLEGHLLALGRRTDSLYRRTVRLRRRLPCRLLGPEEDEEELAAANSGRENATATAHSRSSWRQPVNVFLSSGRPPSVEELLREAQLNLQSLLQEEYEEQYSEARLVGQTFRSSDEATKPTPNPRPQSARRLEFILMPTKRQLSEDETTTQGVRAPEASLSLSTTADKQTAWNSLFPLPILEEKRWPQLCSTQSDIVPINISGQQFDKHASLRHSLFNTETAVNPKSTLRRRRTIIGFSNFSQRDQGHSNSPAGSVAHSTTSDIRPSHSVPEGVHGRVAVGQDARFPSLTSPVLRTPSSEPDEPHQARSGPNPPGMESMGMVYSVPSSCNGPTESTFSTSWKGDAFTYMTPSATSQSNQVNENGKNPSCGNSWVSLNKVPPLVPKEAATLLVARDNPAGCSGSAGYPERLIQQRHMPERPSKIGLLTSGTSRLETGPGGASRFRERSLSVPTDSGTTDVDYDEEQKANEACALPFASTSSEGSNSADNIASLSAQQEAQHRRQRSKSISLRKAKKKPSPPTRSVSLVKDEPGLLPEGGSALPKDQRPKSLCLSLEHQGHHSSHPDAQGHPAIPNHKDPESTQFSHHWYLTDWKSGDTYQSLSSSSTATGTTVIECTQVQGSSESLASPSTSRATTPSQLSIEVEAREISSPGRPPGLMSPSSGYSSQSETPTPTVSMSLTLGHLPPPSSSVRVRPVVPERKSSLPPTSPMEKFPKSRLSFDLPLTSSPNLDLSGMSISIRSKTKVSRHHSETNFGVKLAQKTNPNQPIMPMVTQSDLRSVRLRSVSKSEPEDDIESPEYAEEPRAEEVFTLPERKTKPPVAEKPPVARRPPSLVHKPPSVPEEYALTSPTLAMPPRSSIQHARPLPQDSYTVVRKPKPSSFPDGRSPGESTAPSSLVFTPFASSSDAFFSGTQQPPQGSVEDEGPKVRVLPERISLQSQEEAEKKKGKIPPPVPKKPSVLYLPLTSPTAQMEAYVAEPRLPLSPIITLEEDTKCPATGDDLQSLGQRVTSTPQADSEREASPLGSSVEPGTEEKSLISDKTAEWIAEDDDDVFVASRTTEDLFTVIHRSKRKLLGWKEPGEAFVGGRTSSHSPIKNTAESPISESTATAGSGSSANLDAGRNDDFKALLQKKGSKATPRSRPSAAELLKTTNPLARRIIAQFSKDYETTDNPST

SEQ ID NO: 32364 - protein, 1114 aa, Homo sapiens
  ENSP00000355554
MLASSSRIRAAWTRALLLPLLLAGPVGCLSRQELFPFGPGQGDLELEDGDDFVSPALELSGALRFYDRSDIDAVYVTTNGIIATSEPPAKESHPGLFPPTFGAVAPFLADLDTTDGLGKVYYREDLSPSITQRAAECVHRGFPEISFQPSSAVVVTWESVAPYQGPSRDPDQKGKRNTFQAVLASSDSSSYAIFLYPEDGLQFHTTFSKKENNQVPAVVAFSQGSVGFLWKSNGAYNIFANDRESVENLAKSSNSGQQGVWVFEIGSPATTNGVVPADVILGTEDGAEYDDEDEDYDLATTRLGLEDVGTTPFSYKALRRGGADTYSVPSVLSPRRAATERPLGPPTERTRSFQLAVETFHQQHPQVIDVDEVEETGVVFSYNTDSRQTCANNRHQCSVHAECRDYATGFCCSCVAGYTGNGRQCVAEGSPQRVNGKVKGRIFVGSSQVPIVFENTDLHSYVVMNHGRSYTAISTIPETVGYSLLPLAPVGGIIGWMFAVEQDGFKNGFSITGGEFTRQAEVTFVGHPGNLVIKQRFSGIDEHGHLTIDTELEGRVPQIPFGSSVHIEPYTELYHYSTSVITSSSTREYTVTEPERDGASPSRIYTYQWRQTITFQECVHDDSRPALPSTQQLSVDSVFVLYNQEEKILRYALSNSIGPVREGSPDALQNPCYIGTHGCDTNAACRPGPRTQFTCECSIGFRGDGRTCYEVEKTRCQHEREHILGAAGATDPQRPIPPGLFVPECDAHGHYAPTQCHGSTGYCWCVDRDGREVEGTRTRPGMTPPCLSTVAPPIHQGPAVPTAVIPLPPGTHLLFAQTGKIERLPLEGNTMRKTEAKAFLHVPAKVIIGLAFDCVDKMVYWTDITEPSIGRASLHGGEPTTIIRQDLGSPEGIAVDHLGRNIFWTDSNLDRIEVAKLDGTQRRVLFETDLVNPRGIVTDSVRGNLYWTDWNRDNPKIETSYMDGTNRRILVQDDLGLPNGLTFDAFSSQLCWVDAGTNRAECLNPSQPSRRKALEGLQYPFAVTSYGKNLYFTDWKMNSVVALDLAISKETDAFQPHKQTRLYGITTALSQCPQGHNYCSVNNGGCTHLCLATPGSRTCRCPDNTLGVDCIEQK

SEQ ID NO: 32365 - protein, 1247 aa, Homo sapiens
  ENSP00000264187
MLASSSRIRAAWTRALLLPLLLAGPVGCLSRQELFPFGPGQGDLELEDGDDFVSPALELSGALRFYDRSDIDAVYVTTNGIIATSEPPAKESHPGLFPPTFGAVAPFLADLDTTDGLGKVYYREDLSPSITQRAAECVHRGFPEISFQPSSAVVVTWESVAPYQGPSRDPDQKGKRNTFQAVLASSDSSSYAIFLYPEDGLQFHTTFSKKENNQVPAVVAFSQGSVGFLWKSNGAYNIFANDRESVENLAKSSNSGQQGVWVFEIGSPATTNGVVPADVILGTEDGAEYDDEDEDYDLATTRLGLEDVGTTPFSYKALRRGGADTYSVPSVLSPRRAATERPLGPPTERTRSFQLAVETFHQQHPQVIDVDEVEETGVVFSYNTDSRQTCANNRHQCSVHAECRDYATGFCCSCVAGYTGNGRQCVAEGSPQRVNGKVKGRIFVGSSQVPIVFENTDLHSYVVMNHGRSYTAISTIPETVGYSLLPLAPVGGIIGWMFAVEQDGFKNGFSITGGEFTRQAEVTFVGHPGNLVIKQRFSGIDEHGHLTIDTELEGRVPQIPFGSSVHIEPYTELYHYSTSVITSSSTREYTVTEPERDGASPSRIYTYQWRQTITFQECVHDDSRPALPSTQQLSVDSVFVLYNQEEKILRYALSNSIGPVREGSPDALQNPCYIGTHGCDTNAACRPGPRTQFTCECSIGFRGDGRTCYDIDECSEQPSVCGSHTICNNHPGTFRCECVEGYQFSDEGTCVAVVDQRPINYCETGLHNCDIPQRAQCIYTGGSSYTCSCLPGFSGDGQACQDVDECQPSRCHPDAFCYNTPGSFTCQCKPGYQGDGFRCVPGEVEKTRCQHEREHILGAAGATDPQRPIPPGLFVPECDAHGHYAPTQCHGSTGYCWCVDRDGREVEGTRTRPGMTPPCLSTVAPPIHQGPAVPTAVIPLPPGTHLLFAQTGKIERLPLEGNTMRKTEAKAFLHVPAKVIIGLAFDCVDKMVYWTDITEPSIGRASLHGGEPTTIIRQDLGSPEGIAVDHLGRNIFWTDSNLDRIEVAKLDGTQRRVLFETDLVNPRGIVTDSVRGNLYWTDWNRDNPKIETSYMDGTNRRILVQDDLGLPNGLTFDAFSSQLCWVDAGTNRAECLNPSQPSRRKALEGLQYPFAVTSYGKNLYFTDWKMNSVVALDLAISKETDAFQPHKQTRLYGITTALSQCPQGHNYCSVNNGGCTHLCLATPGSRTCRCPDNTLGVDCIEQK

SEQ ID NO: 32366 - protein, 188 aa, Homo sapiens
  ENSP00000307552
MAGLSRQLCALSHPKKAAETQTAEPGGAHAVCSRHPVRVKGLEGSEMESARENIDLQPGSSDPRSQPINLNHYATKKSVAESMLDVALFMSNAMRLKAVLEQGPSSHYYTTLVTLISLSLLLQVVIGVLLVVIARLNLNEVEKQWRLNQLNNAATILVFFTVVINVFITAFGAHKTGFLAARASRNPL

SEQ ID NO: 32367 - protein, 135 aa, Homo sapiens
  ENSP00000380435
MMYMPGSSDPRSQPINLNHYATKKSVAESMLDVALFMSNAMRLKAVLEQGPSSHYYTTLVTLISLSLLLQVVIGVLLVVIARLNLNEVEKQWRLNQLNNAATILVFFTVVINVFITAFGAHKTGFLAARASRNPL

SEQ ID NO: 32368 - protein, 106 aa, Homo sapiens
  ENSP00000438831
MLDVALFMSNAMRLKAVLEQGPSSHYYTTLVTLISLSLLLQVVIGVLLVVIARLNLNEVEKQWRLNQLNNAATILVFFTVVINVFITAFGAHKTGFLAARASRNPL

SEQ ID NO: 32369 - protein, 90 aa, Homo sapiens
  ENSP00000415158
MLDVALFMSNAMRLKAVLEQGPSSHYYTTLVTLISLSLLLQVVIGVLLVVIGEEPSLQSDLLPRHPWLAERPHVSPGPPCIGTGSFATTR

SEQ ID NO: 32370 - protein, 447 aa, Homo sapiens
  ENSP00000406456
MPGDSSPGTLPLWDASLSPPLGPDPGGFSRASHAGDKSRPPAPELGSPGAVRPRVGSCAPGPMELRVSNTSCENGSLLHLYCSSQEVLCQIVNDLSPEVPSNATFHSWQERIRQNYGFYIGLGLAFLSSFLIGSSVILKKKGLLRLVATGATRAVAAGEVANFGAYAFAPATVVTPLGALSVLISAILSSYFLRESLNLLGKLGCVICVAGSTVMVIHAPEEEKVTTIMEMASKMKDTGFIVFAVLLLVSCLILIFVIAPRYGQRNILIYIIICSVIGAFSVAAVKGLGITIKNFFQGLPVVRHPLPYILSLILALSLSTQVNFLNRALDIFNTSLVFPIYYVFFTTVVVTSSIILFKEWYSMSAVDIAGTLSGFVTIILGVFMLHAFKDLDISCASLPHMHKNPPPSPAPEPTVIRLEDKNVLVDNIELASTSSPEEKPKVFIIHS

SEQ ID NO: 32371 - protein, 466 aa, Homo sapiens
  ENSP00000311687
MPGDSSPGTLPLWDASLSPPLGPDPGGFSRASHAGDKSRPPAPELGSPGAVRPRVGSCAPGPMELRVSNTSCENGSLLHLYCSSQEVLCQIVNDLSPEVPSNATFHSWQERIRQNYGFYIGLGLAFLSSFLIGSSVILKKKGLLRLVATGATRAVDGGFGYLKDAMWWAGFLTMAAGEVANFGAYAFAPATVVTPLGALSVLISAILSSYFLRESLNLLGKLGCVICVAGSTVMVIHAPEEEKVTTIMEMASKMKDTGFIVFAVLLLVSCLILIFVIAPRYGQRNILIYIIICSVIGAFSVAAVKGLGITIKNFFQGLPVVRHPLPYILSLILALSLSTQVNFLNRALDIFNTSLVFPIYYVFFTTVVVTSSIILFKEWYSMSAVDIAGTLSGFVTIILGVFMLHAFKDLDISCASLPHMHKNPPPSPAPEPTVIRLEDKNVLVDNIELASTSSPEEKPKVFIIHS

SEQ ID NO: 32372 - protein, 132 aa, Homo sapiens
  ENSP00000430810
PAPELGSPGAVRPRVGSCAPGPMELRVSNTSCENAGMAERSQGRKVPCSTSTAPPKKSCARLSMTSALRCPAMPPFTAGRKESGRTMASTSAWAWHSCLASSSAAASSSRRKASCDSWPREPLELWMEASAT

SEQ ID NO: 32373 - protein, 188 aa, Homo sapiens
  ENSP00000357401
MGYCSGRCTLIFICGMQLVCVLERQIFDFLGYQWAPILANFVHIIIVILGLFGTIQYRPRYITGYAVWLVLWVTWNVFVICFYLEAGDLSKETDLILTFNISMHRSWWMENGPGCTVTSVTPAPDWAPEDHRYITVSGCLLEYQYIEVAHSSLQIVLAVSVGSQPLLLVPLGLFYFCANSVHTNGICG

SEQ ID NO: 32374 - protein, 208 aa, Homo sapiens
  ENSP00000357402
MGYCSGRCTLIFICGMQLVCVLERQIFDFLGYQWAPILANFVHIIIVILGLFGTIQYRPRYITGYAVWLVLWVTWNVFVICFYLEAGDLSKETDLILTFNISMHRSWWMENGPGCTVTSVTPAPDWAPEDHRYITVSGCLLEYQYIEVAHSSLQIVLALAGFIYACYVVKCITEEEDSFDFIGGFDSYGYQGPQKTSHLQLQPMYMSK

SEQ ID NO: 32375 - protein, 31 aa, Homo sapiens
  ENSP00000492855
  MOD_RES (1)..(1): Any amino acid
XGFDSYGYQGPQKTSHLQLQPMYMQIPLDNN

SEQ ID NO: 32376 - protein, 49 aa, Homo sapiens
  ENSP00000440287
VCVLERQIFDFLGYQWAPILANFVHIIIVILGLFGTIQYRPRYITGYHV

SEQ ID NO: 32377 - protein, 207 aa, Homo sapiens
  ENSP00000437798
MGIIRFLLLYCPTNILTVCVLERQIFDFLGYQWAPILANFVHIIIVILGLFGTIQYRPRYITGYAVWLVLWVTWNVFVICFYLEAGDLSKETDLILTFNISMHRSWWMENGPGCTVTSVTPAPDWAPEDHRYITVSGCLLEYQYIEVAHSSLQIVLALAGFIYACYVVKCITEEEDSFDFIGGFDSYGYQGPQKTSHLQLQPMYMSK

SEQ ID NO: 32378 - protein, 197 aa, Homo sapiens
  ENSP00000429073
MGCCTGRCSLICLCALQLVSALERQIFDFLGFQWAPILGNFLHIIVVILGLFGTIQYRPRYIMVYTVWTALWVTWNVFIICFYLEVGGLSKDTDLMTFNISVHRSWWREHGPGCVRRVLPPSAHGMMDDYTYVSVTGCIVDFQYLEVIHSAVQILLSLVGFVYACYVISISMEEEDTYSCDLQVCKHLFIQMLQIIE

SEQ ID NO: 32379 - protein, 101 aa, Homo sapiens
  ENSP00000429393
MGCCTGRCSLICLCALQLVSALERQIFDFLGFQWAPILGNFLHIIVVILGLFGTIQYRPRYIMVDTDLMTFNISVHRSWWREHGPGCVRRVLPPSAHGMMD

SEQ ID NO: 32380 - protein, 119 aa, Homo sapiens
  ENSP00000359336
MVYTLWAAVWVTWNVFIICFYLEVGGLLKDSELLTFSLSRHRSWWRERWPGCLHEEVPAVGLGAPHGQALVSGAGCALEPSYVEALHSCLQILIALLGFVCGCQVVSVFTEEEDSCLRK

SEQ ID NO: 32381 - protein, 208 aa, Homo sapiens
  ENSP00000359340
MGSCSGRCALVVLCAFQLVAALERQVFDFLGYQWAPILANFVHIIIVILGLFGTIQYRLRYVMVYTLWAAVWVTWNVFIICFYLEVGGLLKDSELLTFSLSRHRSWWRERWPGCLHEEVPAVGLGAPHGQALVSGAGCALEPSYVEALHSCLQILIALLGFVCGCQVVSVFTEEEDSFDFIGGFDPFPLYHVNEKPSSLLSKQVYLPA

SEQ ID NO: 32382 - protein, 146 aa, Homo sapiens
  ENSP00000359330
MVYTLWAAVWVTWNVFIICFYLEVGGLLKDSELLTFSLSRHRSWWRERWPGCLHEEVPAVGLGAPHGQALVSGAGCALEPSYVEALHSCLQILIALLGFVCGCQVVSVFTEEEDSFDFIGGFDPFPLYHVNEKPSSLLSKQVYLPA

SEQ ID NO: 32383 - protein, 167 aa, Homo sapiens
  ENSP00000359341
VWVTWNVFIICFYLEVGGLLKDSELLTFSLSRHRSWWRERWPGCLHEEVPAVGLGAPHGQALVSGAGCALEPSYVEALHSCLQILIANPRWLAPQRRRNPWWLLAGVGWGQSFWALSVAARWSACLRRKRTALISLVDLIHFLSTMSMKSHPVSCPSRCTSPQARPH

SEQ ID NO: 32384 - protein, 470 aa, Homo sapiens
  ENSP00000268459
MGKLHSKPAAVCKRRESPEGDSFAVSAAWARKGIEEWIGRQRCPGGVSGPRQLRLAGTIGRSTRELVGDVLRDTLSEEEEDDFRLEVALPPEKTDGLGSGDEKKMERVSEPCPGSKKQLKFEELQCDVSMEEDSRQEWTFTLYDFDNNGKVTREDITSLLHTIYEVVDSSVNHSPTSSKMLRVKLTVAPDGSQSKRSVLVNQADLQSARPRAETKPTEDLRSWEKKQRAPLRFQGDSRLEQSGCYHHCVDENIERRNHYLDLAGIENYTSQFGPGSPSVAQKSELPPRTSNPTRSRSHEPEAIHIPHRKPQGVDPASFHFLDTPIAKVSELQQRLRGTQDGSKHFVRSPKAQGKSVGVGHVARGARNKPPLGPAIPAVSPSAHLAASPALLPSLAPLGHKKHKHRAKESQQGCRGLQAPLASGGPVLGREHLRELPALVVYESQAGQPVQRHEHHHHHEHHHHYHHFYQT

SEQ ID NO: 32385 - protein, 46 aa, Homo sapiens
  ENSP00000468081
MGKSCKVVVCGQASVGKTSILEQLLYGNHVVGSEMIETQEDIYVGS

SEQ ID NO: 32386 - protein, 191 aa, Homo sapiens
  ENSP00000303580
MGKSCKVVVCGQASVGKTSILEQLLYGNHVVGSEMIETQEDIYVGSIETDRGVREQVRFYDTRGLRDGAELPRHCFSCTDGYVLVYSTDSRESFQRVELLKKEIDKSKDKKEVTIVVLGNKCDLQEQRRVDPDVAQHWAKSEKVKLWEVSVADRRSLLEPFVYLASKMTQPQSKSAFPLSRKNKGSGSLDG

SEQ ID NO: 32387 - protein, 191 aa, Homo sapiens; identical to SEQ ID NO: 32386
  ENSP00000377463

SEQ ID NO: 32388 - protein, 140 aa, Homo sapiens
  ENSP00000468245
MIETQEDIYVGSIETDRGVREQVRFYDTRGLRDGAELPRHCFSCTDGYVLVYSTDSRESFQRVELLKKEIDKSKDKKEVTIVVLGNKCDLQEQRRVDPDVAQHWAKSEKVKLWEVSVADRRSLLEPFVYLASKMTQPQSK

SEQ ID NO: 32389 - protein, 58 aa, Homo sapiens
  ENSP00000466135
MGKSCKVVVCGQASVGKTSILEQLLYGNHVVGSEMIETQEDIYVGSIETDRGVREQHR

SEQ ID NO: 32390 - protein, 97 aa, Homo sapiens
  ENSP00000465633
MGKSCKVVVCGQASVGKTSILEQLLYGNHVVGSEMIETQEDIYVGSIETDRGVREQIAESLFSVWSCSRRRLTNPRTRRRSPSWSLATSVTYRSSGV

SEQ ID NO: 32391 - protein, 191 aa, Homo sapiens; identical to SEQ ID NO: 32386
  ENSP00000377458

SEQ ID NO: 32392 - protein, 191 aa, Homo sapiens; identical to SEQ ID NO: 32386
  ENSP00000377459

SEQ ID NO: 32393 - protein, 41 aa, Homo sapiens
  ENSP00000419929
MGKSCKVVVCGQASVGKTSILEQLLYGNHVVGHHRGPWQQV

SEQ ID NO: 32394 - protein, 42 aa, Homo sapiens
  ENSP00000465588
MGKSCKVVVCGQASVGKTSILEQLLYGNHVVDSFLILYQVRR

SEQ ID NO: 32395 - protein, 135 aa, Homo sapiens
  ENSP00000401976
MGKSCKVVVCGQASVGKTSILEQLLYGNHVVGSEMIETQEDIYVGSIETDRGVREQVTIVVLGNKCDLQEQRRVDPDVAQHWAKSEKVKLWEVSVADRRSLLEPFVYLASKMTQPQSKSAFPLSRKNKGSGSLDG

SEQ ID NO: 32396 - protein, 229 aa, Homo sapiens
  ENSP00000312773
MGKSCKVVVCGQASVGKTSILEQLLYGNHVVGSEMIETQEDIYVGSIETDRGVREQVRFYDTRGLRDGAELPRHCFSCTDGYVLVYSTDSRESFQRVELLKKEIDKSKDKKEGLTLPPRLECSGMITAHCSLNLPRLRWSSCLSPLLRLQVTIVVLGNKCDLQEQRRVDPDVAQHWAKSEKVKLWEVSVADRRSLLEPFVYLASKMTQPQSKSAFPLSRKNKGSGSLDG

SEQ ID NO: 32397 - protein, 690 aa, Homo sapiens
  ENSP00000360582
MEKILQMAEGIDIGEMPSYDLVLSKPSKGQKRHLSTCDGQNPPKKQAGSKFHARPRFEPVHFVASSSKDERQEDPYGPQTKEVNEQTHFASMPRDIYQDYTQDSFSIQDGNSQYCDSSGFILTKDQPVTANMYFDSGNPAPSTTSQQANSQSTPEPSPSQTFPESVVAEKQYFIEKLTATIWKNLSNPEMTSGSDKINYTYMLTRCIQACKTNPEYIYAPLKEIPPADIPKNKKLLTDGYACEVRCQNIYLTTGYAGSKNGSRDRATELAVKLLQKRIEVRVVRRKFKHTFGEDLVVCQIGMSSYEFPPALKPPEDLVVLGKDASGQPIFNASAKHWTNFVITENANDAIGILNNSASFNKMSIEYKYEMMPNRTWRCRVFLQDHCLAEGYGTKKTSKHAAADEALKILQKTQPTYPSVKSSQCHTGSSPRGSGKKKDIKDLVVYENSSNPVCTLNDTAQFNRMTVEYVYERMTGLRWKCKVILESEVIAEAVGVKKTVKYEAAGEAVKTLKKTQPTVINNLKKGAVEDVISRNEIQGRSAEEAYKQQIKEDNIGNQLLRKMGWTGGGLGKSGEGIREPISVKEQHKREGLGLDVERVNKIAKRDIEQIIRNYARSESHTDLTFSRELTNDERKQIHQIAQKYGLKSKSHGVGHDRYLVVGRKRRKEDLLDQLKQEGQVGHYELVMPQAN

SEQ ID NO: 32398 - protein, 690 aa, Homo sapiens; identical to SEQ ID NO: 32397
  ENSP00000304803

SEQ ID NO: 32399 - protein, 705 aa, Homo sapiens
  ENSP00000442308
MGFMLPLIFRYSPRLMEKILQMAEGIDIGEMPSYDLVLSKPSKGQKRHLSTCDGQNPPKKQAGSKFHARPRFEPVHFVASSSKDERQEDPYGPQTKEVNEQTHFASMPRDIYQDYTQDSFSIQDGNSQYCDSSGFILTKDQPVTANMYFDSGNPAPSTTSQQANSQSTPEPSPSQTFPESVVAEKQYFIEKLTATIWKNLSNPEMTSGSDKINYTYMLTRCIQACKTNPEYIYAPLKEIPPADIPKNKKLLTDGYACEVRCQNIYLTTGYAGSKNGSRDRATELAVKLLQKRIEVRVVRRKFKHTFGEDLVVCQIGMSSYEFPPALKPPEDLVVLGKDASGQPIFNASAKHWTNFVITENANDAIGILNNSASFNKMSIEYKYEMMPNRTWRCRVFLQDHCLAEGYGTKKTSKHAAADEALKILQKTQPTYPSVKSSQCHTGSSPRGSGKKKDIKDLVVYENSSNPVCTLNDTAQFNRMTVEYVYERMTGLRWKCKVILESEVIAEAVGVKKTVKYEAAGEAVKTLKKTQPTVINNLKKGAVEDVISRNEIQGRSAEEAYKQQIKEDNIGNQLLRKMGWTGGGLGKSGEGIREPISVKEQHKREGLGLDVERVNKIAKRDIEQIIRNYARSESHTDLTFSRELTNDERKQIHQIAQKYGLKSKSHGVGHDRYLVVGRKRRKEDLLDQLKQEGQVGHYELVMPQAN

SEQ ID NO: 32400 - protein, 273 aa, Homo sapiens
  ENSP00000366347
MSLTNTKTGFSVKDILDLPDTNDEEGSVAEGPEEENEGPEPAKRAGPLGQGALDAVQSLPLKNPFYDSSDNPYTRWLASTEGLQYSLHGLAAGAPPQDSSSKSPEPSADESPDNDKETPGGGGDAGKKRKRRVLFSKAQTYELERRFRQQRYLSAPEREHLASLIRLTPTQVKIWFQNHRYKMKRARAEKGMEVTPLPSPRRVAVPVLVRDGKPCHALKAQDLAAATFQAGIPFSAYSAQSLQHMQYNAQYSSASTPQYPTAHPLVQAQQWTW

SEQ ID NO: 32401 - protein, 513 aa, Homo sapiens
  ENSP00000379196
MWLRLGPPSLSLSPKPTVGRSLCLTLWFLSLALRASTQAPAPTVNTHFGKLRGARVPLPSEILGPVDQYLGVPYAAPPIGEKRFLPPEPPPSWSGIRNATHFPPVCPQNIHTAVPEVMLPVWFTANLDIVATYIQEPNEDCLYLNVYVPTEDDIRDSGAKPVMVYIHGGSYMEGTGNMIDGSILASYGNVIVITLNYRVGVLGFLSTGDQAAKGNYGLLDQIQALRWVSENIAFFGGDPRRITVFGSGIGASCVSLLTLSHHSEGLFQRAIIQSGSALSSWAVNYQPVKYTSLLADKVGCNVLDTVDMVDCLRQKSAKELVEQDIQPARYHVAFGPVIDGDVIPDDPEILMEQGEFLNYDIMLGVNQGEGLKFVEGVVDPEDGVSGTDFDYSVSNFVDNLYGYPEGKDTLRETIKFMYTDWADRDNPETRRKTLVALFTDHQWVEPSVVTADLHARYGSPTYFYAFYHHCQSLMKPAWSDAAHGDEVPYVFGVPMVGPTDLFPCNFSKNDVML

SEQ ID NO: 32402 - protein, 828 aa, Homo sapiens
  ENSP00000363163
MWLRLGPPSLSLSPKPTVGRSLCLTLWFLSLALRASTQAPAPTVNTHFGKLRGARVPLPSEILGPVDQYLGVPYAAPPIGEKRFLPPEPPPSWSGIRNATHFPPVCPQNIHTAVPEVMLPVWFTANLDIVATYIQEPNEDCLYLNVYVPTEDGSGAKKQGEDLADNDGDEDEDIRDSGAKPVMVYIHGGSYMEGTGNMIDGSILASYGNVIVITLNYRVGVLGFLSTGDQAAKGNYGLLDQIQALRWVSENIAFFGGDPRRITVFGSGIGASCVSLLTLSHHSEGLFQRAIIQSGSALSSWAVNYQPVKYTSLLADKVGCNVLDTVDMVDCLRQKSAKELVEQDIQPARYHVAFGPVIDGDVIPDDPEILMEQGEFLNYDIMLGVNQGEGLKFVEGVVDPEDGVSGTDFDYSVSNFVDNLYGYPEGKDTLRETIKFMYTDWADRDNPETRRKTLVALFTDHQWVEPSVVTADLHARYGSPTYFYAFYHHCQSLMKPAWSDAAHGDEVPYVFGVPMVGPTDLFPCNFSKNDVMLSAVVMTYWTNFAKTGDPNKPVPQDTKFIHTKANRFEEVAWSKYNPRDQLYLHIGLKPRVRDHYRATKVAFWKHLVPHLYNLHDMFHYTSTTTKVPPPDTTHSSHITRRPNGKTWSTKRPAISPAYSNENAQGSWNGDQDAGPLLVENPRDYSTELSVTIAVGASLLFLNVLAFAALYYRKDKRRQEPLRQPSPQRGAGAPELGAAPEEELAALQLGPTHHECEAGPPHDTLRLTALPDYTLTLRRSPDDIPLMTPNTITMIPNSLVGLQTLHPYNTFAAGFNSTGLPHSHSTTRV

SEQ ID NO: 32403 - protein, 848 aa, Homo sapiens
  ENSP00000351591
MWLRLGPPSLSLSPKPTVGRSLCLTLWFLSLALRASTQAPAPTVNTHFGKLRGARVPLPSEILGPVDQYLGVPYAAPPIGEKRFLPPEPPPSWSGIRNATHFPPVCPQNIHTAVPEVMLPVWFTANLDIVATYIQEPNEDCLYLNVYVPTEDVKRISKECARKPNKKICRKGGSGAKKQGEDLADNDGDEDEDIRDSGAKPVMVYIHGGSYMEGTGNMIDGSILASYGNVIVITLNYRVGVLGFLSTGDQAAKGNYGLLDQIQALRWVSENIAFFGGDPRRITVFGSGIGASCVSLLTLSHHSEGLFQRAIIQSGSALSSWAVNYQPVKYTSLLADKVGCNVLDTVDMVDCLRQKSAKELVEQDIQPARYHVAFGPVIDGDVIPDDPEILMEQGEFLNYDIMLGVNQGEGLKFVEGVVDPEDGVSGTDFDYSVSNFVDNLYGYPEGKDTLRETIKFMYTDWADRDNPETRRKTLVALFTDHQWVEPSVVTADLHARYGSPTYFYAFYHHCQSLMKPAWSDAAHGDEVPYVFGVPMVGPTDLFPCNFSKNDVMLSAVVMTYWTNFAKTGDPNKPVPQDTKFIHTKANRFEEVAWSKYNPRDQLYLHIGLKPRVRDHYRATKVAFWKHLVPHLYNLHDMFHYTSTTTKVPPPDTTHSSHITRRPNGKTWSTKRPAISPAYSNENAQGSWNGDQDAGPLLVENPRDYSTELSVTIAVGASLLFLNVLAFAALYYRKDKRRQEPLRQPSPQRGAGAPELGAAPEEELAALQLGPTHHECEAGPPHDTLRLTALPDYTLTLRRSPDDIPLMTPNTITMIPNSLVGLQTLHPYNTFAAGFNSTGLPHSHSTTRV

SEQ ID NO: 32404 - protein, 808 aa, Homo sapiens
  ENSP00000445298
MWLRLGPPSLSLSPKPTVGRSLCLTLWFLSLALRASTQAPAPTVNTHFGKLRGARVPLPSEILGPVDQYLGVPYAAPPIGEKRFLPPEPPPSWSGIRNATHFPPVCPQNIHTAVPEVMLPVWFTANLDIVATYIQEPNEDCLYLNVYVPTEDDIRDSGAKPVMVYIHGGSYMEGTGNMIDGSILASYGNVIVITLNYRVGVLGFLSTGDQAAKGNYGLLDQIQALRWVSENIAFFGGDPRRITVFGSGIGASCVSLLTLSHHSEGLFQRAIIQSGSALSSWAVNYQPVKYTSLLADKVGCNVLDTVDMVDCLRQKSAKELVEQDIQPARYHVAFGPVIDGDVIPDDPEILMEQGEFLNYDIMLGVNQGEGLKFVEGVVDPEDGVSGTDFDYSVSNFVDNLYGYPEGKDTLRETIKFMYTDWADRDNPETRRKTLVALFTDHQWVEPSVVTADLHARYGSPTYFYAFYHHCQSLMKPAWSDAAHGDEVPYVFGVPMVGPTDLFPCNFSKNDVMLSAVVMTYWTNFAKTGDPNKPVPQDTKFIHTKANRFEEVAWSKYNPRDQLYLHIGLKPRVRDHYRATKVAFWKHLVPHLYNLHDMFHYTSTTTKVPPPDTTHSSHITRRPNGKTWSTKRPAISPAYSNENAQGSWNGDQDAGPLLVENPRDYSTELSVTIAVGASLLFLNVLAFAALYYRKDKRRQEPLRQPSPQRGAGAPELGAAPEEELAALQLGPTHHECEAGPPHDTLRLTALPDYTLTLRRSPDDIPLMTPNTITMIPNSLVGLQTLHPYNTFAAGFNSTGLPHSHSTTRV

SEQ ID NO: 32405 - protein, 351 aa, Homo sapiens
  ENSP00000479877
MLPVWFTANLDIVATYIQEPNEDCLYLNVYVPTEDGSGAKKQGEDLADNDGDEDEDIRDSGAKPVMVYIHGGSYMEGTGNMIDGSILASYGNVIVITLNYRVGVLGFLSTGDQAAKGNYGLLDQIQALRWVSENIAFFGGDPRRITVFGSGIGASCVSLLTLSHHSEGLFQRAIIQSGSALSSWAVNYQPVKYTSLLADKVGCNVLDTVDMVDCLRQKSAKELVEQDIQPARYHVAFGPVIDGDVIPDDPEILMEQGEFLNYDIMLGVNQGEGLKFVEGVVDPEDGVSGTDFDYSVSILWTICMAILRVRTPCERPSSSCIQTGQTVTTLRPAVKHWWHSSLTTSGWSPQW

SEQ ID NO: 32406 - protein, 648 aa, Homo sapiens
  ENSP00000372325
MVYIHGGSYMEGTGNMIDGSILASYGNVIVITINYRLGILGFLSTGDQAAKGNYGLLDQIQALRWIEENVGAFGGDPKRVTIFGSGAGASCVSLLTLSHYSEGLFQKAIIQSGTALSSWAVNYQPAKYTRILADKVGCNMLDTTDMVECLKNKNYKELIQQTITPATYHIAFGPVIDGDVIPDDPQILMEQGEFLNYDIMLGVNQGEGLKFVDGIVDNEDGVTPNDFDFSVSNFVDNLYGYPEGKDTLRETIKFMYTDWADKENPETRRKTLVALFTDHQWVAPAVATADLHAQYGSPTYFYAFYHHCQSEMKPSWADSAHGDEVPYVFGIPMIGPTELFSCNFSKNDVMLSAVVMTYWTNFAKTGDPNQPVPQDTKFIHTKPNRFEEVAWSKYNPKDQLYLHIGLKPRVRDHYRATKVAFWLELVPHLHNLNEIFQYVSTTTKVPPPDMTSFPYGTRRSPAKIWPTTKRPAITPANNPKHSKDPHKTGPEDTTVLIETKRDYSTELSVTIAVGASLLFLNILAFAALYYKKDKRRHETHRHPSPQRNTTNDITHIQNEEIMSLQMKQLEHDHECESLQAHDTLRLTCPPDYTLTLRRSPDDIPFMTPNTITMIPNTLMGMQPLHTFKTFSGGQNSTNLPHGHSTTRV

SEQ ID NO: 32407 - protein, 816 aa, Homo sapiens
  ENSP00000348169
MLRPQGLLWLPLLFTSVCVMLNSNVLLWITALAIKFTLIDSQAQYPVVNTNYGKIQGLRTPLPSEILGPVEQYLGVPYASPPTGERRFQPPESPSSWTGIRNATQFSAVCPQHLDERFLLHDMLPIWFTTSLDTLMTYVQDQNEDCLYLNIYVPMEDDIHEQNSKKPVMVYIHGGSYMEGTGNMIDGSILASYGNVIVITINYRLGILGFLSTGDQAAKGNYGLLDQIQALRWIEENVGAFGGDPKRVTIFGSGAGASCVSLLTLSHYSEGLFQKAIIQSGTALSSWAVNYQPAKYTRILADKVGCNMLDTTDMVECLKNKNYKELIQQTITPATYHIAFGPVIDGDVIPDDPQILMEQGEFLNYDIMLGVNQGEGLKFVDGIVDNEDGVTPNDFDFSVSNFVDNLYGYPEGKDTLRETIKFMYTDWADKENPETRRKTLVALFTDHQWVAPAVATADLHAQYGSPTYFYAFYHHCQSEMKPSWADSAHGDEVPYVFGIPMIGPTELFSCNFSKNDVMLSAVVMTYWTNFAKTGDPNQPVPQDTKFIHTKPNRFEEVAWSKYNPKDQLYLHIGLKPRVRDHYRATKVAFWLELVPHLHNLNEIFQYVSTTTKVPPPDMTSFPYGTRRSPAKIWPTTKRPAITPANNPKHSKDPHKTGPEDTTVLIETKRDYSTELSVTIAVGASLLFLNILAFAALYYKKDKRRHETHRHPSPQRNTTNDITHIQNEEIMSLQMKQLEHDHECESLQAHDTLRLTCPPDYTLTLRRSPDDIPFMTPNTITMIPNTLMGMQPLHTFKTFSGGQNSTNLPHGHSTTRV

SEQ ID NO: 32408 - protein, 873 aa, Homo sapiens
  ENSP00000372320
MLRPQGLLWLPLLFTSVCVMLNSNVLLWITALAIKFTLIDSQAQYPVVNTNYGKIQGLRTPLPSEILGPVEQYLGVPYASPPTGERRFQPPESPSSWTGIRNATQFSAVCPQHLDERFLLHDMLPIWFTTSLDTLMTYVQDQNEDCLYLNIYVPMEDGTNIKRNADDITSNDHGEDKDIHEQNSKKPVMVYIHGGSYMEGTGNMIDGSILASYGNVIVITINYRLGILAQNTLAHGNCKHRCQLHLQAPRDCKSAYPFRNEDEIRGFLSTGDQAAKGNYGLLDQIQALRWIEENVGAFGGDPKRVTIFGSGAGASCVSLLTLSHYSEGLFQKAIIQSGTALSSWAVNYQPAKYTRILADKVGCNMLDTTDMVECLKNKNYKELIQQTITPATYHIAFGPVIDGDVIPDDPQILMEQGEFLNYDIMLGVNQGEGLKFVDGIVDNEDGVTPNDFDFSVSNFVDNLYGYPEGKDTLRETIKFMYTDWADKENPETRRKTLVALFTDHQWVAPAVATADLHAQYGSPTYFYAFYHHCQSEMKPSWADSAHGDEVPYVFGIPMIGPTELFSCNFSKNDVMLSAVVMTYWTNFAKTGDPNQPVPQDTKFIHTKPNRFEEVAWSKYNPKDQLYLHIGLKPRVRDHYRATKVAFWLELVPHLHNLNEIFQYVSTTTKVPPPDMTSFPYGTRRSPAKIWPTTKRPAITPANNPKHSKDPHKTGPEDTTVLIETKRDYSTELSVTIAVGASLLFLNILAFAALYYKKDKRRHETHRHPSPQRNTTNDITHIQNEEIMSLQMKQLEHDHECESLQAHDTLRLTCPPDYTLTLRRSPDDIPFMTPNTITMIPNTLMGMQPLHTFKTFSGGQNSTNLPHGHSTTRV

SEQ ID NO: 32409 - protein, 816 aa, Homo sapiens; identical to SEQ ID NO: 32407
  ENSP00000342535

SEQ ID NO: 32410 - protein, 236 aa, Homo sapiens
  ENSP00000412638
  MOD_RES (1)..(1): Any amino acid
XNSNVLLWITALAIKFTLIDSQAQYPVVNTNYGKIQGLRTPLPSEILGPVEQYLGVPYASPPTGERRFQPPESPSSWTGIRNATQFSAVCPQHLDERFLLHDMLPIWFTTSLDTLMTYVQDQNEDCLYLNIYVPMEDGTNIKRNADDITSNDHGEDKDIHEQNSKKPVMVYIHGGSYMEGTGNMIDGSILASYGNVIVITINYRLGILGMQEARLCGSSKMFNYFKSPFTNLINFF

SEQ ID NO: 32411 - protein, 704 aa, Homo sapiens
  ENSP00000370372
MIARCLLAVRSLRRVGGSRILLRMTLGREVMSPLQAMSSYTVAGRNVLRWDLSPEQIKTRTEELIVQTKQVYDAVGMLGIEEVTYENCLQALADVEVKYIVERTMLDFPQHVSSDKEVRAASTEADKRLSRFDIEMSMRGDIFERIVHLQETCDLGKIKPEARRYLEKSIKMGKRNGLHLPEQVQNEIKSMKKRMSELCIDFNKNLNEDDTFLVFSKAELGALPDDFIDSLEKTDDDKYKITLKYPHYFPVMKKCCIPETRRRMEMAFNTRCKEENTIILQQLLPLRTKVAKLLGYSTHADFVLEMNTAKSTSRVTAFLDDLSQKLKPLGEAEREFILNLKKKECKDRGFEYDGKINAWDLYYYMTQTEELKYSIDQEFLKEYFPIEVVTEGLLNTYQELLGLSFEQMTDAHVWNKSVTLYTVKDKATGEVLGQFYLDLYPREGKYNHAACFGLQPGCLLPDGSRMMAVAALVVNFSQPVAGRPSLLRHDEVRTYFHEFGHVMHQICAQTDFARFSGTNVETDFVEVPSQMLENWVWDVDSLRRLSKHYKDGSPIADDLLEKLVASRLVNTGLLTLRQIVLSKVDQSLHTNTSLDAASEYAKYCSEILGVAATPGTNMPATFGHLAGGYDGQYYGYLWSEVFSMDMFYSCFKKEGIMNPEVGMKYRNLILKPGGSLDGMDMLHNFLKREPNQKAFLMSRGLHAP

SEQ ID NO: 32412 - protein, 600 aa, Homo sapiens
  ENSP00000423214
MLDFPQHVSSDKEVRAASTEADKRLSRFDIEMSMRGDIFERIVHLQETCDLGKIKPEARRYLEKSIKMGKRNGLHLPEQVQNEIKSMKKRMSELCIDFNKNLNEDDTFLVFSKAELGALPDDFIDSLEKTDDDKYKITLKYPHYFPVMKKCCIPETRRRMEMAFNTRCKEENTIILQQLLPLRTKVAKLLGYSTHADFVLEMNTAKSTSRVTAFLDDLSQKLKPLGEAEREFILNLKKKECKDRGFEYDGKINAWDLYYYMTQTEELKYSIDQEFLKEYFPIEVVTEGLLNTYQELLGLSFEQMTDAHVWNKSVTLYTVKDKATGEVLGQFYLDLYPREGKYNHAACFGLQPGCLLPDGSRMMAVAALVVNFSQPVAGRPSLLRHDEVRTYFHEFGHVMHQICAQTDFARFSGTNVETDFVEVPSQMLENWVWDVDSLRRLSKHYKDGSPIADDLLEKLVASRLVNTGLLTLRQIVLSKVDQSLHTNTSLDAASEYAKYCSEILGVAATPGTNMPATFGHLAGGYDGQYYGYLWSEVFSMDMFYSCFKKEGIMNPEVGMKYRNLILKPGGSLDGMDMLHNFLKREPNQKAFLMSRGLHAP

SEQ ID NO: 32413 - protein, 48 aa, Homo sapiens
  ENSP00000422822
MIARCLLAVRSLRRWSLALLPRLVCSGVILAHCSLCLPGSSDSPASAT

SEQ ID NO: 32414 - protein, 414 aa, Homo sapiens
  ENSP00000427417
KEENTIILQQLLPLRTKVAKLLGYSTHADFVLEMNTAKSTSRVTAFLDDLSQKLKPLGEAEREFILNLKKKECKDRGFEYDGKINAWDLYYYMTQTEELKYSIDQEFLKEYFPIEVVTEGLLNTYQELLGLSFEQMTDAHVWNKSVTLYTVKDKATGEVLGQFYLDLYPREGKYNHAACFGLQPGCLLPDGSRMMAVAALVVNFSQPVAGRPSLLRHDETDFARFSGTNVETDFVEVPSQMLENWVWDVDSLRRLSKHYKDGSPIADDLLEKLVASRLVNTGLLTLRQIVLSKVDQSLHTNTSLDAASEYAKYCSEILGVAATPGTNMPATFGHLAGGYDGQYYGYLWSEVFSMDMFYSCFKKEGIMNPEVGMKYRNLILKPGGSLDGMDMLHNFLKREPNQKAFLMSRGLHAP

SEQ ID NO: 32415 - protein, 283 aa, Homo sapiens
  ENSP00000426959
GLSFEQMTDAHVWNKSVTLYTVKDKATGEVLGQFYLDLYPREGKYNHAACFGLQPGCLLPDGSRMMAVAALVVNFSQPVAGRPSLLRHDEVRTYFHEFGHVMHQICAQTDFARFSGTNVETDFVEVPSQMLENWVWDVDSLRRLSKHYKDGSPIADDLLEKLVASRLVNTGLLTLRQIVLSKVDQSLHTNTSLDAASEYAKYCSEILGVAATPGTNMPATFGHLAGGYDGQYYGYLWSEVFSMDMFYSCFKKEGIMNPETSKHHGISLIMFHYSKGEVDLVPF

SEQ ID NO: 32416 - protein, 199 aa, Homo sapiens
  ENSP00000427670
MANLLKTVVTGCSCPLLSNLGSCKGLRVKKDFLRTFYTHQELWCKAPVKPGIPYKQLTVGVPKEIFQNEKRVALSPAGVQNLVKQGFNVVVESGAGEASKFSDDHYRVAGAQIQGAKEVLASDLVVKVRAPMVNPTLGVHEADLLKTSGTLISFIYPAQNPELLNKLSQRKTTVLAMDQVPRVTIAQGYDALSSMANIA

SEQ ID NO: 32417 - protein, 217 aa, Homo sapiens
  ENSP00000421886
MANLLKTVVTGCSCPLLSNLGSCKGLRVKKDFLRTFYTHQELWCKAPVKPGIPYKQLTVGVPKEIFQNEKRVALSPAGVQNLVKQGFNVVVESGAGEASKFSDDHYRVAGAQIQGAKEVLASDLVVKVRAPMVNPTLGVHEADLLKTSGTLISFIYPAQNPELLNKLSQRKTTVLAMDQVPRVTIAQGYDALSSMANIAGYKAVVLAANHFGRFFTG

SEQ ID NO: 32418 - protein, 1086 aa, Homo sapiens
  ENSP00000264663
MANLLKTVVTGCSCPLLSNLGSCKGLRVKKDFLRTFYTHQELWCKAPVKPGIPYKQLTVGVPKEIFQNEKRVALSPAGVQNLVKQGFNVVVESGAGEASKFSDDHYRVAGAQIQGAKEVLASDLVVKVRAPMVNPTLGVHEADLLKTSGTLISFIYPAQNPELLNKLSQRKTTVLAMDQVPRVTIAQGYDALSSMANIAGYKAVVLAANHFGRFFTGQITAAGKVPPAKILIVGGGVAGLASAGAAKSMGAIVRGFDTRAAALEQFKSLGAEPLEVDLKESGEGQGGYAKEMSKEFIEAEMKLFAQQCKEVDILISTALIPGKKAPVLFNKEMIESMKEGSVVVDLAAEAGGNFETTKPGELYIHKGITHIGYTDLPSRMATQASTLYSNNITKLLKAISPDKDNFYFDVKDDFDFGTMGHVIRGTVVMKDGKVIFPAPTPKNIPQGAPVKQKTVAELEAEKAATITPFRKTMSTASAYTAGLTGILGLGIAAPNLAFSQMVTTFGLAGIVGYHTVWGVTPALHSPLMSVTNAISGLTAVGGLALMGGHLYPSTTSQGLAALAAFISSVNIAGGFLVTQRMLDMFKRPTDPPEYNYLYLLPAGTFVGGYLAALYSGYNIEQIMYLGSGLCCVGALAGLSTQGTARLGNALGMIGVAGGLAATLGVLKPGPELLAQMSGAMALGGTIGLTIAKRIQISDLPQLVAAFHSLVGLAAVLTCIAEYIIEYPHFATDAAANLTKIVAYLGTYIGGVTFSGSLIAYGKLQGLLKSAPLLLPGRHLLNAGLLAASVGGIIPFMVDPSFTTGITCLGSVSALSAVMGVTLTAAIGGADMPVVITVLNSYSGWALCAEGFLLNNNLLTIVGALIGSSGAILSYIMCVAMNRSLANVILGGYGTTSTAGGKPMEISGTHTEINLDNAIDMIREANSIIITPGYGLCAAKAQYPIADLVKMLTEQGKKVRFGIHPVAGRMPGQLNVLLAEAGVPYDIVLEMDEINHDFPDTDLVLVIGANDTVNSAAQEDPNSIIAGMPVLEVWKSKQVIVMKRSLGVGYAAVDNPIFYKPNTAMLLGDAKKTCDALQAKVRESYQK

SEQ ID NO: 32419 - protein, 1086 aa, Homo sapiens; identical to SEQ ID NO: 32418
  ENSP00000343873

SEQ ID NO: 32420 - protein, 955 aa, Homo sapiens
  ENSP00000426343
MVNPTLGVHEADLLKTSGTLISFIYPAQNPELLNKLSQRKTTVLAMDQVPRVTIAQGYDALSSMANIAGYKAVVLAANHFGRFFTGQITAAGKVPPAKILIVGGGVAGLASAGAAKSMGAIVRGFDTRAAALEQFKSLGAEPLEVDLKESGEGQGGYAKEMSKEFIEAEMKLFAQQCKEVDILISTALIPGKKAPVLFNKEMIESMKEGSVVVDLAAEAGGNFETTKPGELYIHKGITHIGYTDLPSRMATQASTLYSNNITKLLKAISPDKDNFYFDVKDDFDFGTMGHVIRGTVVMKDGKVIFPAPTPKNIPQGAPVKQKTVAELEAEKAATITPFRKTMSTASAYTAGLTGILGLGIAAPNLAFSQMVTTFGLAGIVGYHTVWGVTPALHSPLMSVTNAISGLTAVGGLALMGGHLYPSTTSQGLAALAAFISSVNIAGGFLVTQRMLDMFKRPTDPPEYNYLYLLPAGTFVGGYLAALYSGYNIEQIMYLGSGLCCVGALAGLSTQGTARLGNALGMIGVAGGLAATLGVLKPGPELLAQMSGAMALGGTIGLTIAKRIQISDLPQLVAAFHSLVGLAAVLTCIAEYIIEYPHFATDAAANLTKIVAYLGTYIGGVTFSGSLIAYGKLQGLLKSAPLLLPGRHLLNAGLLAASVGGIIPFMVDPSFTTGITCLGSVSALSAVMGVTLTAAIGGADMPVVITVLNSYSGWALCAEGFLLNNNLLTIVGALIGSSGAILSYIMCVAMNRSLANVILGGYGTTSTAGGKPMEISGTHTEINLDNAIDMIREANSIIITPGYGLCAAKAQYPIADLVKMLTEQGKKVRFGIHPVAGRMPGQLNVLLAEAGVPYDIVLEMDEINHDFPDTDLVLVIGANDTVNSAAQEDPNSIIAGMPVLEVWKSKQVIVMKRSLGVGYAAVDNPIFYKPNTAMLLGDAKKTCDALQAKVRESYQK

SEQ ID NO: 32421 - protein, 58 aa, Homo sapiens
  ENSP00000425542
MVNPTLGVHEADLLKTSGTLISFIYPAQNPELLNKLSQRKTTVLAMDQVPRVTIAQGY

SEQ ID NO: 32422 - protein, 57 aa, Homo sapiens
  ENSP00000421674
DGKVIFPAPTPKNIPQGAPVKQKTVAELEAEKAATITPFRKTMSTASAYTADEDREG

SEQ ID NO: 32423 - protein, 11 aa, Homo sapiens
  ENSP00000424782
  MOD_RES (1)..(1): Any amino acid
XLTEQGKKVRY

SEQ ID NO: 32424 - protein, 174 aa, Homo sapiens
  ENSP00000457732
MGNAQERPSETIDRERKRLVETLQADSGLLLDALLARGVLTGPEYEALDALPDAERRVRRLLLLVQGKGEAACQELLRCAQRTAGAPDPAWDWQHVGPGYRDRSYDPPCPGHWTPEAPGSGTTCPGLPRASDPDEAGGPEGSEAVQSGTPEEPEPELEAEASKEAEPEPEPEPE

SEQ ID NO: 32425 - protein, 138 aa, Homo sapiens
  ENSP00000454256
MGNAQERPSETIDRERKRLVETLQADSGLLLDALLARGVLTGPEYEALDALPDAERRVRRLLLLVQGKGEAACQELLRCAQRTAGAPDPAWDWQHVGPGYRDRSYDPPCPGHWTPEAPGSGTTCPGLPRASDPDEAGG

SEQ ID NO: 32426 - protein, 206 aa, Homo sapiens
  ENSP00000457720
MGNAQERPSETIDRERKRLVETLQADSGLLLDALLARGVLTGPEYEALDALPDAERRVRRLLLLVQGKGEAACQELLRCAQRTAGAPDPAWDWQHVGPGYRDRSYDPPCPGHWTPEAPGSGTTCPGLPRASDPDEAGGPEGSEAVQSGTPEEPEPELEAEASKEAEPEPEPEPELEPEAEAEPEPELEPEPDPEPEPDFEERDESE

SEQ ID NO: 32427 - protein, 270 aa, Homo sapiens
  ENSP00000457243
MPVLGKAGEERRATADAWGQKEEPEEETGQSVWRGRRTPSSPCWPPGPVLAEPSGGWDRAPTMGNAQERPSETIDRERKRLVETLQADSGLLLDALLARGVLTGPEYEALDALPDAERRVRRLLLLVQGKGEAACQELLRCAQRTAGAPDPAWDWQHVGPGYRDRSYDPPCPGHWTPEAPGSGTTCPGLPRASDPDEAGGPEGSEAVQSGTPEEPEPELEAEASKEAEPEPEPEPELEPEAEAEPEPELEPEPDPEPEPDFEERDESEDS

SEQ ID NO: 32428 - protein, 216 aa, Homo sapiens
  ENSP00000455808
  MOD_RES (1)..(1): Any amino acid
XGQSVWRGRRTPSSPCWPPGPVLAEPSGGWDRAPTMGNAQERPSETIDRERKRLVETLQADSGLLLDALLARGVLTGPEYEALDALPDAERRATGTAAMTLHAQATGRRRHPARGPHAPGCPELQTLTRPGALRAPRRCNPGPRRSQSQSWKLRPLKRLNRSRSQSQSWNPRLKQNQSRNWSQNRTQSPSPTSRKGTSPKIPEGQSSDRRCPAHAG

SEQ ID NO: 32429 - protein, 131 aa, Homo sapiens
  ENSP00000463698
  MOD_RES (1)..(1): Any amino acid
XSSPCWPPGPVLAEPSGGWDRGYRDRSYDPPCPGHWTPEAPGSGTTCPGLPRASDPDEAGGPEGSEAVQSGTPEEPEPELEAEASKEAEPEPEPEPELEPEAEAEPEPELEPEPDPEPEPDFEERDESEDS

SEQ ID NO: 32430 - protein, 219 aa, Homo sapiens
  ENSP00000454598
MGNAQERPSETIDRERKRLVETLQADSGLLLDALLARGVLTGPEYEALDALPDAERRVRRLLLLVQGKGEAACQELLRCAQRTAGAPDPAWDWQHATGTAAMTLHAQATGRRRHPARGPHAPGCPELQTLTRPGALRAPRRCNPGPRRSQSQSWKLRPLKRLNRSRSQSQSWNPRLKQNQSRNWSQNRTQSPSPTSRKGTSPKIPEGQSSDRRCPAHAG

SEQ ID NO: 32431 - protein, 106 aa, Homo sapiens
  ENSP00000463685
  MOD_RES (1)..(1): Any amino acid
XSWNPRLKQNQSRNWSQNRTQSPSPTSRKGTSPKVFLKARALTGGAPPMLDRTWDAAGAESDATKARSSPVPLEVNKLRRVGRDLGSLHDSGCLPRNLGWVPLSPR

SEQ ID NO: 32432 - protein, 208 aa, Homo sapiens
  ENSP00000268605
MGNAQERPSETIDRERKRLVETLQADSGLLLDALLARGVLTGPEYEALDALPDAERRVRRLLLLVQGKGEAACQELLRCAQRTAGAPDPAWDWQHVGPGYRDRSYDPPCPGHWTPEAPGSGTTCPGLPRASDPDEAGGPEGSEAVQSGTPEEPEPELEAEASKEAEPEPEPEPELEPEAEAEPEPELEPEPDPEPEPDFEERDESEDS

SEQ ID NO: 32433 - protein, 1434 aa, Homo sapiens
  ENSP00000320758
MEDHMFGVQQIQPNVISVRLFKRKVGGLGFLVKERVSKPPVIISDLIRGGAAEQSGLIQAGDIILAVNGRPLVDLSYDSALEVLRGIASETHVVLILRGPEGFTTHLETTFTGDGTPKTIRVTQPLGPPTKAVDLSHQPPAGKEQPLAVDGASGPGNGPQHAYDDGQEAGSLPHANGLAPRPPGQDPAKKATRVSLQGRGENNELLKEIEPVLSLLTSGSRGVKGGAPAKAEMKDMGIQVDRDLDGKSHKPLPLGVENDRVFNDLWGKGNVPVVLNNPYSEKEQPPTSGKQSPTKNGSPSKCPRFLKVKNWETEVVLTDTLHLKSTLETGCTEYICMGSIMHPSQHARRPEDVRTKGQLFPLAKEFIDQYYSSIKRFGSKAHMERLEEVNKEIDTTSTYQLKDTELIYGAKHAWRNASRCVGRIQWSKLQVFDARDCTTAHGMFNYICNHVKYATNKGNLRSAITIFPQRTDGKHDFRVWNSQLIRYAGYKQPDGSTLGDPANVQFTEICIQQGWKPPRGRFDVLPLLLQANGNDPELFQIPPELVLEVPIRHPKFEWFKDLGLKWYGLPAVSNMLLEIGGLEFSACPFSGWYMGTEIGVRDYCDNSRYNILEEVAKKMNLDMRKTSSLWKDQALVEINIAVLYSFQSDKVTIVDHHSATESFIKHMENEYRCRGGCPADWVWIVPPMSGSITPVFHQEMLNYRLTPSFEYQPDPWNTHVWKGTNGTPTKRRAIGFKKLAEAVKFSAKLMGQAMAKRVKATILYATETGKSQAYAKTLCEIFKHAFDAKVMSMEEYDIVHLEHETLVLVVTSTFGNGDPPENGEKFGCALMEMRHPNSVQEERKSYKVRFNSVSSYSDSQKSSGDGPDLRDNFESAGPLANVRFSVFGLGSRAYPHFCAFGHAVDTLLEELGGERILKMREGDELCGQEEAFRTWAKKVFKAACDVFCVGDDVNIEKANNSLISNDRSWKRNKFRLTFVAEAPELTQGLSNVHKKRVSAARLLSRQNLQSPKSSRSTIFVRLHTNGSQELQYQPGDHLGVFPGNHEDLVNALIERLEDAPPVNQMVKVELLEERNTALGVISNWTDELRLPPCTIFQAFKYYLDITTPPTPLQLQQFASLATSEKEKQRLLVLSKGLQEYEEWKWGKNPTIVEVLEEFPSIQMPATLLLTQLSLLQPRYYSISSSPDMYPDEVHLTVAIVSYRTRDGEGPIHHGVCSSWLNRIQADELVPCFVRGAPSFHLPRNPQVPCILVGPGTGIAPFRSFWQQRQFDIQHKGMNPCPMVLVFGCRQSKIDHIYREETLQAKNKGVFRELYTAYSREPDKPKKYVQDILQEQLAESVYRALKEQGGHIYVCGDVTMAADVLKAIQRIMTQQGKLSAEDAGVFISRMRDDNRYHEDIFGVTLRTYEVTNRLRSESIAFIEESKKDTDEVFSS

SEQ ID NO: 32434 - protein, 1468 aa, Homo sapiens
  ENSP00000337459
MEDHMFGVQQIQPNVISVRLFKRKVGGLGFLVKERVSKPPVIISDLIRGGAAEQSGLIQAGDIILAVNGRPLVDLSYDSALEVLRGIASETHVVLILRGPEGFTTHLETTFTGDGTPKTIRVTQPLGPPTKAVDLSHQPPAGKEQPLAVDGASGPGNGPQHAYDDGQEAGSLPHANGLAPRPPGQDPAKKATRVSLQGRGENNELLKEIEPVLSLLTSGSRGVKGGAPAKAEMKDMGIQVDRDLDGKSHKPLPLGVENDRVFNDLWGKGNVPVVLNNPYSEKEQPPTSGKQSPTKNGSPSKCPRFLKVKNWETEVVLTDTLHLKSTLETGCTEYICMGSIMHPSQHARRPEDVRTKGQLFPLAKEFIDQYYSSIKRFGSKAHMERLEEVNKEIDTTSTYQLKDTELIYGAKHAWRNASRCVGRIQWSKLQVFDARDCTTAHGMFNYICNHVKYATNKGNLRSAITIFPQRTDGKHDFRVWNSQLIRYAGYKQPDGSTLGDPANVQFTEICIQQGWKPPRGRFDVLPLLLQANGNDPELFQIPPELVLEVPIRHPKFEWFKDLGLKWYGLPAVSNMLLEIGGLEFSACPFSGWYMGTEIGVRDYCDNSRYNILEEVAKKMNLDMRKTSSLWKDQALVEINIAVLYSFQSDKVTIVDHHSATESFIKHMENEYRCRGGCPADWVWIVPPMSGSITPVFHQEMLNYRLTPSFEYQPDPWNTHVWKGTNGTPTKRRAIGFKKLAEAVKFSAKLMGQAMAKRVKATILYATETGKSQAYAKTLCEIFKHAFDAKVMSMEEYDIVHLEHETLVLVVTSTFGNGDPPENGEKFGCALMEMRHPNSVQEERKYPEPLRFFPRKGPPLPNGDTEVHGLAAARDSQHRSYKVRFNSVSSYSDSQKSSGDGPDLRDNFESAGPLANVRFSVFGLGSRAYPHFCAFGHAVDTLLEELGGERILKMREGDELCGQEEAFRTWAKKVFKAACDVFCVGDDVNIEKANNSLISNDRSWKRNKFRLTFVAEAPELTQGLSNVHKKRVSAARLLSRQNLQSPKSSRSTIFVRLHTNGSQELQYQPGDHLGVFPGNHEDLVNALIERLEDAPPVNQMVKVELLEERNTALGVISNWTDELRLPPCTIFQAFKYYLDITTPPTPLQLQQFASLATSEKEKQRLLVLSKGLQEYEEWKWGKNPTIVEVLEEFPSIQMPATLLLTQLSLLQPRYYSISSSPDMYPDEVHLTVAIVSYRTRDGEGPIHHGVCSSWLNRIQADELVPCFVRGAPSFHLPRNPQVPCILVGPGTGIAPFRSFWQQRQFDIQHKGMNPCPMVLVFGCRQSKIDHIYREETLQAKNKGVFRELYTAYSREPDKPKKYVQDILQEQLAESVYRALKEQGGHIYVCGDVTMAADVLKAIQRIMTQQGKLSAEDAGVFISRMRDDNRYHEDIFGVTLRTYEVTNRLRSESIAFIEESKKDTDEVFSS

SEQ ID NO: 32435 - protein, 1468 aa, Homo sapiens; identical to SEQ ID NO: 32434
  ENSP00000477999

SEQ ID NO: 32436 - protein, 1433 aa, Homo sapiens [sequence omitted]

SEQ ID NO: 32437 - protein, 2555 aa, Homo sapiens
  ENSP00000277541
MPPLLAPLLCLALLPALAARGPRCSQPGETCLNGGKCEAANGTEACVCGGAFVGPRCQDPNPCLSTPCKNAGTCHVVDRRGVADYACSCALGFSGPLCLTPLDNACLTNPCRNGGTCDLLTLTEYKCRCPPGWSGKSCQQADPCASNPCANGGQCLPFEASYICHCPPSFHGPTCRQDVNECGQKPGLCRHGGTCHNEVGSYRCVCRATHTGPNCERPYVPCSPSPCQNGGTCRPTGDVTHECACLPGFTGQNCEENIDDCPGNNCKNGGACVDGVNTYNCRCPPEWTGQYCTEDVDECQLMPNACQNGGTCHNTHGGYNCVCVNGWTGEDCSENIDDCASAACFHGATCHDRVASFYCECPHGRTGLLCHLNDACISNPCNEGSNCDTNPVNGKAICTCPSGYTGPACSQDVDECSLGANPCEHAGKCINTLGSFECQCLQGYTGPRCEIDVNECVSNPCQNDATCLDQIGEFQCICMPGYEGVHCEVNTDECASSPCLHNGRCLDKINEFQCECPTGFTGHLCQYDVDECASTPCKNGAKCLDGPNTYTCVCTEGYTGTHCEVDIDECDPDPCHYGSCKDGVATFTCLCRPGYTGHHCETNINECSSQPCRHGGTCQDRDNAYLCFCLKGTTGPNCEINLDDCASSPCDSGTCLDKIDGYECACEPGYTGSMCNINIDECAGNPCHNGGTCEDGINGFTCRCPEGYHDPTCLSEVNECNSNPCVHGACRDSLNGYKCDCDPGWSGTNCDINNNECESNPCVNGGTCKDMTSGYVCTCREGFSGPNCQTNINECASNPCLNQGTCIDDVAGYKCNCLLPYTGATCEVVLAPCAPSPCRNGGECRQSEDYESFSCVCPTGWQGQTCEVDINECVLSPCRHGASCQNTHGGYRCHCQAGYSGRNCETDIDDCRPNPCHNGGSCTDGINTAFCDCLPGFRGTFCEEDINECASDPCRNGANCTDCVDSYTCTCPAGFSGIHCENNTPDCTESSCFNGGTCVDGINSFTCLCPPGFTGSYCQHDVNECDSQPCLHGGTCQDGCGSYRCTCPQGYTGPNCQNLVHWCDSSPCKNGGKCWQTHTQYRCECPSGWTGLYCDVPSVSCEVAAQRQGVDVARLCQHGGLCVDAGNTHHCRCQAGYTGSYCEDLVDECSPSPCQNGATCTDYLGGYSCKCVAGYHGVNCSEEIDECLSHPCQNGGTCLDLPNTYKCSCPRGTQGVHCEINVDDCNPPVDPVSRSPKCFNNGTCVDQVGGYSCTCPPGFVGERCEGDVNECLSNPCDARGTQNCVQRVNDFHCECRAGHTGRRCESVINGCKGKPCKNGGTCAVASNTARGFICKCPAGFEGATCENDARTCGSLRCLNGGTCISGPRSPTCLCLGPFTGPECQFPASSPCLGGNPCYNQGTCEPTSESPFYRCLCPAKFNGLLCHILDYSFGGGAGRDIPPPLIEEACELPECQEDAGNKVCSLQCNNHACGWDGGDCSLNFNDPWKNCTQSLQCWKYFSDGHCDSQCNSAGCLFDGFDCQRAEGQCNPLYDQYCKDHFSDGHCDQGCNSAECEWDGLDCAEHVPERLAAGTLVVVVLMPPEQLRNSSFHFLRELSRVLHTNVVFKRDAHGQQMIFPYYGREEELRKHPIKRAAEGWAAPDALLGQVKASLLPGGSEGGRRRRELDPMDVRGSIVYLEIDNRQCVQASSQCFQSATDVAAFLGALASLGSLNIPYKIEAVQSETVEPPPPAQLHFMYVAAAAFVLLFFVGCGVLLSRKRRRQHGQLWFPEGFKVSEASKKKRREPLGEDSVGLKPLKNASDGALMDDNQNEWGDEDLETKKFRFEEPVVLPDLDDQTDHRQWTQQHLDAADLRMSAMAPTPPQGEVDADCMDVNVRGPDGFTPLMIASCSGGGLETGNSEEEEDAPAVISDFIYQGASLHNQTDRTGETALHLAARYSRSDAAKRLLEASADANIQDNMGRTPLHAAVSADAQGVFQILIRNRATDLDARMHDGTTPLILAARLAVEGMLEDLINSHADVNAVDDLGKSALHWAAAVNNVDAAVVLLKNGANKDMQNNREETPLFLAAREGSYETAKVLLDHFANRDITDHMDRLPRDIAQERMHHDIVRLLDEYNLVRSPQLHGAPLGGTPTLSPPLCSPNGYLGSLKPGVQGKKVRKPSSKGLACGSKEAKDLKARRKKSQDGKGCLLDSSGMLSPVDSLESPHGYLSDVASPPLLPSPFQQSPSVPLNHLPGMPDTHLGIGHLNVAAKPEMAALGGGGRLAFETGPPRLSHLPVASGTSTVLGSSSGGALNFTVGGSTSLNGQCEWLSRLQSGMVPNQYNPLRGSVAPGPLSTQAPSLQHGMVGPLHSSLAASALSQMMSYQGLPSTRLATQPHLVQTQQVQPQNLQMQQQNLQPANIQQQQSLQPPPPPPQPHLGVSSAASGHLGRSFLSGEPSQADVQPLGPSSLAVHTILPQESPALPTSLPSSLVPPVTAAQFLTPPSQHSYSSPVDNTPSHQLQVPEHPFLTPSPESPDQWSSSSPHSNVSDWSEGVSSPPTSMQSQIARIPEAFK

SEQ ID NO: 32438 - protein, 2321 aa, Homo sapiens
  ENSP00000263388
MGPGARGRRRRRRPMSPPPPPPPVRALPLLLLLAGPGAAAPPCLDGSPCANGGRCTQLPSREAACLCPPGWVGERCQLEDPCHSGPCAGRGVCQSSVVAGTARFSCRCPRGFRGPDCSLPDPCLSSPCAHGARCSVGPDGRFLCSCPPGYQGRSCRSDVDECRVGEPCRHGGTCLNTPGSFRCQCPAGYTGPLCENPAVPCAPSPCRNGGTCRQSGDLTYDCACLPGFEGQNCEVNVDDCPGHRCLNGGTCVDGVNTYNCQCPPEWTGQFCTEDVDECQLQPNACHNGGTCFNTLGGHSCVCVNGWTGESCSQNIDDCATAVCFHGATCHDRVASFYCACPMGKTGLLCHLDDACVSNPCHEDAICDTNPVNGRAICTCPPGFTGGACDQDVDECSIGANPCEHLGRCVNTQGSFLCQCGRGYTGPRCETDVNECLSGPCRNQATCLDRIGQFTCICMAGFTGTYCEVDIDECQSSPCVNGGVCKDRVNGFSCTCPSGFSGSTCQLDVDECASTPCRNGAKCVDQPDGYECRCAEGFEGTLCDRNVDDCSPDPCHHGRCVDGIASFSCACAPGYTGTRCESQVDECRSQPCRHGGKCLDLVDKYLCRCPSGTTGVNCEVNIDDCASNPCTFGVCRDGINRYDCVCQPGFTGPLCNVEINECASSPCGEGGSCVDGENGFRCLCPPGSLPPLCLPPSHPCAHEPCSHGICYDAPGGFRCVCEPGWSGPRCSQSLARDACESQPCRAGGTCSSDGMGFHCTCPPGVQGRQCELLSPCTPNPCEHGGRCESAPGQLPVCSCPQGWQGPRCQQDVDECAGPAPCGPHGICTNLAGSFSCTCHGGYTGPSCDQDINDCDPNPCLNGGSCQDGVGSFSCSCLPGFAGPRCARDVDECLSNPCGPGTCTDHVASFTCTCPPGYGGFHCEQDLPDCSPSSCFNGGTCVDGVNSFSCLCRPGYTGAHCQHEADPCLSRPCLHGGVCSAAHPGFRCTCLESFTGPQCQTLVDWCSRQPCQNGGRCVQTGAYCLCPPGWSGRLCDIRSLPCREAAAQIGVRLEQLCQAGGQCVDEDSSHYCVCPEGRTGSHCEQEVDPCLAQPCQHGGTCRGYMGGYMCECLPGYNGDNCEDDVDECASQPCQHGGSCIDLVARYLCSCPPGTLGVLCEINEDDCGPGPPLDSGPRCLHNGTCVDLVGGFRCTCPPGYTGLRCEADINECRSGACHAAHTRDCLQDPGGGFRCLCHAGFSGPRCQTVLSPCESQPCQHGGQCRPSPGPGGGLTFTCHCAQPFWGPRCERVARSCRELQCPVGVPCQQTPRGPRCACPPGLSGPSCRSFPGSPPGASNASCAAAPCLHGGSCRPAPLAPFFRCACAQGWTGPRCEAPAAAPEVSEEPRCPRAACQAKRGDQRCDRECNSPGCGWDGGDCSLSVGDPWRQCEALQCWRLFNNSRCDPACSSPACLYDNFDCHAGGRERTCNPVYEKYCADHFADGRCDQGCNTEECGWDGLDCASEVPALLARGVLVLTVLLPPEELLRSSADFLQRLSAILRTSLRFRLDAHGQAMVFPYHRPSPGSEPRARRELAPEVIGSVVMLEIDNRLCLQSPENDHCFPDAQSAADYLGALSAVERLDFPYPLRDVRGEPLEPPEPSVPLLPLLVAGAVLLLVILVLGVMVARRKREHSTLWFPEGFSLHKDVASGHKGRREPVGQDALGMKNMAKGESLMGEVATDWMDTECPEAKRLKVEEPGMGAEEAVDCRQWTQHHLVAADIRVAPAMALTPPQGDADADGMDVNVRGPDGFTPLMLASFCGGALEPMPTEEDEADDTSASIISDLICQGAQLGARTDRTGETALHLAARYARADAAKRLLDAGADTNAQDHSGRTPLHTAVTADAQGVFQILIRNRSTDLDARMADGSTALILAARLAVEGMVEELIASHADVNAVDELGKSALHWAAAVNNVEATLALLKNGANKDMQDSKEETPLFLAAREGSYEAAKLLLDHFANREITDHLDRLPRDVAQERLHQDIVRLLDQPSGPRSPPGPHGLGPLLCPPGAFLPGLKAAQSGSKKSRRPPGKAGLGPQGPRGRGKKLTLACPGPLADSSVTLSPVDSLDSPRPFGGPPASPGGFPLEGPYAAATATAVSLAQLGGPGRAGLGRQPPGGCVLSLGLLNPVAVPLDWARLPPPAPPGPSFLLPLAPGPQLLNPGTPVSPQERPPPYLAVPGHGEEYPAAGAHSSPPKARFLRVPSEHPYLTPSPESPEHWASPSPPSLSDWSESTPSPATATGAMATTTGALPAQPLPLSVPSSLAQAQTQLGPQPEVTPKRQVLA

SEQ ID NO: 32439 - protein, 117 aa, Homo sapiens
  ENSP00000470661
  MOD_RES (1)..(1): Any amino acid
XLMGEVATDWMDTECPEAKRLKVEEPGMGAEEAVDCRQWTQHHLVAADIRVAPAMALTPPQGDADADGMDVNVRGPDSHPKPLYRLGCPHGRWLNGTDPGGPPGSRGHGGRAHRQPC

SEQ ID NO: 32440 - protein, 177 aa, Homo sapiens
  ENSP00000468879
  MOD_RES (1)..(1): Any amino acid
XQLGARTDRTGETALHLAARYARADAAKRLLDAGADTNAQDHSGRTPLHTAVTADAQGVFQILIRNRSTDLDARMADGSTALILAARLAVEGMVEELIASHADVNAVDELGKSALHWAAAVNNVEATLALLKNGANKDMQDSKVSPSPWSTGCQQWHSAIAIQPGQQSETLSKNKTK

SEQ ID NO: 32441 - protein, 1286 aa, Homo sapiens
  ENSP00000473138
GPGARGRRRRRRPMSPPPPPPPVRALPLLLLLAGPGAAAPPCLDGSPCANGGRCTQLPSREAACLCPPGWVGERCQLEDPCHSGPCAGRGVCQSSVVAGTARFSCRCPRGFRGPDCSLPDPCLSSPCAHGARCSVGPDGRFLCSCPPGYQGRSCRSDVDECRVGEPCRHGGTCLNTPGSFRCQCPAGYTGPLCENPAVPCAPSPCRNGGTCRQSGDLTYDCACLPGFEGQNCEVNVDDCPGHRCLNGGTCVDGVNTYNCQCPPEWTGQFCTEDVDECQLQPNACHNGGTCFNTLGGHSCVCVNGWTGESCSQNIDDCATAVCFHGATCHDRVASFYCACPMGKTGLLCHLDDACVSNPCHEDAICDTNPVNGRAICTCPPGFTGGACDQDVDECSIGANPCEHLGRCVNTQGSFLCQCGRGYTGPRCETDVNECLSGPCRNQATCLDRIGQFTCICMAGFTGTYCEVDIDECQSSPCVNGGVCKDRVNGFSCTCPSGFSGSTCQLDVDECASTPCRNGAKCVDQPDGYECRCAEGFEGTLCDRNVDDCSPDPCHHGRCVDGIASFSCACAPGYTGTRCESQVDECRSQPCRHGGKCLDLVDKYLCRCPSGTTGVNCEVNIDDCASNPCTFGVCRDGINRYDCVCQPGFTGPLCNVEINECASSPCGEGGSCVDGENGFRCLCPPGSLPPLCLPPSHPCAHEPCSHGICYDAPGGFRCVCEPGWSGPRCSQSLARDACESQPCRAGGTCSSDGMGFHCTCPPGVQGRQCELLSPCTPNPCEHGGRCESAPGQLPVCSCPQGWQDPCLNGGSCQDGVGSFSCSCLPGFAGPRCARDVDECLSNPCGPGTCTDHVASFTCTCPPGYGGFHCEQDLPDCSPSSCFNGGTCVDGVNSFSCLCRPGYTGAHCQHEADPCLSRPCLHGGVCSAAHPGFRCTCLESFTGPQCQTLVDWCSRQPCQNGGRCVQTGAYCLCPPGWSGRLCDIRSLPCREAAAQIGVRLEQLCQAGGQCVDEDSSHYCVCPEGRTGSHCEQEVDPCLAQPCQHGGTCRGYMGGYMCECLPGYNGDNCEDDVDECASQPCQHGGSCIDLVARYLCSCPPGTLGVLCEINEDDCGPGPPLDSGPRCLHNGTCVDLVGGFRCTCPPGYTGLRCEADINECRSGACHAAHTRDCLQDPGGGFRCLCHAGFSGPRCQTVLSPCESQPCQHGGQCRPSPGPGGGLTFTCHCAQPFWGPRCERVARSCRELQCPVGVPCQQTPRGPRCACPPGLSGPSCRSFPGSPPGASNASC

SEQ ID NO: 32442 - protein, 802 aa, Homo sapiens
  ENSP00000311196
MYRSTKGASKARRDQINAEIRNLKELLPLAEADKVRLSYLHIMSLACIYTRKGVFFAGGTPLAGPTGLLSAQELEDIVAALPGFLLVFTAEGKLLYLSESVSEHLGHSMVDLVAQGDSIYDIIDPADHLTVRQQLTLPSALDTDRLFRCRFNTSKSLRRQSAGNKLVLIRGRFHAHPPGAYWAGNPVFTAFCAPLEPRPRPGPGPGPGPASLFLAMFQSRHAKDLALLDISESVLIYLGFERSELLCKSWYGLLHPEDLAHASAQHYRLLAESGDIQAEMVVRLQAKTGGWAWIYCLLYSEGPEGPITANNYPISDMEAWSLRQQLNSEDTQAAYVLGTPTMLPSFPENILSQEECSSTNPLFTAALGAPRSTSFPSAPELSVVSASEELPRPSKELDFSYLTFPSGPEPSLQAELSKDLVCTPPYTPHQPGGCAFLFSLHEPFQTHLPTPSSTLQEQLTPSTATFSDQLTPSSATFPDPLTSPLQGQLTETSVRSYEDQLTPCTSTFPDQLLPSTATFPEPLGSPAHEQLTPPSTAFQAHLDSPSQTFPEQLSPNPTKTYFAQEGCSFLYEKLPPSPSSPGNGDCTLLALAQLRGPLSVDVPLVPEGLLTPEASPVKQSFFHYSEKEQNEIDRLIQQISQLAQGMDRPFSAEAGTGGLEPLGGLEPLDSNLSLSGAGPPVLSLDLKPWKCQELDFLADPDNMFLEETPVEDIFMDLSTPDPSEEWGSGDPEAEGPGGAPSPCNNLSPEDHSFLEDLATYETAFETGVSAFPYDGFTDELHQLQSQVQDSFHEDGSGGEPTF

SEQ ID NO: 32443 - protein, 234 aa, Homo sapiens
  ENSP00000433135
MYRSTKGASKARRDQINAEIRNLKELLPLAEADKVRLSYLHIMSLACIYTRKGVFFAGGTPLAGPTGLLSAQELEDIVAALPGFLLVFTAEGKLLYLSESVSEHLGHSMVDLVAQGDSIYDIIDPADHLTVRQQLTLPSALDTDRLFRCRFNTSKSLRRQSAGNKLVLIRGRFHAHPPGAYWAGNPVFTAFCAPLEPRPRPGPGPGPGPASLFLAMFQSRHAKDLALLDISESG

SEQ ID NO: 32444 - protein, 234 aa, Homo sapiens; identical to SEQ ID NO: 32443
  ENSP00000492526

SEQ ID NO: 32445 - protein, 240 aa, Homo sapiens
  ENSP00000356526
MAFPKKKLQGLVAATITPMTENGEINFSVIGQYVDYLVKEQGVKNIFVNGTTGEGLSLSVSERRQVAEEWVTKGKDKLDQVIIHVGALSLKESQELAQHAAEIGADGIAVIAPFFLKPWTKDILINFLKEVAAAAPALPFYYYHIPALTGVKIRAEELLDGILDKIPTFQGLKFSDTDLLDFGQCVDQNRQQQFAFLFGVDEFCIQRFINFVVKLENSKLKVSKNQRTLPLGTTNFPFLH

SEQ ID NO: 32446 - protein, 320 aa, Homo sapiens
  ENSP00000356524
MAFPKKKLQGLVAATITPMTENGEINFSVIGQYVDYLVKEQGVKNIFVNGTTGEGLSLSVSERRQVAEEWVTKGKDKLDQVIIHVGALSLKESQELAQHAAEIGADGIAVIAPFFLKPWTKDILINFLKEVAAAAPALPFYYYHIPALTGVKIRAEELLDGILDKIPTFQGLKFSDTDLLDFGQCVDQNRQQQFAFLFGVDEQLLSALVMGATGAVGSTYNYLGKKTNQMLEAFEQKDFSLALNYQFCIQRFINFVVKLGFGVSQTKAIMTLVSGIPMGPPRLPLQKASREFTDSAEAKLKSLDFLSFTDLKDGNLEAGS

SEQ ID NO: 32447 - protein, 240 aa, Homo sapiens; identical to SEQ ID NO: 32445
  ENSP00000356523

SEQ ID NO: 32448 - protein, 320 aa, Homo sapiens; identical to SEQ ID NO: 32446
  ENSP00000258317

SEQ ID NO: 32449 - protein, 301 aa, Homo sapiens
  ENSP00000356525
MSRAPGILASWRRAPSLSVQKGSQTARHTCHPEVPLGNCFLPVYKASPLTVTRLWAERLDQVIIHVGALSLKESQELAQHAAEIGADGIAVIAPFFLKPWTKDILINFLKEVAAAAPALPFYYYHIPALTGVKIRAEELLDGILDKIPTFQGLKFSDTDLLDFGQCVDQNRQQQFAFLFGVDEQLLSALVMGATGAVGSTYNYLGKKTNQMLEAFEQKDFSLALNYQFCIQRFINFVVKLGFGVSQTKAIMTLVSGIPMGPPRLPLQKASREFTDSAEAKLKSLDFLSFTDLKDGNLEAGS

SEQ ID NO: 32450 - protein, 230 aa, Homo sapiens
  ENSP00000482415
MAFPKKKLQGLVAATITPMTENGEINFSVIGQYVDYLVKEQGVKNIFVNGTTGEGLSLSVSERRQVAEEWVTKGKDKLDQVIIHVGALSLKESQELAQHAAEIGADGIAVIAPFFLKPWTKDILINFLKEVAAAAPALPFYYYHIPALTGVKIRAEELLDGILDKIPTFQGLKFSDTDLLDFGQCVDQNRQQQFAFLFGVDEQLLSALVMGATGAVGSFVSRDLSTLLSN

SEQ ID NO: 32451 - protein, 1061 aa, Homo sapiens
  ENSP00000357669
MPGPRRPAGSRLRLLLLLLLPPLLLLLRGSHAGNLTVAVVLPLANTSYPWSWARVGPAVELALAQVKARPDLLPGWTVRTVLGSSENALGVCSDTAAPLAAVDLKWEHNPAVFLGPGCVYAAAPVGRFTAHWRVPLLTAGAPALGFGVKDEYALTTRAGPSYAKLGDFVAALHRRLGWERQALMLYAYRPGDEEHCFFLVEGLFMRVRDRLNITVDHLEFAEDDLSHYTRLLRTMPRKGRVIYICSSPDAFRTLMLLALEAGLCGEDYVFFHLDIFGQSLQGGQGPAPRRPWERGDGQDVSARQAFQAAKIITYKDPDNPEYLEFLKQLKHLAYEQFNFTMEDGLVNTIPASFHDGLLLYIQAVTETLAHGGTVTDGENITQRMWNRSFQGVTGYLKIDSSGDRETDFSLWDMDPENGAFRVVLNYNGTSQELVAVSGRKLNWPLGYPPPDIPKCGFDNEDPACNQDHLSTLEVLALVGSLSLLGILIVSFFIYRKMQLEKELASELWRVRWEDVEPSSLERHLRSAGSRLTLSGRGSNYGSLLTTEGQFQVFAKTAYYKGNLVAVKRVNRKRIELTRKVLFELKHMRDVQNEHLTRFVGACTDPPNICILTEYCPRGSLQDILENESITLDWMFRYSLTNDIVKGMLFLHNGAICSHGNLKSSNCVVDGRFVLKITDYGLESFRDLDPEQGHTVYAKKLWTAPELLRMASPPVRGSQAGDVYSFGIILQEIALRSGVFHVEGLDLSPKEIIERVTRGEQPPFRPSLALQSHLEELGLLMQRCWAEDPQERPPFQQIRLTLRKFNRENSSNILDNLLSRMEQYANNLEELVEERTQAYLEEKRKAEALLYQILPHSVAEQLKRGETVQAEAFDSVTIYFSDIVGFTALSAESTPMQVVTLLNDLYTCFDAVIDNFDVYKVETIGDAYMVVSGLPVRNGRLHACEVARMALALLDAVRSFRIRHRPQEQLRLRIGIHTGPVCAGVVGLKMPRYCLFGDTVNTASRMESNGEALKIHLSSETKAVLEEFGGFELELRGDVEMKGKGKVRTYWLLGERGSSTRG

SEQ ID NO: 32452 - protein, 252 aa, Homo sapiens
  ENSP00000425325
MAEGCAVYGTWPWGGMFQLFRPSALAGLCSIGLVVIMCASSDTIRSIMLVAHRHGMTSGDYAFFNIELFNSSSYGDGSWKRGDKHDFEAKQAYSSLQTVTLLRTVKPEFEKFSMEVKSSVEKQGLNMEDYVNMFVEGFHDAILLYVLALHEVLRAGYSKKDGGKIIQQTWNRTFEGIAGQVSIDANGDRYGDFSVIAMTDVEAGTQEVIGDYFGKEGRFEMRPNVKYPWGPLKLRIDENRIVEHTNSSPCKS

SEQ ID NO: 32453 - protein, 325 aa, Homo sapiens
  ENSP00000388408
MEPSALGPWSLFPDLAPRDQEGQVLAPRRCFRRECGQNEKVVIMCASSDTIRSIMLVAHRHGMTSGDYAFFNIELFNSSSYGDGSWKRGDKHDFEAKQAYSSLQTVTLLRTVKPEFEKFSMEVKSSVEKQGLNMEDYVNMFVEGFHDAILLYVLALHEVLRAGYSKKDGGKIIQQTWNRTFEGIAGQVSIDANGDRYGDFSVIAMTDVEAGTQEVIGDYFGKEGRFEMRPNVKYPWGPLKLRIDENRIVEHTNSSPCKSSGGLEESAVTGIVVGALLGAGLLMAFYFFRKKYRITIERRTQQEESNLGKHRELREDSIRSHFSVA

SEQ ID NO: 32454 - protein, 541 aa, Homo sapiens
  ENSP00000265074
MPSLLVLTFSPCVLLGWALLAGGTGGGGVGGGGGGAGIGGGRQEREALPPQKIEVLVLLPQDDSYLFSLTRVRPAIEYALRSVEGNGTGRRLLPPGTRFQVAYEDSDCGNRALFSLVDRVAAARGAKPDLILGPVCEYAAAPVARLASHWDLPMLSAGALAAGFQHKDSEYSHLTRVAPAYAKMGEMMLALFRHHHWSRAALVYSDDKLERNCYFTLEGVHEVFQEEGLHTSIYSFDETKDLDLEDIVRNIQASERVVIMCASSDTIRSIMLVAHRHGMTSGDYAFFNIELFNSSSYGDGSWKRGDKHDFEAKQAYSSLQTVTLLRTVKPEFEKFSMEVKSSVEKQGLNMEDYVNMFVEGFHDAILLYVLALHEVLRAGYSKKDGGKIIQQTWNRTFEGIAGQVSIDANGDRYGDFSVIAMTDVEAGTQEVIGDYFGKEGRFEMRPNVKYPWGPLKLRIDENRIVEHTNSSPCKSSGGLEESAVTGIVVGALLGAGLLMAFYFFRKKYRITIERRTQQEESNLGKHRELREDSIRSHFSVA

SEQ ID NO: 32455 - protein, 540 aa, Homo sapiens
  ENSP00000398028
MPSLLVLTFSPCVLLGWALLAGGTGGGGVGGGGGGAGIGGGRQEREALPPQKIEVLVLLPQDDSYLFSLTRVRPAIEYALRSVEGNGTGRRLLPPGTRFQVAYEDSDCGNRALFSLVDRVAAARGAKPDLILGPVCEYAAAPVARLASHWDLPMLSAGALAAGFQHKDSEYSHLTRVAPAYAKMGEMMLALFRHHHWSRAALVYSDDKLERNCYFTLEGVHEVFQEEGLHTSIYSFDETKDLDLEDIVRNIQASERVVIMCASSDTIRSIMLVAHRHGMTSGDYAFFNIELFNSSSYGDGSWKRGDKHDFEAKQAYSSLQTVTLLRTVKPEFEKFSMEVKSSVEKQGLNMEDYVNMFVEGFHDAILLYVLALHEVLRAGYSKKDGGKIIQQTWNRTFEGIAGQVSIDANGDRYGDFSVIAMTDVEAGTQEVIGDYFGKEGRFEMRPNVKYPWGPLKLRIDENRIVEHTNSSPCKSCGLEESAVTGIVVGALLGAGLLMAFYFFRKKYRITIERRTQQEESNLGKHRELREDSIRSHFSVA

SEQ ID NO: 32456 - protein, 88 aa, Homo sapiens
  ENSP00000423730
  MOD_RES (1)..(1): Any amino acid
XEMMLALFRHHHWSRAALVYSDDKLERNCYFTLEGVHEVFQEEGLHTSIYSFDETKDLDLEDIVRNIQASERVLGLICWNPSGRKFSS

SEQ ID NO: 32457 - protein, 324 aa, Homo sapiens
  ENSP00000318340
MEPSALGPWSLFPDLAPRDQEGQVLAPRRCFRRECGQNEKVVIMCASSDTIRSIMLVAHRHGMTSGDYAFFNIELFNSSSYGDGSWKRGDKHDFEAKQAYSSLQTVTLLRTVKPEFEKFSMEVKSSVEKQGLNMEDYVNMFVEGFHDAILLYVLALHEVLRAGYSKKDGGKIIQQTWNRTFEGIAGQVSIDANGDRYGDFSVIAMTDVEAGTQEVIGDYFGKEGRFEMRPNVKYPWGPLKLRIDENRIVEHTNSSPCKSCGLEESAVTGIVVGALLGAGLLMAFYFFRKKYRITIERRTQQEESNLGKHRELREDSIRSHFSVA

SEQ ID NO: 32458 - protein, 384 aa, Homo sapiens
  ENSP00000354652
MNSTLFSQVENHSVHSNFSEKNAQLLAFENDDCHLPLAMIFTLALAYGAVIILGVSGNLALIIIILKQKEMRNVTNILIVNLSFSDLLVAIMCLPFTFVYTLMDHWVFGEAMCKLNPFVQCVSITVSIFSLVLIAVERHQLIINPRGWRPNNRHAYVGIAVIWVLAVASSLPFLIYQVMTDEPFQNVTLDAYKDKYVCFDQFPSDSHRLSYTTLLLVLQYFGPLCFIFICYFKIYIRLKRRNNMMDKMRDNKYRSSETKRINIMLLSIVVAFAVCWLPLTIFNTVFDWNHQIIATCNHNLLFLLCHLTAMISTCVNPIFYGFLNKNFQRDLQFFFNFCDFRSRDDDYETIAMSTMHTDVSKTSLKQASPVAFKKINNNDDNEKI

SEQ ID NO: 32459 - protein, 141 aa, Homo sapiens
  ENSP00000427284
MMDKMRDNKYRSSETKRINIMLLSIVVAFAVCWLPLTIFNTVFDWNHQIIATCNHNLLFLLCHLTAMISTCVNPIFYGFLNKNFQRDLQFFFNFCDFRSRDDDYETIAMSTMHTDVSKTSLKQASPVAFKKINNNDDNEKI

SEQ ID NO: 32460 - protein, 64 aa, Homo sapiens
  ENSP00000422963
MMDKMRDNKYRSSETKRINIMLLSIVVAFAVCWLPLTIFNTVFDWNHQIIATCNHNLLFLLCHL

SEQ ID NO: 32461 - protein, 99 aa, Homo sapiens
  ENSP00000421618
MTDEPFQNVTLDAYKDKYVCFDQFPSDSHRLSYTTLLLVLQYFGPLCFIFICYFKIYIRLKRRNNMMDKMRDNKYRSSETKRINIMLLSIVVAFAVCWL

SEQ ID NO: 32462 - protein, 61 aa, Homo sapiens
  ENSP00000427564
MNSTLFSQVENHSVHSNFSEKNAQLLAFENDDCHLPLAMIFTLALAYGAVIILGVSGNLAL

SEQ ID NO: 32463 - protein, 60 aa, Homo sapiens
  ENSP00000426099
MNSTLFSQVENHSVHSNFSEKNAQLLAFENDDCHLPLAMIFTLALAYGAVIILGVSGNLA

SEQ ID NO: 32464 - protein, 24 aa, Homo sapiens
  ENSP00000423878
MNSTLFSQVENHSVHSNFSEKNAQ

SEQ ID NO: 32465 - protein, 984 aa, Homo sapiens
  ENSP00000341390
METKGYHSLPEGLDMERRWGQVSQAVERSSLGPTERTDENNYMEIVNVSCVSGAIPNNSTQGSSKEKQELLPCLQQDNNRPGILTSDIKTELESKELSATVAESMGLYMDSVRDADYSYEQQNQQGSMSPAKIYQNVEQLVKFYKGNGHRPSTLSCVNTPLRSFMSDSGSSVNGGVMRAVVKSPIMCHEKSPSVCSPLNMTSSVCSPAGINSVSSTTASFGSFPVHSPITQGTPLTCSPNVENRGSRSHSPAHASNVGSPLSSPLSSMKSSISSPPSHCSVKSPVSSPNNVTLRSSVSSPANINNSRCSVSSPSNTNNRSTLSSPAASTVGSICSPVNNAFSYTASGTSAGSSTLRDVVPSPDTQEKGAQEVPFPKTEEVESAISNGVTGQLNIVQYIKPEPDGAFSSSCLGGNSKINSDSSFSVPIKQESTKHSCSGTSFKGNPTVNPFPFMDGSYFSFMDDKDYYSLSGILGPPVPGFDGNCEGSGFPVGIKQEPDDGSYYPEASIPSSAIVGVNSGGQSFHYRIGAQGTISLSRSARDQSFQHLSSFPPVNTLVESWKSHGDLSSRRSDGYPVLEYIPENVSSSTLRSVSTGSSRPSKICLVCGDEASGCHYGVVTCGSCKVFFKRAVEGQHNYLCAGRNDCIIDKIRRKNCPACRLQKCLQAGMNLGARKSKKLGKLKGIHEEQPQQQQPPPPPPPPQSPEEGTTYIAPAKEPSVNTALVPQLSTISRALTPSPVMVLENIEPEIVYAGYDSSKPDTAENLLSTLNRLAGKQMIQVVKWAKVLPGFKNLPLEDQITLIQYSWMCLSSFALSWRSYKHTNSQFLYFAPDLVFNEEKMHQSAMYELCQGMHQISLQFVRLQLTFEEYTIMKVLLLLSTIPKDGLKSQAAFEEMRTNYIKELRKMVTKCPNNSGQSWQRFYQLTKLLDSMHDLVSDLLEFCFYTFRESHALKVEFPAMLVEIISDQLPKVESGNAKPLYFHRK

SEQ ID NO: 32466 - protein, 984 aa, Homo sapiens; identical to SEQ ID NO: 32465
  ENSP00000350815

SEQ ID NO: 32467 - protein, 867 aa, Homo sapiens
  ENSP00000423510
METKGYHSLPEGLDMERRWGQVSQAVERSSLGPTERTDENNYMEIVNVSCVSGAIPNNSTQGSSKEKQELLPCLQQDNNRPGILTSDIKTELESKELSATVAESMGLYMDSVRDADYSYEQQNQQGSMSPAKIYQNVEQLVKFYKGNGHRPSTLSCVNTPLRSFMSDSGSSVNGGVMRAVVKSPIMCHEKSPSVCSPLNMTSSVCSPAGINSVSSTTASFGSFPVHSPITQGTPLTCSPNVENRGSRSHSPAHASNVGSPLSSPLSSMKSSISSPPSHCSVKSPVSSPNNVTLRSSVSSPANINNSRCSVSSPSNTNNRSTLSSPAASTVGSICSPVNNAFSYTASGTSAGSSTLRDVVPSPDTQEKGAQEVPFPKTEEVESAISNGVTGQLNIVQYIKPEPDGAFSSSCLGGNSKINSDSSFSVPIKQESTKHSCSGTSFKGNPTVNPFPFMDGSYFSFMDDKDYYSLSGILGPPVPGFDGNCEGSGFPVGIKQEPDDGSYYPEASIPSSAIVGVNSGGQSFHYRIGAQGTISLSRSARDQSFQHLSSFPPVNTLVESWKSHGDLSSRRSDGYPVLEYIPENVSSSTLRSVSTGSSRPSKICLVCGDEASGCHYGVVTCGSCKVFFKRAVEGQHNYLCAGRNDCIIDKIRRKNCPACRLQKCLQAGMNLGGFKNLPLEDQITLIQYSWMCLSSFALSWRSYKHTNSQFLYFAPDLVFNEEKMHQSAMYELCQGMHQISLQFVRLQLTFEEYTIMKVLLLLSTIPKDGLKSQAAFEEMRTNYIKELRKMVTKCPNNSGQSWQRFYQLTKLLDSMHDLVSDLLEFCFYTFRESHALKVEFPAMLVEIISDQLPKVESGNAKPLYFHRK

SEQ ID NO: 32468 - protein, 706 aa, Homo sapiens
  ENSP00000343907
METKGYHSLPEGLDMERRWGQVSQAVERSSLGPTERTDENNYMEIVNVSCVSGAIPNNSTQGSSKEKQELLPCLQQDNNRPGILTSDIKTELESKELSATVAESMGLYMDSVRDADYSYEQQNQQGSMSPAKIYQNVEQLVKFYKGNGHRPSTLSCVNTPLRSFMSDSGSSVNGGVMRAVVKSPIMCHEKSPSVCSPLNMTSSVCSPAGINSVSSTTASFGSFPVHSPITQGTPLTCSPNVENRGSRSHSPAHASNVGSPLSSPLSSMKSSISSPPSHCSVKSPVSSPNNVTLRSSVSSPANINNSRCSVSSPSNTNNRSTLSSPAASTVGSICSPVNNAFSYTASGTSAGSSTLRDVVPSPDTQEKGAQEVPFPKTEEVESAISNGVTGQLNIVQYIKPEPDGAFSSSCLGGNSKINSDSSFSVPIKQESTKHSCSGTSFKGNPTVNPFPFMDGSYFSFMDDKDYYSLSGILGPPVPGFDGNCEGSGFPVGIKQEPDDGSYYPEASIPSSAIVGVNSGGQSFHYRIGAQGTISLSRSARDQSFQHLSSFPPVNTLVESWKSHGDLSSRRSDGYPVLEYIPENVSSSTLRSVSTGSSRPSKICLVCGDEASGCHYGVVTCGSCKVFFKRAVEGQHNYLCAGRNDCIIDKIRRKNCPACRLQKCLQAGMNLGERRCISLPCMNYARGCTKSAFSSFDCSSPLKNTPS

SEQ ID NO: 32469 - protein, 988 aa, Homo sapiens
  ENSP00000421481
METKGYHSLPEGLDMERRWGQVSQAVERSSLGPTERTDENNYMEIVNVSCVSGAIPNNSTQGSSKEKQELLPCLQQDNNRPGILTSDIKTELESKELSATVAESMGLYMDSVRDADYSYEQQNQQGSMSPAKIYQNVEQLVKFYKGNGHRPSTLSCVNTPLRSFMSDSGSSVNGGVMRAVVKSPIMCHEKSPSVCSPLNMTSSVCSPAGINSVSSTTASFGSFPVHSPITQGTPLTCSPNVENRGSRSHSPAHASNVGSPLSSPLSSMKSSISSPPSHCSVKSPVSSPNNVTLRSSVSSPANINNSRCSVSSPSNTNNRSTLSSPAASTVGSICSPVNNAFSYTASGTSAGSSTLRDVVPSPDTQEKGAQEVPFPKTEEVESAISNGVTGQLNIVQYIKPEPDGAFSSSCLGGNSKINSDSSFSVPIKQESTKHSCSGTSFKGNPTVNPFPFMDGSYFSFMDDKDYYSLSGILGPPVPGFDGNCEGSGFPVGIKQEPDDGSYYPEASIPSSAIVGVNSGGQSFHYRIGAQGTISLSRSARDQSFQHLSSFPPVNTLVESWKSHGDLSSRRSDGYPVLEYIPENVSSSTLRSVSTGSSRPSKICLVCGDEASGCHYGVVTCGSCKVFFKRAVEGKCSWQHNYLCAGRNDCIIDKIRRKNCPACRLQKCLQAGMNLGARKSKKLGKLKGIHEEQPQQQQPPPPPPPPQSPEEGTTYIAPAKEPSVNTALVPQLSTISRALTPSPVMVLENIEPEIVYAGYDSSKPDTAENLLSTLNRLAGKQMIQVVKWAKVLPGFKNLPLEDQITLIQYSWMCLSSFALSWRSYKHTNSQFLYFAPDLVFNEEKMHQSAMYELCQGMHQISLQFVRLQLTFEEYTIMKVLLLLSTIPKDGLKSQAAFEEMRTNYIKELRKMVTKCPNNSGQSWQRFYQLTKLLDSMHDLVSDLLEFCFYTFRESHALKVEFPAMLVEIISDQLPKVESGNAKPLYFHRK

SEQ ID NO: 32470 - protein, 988 aa, Homo sapiens; identical to SEQ ID NO: 32469
  ENSP00000486719

SEQ ID NO: 32471 - protein, 119 aa, Homo sapiens
  ENSP00000456633
MWLAKACWSIQSEMPCIQAQYGTPAPSPGPRDHLASDPLTPEFIKPTMDLASPEAAPAAPTALPSFSTFMDGYTGEFDTFLYQLPGTVQPCSSASSSASSTSSSSATSPASASFKFEDF

SEQ ID NO: 32472 - protein, 302 aa, Homo sapiens
  ENSP00000457070
MWLAKACWSIQSEMPCIQAQYGTPAPSPGPRDHLASDPLTPEFIKPTMDLASPEAAPAAPTALPSFSTFMDGYTGEFDTFLYQLPGTVQPCSSASSSASSTSSSSATSPASASFKFEDFQVYGCYPGPLSGPVDEALSSSGSDYYGSPCSAPSPSTPSFQPPQLSPWDGSFGHFSPSQTYEGLRAWTEQLPKASGPPQPPAFFSFSPPTGPSPSLAQSPLKLFPSQATHQLGEGESYSMPTAFPGLAPTSPHLEGSGILDTPVTSTKARSGAPGGSEGRCAVCGDNASCQHYGVRTCEGCKG

SEQ ID NO: 32473 - protein, 78 aa, Homo sapiens
  ENSP00000456776
MWLAKACWSIQSGLPETTRKSPQPILGFSLRAVVWDLFPGSKQIVRRKLVSHDSGGAQAPGSATFGCGASPFHCELNS

SEQ ID NO: 32474 - protein, 652 aa, Homo sapiens
  ENSP00000440864
MTSAQYKIKILIEGLHHGQRPGPAPPRQPGSFCWALKADGIMWLAKACWSIQSEMPCIQAQYGTPAPSPGPRDHLASDPLTPEFIKPTMDLASPEAAPAAPTALPSFSTFMDGYTGEFDTFLYQLPGTVQPCSSASSSASSTSSSSATSPASASFKFEDFQVYGCYPGPLSGPVDEALSSSGSDYYGSPCSAPSPSTPSFQPPQLSPWDGSFGHFSPSQTYEGLRAWTEQLPKASGPPQPPAFFSFSPPTGPSPSLAQSPLKLFPSQATHQLGEGESYSMPTAFPGLAPTSPHLEGSGILDTPVTSTKARSGAPGGSEGRCAVCGDNASCQHYGVRTCEGCKGFFKRTVQKNAKYICLANKDCPVDKRRRNRCQFCRFQKCLAVGMVKEVVRTDSLKGRRGRLPSKPKQPPDASPANLLTSLVRAHLDSGPSTAKLDYSKFQELVLPHFGKEDAGDVQQFYDLLSGSLEVIRKWAEKIPGFAELSPADQDLLLESAFLELFILRLAYRSKPGEGKLIFCSGLVLHRLQCARGFGDWIDSILAFSRSLHSLLVDVPAFACLSALVLITDRHGLQEPRRVEELQNRIASCLKEHVAAVAGEPQPASCLSRLLGKLPELRTLCTQGLQRIFYLKLEDLVPPPPIIDKIFMDTLPF

SEQ ID NO: 32475 - protein, 611 aa, Homo sapiens
  ENSP00000449539
MWLAKACWSIQSEMPCIQAQYGTPAPSPGPRDHLASDPLTPEFIKPTMDLASPEAAPAAPTALPSFSTFMDGYTGEFDTFLYQLPGTVQPCSSASSSASSTSSSSATSPASASFKFEDFQVYGCYPGPLSGPVDEALSSSGSDYYGSPCSAPSPSTPSFQPPQLSPWDGSFGHFSPSQTYEGLRAWTEQLPKASGPPQPPAFFSFSPPTGPSPSLAQSPLKLFPSQATHQLGEGESYSMPTAFPGLAPTSPHLEGSGILDTPVTSTKARSGAPGGSEGRCAVCGDNASCQHYGVRTCEGCKGFFKRTVQKNAKYICLANKDCPVDKRRRNRCQFCRFQKCLAVGMVKEVVRTDSLKGRRGRLPSKPKQPPDASPANLLTSLVRAHLDSGPSTAKLDYSKFQELVLPHFGKEDAGDVQQFYDLLSGSLEVIRKWAEKIPGFAELSPADQDLLLESAFLELFILRLAYRSKPGEGKLIFCSGLVLHRLQCARGFGDWIDSILAFSRSLHSLLVDVPAFACLSALVLITDRHGLQEPRRVEELQNRIASCLKEHVAAVAGEPQPASCLSRLLGKLPELRTLCTQGLQRIFYLKLEDLVPPPPIIDKIFMDTLPF

SEQ ID NO: 32476 - protein, 148 aa, Homo sapiens
  ENSP00000449858
MPCIQAQYGTPAPSPGPRDHLASDPLTPEFIKPTMDLASPEAAPAAPTALPSFSTFMDGYTGEFDTFLYQLPGTVQPCSSASSSASSTSSSSATSPASASFKFEDFQVAQCRKTPSTSAWLTRTALWTRGGETAASSAASRSAWRWAW

SEQ ID NO: 32477 - protein, 598 aa, Homo sapiens
  ENSP00000378301
MPCIQAQYGTPAPSPGPRDHLASDPLTPEFIKPTMDLASPEAAPAAPTALPSFSTFMDGYTGEFDTFLYQLPGTVQPCSSASSSASSTSSSSATSPASASFKFEDFQVYGCYPGPLSGPVDEALSSSGSDYYGSPCSAPSPSTPSFQPPQLSPWDGSFGHFSPSQTYEGLRAWTEQLPKASGPPQPPAFFSFSPPTGPSPSLAQSPLKLFPSQATHQLGEGESYSMPTAFPGLAPTSPHLEGSGILDTPVTSTKARSGAPGGSEGRCAVCGDNASCQHYGVRTCEGCKGFFKRTVQKNAKYICLANKDCPVDKRRRNRCQFCRFQKCLAVGMVKEVVRTDSLKGRRGRLPSKPKQPPDASPANLLTSLVRAHLDSGPSTAKLDYSKFQELVLPHFGKEDAGDVQQFYDLLSGSLEVIRKWAEKIPGFAELSPADQDLLLESAFLELFILRLAYRSKPGEGKLIFCSGLVLHRLQCARGFGDWIDSILAFSRSLHSLLVDVPAFACLSALVLITDRHGLQEPRRVEELQNRIASCLKEHVAAVAGEPQPASCLSRLLGKLPELRTLCTQGLQRIFYLKLEDLVPPPPIIDKIFMDTLPF

SEQ ID NO: 32478 - protein, 325 aa, Homo sapiens
  ENSP00000449587
MPCIQAQYGTPAPSPGPRDHLASDPLTPEFIKPTMDLASPEAAPAAPTALPSFSTFMDGYTGEFDTFLYQLPGTVQPCSSASSSASSTSSSSATSPASASFKFEDFQVYGCYPGPLSGPVDEALSSSGSDYYGSPCSAPSPSTPSFQPPQLSPWDGSFGHFSPSQTYEGLRAWTEQLPKASGPPQPPAFFSFSPPTGPSPSLAQSPLKLFPSQATHQLGEGESYSMPTAFPGLAPTSPHLEGSGILDTPVTSTKARSGAPGGSEGRCAVCGDNASCQHYGVRTCEGCKGFFKVPRSPRWGLLLEMERGWPHPIGTCGLPLGSPPS

SEQ ID NO: 32479 - protein, 150 aa, Homo sapiens
  ENSP00000455399
MDLASPEAAPAAPTALPSFSTFMDGYTGEFDTFLYQLPGTVQPCSSASSSASSTSSSSATSPASASFKFEDFQVYGCYPGPLSGPVDEALSSSGSDYYGSPCSAPSPSTPSFQPPQLSPWDGSFGHFSPSQTYEGLRAWTEQLPKASGPP

SEQ ID NO: 32480 - protein, 120 aa, Homo sapiens
  ENSP00000455767
MLGMYSSSTTCSPVLWRSSASGRRRSLALLSCHRLTRTCCWSRPSWSSSSSAWRTGLSQARASSSSAQAWCYTGCSVPVASGTGLTVSWPSQGPCTACLSMSLPSPASLPLSSSPTGMGC

SEQ ID NO: 32481 - protein, 598 aa, Homo sapiens; identical to SEQ ID NO: 32477
  ENSP00000378302

SEQ ID NO: 32482 - protein, 611 aa, Homo sapiens; identical to SEQ ID NO: 32475
  ENSP00000353427

SEQ ID NO: 32483 - protein, 598 aa, Homo sapiens; identical to SEQ ID NO: 32477
  ENSP00000243050

SEQ ID NO: 32484 - protein, 598 aa, Homo sapiens
  ENSP00000344479
MPCVQAQYGSSPQGASPASQSYSYHSSGEYSSDFLTPEFVKFSMDLTNTEITATTSLPSFSTFMDNYSTGYDVKPPCLYQMPLSGQQSSIKVEDIQMHNYQQHSHLPPQSEEMMPHSGSVYYKPSSPPTPTTPGFQVQHSPMWDDPGSLHNFHQNYVATTHMIEQRKTPVSRLSLFSFKQSPPGTPVSSCQMRFDGPLHVPMNPEPAGSHHVVDGQTFAVPNPIRKPASMGFPGLQIGHASQLLDTQVPSPPSRGSPSNEGLCAVCGDNAACQHYGVRTCEGCKGFFKRTVQKNAKYVCLANKNCPVDKRRRNRCQYCRFQKCLAVGMVKEVVRTDSLKGRRGRLPSKPKSPQEPSPPSPPVSLISALVRAHVDSNPAMTSLDYSRFQANPDYQMSGDDTQHIQQFYDLLTGSMEIIRGWAEKIPGFADLPKADQDLLFESAFLELFVLRLAYRSNPVEGKLIFCNGVVLHRLQCVRGFGEWIDSIVEFSSNLQNMNIDISAFSCIAALAMVTERHGLKEPKRVEELQNKIVNCLKDHVTFNNGGLNRPNYLSKLLGKLPELRTLCTQGLQRIFYLKLEDLVPPPAIIDKLFLDTLPF

SEQ ID NO: 32485 - protein, 535 aa, Homo sapiens
  ENSP00000389986
MDNYSTGYDVKPPCLYQMPLSGQQSSIKVEDIQMHNYQQHSHLPPQSEEMMPHSGSVYYKPSSPPTPTTPGFQVQHSPMWDDPGSLHNFHQNYVATTHMIEQRKTPVSRLSLFSFKQSPPGTPVSSCQMRFDGPLHVPMNPEPAGSHHVVDGQTFAVPNPIRKPASMGFPGLQIGHASQLLDTQVPSPPSRGSPSNEGLCAVCGDNAACQHYGVRTCEGCKGFFKRTVQKNAKYVCLANKNCPVDKRRRNRCQYCRFQKCLAVGMVKEVVRTDSLKGRRGRLPSKPKSPQEPSPPSPPVSLISALVRAHVDSNPAMTSLDYSRFQANPDYQMSGDDTQHIQQFYDLLTGSMEIIRGWAEKIPGFADLPKADQDLLFESAFLELFVLRLAYRSNPVEGKLIFCNGVVLHRLQCVRGFGEWIDSIVEFSSNLQNMNIDISAFSCIAALAMVTERHGLKEPKRVEELQNKIVNCLKDHVTFNNGGLNRPNYLSKLLGKLPELRTLCTQGLQRIFYLKLEDLVPPPAIIDKLFLDTLPF

SEQ ID NO: 32486 - protein, 598 aa, Homo sapiens; identical to SEQ ID NO: 32484
  ENSP00000386747

SEQ ID NO: 32487 - protein, 392 aa, Homo sapiens
  ENSP00000415632
MDNYSTGYDVKPPCLYQMPLSGQQSSIKVEDIQMHNYQQHSHLPPQSEEMMPHSGSVYYKPSSPPTPTTPGFQVQHSPMWDDPGSLHNFHQNYVATTHMIEQRKTPVSRLSLFSFKQSPPGTPVSSCQMRFDGPLHVPMNPEPAGSHHVVDGQTFAVPNPIRKPASMGFPGLQIGHASQLLDTQVPSPPSRGSPSNEGLCAVCGDNAACQHYGVRTCEGCKGFFKRTVQKNAKYVCLANKNCPVDKRRRNRCQYCRFQKCLAVGMVKEVVRTDSLKGRRGRLPSKPKSPQEPSPPSPPVSLISALVRAHVDSNPAMTSLDYSRFQANPDYQMSGDDTQHIQQFYDLLTGSMEIIRGWAEKIPGFADLPKADQDLLFESAFLELFVLRLAYRI

SEQ ID NO: 32488 - protein, 392 aa, Homo sapiens; identical to SEQ ID NO: 32487
  ENSP00000394671

SEQ ID NO: 32489 - protein, 553 aa, Homo sapiens
  ENSP00000386993
MPCVQAQYGSSPQGASPASQSYSYHSSGEYSSDFLTPEFVKFSMDLTNTEITATTSLPSFSTFMDNYSTGYDVKPPCLYQMPLSGQQSSIKVEDIQMHNYQQHSHLPPQSEEMMPHSGSVYYKPSSPPTPTTPGFQVQHSPMWDDPGSLHNFHQNYVATTHMIEQRKTPVSRLSLFSFKQSPPGTPVSSCQMRFDGPLHVPMNPEPAGSHHVVDGQTFAVPNPIRKPASMGFPGLQIGHASQLLDTQVPSPPSRGSPSNEGLCAVCGDNAACQHYGVRTCEGCKGFFKRTVQKNAKYVCLANKNCPVDKRRRNRCQYCRFQKCLAVGMVKEVVRTDSLKGRRGRLPSKPKSPQEPSPPSPPVSLISALVRAHVDSNPAMTSLDYSRFQANPDYQMSGDDTQHIQQFYDLLTGSMEIIRGWAEKIPGFADLPKADQDLLFESAFLELFVLRLAYRSNPVEEYEHRHFCLLLHCCPGYGHRETRAQGTQESGRTAKQDCKLSQRPRDFQQWGVEPPQLFVQTVGEAPRTSYPLHTGATAHFLPEIGRLGATASNN

SEQ ID NO: 32490 - protein, 490 aa, Homo sapiens
  ENSP00000410952
MDNYSTGYDVKPPCLYQMPLSGQQSSIKVEDIQMHNYQQHSHLPPQSEEMMPHSGSVYYKPSSPPTPTTPGFQVQHSPMWDDPGSLHNFHQNYVATTHMIEQRKTPVSRLSLFSFKQSPPGTPVSSCQMRFDGPLHVPMNPEPAGSHHVVDGQTFAVPNPIRKPASMGFPGLQIGHASQLLDTQVPSPPSRGSPSNEGLCAVCGDNAACQHYGVRTCEGCKGFFKRTVQKNAKYVCLANKNCPVDKRRRNRCQYCRFQKCLAVGMVKEVVRTDSLKGRRGRLPSKPKSPQEPSPPSPPVSLISALVRAHVDSNPAMTSLDYSRFQANPDYQMSGDDTQHIQQFYDLLTGSMEIIRGWAEKIPGFADLPKADQDLLFESAFLELFVLRLAYRSNPVEEYEHRHFCLLLHCCPGYGHRETRAQGTQESGRTAKQDCKLSQRPRDFQQWGVEPPQLFVQTVGEAPRTSYPLHTGATAHFLPEIGRLGATASNN

SEQ ID NO: 32491 - protein, 150 aa, Homo sapiens
  ENSP00000385379
  MOD_RES (1)..(1): Any amino acid
XSYHSSGEYSSDFLTPEFVKFSMDLTNTEITATTSLPSFSTFMDNYSTGYDVKPPCLYQMPLSGQQSSIKRTVQKNAKYVCLANKNCPVDKRRRNRCQYCRFQKCLAVGMVKEVVRTDSLKGRRGRLPSKPKSPQEPSPPSPPVSLISAL

SEQ ID NO: 32492 - protein, 258 aa, Homo sapiens
  ENSP00000406808
MPCVQAQYGSSPQGASPASQSYSYHSSGEYSSDFLTPEFVKFSMDLTNTEITATTSLPSFSTFMDNYSTGYDVKPPCLYQMPLSGQQSSIKVEDIQMHNYQQHSHLPPQSEEMMPHSGSVYYKPSSPPTPTTPGFQVQHSPMWDDPGSLHNFHQNYVATTHMIEQRKTPVSRLSLFSFKQSPPGTPVSSCQMRFDGPLHVPMNPEPAGSHHVVDGQTFAVPNPIRKPASMGFPGLQIGHASQLLDTQVPSPPSRGSPS

SEQ ID NO: 32493 - protein, 106 aa, Homo sapiens
  ENSP00000388120
MDNYSTGYDVKPPCLYQMPLSGQQSSIKVEDIQMHNYQQHSHLPPQSEEMMPHSGSVYYKPSSPPTPTTPGFQVQHSPMWDDPGSLHNFHQNYVATTHMIEQRKTP

SEQ ID NO: 32494 - protein, 443 aa, Homo sapiens
  ENSP00000340301
MPCVQAQYSPSPPGSSYAAQTYSSEYTTEIMNPDYTKLTMDLGSTEITATATTSLPSISTFVEGYSSNYELKPSCVYQMQRPLIKVEEGRAPSYHHHHHHHHHHHHHHQQQHQQPSIPPASSPEDEVLPSTSMYFKQSPPSTPTTPAFPPQAGALWDEALPSAPGCIAPGPLLDPPMKAVPTVAGARFPLFHFKPSPPHPPAPSPAGGHHLGYDPTAAAALSLPLGAAAAAGSQAAALESHPYGLPLAKRAAPLAFPPLGLTPSPTASSLLGESPSLPSPPSRSSSSGEGTCAVCGDNAACQHYGVRTCEGCKGFFKRTVQKNAKYVCLANKNCPVDKRRRNRCQYCRFQKCLSVGMVKEVVRTDSLKGRRGRLPSKPKSPLQQEPSQPSPPSPPICMMNALVRALTDSTPRDLDYSRVSFMISCFQMNDQGLYLWLLVIRVD

SEQ ID NO: 32495 - protein, 626 aa, Homo sapiens
  ENSP00000378531
MPCVQAQYSPSPPGSSYAAQTYSSEYTTEIMNPDYTKLTMDLGSTEITATATTSLPSISTFVEGYSSNYELKPSCVYQMQRPLIKVEEGRAPSYHHHHHHHHHHHHHHQQQHQQPSIPPASSPEDEVLPSTSMYFKQSPPSTPTTPAFPPQAGALWDEALPSAPGCIAPGPLLDPPMKAVPTVAGARFPLFHFKPSPPHPPAPSPAGGHHLGYDPTAAAALSLPLGAAAAAGSQAAALESHPYGLPLAKRAAPLAFPPLGLTPSPTASSLLGESPSLPSPPSRSSSSGEGTCAVCGDNAACQHYGVRTCEGCKGFFKRTVQKNAKYVCLANKNCPVDKRRRNRCQYCRFQKCLSVGMVKEVVRTDSLKGRRGRLPSKPKSPLQQEPSQPSPPSPPICMMNALVRALTDSTPRDLDYSRYCPTDQAAAGTDAEHVQQFYNLLTASIDVSRSWAEKIPGFTDLPKEDQTLLIESAFLELFVLRLSIRSNTAEDKFVFCNGLVLHRLQCLRGFGEWLDSIKDFSLNLQSLNLDIQALACLSALSMITERHGLKEPKRVEELCNKITSSLKDHQSKGQALEPTESKVLGALVELRKICTLGLQRIFYLKLEDLVSPPSIIDKLFLDTLPF

SEQ ID NO: 32496 - protein, 637 aa, Homo sapiens
  ENSP00000333122
MHDSIRFGNVDMPCVQAQYSPSPPGSSYAAQTYSSEYTTEIMNPDYTKLTMDLGSTEITATATTSLPSISTFVEGYSSNYELKPSCVYQMQRPLIKVEEGRAPSYHHHHHHHHHHHHHHQQQHQQPSIPPASSPEDEVLPSTSMYFKQSPPSTPTTPAFPPQAGALWDEALPSAPGCIAPGPLLDPPMKAVPTVAGARFPLFHFKPSPPHPPAPSPAGGHHLGYDPTAAAALSLPLGAAAAAGSQAAALESHPYGLPLAKRAAPLAFPPLGLTPSPTASSLLGESPSLPSPPSRSSSSGEGTCAVCGDNAACQHYGVRTCEGCKGFFKRTVQKNAKYVCLANKNCPVDKRRRNRCQYCRFQKCLSVGMVKEVVRTDSLKGRRGRLPSKPKSPLQQEPSQPSPPSPPICMMNALVRALTDSTPRDLDYSRYCPTDQAAAGTDAEHVQQFYNLLTASIDVSRSWAEKIPGFTDLPKEDQTLLIESAFLELFVLRLSIRSNTAEDKFVFCNGLVLHRLQCLRGFGEWLDSIKDFSLNLQSLNLDIQALACLSALSMITERHGLKEPKRVEELCNKITSSLKDHQSKGQALEPTESKVLGALVELRKICTLGLQRIFYLKLEDLVSPPSIIDKLFLDTLPF

SEQ ID NO: 32497 - protein, 637 aa, Homo sapiens; identical to SEQ ID NO: 32496
  ENSP00000482027

SEQ ID NO: 32498 - protein, 287 aa, Homo sapiens
  ENSP00000277746
MEVMEGPLNLAHQQSRRADRLLAAGKYEEAISCHKKAAAYLSEAMKLTQSEQAHLSLELQRDSHMKQLLLIQERWKRAQREERLKAQQNTDKDAAAHLQTSHKPSAEDAEGQSPLSQKYSPSTEKCLPEIQGIFDRDPDTLLYLLQQKSEPAEPCIGSKAPKDDKTIIEEQATKIADLKRHVEFLVAENERLRKENKQLKAEKARLLKGPIEKELDVDADFVETSELWSLPPHAETATASSTWQKFAANTGKAKDIPIPNLPPLDFPSPELPLMELSEDILKGFMNN

SEQ ID NO: 32499 - protein, 277 aa, Homo sapiens
  ENSP00000397502
MFPGATTPLPKAAAYPGVYGSNGRTPQPAYLSEAMKLTQSEQAHLSLELQRDSHMKQLLLIQERWKRAQREERLKAQQNTDKDAAAHLQTSHKPSAEDAEGQSPLSQKYSPSTEKCLPEIQGIFDRDPDTLLYLLQQKSEPAEPCIGSKAPKDDKTIIEEQATKIADLKRHVEFLVAENERLRKENKQLKAEKARLLKGPIEKELDVDADFVETSELWSLPPHAETATASSTWQKFAANTGKAKDIPIPNLPPLDFPSPELPLMELSEDILKGFMNN

SEQ ID NO: 32500 - protein, 1183 aa, Homo sapiens
  ENSP00000325269
MQLKIMPKKKRLSAGRVPLILFLCQMISALEVPLDLVQPPTITQQSPKDYIIDPRENIVIQCEAKGKPPPSFSWTRNGTHFDIDKDPLVTMKPGTGTLIINIMSEGKAETYEGVYQCTARNERGAAVSNNIVVRPSRSPLWTKEKLEPITLQSGQSLVLPCRPPIGLPPPIIFWMDNSFQRLPQSERVSQGLNGDLYFSNVLPEDTREDYICYARFNHTQTIQQKQPISVKVISVDELNDTIAANLSDTEFYGAKSSRERPPTFLTPEGNASNKEELRGNVLSLECIAEGLPTPIIYWAKEDGMLPKNRTVYKNFEKTLQIIHVSEADSGNYQCIAKNALGAIHHTISVRVKAAPYWITAPQNLVLSPGEDGTLICRANGNPKPRISWLTNGVPIEIAPDDPSRKIDGDTIIFSNVQERSSAVYQCNASNEYGYLLANAFVNVLAEPPRILTPANTLYQVIANRPALLDCAFFGSPLPTIEWFKGAKGSALHEDIYVLHENGTLEIPVAQKDSTGTYTCVARNKLGMAKNEVHLEIKDPTWIVKQPEYAVVQRGSMVSFECKVKHDHTLSLTVLWLKDNRELPSDERFTVDKDHLVVADVSDDDSGTYTCVANTTLDSVSASAVLSVVDVPNPPFDLELTDQLDKSVQLSWTPGDDNNSPITKFIIEYEDAMHKPGLWHHQTEVSGTQTTAQLKLSPYVNYSFRVMAVNSIGKSLPSEASEQYLTKASEPDKNPTAVEGLGSEPDNLVITWKPLNGFESNGPGLQYKVSWRQKDGDDEWTSVVVANVSKYIVSGTPTFVPYLIKVQALNDMGFAPEPAVVMGHSGEDLPMVAPGNVRVNVVNSTLAEVHWDPVPLKSIRGHLQGYRIYYWKTQSSSKRNRRHIEKKILTFQGSKTHGMLPGLEPFSHYTLNVRVVNGKGEGPASPDRVFNTPEGVPSAPSSLKIVNPTLDSLTLEWDPPSHPNGILTEYTLKYQPINSTHELGPLVDLKIPANKTRWTLKNLNFSTRYKFYFYAQTSAGSGSQITEEAVTTVDEAMASRQVDIATQGWFIGLMCAVALLILILLIVCFIRRNKGGKYPVKEKEDAHADPEIQPMKEDDGTFGEYSDAEDHKPLKKGSRTPSDRTVKKEDSDDSLVDYGEGVNGQFNEDGSFIGQYSGKKEKEPAEGNESSEAPSPVNAMNSFV

SEQ ID NO: 32501 - protein, 1192 aa, Homo sapiens
  ENSP00000368310
MQLKIMPKKKRLSAGRVPLILFLCQMISALEVPLDPKLLEDLVQPPTITQQSPKDYIIDPRENIVIQCEAKGKPPPSFSWTRNGTHFDIDKDPLVTMKPGTGTLIINIMSEGKAETYEGVYQCTARNERGAAVSNNIVVRPSRSPLWTKEKLEPITLQSGQSLVLPCRPPIGLPPPIIFWMDNSFQRLPQSERVSQGLNGDLYFSNVLPEDTREDYICYARFNHTQTIQQKQPISVKVISAKSSRERPPTFLTPEGNASNKEELRGNVLSLECIAEGLPTPIIYWAKEDGMLPKNRTVYKNFEKTLQIIHVSEADSGNYQCIAKNALGAIHHTISVRVKAAPYWITAPQNLVLSPGEDGTLICRANGNPKPRISWLTNGVPIEIAPDDPSRKIDGDTIIFSNVQERSSAVYQCNASNEYGYLLANAFVNVLAEPPRILTPANTLYQVIANRPALLDCAFFGSPLPTIEWFKGAKGSALHEDIYVLHENGTLEIPVAQKDSTGTYTCVARNKLGMAKNEVHLEIKDPTWIVKQPEYAVVQRGSMVSFECKVKHDHTLSLTVLWLKDNRELPSDERFTVDKDHLVVADVSDDDSGTYTCVANTTLDSVSASAVLSVVAPTPTPAPVYDVPNPPFDLELTDQLDKSVQLSWTPGDDNNSPITKFIIEYEDAMHKPGLWHHQTEVSGTQTTAQLKLSPYVNYSFRVMAVNSIGKSLPSEASEQYLTKASEPDKNPTAVEGLGSEPDNLVITWKPLNGFESNGPGLQYKVSWRQKDGDDEWTSVVVANVSKYIVSGTPTFVPYLIKVQALNDMGFAPEPAVVMGHSGEDLPMVAPGNVRVNVVNSTLAEVHWDPVPLKSIRGHLQGYRIYYWKTQSSSKRNRRHIEKKILTFQGSKTHGMLPGLEPFSHYTLNVRVVNGKGEGPASPDRVFNTPEGVPSAPSSLKIVNPTLDSLTLEWDPPSHPNGILTEYTLKYQPINSTHELGPLVDLKIPANKTRWTLKNLNFSTRYKFYFYAQTSAGSGSQITEEAVTTVDEAGILPPDVGAGKAMASRQVDIATQGWFIGLMCAVALLILILLIVCFIRRNKGGKYPVKEKEDAHADPEIQPMKEDDGTFGEYSDAEDHKPLKKGSRTPSDRTVKKEDSDDSLVDYGEGVNGQFNEDGSFIGQYSGKKEKEPAEGNESSEAPSPVNAMNSFV

SEQ ID NO: 32502 - protein, 1304 aa, Homo sapiens
  ENSP00000401244
MQLKIMPKKKRLSAGRVPLILFLCQMISALEVPLDPKLLEDLVQPPTITQQSPKDYIIDPRENIVIQCEAKGKPPPSFSWTRNGTHFDIDKDPLVTMKPGTGTLIINIMSEGKAETYEGVYQCTARNERGAAVSNNIVVRPSRSPLWTKEKLEPITLQSGQSLVLPCRPPIGLPPPIIFWMDNSFQRLPQSERVSQGLNGDLYFSNVLPEDTREDYICYARFNHTQTIQQKQPISVKVISVDELNDTIAANLSDTEFYGAKSSRERPPTFLTPEGNASNKEELRGNVLSLECIAEGLPTPIIYWAKEDGMLPKNRTVYKNFEKTLQIIHVSEADSGNYQCIAKNALGAIHHTISVRVKAAPYWITAPQNLVLSPGEDGTLICRANGNPKPRISWLTNGVPIEIAPDDPSRKIDGDTIIFSNVQERSSAVYQCNASNEYGYLLANAFVNVLAEPPRILTPANTLYQVIANRPALLDCAFFGSPLPTIEWFKGAKGSALHEDIYVLHENGTLEIPVAQKDSTGTYTCVARNKLGMAKNEVHLEIKDPTWIVKQPEYAVVQRGSMVSFECKVKHDHTLSLTVLWLKDNRELPSDERFTVDKDHLVVADVSDDDSGTYTCVANTTLDSVSASAVLSVVAPTPTPAPVYDVPNPPFDLELTDQLDKSVQLSWTPGDDNNSPITKFIIEYEDAMHKPGLWHHQTEVSGTQTTAQLKLSPYVNYSFRVMAVNSIGKSLPSEASEQYLTKASEPDKNPTAVEGLGSEPDNLVITWKPLNGFESNGPGLQYKVSWRQKDGDDEWTSVVVANVSKYIVSGTPTFVPYLIKVQALNDMGFAPEPAVVMGHSGEDLPMVAPGNVRVNVVNSTLAEVHWDPVPLKSIRGHLQGYRIYYWKTQSSSKRNRRHIEKKILTFQGSKTHGMLPGLEPFSHYTLNVRVVNGKGEGPASPDRVFNTPEGVPSAPSSLKIVNPTLDSLTLEWDPPSHPNGILTEYTLKYQPINSTHELGPLVDLKIPANKTRWTLKNLNFSTRYKFYFYAQTSAGSGSQITEEAVTTVDEAGILPPDVGAGKVQAVNPRISNLTAAAAETYANISWEYEGPEHVNFYVEYGVAGSKEEWRKEIVNGSRSFFGLKGLMPGTAYKVRVGAVGDSGFVSSEDVFETGPAMASRQVDIATQGWFIGLMCAVALLILILLIVCFIRRNKGGKYPVKEKEDAHADPEIQPMKEDDGTFGEYSDAEDHKPLKKGSRTPSDRTVKKEDSDDSLVDYGEGVNGQFNEDGSFIGQYSGKKEKEPAEGNESSEAPSPVNAMNSFV

SEQ ID NO: 32503 - protein, 190 aa, Homo sapiens
  ENSP00000398174
  MOD_RES (1)..(1): Any amino acid
XGILPPDVGAGKVQAVNPRISNLTAAAAETYANISWEYEGPEHVNFYVEYGVAGTMASRQVDIATQGWFIGLMCAVALLILILLIVCFIRRNKGGKYPVKEKEDAHADPEIQPMKEDDGTFGEYSDAEDHKPLKKGSRTPSDRTVKKEDSDDSLVDYGEGVNGQFNEDGSFIGQYSGKKEKEPAEGNESS

SEQ ID NO: 32504 - protein, 431 aa, Homo sapiens
  ENSP00000390421
MQLKIMPKKKRLSAGRVPLILFLCQMISALEVPLDLVQPPTITQQSPKDYIIDPRENIVIQCEAKGKPPPSFSWTRNGTHFDIDKDPLVTMKPGTGTLIINIMSEGKAETYEGVYQCTARNERGAAVSNNIVVRPSRSPLWTKEKLEPITLQSGQSLVLPCRPPIGLPPPIIFWMDNSFQRLPQSERVSQGLNGDLYFSNVLPEDTREDYICYARFNHTQTIQQKQPISVKVISVDELNDTIAANLSDTEFYGAKSSRERPPTFLTPEGNASNKEELRGNVLSLECIAEGLPTPIIYWAKEDGMLPKNRTVYKNFEKTLQIIHVSEADSGNYQCIAKNALGAIHHTISVRVKAAPYWITAPQNLVLSPGEDGTLICRANGNPKPRISWLTNGVPIEIAPDDPSRKIDGDTIIFSNVQERSSAVYQCNASNE

SEQ ID NO: 32505 - protein, 118 aa, Homo sapiens
  ENSP00000390868
MQLKIMPKKKRLSAGRVPLILFLCQMISALEVPLDPKLLEDLVQPPTITQQSPKDYIIDPRENIVIQCEAKGKPPPSFSWTRNGTHFDIDKDPLVTMKPGTGTLIINIMSEGKAETYE

SEQ ID NO: 32506 - protein, 106 aa, Homo sapiens
  ENSP00000397544
MQLKIMPKKKRLSAGRVPLILFLCQMISALEVPLDLVQPPTITQQSPKDYIIDPRENIVIQCEAKGKPPPSFSWTRNGTHFDIDKDPLVTMKPGTGTLIINIMSEG

SEQ ID NO: 32507 - protein, 106 aa, Homo sapiens; identical to SEQ ID NO: 32506
  ENSP00000408203

SEQ ID NO: 32508 - protein, 61 aa, Homo sapiens
  ENSP00000393663
MQLKIMPKKKRLSAGRVPLILFLCQMISALEVPLDPKLLEDLVQPPTITQQSPKDYIIDPR

SEQ ID NO: 32509 - protein, 1304 aa, Homo sapiens; identical to SEQ ID NO: 32502
  ENSP00000368314

SEQ ID NO: 32510 - protein, 1211 aa, Homo sapiens
  ENSP00000407858
MQLKIMPKKKRLSAGRVPLILFLCQMISALEVPLDPKLLEDLVQPPTITQQSPKDYIIDPRENIVIQCEAKGKPPPSFSWTRNGTHFDIDKDPLVTMKPGTGTLIINIMSEGKAETYEGVYQCTARNERGAAVSNNIVVRPSRSPLWTKEKLEPITLQSGQSLVLPCRPPIGLPPPIIFWMDNSFQRLPQSERVSQGLNGDLYFSNVLPEDTREDYICYARFNHTQTIQQKQPISVKVISVDELNDTIAANLSDTEFYGAKSSRERPPTFLTPEGNASNKEELRGNVLSLECIAEGLPTPIIYWAKEDGMLPKNRTVYKNFEKTLQIIHVSEADSGNYQCIAKNALGAIHHTISVRVKAAPYWITAPQNLVLSPGEDGTLICRANGNPKPRISWLTNGVPIEIAPDDPSRKIDGDTIIFSNVQERSSAVYQCNASNEYGYLLANAFVNVLAEPPRILTPANTLYQVIANRPALLDCAFFGSPLPTIEWFKGAKGSALHEDIYVLHENGTLEIPVAQKDSTGTYTCVARNKLGMAKNEVHLEIKDPTWIVKQPEYAVVQRGSMVSFECKVKHDHTLSLTVLWLKDNRELPSDERFTVDKDHLVVADVSDDDSGTYTCVANTTLDSVSASAVLSVVAPTPTPAPVYDVPNPPFDLELTDQLDKSVQLSWTPGDDNNSPITKFIIEYEDAMHKPGLWHHQTEVSGTQTTAQLKLSPYVNYSFRVMAVNSIGKSLPSEASEQYLTKASEPDKNPTAVEGLGSEPDNLVITWKPLNGFESNGPGLQYKVSWRQKDGDDEWTSVVVANVSKYIVSGTPTFVPYLIKVQALNDMGFAPEPAVVMGHSGEDLPMVAPGNVRVNVVNSTLAEVHWDPVPLKSIRGHLQGYRIYYWKTQSSSKRNRRHIEKKILTFQGSKTHGMLPGLEPFSHYTLNVRVVNGKGEGPASPDRVFNTPEGVPSAPSSLKIVNPTLDSLTLEWDPPSHPNGILTEYTLKYQPINSTHELGPLVDLKIPANKTRWTLKNLNFSTRYKFYFYAQTSAGSGSQITEEAVTTVDEAGILPPDVGAGKAMASRQVDIATQGWFIGLMCAVALLILILLIVCFIRRNKGGKYPVKEKEDAHADPEIQPMKEDDGTFGEYSDAEDHKPLKKGSRTPSDRTVKKEDSDDSLVDYGEGVNGQFNEDGSFIGQYSGKKEKEPAEGNESSEAPSPVNAMNSFV

SEQ ID NO: 32511 - protein, 1299 aa, Homo sapiens
  ENSP00000368308
MPKKKRLSAGRVPLILFLCQMISALEVPLDPKLLEDLVQPPTITQQSPKDYIIDPRENIVIQCEAKGKPPPSFSWTRNGTHFDIDKDPLVTMKPGTGTLIINIMSEGKAETYEGVYQCTARNERGAAVSNNIVVRPSRSPLWTKEKLEPITLQSGQSLVLPCRPPIGLPPPIIFWMDNSFQRLPQSERVSQGLNGDLYFSNVLPEDTREDYICYARFNHTQTIQQKQPISVKVISVDELNDTIAANLSDTEFYGAKSSRERPPTFLTPEGNASNKEELRGNVLSLECIAEGLPTPIIYWAKEDGMLPKNRTVYKNFEKTLQIIHVSEADSGNYQCIAKNALGAIHHTISVRVKAAPYWITAPQNLVLSPGEDGTLICRANGNPKPRISWLTNGVPIEIAPDDPSRKIDGDTIIFSNVQERSSAVYQCNASNEYGYLLANAFVNVLAEPPRILTPANTLYQVIANRPALLDCAFFGSPLPTIEWFKGAKGSALHEDIYVLHENGTLEIPVAQKDSTGTYTCVARNKLGMAKNEVHLEIKDPTWIVKQPEYAVVQRGSMVSFECKVKHDHTLSLTVLWLKDNRELPSDERFTVDKDHLVVADVSDDDSGTYTCVANTTLDSVSASAVLSVVAPTPTPAPVYDVPNPPFDLELTDQLDKSVQLSWTPGDDNNSPITRIHHEYEDAMHKPGLWHHQTEVSGTQTTAQLKLSPYVNYSFRVMAVNSIGKSLPSEASEQYLTKASEPDKNPTAVEGLGSEPDNLVITWKPLNGFESNGPGLQYKVSWRQKDGDDEWTSVVVANVSKYIVSGTPTFVPYLIKVQALNDMGFAPEPAVVMGHSGEDLPMVAPGNVRVNVVNSTLAEVHWDPVPLKSIRGHLQGYRIYYWKTQSSSKRNRRHIEKKILTFQGSKTHGMLPGLEPFSHYTLNVRVVNGKGEGPASPDRVFNTPEGVPSAPSSLKIVNPTLDSLTLEWDPPSHPNGILTEYTLKYQPINSTHELGPLVDLKIPANKTRWTLKNLNFSTRYKFYFYAQTSAGSGSQITEEAVTTVDEAGILPPDVGAGKVQAVNPRISNLTAAAAETYANISWEYEGPEHVNFYVEYGVAGSKEEWRKEIVNGSRSFFGLKGLMPGTAYKVRVGAVGDSGFVSSEDVFETGPAMASRQVDIATQGWFIGLMCAVALLILILLIVCFIRRNKGGKYPVKEKEDAHADPEIQPMKEDDGTFGEYSDAEDHKPLKKGSRTPSDRTVKKEDSDDSLVDYGEGVNGQFNEDGSFIGQYSGKKEKEPAEGNESSEAPSPVNAMNSFV

SEQ ID NO: 32512 - protein, 771 aa, Homo sapiens [sequence omitted]

SEQ ID NO: 32513 - protein, 37 aa, Homo sapiens
  ENSP00000427595
MVYYPELFVWVSQEPFPNKDMEGRLPKETSLSPFMES

SEQ ID NO: 32514 - protein, 37 aa, Homo sapiens; identical to SEQ ID NO: 32513
  ENSP00000426834

SEQ ID NO: 32515 - protein, 68 aa, Homo sapiens
  ENSP00000368993
MVYYPELFVWVSQEPFPNKDMEGRLPKGRLPVPKEVNRKKNDETNAASLTPLGSSELRSPRISYLHFF

SEQ ID NO: 32516 - protein, 68 aa, Homo sapiens; identical to SEQ ID NO: 32515
  ENSP00000257435

SEQ ID NO: 32517 - protein, 68 aa, Homo sapiens; identical to SEQ ID NO: 32515
  ENSP00000402965

SEQ ID NO: 32518 - protein, 112 aa, Homo sapiens
  ENSP00000378996
MKGVWNYSALSRREDETRTQRSRMTDRVPCSKCFQVHCQISVLNCVYYPELFVWVSQEPFPNKDMEGRLPKGRLPVPKEVNRKKNDETNAASLTPLGSSELRSPRISYLHFF

SEQ ID NO: 32519 - protein, 35 aa, Homo sapiens
  ENSP00000422278
MVYYPELFVWVSQEPFPNKDMEGRLPKLRKKNRIH

SEQ ID NO: 32520 - protein, 35 aa, Homo sapiens; identical to SEQ ID NO: 32519
  ENSP00000423320

SEQ ID NO: 32521 - protein, 68 aa, Homo sapiens; identical to SEQ ID NO: 32515
  ENSP00000416617

SEQ ID NO: 32522 - protein, 68 aa, Homo sapiens; identical to SEQ ID NO: 32515
  ENSP00000399766

SEQ ID NO: 32523 - protein, 68 aa, Homo sapiens; identical to SEQ ID NO: 32515
  ENSP00000422630

SEQ ID NO: 32524 - protein, 68 aa, Homo sapiens; identical to SEQ ID NO: 32515
  ENSP00000403383

SEQ ID NO: 32525 - protein, 68 aa, Homo sapiens; identical to SEQ ID NO: 32515
  ENSP00000392559

SEQ ID NO: 32526 - protein, 68 aa, Homo sapiens; identical to SEQ ID NO: 32515
  ENSP00000427149

SEQ ID NO: 32527 - protein, 65 aa, Homo sapiens
  ENSP00000427476
MVYYPELFVWVSQEPFPNKDMEGRLPKGRLPVPKEVNRKKNDETNAASLTPLGSSELRSPRISYL

SEQ ID NO: 32528 - protein, 33 aa, Homo sapiens
  ENSP00000422046
MVYYPELFVWVSQEPFPNKDMEGRLPKGRLPVP

SEQ ID NO: 32529 - protein, 5 aa, Homo sapiens
  ENSP00000422514
MVYYP

SEQ ID NO: 32530 - protein, 68 aa, Homo sapiens; identical to SEQ ID NO: 32515
  ENSP00000408839

SEQ ID NO: 32531 - protein, 481 aa, Homo sapiens
  ENSP00000430053
MGKGRAGRVGTTALPPRLKEMKSQESAAGSKLVLRCETSSEYSSLRFKWFKNGNELNRKNKPQNIKIQKKPGKSELRINKASLADSGEYMCKVISKLGNDSASANITIVESNEIITGMPASTEGAYVSSATSTSTTGTSHLVKCAEKEKTFCVNGGECFMVKDLSNPSRYLCKCPNEFTGDRCQNYVMASFYKHLGIEFMEAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSERYVSAMTTPARMSPVDFHTPSSPKSPPSEMSPPVSSMTVSMPSMAVSPFMEEERPLLLVTPPRLREKKFDHHPQQFSSFHHNPAHDSNSLPA

SEQ ID NO: 32532 - protein, 590 aa, Homo sapiens
  ENSP00000429582
MGKGRAGRVGTTALPPRLKEMKSQESAAGSKLVLRCETSSEYSSLRFKWFKNGNELNRKNKPQNIKIQKKPGKSELRINKASLADSGEYMCKVISKLGNDSASANITIVESNATSTSTTGTSHLVKCAEKEKTFCVNGGECFMVKDLSNPSRYLCKCPNEFTGDRCQNYVMASFYKHLGIEFMEAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSERYVSAMTTPARMSPVDFHTPSSPKSPPSEMSPPVSSMTVSMPSMAVSPFMEEERPLLLVTPPRLREKKFDHHPQQFSSFHHNPAHDSNSLPASPLRIVEDEEYETTQEYEPAQEPVKKLANSRRAKRTKPNGHIANRLEVDSNTSSQSSNSESETEDERVGEDTPFLGIQNPLAASLEATPAFRLADSRTNPAGRFSTQEEIQARLSSVIANQDPIAV

SEQ ID NO: 32533 - protein, 422 aa, Homo sapiens
  ENSP00000434640
MRWRRAPRRSGRPGPRAQRPGSAARSSPPLPLLPLLLLLGTAALAPGAAAGNEAAPAGASVCYSSPPSVGSVQELAQRAAVVIEGKVHPQRRQQGALDRKAAAAAGEAGAWGGDREPPAAGPRALGPPAEEPLLAANGTVPSWPTAPVPSAGEPGEEAPYLVKVHQVWAVKAGGLKKDSLLTVRLGTWGHPAFPSCGRLKEDSRYIFFMEPDANSTSRAPAAFRASFPPLETGRNLKKEVSRVLCKRCALPPRLKEMKSQESAAGSKLVLRCETSSEYSSLRFKWFKNGNELNRKNKPQNIKIQKKPGKSELRINKASLADSGEYMCKVISKLGNDSASANITIVESNATSTSTTGTSHLVKCAEKEKTFCVNGGECFMVKDLSNPSRYLCKCPNEFTGDRCQNYVMASFYSTSTPFLSLPE

SEQ ID NO: 32534 - protein, 713 aa, Homo sapiens
  ENSP00000429067
VPSAGEPGEEAPYLVKVHQVWAVKAGGLKKDSLLTVRLGTWGHPAFPSCGRLKEDSRYIFFMEPDANSTSRAPAAFRASFPPLETGRNLKKEVSRVLCKRCALPPRLKEMKSQESAAGSKLVLRCETSSEYSSLRFKWFKNGNELNRKNKPQNIKIQKKPGKSELRINKASLADSGEYMCKVISKLGNDSASANITIVESNEIITGMPASTEGAYVSSESPIRISVSTEGANTSSSTSTSTTGTSHLVKCAEKEKTFCVNGGECFMVKDLSNPSRYLCKCPNEFTGDRCQNYVMASFYKHLGIEFMEAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSERYVSAMTTPARMSPVDFHTPSSPKSPPSEMSPPVSSMTVSMPSMAVSPFMEEERPLLLVTPPRLREKKFDHHPQQFSSFHHNPAHDSNSLPASPLRIVEDEEYETTQEYEPAQEPVKKLANSRRAKRTKPNGHIANRLEVDSNTSSQSSNSESETEDERVGEDTPFLGIQNPLAASLEATPAFRLADSRTNPAGRFSTQEEIQARLSSVIANQDPIAV

SEQ ID NO: 32535 - protein, 193 aa, Homo sapiens
  ENSP00000486375
MKKRNEMIFLATLKNKALPPRLKEMKSQESAAGSKLVLRCETSSEYSSLRFKWFKNGNELNRKNKPQNIKIQKKPGKSELRINKASLADSGEYMCKVISKLGNDSASANITIVESNEIITGMPASTEGAYVSSESPIRISVSTEGANTSSSTSTSTTGTSHLVKCAEKEKTFCVNGGECFMVKDLSNPSRYLC

SEQ ID NO: 32536 - protein, 420 aa, Homo sapiens
  ENSP00000430120
MSERKEGRGKGKGKKKERGSGKKPESAAGSQSPALPPRLKEMKSQESAAGSKLVLRCETSSEYSSLRFKWFKNGNELNRKNKPQNIKIQKKPGKSELRINKASLADSGEYMCKVISKLGNDSASANITIVESNEIITGMPASTEGAYVSSESPIRISVSTEGANTSSSTSTSTTGTSHLVKCAEKEKTFCVNGGECFMVKDLSNPSRYLCKCPNEFTGDRCQNYVMASFYKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSER

SEQ ID NO: 32537 - protein, 637 aa, Homo sapiens
  ENSP00000349275
MSERKEGRGKGKGKKKERGSGKKPESAAGSQSPALPPRLKEMKSQESAAGSKLVLRCETSSEYSSLRFKWFKNGNELNRKNKPQNIKIQKKPGKSELRINKASLADSGEYMCKVISKLGNDSASANITIVESNEIITGMPASTEGAYVSSESPIRISVSTEGANTSSSTSTSTTGTSHLVKCAEKEKTFCVNGGECFMVKDLSNPSRYLCKCPNEFTGDRCQNYVMASFYKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSERYVSAMTTPARMSPVDFHTPSSPKSPPSEMSPPVSSMTVSMPSMAVSPFMEEERPLLLVTPPRLREKKFDHHPQQFSSFHHNPAHDSNSLPASPLRIVEDEEYETTQEYEPAQEPVKKLANSRRAKRTKPNGHIANRLEVDSNTSSQSSNSESETEDERVGEDTPFLGIQNPLAASLEATPAFRLADSRTNPAGRFSTQEEIQARLSSVIANQDPIAV

SEQ ID NO: 32538 - protein, 462 aa, Homo sapiens
  ENSP00000428828
MSERKEGRGKGKGKKKERGSGKKPESAAGSQSPALPPRLKEMKSQESAAGSKLVLRCETSSEYSSLRFKWFKNGNELNRKNKPQNIKIQKKPGKSELRINKASLADSGEYMCKVISKLGNDSASANITIVESNEIITGMPASTEGAYVSSESPIRISVSTEGANTSSSTSTSTTGTSHLVKCAEKEKTFCVNGGECFMVKDLSNPSRYLCKCQPGFTGARCTENVPMKVQNQEKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSERHNLIAELRRNKAHRSKCMQIQLSATHLRSSSIPHLGFIL

SEQ ID NO: 32539 - protein, 645 aa, Homo sapiens
  ENSP00000287842
MSERKEGRGKGKGKKKERGSGKKPESAAGSQSPALPPRLKEMKSQESAAGSKLVLRCETSSEYSSLRFKWFKNGNELNRKNKPQNIKIQKKPGKSELRINKASLADSGEYMCKVISKLGNDSASANITIVESNEIITGMPASTEGAYVSSESPIRISVSTEGANTSSSTSTSTTGTSHLVKCAEKEKTFCVNGGECFMVKDLSNPSRYLCKCPNEFTGDRCQNYVMASFYKHLGIEFMEAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSERYVSAMTTPARMSPVDFHTPSSPKSPPSEMSPPVSSMTVSMPSMAVSPFMEEERPLLLVTPPRLREKKFDHHPQQFSSFHHNPAHDSNSLPASPLRIVEDEEYETTQEYEPAQEPVKKLANSRRAKRTKPNGHIANRLEVDSNTSSQSSNSESETEDERVGEDTPFLGIQNPLAASLEATPAFRLADSRTNPAGRFSTQEEIQARLSSVIANQDPIAV

SEQ ID NO: 32540 - protein, 640 aa, Homo sapiens
  ENSP00000384620
MSERKEGRGKGKGKKKERGSGKKPESAAGSQSPALPPRLKEMKSQESAAGSKLVLRCETSSEYSSLRFKWFKNGNELNRKNKPQNIKIQKKPGKSELRINKASLADSGEYMCKVISKLGNDSASANITIVESNEIITGMPASTEGAYVSSESPIRISVSTEGANTSSSTSTSTTGTSHLVKCAEKEKTFCVNGGECFMVKDLSNPSRYLCKCQPGFTGARCTENVPMKVQNQEKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSERYVSAMTTPARMSPVDFHTPSSPKSPPSEMSPPVSSMTVSMPSMAVSPFMEEERPLLLVTPPRLREKKFDHHPQQFSSFHHNPAHDSNSLPASPLRIVEDEEYETTQEYEPAQEPVKKLANSRRAKRTKPNGHIANRLEVDSNTSSQSSNSESETEDERVGEDTPFLGIQNPLAASLEATPAFRLADSRTNPAGRFSTQEEIQARLSSVIANQDPIAV

SEQ ID NO: 32541 - protein, 126 aa, Homo sapiens
  ENSP00000432052
  MOD_RES (1)..(1): Any amino acid
XASANITIVESNEIITGMPASTEGAYVSSESPIRISVSTEGANTSSSTSTSTTGTSHLVKCAEKEKTFCVNGGECFMVKDLSNPSRYLCKCQPGFTGARCTENVPMKVQNQESAQMSLLVIAAKTT

SEQ ID NO: 32542 - protein, 296 aa, Homo sapiens
  ENSP00000433289
MEIYSPDMSEVAAERSSSPSTQLSADPSLDGLPAAEDMPEPQTEDGRTPGLVGLAVPCCACLEAERLRGCLNSEKICIVPILACLVSLCLCIAGLKWVFVDKIFEYDSPTHLDPGGLGQDPIISLDATAASAVWVSSEAYTSPVSRAQSESEVQVTVQGDKAVVSFEPSAAPTPKNRIFAFSFLPSTAPSFPSPTRNPEVRTPKSATQPQTTETNLQTAPKLSTSTSTTGTSHLVKCAEKEKTFCVNGGECFMVKDLSNPSRYLCKCPNEFTGDRCQNYVMASFYSTSTPFLSLPE

SEQ ID NO: 32543 - protein, 196 aa, Homo sapiens
  ENSP00000433350
PQTEDGRTPGLVGLAVPCCACLEAERLRGCLNSEKICIVPILACLVSLCLCIAGLKWVFVDKIFEYDSPTHLDPGGLGQDPIISLDATAASAVWVSSEAYTSPVSRAQSESEVQVTVQGDKAVVSFEPSAAPTPKNRIFAFSFLPSTAPSFPSPTRNPEVRTPKSATQPQTTETNLQTAPKLCAQMSLLVIAAKTT

SEQ ID NO: 32544 - protein, 101 aa, Homo sapiens
  ENSP00000428546
MQIPKHISIEDITATSTSTTGTSHLVKCAEKEKTFCVNGGECFMVKDLSNPSRYLCKCPNEFTGDRCQNYVMASFYKHLGIEFMEAEELYQKRVLTITGIC

SEQ ID NO: 32545 - protein, 128 aa, Homo sapiens
  ENSP00000430862
MQIPKHISIEDITATSTSTTGTSHLVKCAEKEKTFCVNGGECFMVKDLSNPSRYLCKCQPGFTGARCTENVPMKVQNQEKAEELYQKRVLTITGICIALLVVGIMCVVAYCKTKKQRKKLHDRLRQSL

SEQ ID NO: 32546 - protein, 135 aa, Homo sapiens
  ENSP00000428411
MQIPKHISIEDITATSTSTTGTSHLVKCAEKEKTFCVNGGECFMVKDLSNPSRYLCKCPNEFTGDRCQNYVMASFYKAEELYQKRVLTITGICIALLVVGIMCVVAYCKTKKQRKKLHDRLRQSLRSERNNMMNI

SEQ ID NO: 32547 - protein, 308 aa, Homo sapiens
  ENSP00000439276
MQIPKHISIEDITATSTSTTGTSHLVKCAEKEKTFCVNGGECFMVKDLSNPSRYLCKCQPGFTGARCTENVPMKVQNQEKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSERHNLIAELRRNKAHRSKCMQIQLSATHLRSSSIPHLGFIL

SEQ ID NO: 32548 - protein, 254 aa, Homo sapiens [sequence omitted]

SEQ ID NO: 32549 - protein, 858 aa, Homo sapiens
  ENSP00000289422
MRQVCCSALPPPPLEKGRCSSYSDSSSSSSERSSSSSSSSSESGSSSRSSSNNSSISRPAAPPEPRPQQQPQPRSPAARRAAARSRAAAAGGMRRDPAPGFSMLLFGVSLACYSPSLKSVQDQAYKAPVVVEGKVQGLVPAGGSSSNSTREPPASGRVALVKVLDKWPLRSGGLQREQVISVGSCVPLERNQRYIFFLEPTEQPLVFKTAFAPLDTNGKNLKKEVGKILCTDCATRPKLKKMKSQTGQVGEKQSLKCEAAAGNPQPSYRWFKDGKELNRSRDIRIKYGNGRKNSRLQFNKVKVEDAGEYVCEAENILGKDTVRGRLYVNSVSTTLSSWSGHARKCNETAKSYCVNGGVCYYIEGINQLSCKCPNGFFGQRCLEKLPLRLYMPDPKQKHLGFELKEAEELYQKRVLTITGICVALLVVGIVCVVAYCKTKKQRKQMHNHLRQNMCPAHQNRSLANGPSHPRLDPEEIQMADYISKNVPATDHVIRRETETTFSGSHSCSPSHHCSTATPTSSHRHESHTWSLERSESLTSDSQSGIMLSSVGTSKCNSPACVEARARRAAAYNLEERRRATAPPYHDSVDSLRDSPHSERYVSALTTPARLSPVDFHYSLATQVPTFEITSPNSAHAVSLPPAAPISYRLAEQQPLLRHPAPPGPGPGPGPGPGPGADMQRSYDSYYYPAAGPGPRRGTCALGGSLGSLPASPFRIPEDDEYETTQECAPPPPPRPRARGASRRTSAGPRRWRRSRLNGLAAQRARAARDSLSLSSGSGGGSASASDDDADDADGALAAESTPFLGLRGAHDALRSDSPPLCPAADSRTYYSLDSHSTRASSRHSRGPPPRAKQDSAPL

SEQ ID NO: 32550 - protein, 850 aa, Homo sapiens
  ENSP00000354910
MRQVCCSALPPPPLEKGRCSSYSDSSSSSSERSSSSSSSSSESGSSSRSSSNNSSISRPAAPPEPRPQQQPQPRSPAARRAAARSRAAAAGGMRRDPAPGFSMLLFGVSLACYSPSLKSVQDQAYKAPVVVEGKVQGLVPAGGSSSNSTREPPASGRVALVKVLDKWPLRSGGLQREQVISVGSCVPLERNQRYIFFLEPTEQPLVFKTAFAPLDTNGKNLKKEVGKILCTDCATRPKLKKMKSQTGQVGEKQSLKCEAAAGNPQPSYRWFKDGKELNRSRDIRIKYGNGRKNSRLQFNKVKVEDAGEYVCEAENILGKDTVRGRLYVNSVSTTLSSWSGHARKCNETAKSYCVNGGVCYYIEGINQLSCKCPNGFFGQRCLEKLPLRLYMPDPKQKAEELYQKRVLTITGICVALLVVGIVCVVAYCKTKKQRKQMHNHLRQNMCPAHQNRSLANGPSHPRLDPEEIQMADYISKNVPATDHVIRRETETTFSGSHSCSPSHHCSTATPTSSHRHESHTWSLERSESLTSDSQSGIMLSSVGTSKCNSPACVEARARRAAAYNLEERRRATAPPYHDSVDSLRDSPHSERYVSALTTPARLSPVDFHYSLATQVPTFEITSPNSAHAVSLPPAAPISYRLAEQQPLLRHPAPPGPGPGPGPGPGPGADMQRSYDSYYYPAAGPGPRRGTCALGGSLGSLPASPFRIPEDDEYETTQECAPPPPPRPRARGASRRTSAGPRRWRRSRLNGLAAQRARAARDSLSLSSGSGGGSASASDDDADDADGALAAESTPFLGLRGAHDALRSDSPPLCPAADSRTYYSLDSHSTRASSRHSRGPPPRAKQDSAPL

SEQ ID NO: 32551 - protein, 647 aa, Homo sapiens
  ENSP00000342660
MSESRRRGRGRGKKHPEGRKREREPDPGEKATRPKLKKMKSQTGQVGEKQSLKCEAAAGNPQPSYRWFKDGKELNRSRDIRIKYGNGRKNSRLQFNKVKVEDAGEYVCEAENILGKDTVRGRLYVNSVSTTLSSWSGHARKCNETAKSYCVNGGVCYYIEGINQLSCKCPNGFFGQRCLEKLPLRLYMPDPKQKAEELYQKRVLTITGICVALLVVGIVCVVAYCKTKKQRKQMHNHLRQNMCPAHQNRSLANGPSHPRLDPEEIQMADYISKNVPATDHVIRRETETTFSGSHSCSPSHHCSTATPTSSHRHESHTWSLERSESLTSDSQSGIMLSSVGTSKCNSPACVEARARRAAAYNLEERRRATAPPYHDSVDSLRDSPHSERYVSALTTPARLSPVDFHYSLATQVPTFEITSPNSAHAVSLPPAAPISYRLAEQQPLLRHPAPPGPGPGPGPGPGPGADMQRSYDSYYYPAAGPGPRRGTCALGGSLGSLPASPFRIPEDDEYETTQECAPPPPPRPRARGASRRTSAGPRRWRRSRLNGLAAQRARAARDSLSLSSGSGGGSASASDDDADDADGALAAESTPFLGLRGAHDALRSDSPPLCPAADSRTYYSLDSHSTRASSRHSRGPPPRAKQDSAPL

SEQ ID NO: 32552 - protein, 844 aa, Homo sapiens
  ENSP00000289409
MRQVCCSALPPPPLEKGRCSSYSDSSSSSSERSSSSSSSSSESGSSSRSSSNNSSISRPAAPPEPRPQQQPQPRSPAARRAAARSRAAAAGGMRRDPAPGFSMLLFGVSLACYSPSLKSVQDQAYKAPVVVEGKVQGLVPAGGSSSNSTREPPASGRVALVKVLDKWPLRSGGLQREQVISVGSCVPLERNQRYIFFLEPTEQPLVFKTAFAPLDTNGKNLKKEVGKILCTDCATRPKLKKMKSQTGQVGEKQSLKCEAAAGNPQPSYRWFKDGKELNRSRDIRIKYGNGRKNSRLQFNKVKVEDAGEYVCEAENILGKDTVRGRLYVNSVSTTLSSWSGHARKCNETAKSYCVNGGVCYYIEGINQLSCKCPVGYTGDRCQQFAMVNFSKAEELYQKRVLTITGICVALLVVGIVCVVAYCKTKKQRKQMHNHLRQNMCPAHQNRSLANGPSHPRLDPEEIQMADYISKNVPATDHVIRRETETTFSGSHSCSPSHHCSTATPTSSHRHESHTWSLERSESLTSDSQSGIMLSSVGTSKCNSPACVEARARRAAAYNLEERRRATAPPYHDSVDSLRDSPHSERYVSALTTPARLSPVDFHYSLATQVPTFEITSPNSAHAVSLPPAAPISYRLAEQQPLLRHPAPPGPGPGPGPGPGPGADMQRSYDSYYYPAAGPGPRRGTCALGGSLGSLPASPFRIPEDDEYETTQECAPPPPPRPRARGASRRTSAGPRRWRRSRLNGLAAQRARAARDSLSLSSGSGGGSASASDDDADDADGALAAESTPFLGLRGAHDALRSDSPPLCPAADSRTYYSLDSHSTRASSRHSRGPPPRAKQDSAPL

SEQ ID NO: 32553 - protein, 852 aa, Homo sapiens
  ENSP00000351323
MRQVCCSALPPPPLEKGRCSSYSDSSSSSSERSSSSSSSSSESGSSSRSSSNNSSISRPAAPPEPRPQQQPQPRSPAARRAAARSRAAAAGGMRRDPAPGFSMLLFGVSLACYSPSLKSVQDQAYKAPVVVEGKVQGLVPAGGSSSNSTREPPASGRVALVKVLDKWPLRSGGLQREQVISVGSCVPLERNQRYIFFLEPTEQPLVFKTAFAPLDTNGKNLKKEVGKILCTDCATRPKLKKMKSQTGQVGEKQSLKCEAAAGNPQPSYRWFKDGKELNRSRDIRIKYGNGRKNSRLQFNKVKVEDAGEYVCEAENILGKDTVRGRLYVNSVSTTLSSWSGHARKCNETAKSYCVNGGVCYYIEGINQLSCKCPVGYTGDRCQQFAMVNFSKHLGFELKEAEELYQKRVLTITGICVALLVVGIVCVVAYCKTKKQRKQMHNHLRQNMCPAHQNRSLANGPSHPRLDPEEIQMADYISKNVPATDHVIRRETETTFSGSHSCSPSHHCSTATPTSSHRHESHTWSLERSESLTSDSQSGIMLSSVGTSKCNSPACVEARARRAAAYNLEERRRATAPPYHDSVDSLRDSPHSERYVSALTTPARLSPVDFHYSLATQVPTFEITSPNSAHAVSLPPAAPISYRLAEQQPLLRHPAPPGPGPGPGPGPGPGADMQRSYDSYYYPAAGPGPRRGTCALGGSLGSLPASPFRIPEDDEYETTQECAPPPPPRPRARGASRRTSAGPRRWRRSRLNGLAAQRARAARDSLSLSSGSGGGSASASDDDADDADGALAAESTPFLGLRGAHDALRSDSPPLCPAADSRTYYSLDSHSTRASSRHSRGPPPRAKQDSAPL

SEQ ID NO: 32554 - protein, 426 aa, Homo sapiens
  ENSP00000367483
MRQVCCSALPPPPLEKGRCSSYSDSSSSSSERSSSSSSSSSESGSSSRSSSNNSSISRPAAPPEPRPQQQPQPRSPAARRAAARSRAAAAGGMRRDPAPGFSMLLFGVSLACYSPSLKSVQDQAYKAPVVVEGKVQGLVPAGGSSSNSTREPPASGRVALVKVLDKWPLRSGGLQREQVISVGSCVPLERNQRYIFFLEPTEQPLVFKTAFAPLDTNGKNLKKEVGKILCTDCATRPKLKKMKSQTGQVGEKQSLKCEAAAGNPQPSYRWFKDGKELNRSRDIRIKYGNGRKNSRLQFNKVKVEDAGEYVCEAENILGKDTVRGRLYVNSVSTTLSSWSGHARKCNETAKSYCVNGGVCYYIEGINQLSCKCPNGFFGQRCLEKLPLRLYMPDPKQSVLWDTPGTGVSSSQWSTSPKPRSCTRRGS

SEQ ID NO: 32555 - protein, 784 aa, Homo sapiens
  ENSP00000444235
MRQVCCSALPPPPLEKGRCSSYSDSSSSSSERSSSSSSSSSESGSSSRSSSNNSSISRPAAPPEPRPQQQPQPRSPAARRAAARSRAAAAGGMRRDPAPGFSMLLFGVSLACYSPSLKSVQDQAYKAPVVVEGKVQGLVPAGGSSSNSTREPPASGRVALVKVLDKWPLRSGGLQREQVISVGSCVPLERNQRYIFFLEPTEQPLVFKTAFAPLDTNGKNLKKEVGKILCTDCATRPKLKKMKSQTGQVGEKQSLKCEAAAGNPQPSYRWFKDGKELNRSRDIRIKYGNGRKNSRLQFNKVKVEDAGEYVCEAENILGKDTVRGRLYVNSEAEELYQKRVLTITGICVALLVVGIVCVVAYCKTKKQRKQMHNHLRQNMCPAHQNRSLANGPSHPRLDPEEIQMADYISKNVPATDHVIRRETETTFSGSHSCSPSHHCSTATPTSSHRHESHTWSLERSESLTSDSQSGIMLSSVGTSKCNSPACVEARARRAAAYNLEERRRATAPPYHDSVDSLRDSPHSERYVSALTTPARLSPVDFHYSLATQVPTFEITSPNSAHAVSLPPAAPISYRLAEQQPLLRHPAPPGPGPGPGPGPGPGADMQRSYDSYYYPAAGPGPRRGTCALGGSLGSLPASPFRIPEDDEYETTQECAPPPPPRPRARGASRRTSAGPRRWRRSRLNGLAAQRARAARDSLSLSSGSGGGSASASDDDADDADGALAAESTPFLGLRGAHDALRSDSPPLCPAADSRTYYSLDSHSTRASSRHSRGPPPRAKQDSAPL

SEQ ID NO: 32556 - protein, 696 aa, Homo sapiens
  ENSP00000361214
MSEGAAAASPPGAASAAAASAEEGTAAAAAAAAAGGGPDGGGEGAAEPPRELRCSDCIVWNRQQTWLCVVPLFIGFIGLGLSLMLLKWIVVGSVKEYVPTDLVDSKGMGQDPFFLSKPSSFPKAMETTTTTTSTTSPATPSAGGAASSRTPNRISTRLTTITRAPTRFPGHRVPIRASPRSTTARNTAAPATVPSTTAPFFSSSTLGSRPPVPGTPSTQAMPSWPTAAYATSSYLHDSTPSWTLSPFQDAASSSSSSSSSATTTTPETSTSPKFHTTTYSTERSEHFKPCRDKDLAYCLNDGECFVIETLTGSHKHCRCKEGYQGVRCDQFLPKTDSILSDPTDHLGIEFMESEEVYQRQVLSISCIIFGIVIVGMFCAAFYFKSKKQAKQIQEQLKVPQNGKSYSLKASSTMAKSENLVKSHVQLQNYSKVERHPVTALEKMMESSFVGPQSFPEVPSPDRGSQSVKHHRSLSSCCSPGQRSGMLHRNAFRRTPPSPRSRLGGIVGPAYQQLEESRIPDQDTIPCQGYSSSGLKTQRNTSINMQLPSRETNPYFNSLEQKDLVGYSSTRASSVPIIPSVGLEETCLQMPGISEVKSIKWCKNSYSADVVNVSIPVSDCLIAEQQEVKILLETVQEQIRILTDARRSEDYELASVETEDSASENTAFLPLSPTAKSEREAQFVLRNEIQRDSALTK

SEQ ID NO: 32557 - protein, 720 aa, Homo sapiens
  ENSP00000384796
MSEGAAAASPPGAASAAAASAEEGTAAAAAAAAAGGGPDGGGEGAAEPPRELRCSDCIVWNRQQTWLCVVPLFIGFIGLGLSLMLLKWIVVGSVKEYVPTDLVDSKGMGQDPFFLSKPSSFPKAMETTTTTTSTTSPATPSAGGAASSRTPNRISTRLTTITRAPTRFPGHRVPIRASPRSTTARNTAAPATVPSTTAPFFSSSTLGSRPPVPGTPSTQAMPSWPTAAYATSSYLHDSTPSWTLSPFQDAASSSSSSSSSATTTTPETSTSPKFHTTTYSTERSEHFKPCRDKDLAYCLNDGECFVIETLTGSHKHCRCKEGYQGVRCDQFLPKTDSILSDPTDHLGIEFMESEEVYQRQVLSISCIIFGIVIVGMFCAAFYFKSKKQAKQIQEQLKVPQNGKSYSLKASSTMAKSENLVKSHVQLQNYSKVERHPVTALEKMMESSFVGPQSFPEVPSPDRGSQSVKHHRSLSSCCSPGQRSGMLHRNAFRRTPPSPRSRLGGIVGPAYQQLEESRIPDQDTIPCQGIEVRKTISHLPIQLWCVERPLDLKYSSSGLKTQRNTSINMQLPSRETNPYFNSLEQKDLVGYSSTRASSVPIIPSVGLEETCLQMPGISEVKSIKWCKNSYSADVVNVSIPVSDCLIAEQQEVKILLETVQEQIRILTDARRSEDYELASVETEDSASENTAFLPLSPTAKSEREAQFVLRNEIQRDSALTK

SEQ ID NO: 32558 - protein, 499 aa, Homo sapiens
  ENSP00000361215
MECGIPPTLVCVGRGGGLHTINIIIWYYFPSAWRTCFNISSSVGLLLTNSYKFYTTTYSTERSEHFKPCRDKDLAYCLNDGECFVIETLTGSHKHCRCKEGYQGVRCDQFLPKTDSILSDPTDHLGIEFMESEEVYQRQVLSISCIIFGIVIVGMFCAAFYFKSKKQAKQIQEQLKVPQNGKSYSLKASSTMAKSENLVKSHVQLQNYSKVERHPVTALEKMMESSFVGPQSFPEVPSPDRGSQSVKHHRSLSSCCSPGQRSGMLHRNAFRRTPPSPRSRLGGIVGPAYQQLEESRIPDQDTIPCQGIEVRKTISHLPIQLWCVERPLDLKYSSSGLKTQRNTSINMQLPSRETNPYFNSLEQKDLVGYSSTRASSVPIIPSVGLEETCLQMPGISEVKSIKWCKNSYSADVVNVSIPVSDCLIAEQQEVKILLETVQEQIRILTDARRSEDYELASVETEDSASENTAFLPLSPTAKSEREAQFVLRNEIQRDSALTK

SEQ ID NO: 32559 - protein, 54 aa, Homo sapiens
  ENSP00000473669
MECGIPPTLVCVGRGGGLHTVFQRQKLLYELIATSPFWFHLRSSLQKPLSTFWN

SEQ ID NO: 32560 - protein, 76 aa, Homo sapiens
  ENSP00000451858
MECGIPPTLVCVGRGGGLHTVGVFHVLSQLISLCTIPEVFKEKPKIRRHIPQSDPSTSNPAETRTLHTVSMMASAL

SEQ ID NO: 32561 - protein, 500 aa, Homo sapiens
  ENSP00000385804
MECGIPPTLVCVGRGGGLHTVGVFHVLSQLISLCTIPEVFKEKPKINIIIWYYFPSAWRTCFNISSSVGLLLTNSYKFYTTTYSTERSEHFKPCRDKDLAYCLNDGECFVIETLTGSHKHCRCKEGYQGVRCDQFLPKTDSILSDPTDHLGIEFMESEEVYQRQVLSISCIIFGIVIVGMFCAAFYFKSKKQAKQIQEQLKVPQNGKSYSLKASSTMAKSENLVKSHVQLQNYSKVERHPVTALEKMMESSFVGPQSFPEVPSPDRGSQSVKHHRSLSSCCSPGQRSGMLHRNAFRRTPPSPRSRLGGIVGPAYQQLEESRIPDQDTIPCQGYSSSGLKTQRNTSINMQLPSRETNPYFNSLEQKDLVGYSSTRASSVPIIPSVGLEETCLQMPGISEVKSIKWCKNSYSADVVNVSIPVSDCLIAEQQEVKILLETVQEQIRILTDARRSEDYELASVETEDSASENTAFLPLSPTAKSEREAQFVLRNEIQRDSALTK

SEQ ID NO: 32562 - protein, 526 aa, Homo sapiens
  ENSP00000451376
MECGIPPTLVCVGRGGGLHTVGVFHVLSQLISLCTIPEVFKEKPKINIIIWYYFPSAWRTCFNISSSVGLLLTNSYKFCPRDRRHAIHGNMGKTRVVRRQKQEQDTTTYSTERSEHFKPCRDKDLAYCLNDGECFVIETLTGSHKHCRCKEGYQGVRCDQFLPKTDSILSDPTDHLGIEFMESEEVYQRQVLSISCIIFGIVIVGMFCAAFYFKSKKQAKQIQEQLKVPQNGKSYSLKASSTMAKSENLVKSHVQLQNYSKVERHPVTALEKMMESSFVGPQSFPEVPSPDRGSQSVKHHRSLSSCCSPGQRSGMLHRNAFRRTPPSPRSRLGGIVGPAYQQLEESRIPDQDTIPCQGYSSSGLKTQRNTSINMQLPSRETNPYFNSLEQKDLVGYSSTRASSVPIIPSVGLEETCLQMPGISEVKSIKWCKNSYSADVVNVSIPVSDCLIAEQQEVKILLETVQEQIRILTDARRSEDYELASVETEDSASENTAFLPLSPTAKSEREAQFVLRNEIQRDSALTK

SEQ ID NO: 32563 - protein, 346 aa, Homo sapiens
  ENSP00000440377
MESEEVYQRQVLSISCIIFGIVIVGMFCAAFYFKSKKQAKQIQEQLKVPQNGKSYSLKASSTMAKSENLVKSHVQLQNYSKVERHPVTALEKMMESSFVGPQSFPEVPSPDRGSQSVKHHRSLSSCCSPGQRSGMLHRNAFRRTPPSPRSRLGGIVGPAYQQLEESRIPDQDTIPCQGYSSSGLKTQRNTSINMQLPSRETNPYFNSLEQKDLVGYSSTRASSVPIIPSVGLEETCLQMPGISEVKSIKWCKNSYSADVVNVSIPVSDCLIAEQQEVKILLETVQEQIRILTDARRSEDYELASVETEDSASENTAFLPLSPTAKSEREAQFVLRNEIQRDSALTK

SEQ ID NO: 32564 - protein, 346 aa, Homo sapiens; identical to SEQ ID NO: 32563
  ENSP00000441201

SEQ ID NO: 32565 - protein, 78 aa, Homo sapiens
  ENSP00000284292
MDCCTENACSKPDDDILDIPLDDPGANAAAAKIQASFRGHMARKKIKSGERGRKGPGPGGPGGAGVARGGAGGGPSGD

SEQ ID NO: 32566 - protein, 78 aa, Homo sapiens; identical to SEQ ID NO: 32565
  ENSP00000399591

SEQ ID NO: 32567 - protein, 241 aa, Homo sapiens
  ENSP00000310205
MFYSGLLTEGGRKETDMREAASLRQQRRMKQAVQFIHKDSADLLPLDGLKKLGSSKDMQPHNILQRRLMETNLSKLRSGPRVPWASKTNKLNQAKSEGLKKSEEDDMILVSCQCAGKDVKALVDTGCLYNLISLACVDRLGLKEHVKSHKHEGEKLSLPRHLKVVGQIEHLVITLGSLRLDCPAAVVDDNEKNLSLGLQTLRSLKCIINLDKHRLIMGKTDKEEIPFVETVSLNEDNTSEA

SEQ ID NO: 32568 - protein, 55 aa, Homo sapiens
  ENSP00000435785
  MOD_RES (1)..(1): Any amino acid
XLGLQTLRSLKCIINLDKHRLIMGKTDKEEIPFVETVSLNEDKSREASELSKFIY

SEQ ID NO: 32569 - protein, 65 aa, Homo sapiens
  ENSP00000432002
ITLGSLRLDCPAAVVDDNEKNLSLGLQTLRSLKCIINLDKHRLIMGKTDKEEIPFVETVSLNEDK

SEQ ID NO: 32570 - protein, 141 aa, Homo sapiens
  ENSP00000432451
MFYSGLLTEGGRKETDMREAASLRQQRRMKQAVQFIHKDSADLLPLDGLKKLGSSKDMQPHNILQRRLMETNLSKLRSGPRVPWASKTNKLNQAKSEGLKKSEEDDMILVSCQCAGKDVKALVDTGCLYNLISLACVDRLG

SEQ ID NO: 32571 - protein, 160 aa, Homo sapiens
  ENSP00000433845
MFYSGLLTEGGRKETDMREAASLRQQRRMKQAVQFIHKDSADLLPLDGLKKLGSSKDMRRLMETNLSKLRSGPRVPWASKTNKLNQAKSEGLKKSEEDDMILVSCQCAGKDVKALVDTGCLYNLISLACVDRLGLKEHVKSHKHEGEKLSLPRHLKVVGQ

SEQ ID NO: 32572 - protein, 1582 aa, Homo sapiens
  ENSP00000434830
MAGPGGWRDREVTDLGHLPDPTGIFSLDKTIGLGTYGRIYLGLHEKTGAFTAVKVMNARKTPLPEIGRRVRVNKYQKSVGWRYSDEEEDLRTELNLLRKYSFHKNIVSFYGAFFKLSPPGQRHQLWMVMELCAAGSVTDVVRMTSNQSLKEDWIAYICREILQGLAHLHAHRVIHRDIKGQNVLLTHNAEVKLVDFGVSAQVSRTNGRRNSFIGTPYWMAPEVIDCDEDPRRSYDYRSDVWSVGITAIEMAEGAPPLCNLQPLEALFVILRESAPTVKSSGWSRKFHNFMEKCTIKNFLFRPTSANMLQHPFVRDIKNERHVVESLTRHLTGIIKKRQKKGIPLIFEREEAIKEQYTVRRFRGPSCTHELLRLPTSSRCRPLRVLHGEPSQPRWLPDREEPQVQALQQLQGAARVFMPLQALDSAPKPLKGQAQAPQRLQGAARVFMPLQAQVKAKASKPLQMQIKAPPRLRRAARVLMPLQAQVRAPRLLQVQSQVSKKQQAQTQTSEPQDLDQVPEEFQGQDQVPEQQRQGQAPEQQQRHNQVPEQELEQNQAPEQPEVQEQAAEPAQAETEAEEPESLRVNAQVFLPLLSQDHHVLLPLHLDTQVLIPVEGQTEGSPQAQAWTLEPPQAIGSVQALIEGLSRDLLRAPNSNNSKPLGPLQTLMENLSSNRFYSQPEQAREKKSKVSTLRQALAKRLSPKRFRAKSSWRPEKLELSDLEARRQRRQRRWEDIFNQHEEELRQVDKDKEDESSDNDEVFHSIQAEVQIEPLKPYISNPKKIEVQERSPSVPNNQDHAHHVKFSSSVPQRSLLEQAQKPIDIRQRSSQNRQNWLAASESSSEEESPVTGRRSQSSPPYSTIDQKLLVDIHVPDGFKVGKISPPVYLTNEWVGYNALSEIFRNDWLTPAPVIQPPEEDGDYVELYDASADTDGDDDDESNDTFEDTYDHANGNDDLDNQVDQANDVCKDHDDDNNKFVDDVNNNYYEAPSCPRASYGRDGSCKQDGYDGSRGKEEAYRGYGSHTANRSHGGSAASEDNAAIGDQEEHAANIGSERRGSEGDGGKGVVRTSEESGALGLNGEENCSETDGPGLKRPASQDFEYLQEEPGGGNEASNAIDSGAAPSAPDHESDNKDISESSTQSDFSANHSSPSKGSGMSADANFASAILYAGFVEVPEESPKQPSEVNVNPLYVSPACKKPLIHMYEKEFTSEICCGSLWGVNLLLGTRSNLYLMDRSGKADITKLIRRRPFRQIQVLEPLNLLITISGHKNRLRVYHLTWLRNKILNNDPESKRRQEEMLKTEEACKAIDKLTGCEHFSVLQHEETTYIAIALKSSIHLYAWAPKSFDESTAIKVCIDQSADSEGDYMSYQAYIRILAKIQAADPVNRFKRPDELLHLLKLKVFPTLDHKPVTVDLAIGSEKRLKIFFSSADGYHLIDAESEVMSDVTLPKNPLEIIIPQNIIILPDCLGIGMMLTFNAEALSVEANEQLFKKILEMWKDIPSSIAFECTQRTTGWGQKAIEVRSLQSRVLESELKRRSIKKLRFLCTRGDKLFFTSTLRNHHSRVYFMTLGKLEELQSNYDV

SEQ ID NO: 32573 - protein, 188 aa, Homo sapiens
  ENSP00000438785
MAGPGGWRDREVTDLGHLPDPTGIFSLDKTIGLGTYGRIYLGLHEKTGAFTAVKVMNARKTPLPEIGRRVRVNKYQKSVGWRYSDEEEDLRTELNLLRKYSFHKNIVSFYGAFFKLSPPGQRHQLWMVMELCAAGSVTDVVRMTSNQSLKEDWIAYICREILQPKVIFLGTGCSDSSLKKELCLKHQN

SEQ ID NO: 32574 - protein, 355 aa, Homo sapiens
  ENSP00000438378
MAGPGGWRDREVTDLGHLPDPTGIFSLDKTIGLGTYGRIYLGLHEKTGAFTAVKVMNARKTPLPEIGRRVRVNKYQKSVGWRYSDEEEDLRTELNLLRKYSFHKNIVSFYGAFFKLSPPGQRHQLWMVMELCAAGSVTDVVRMTSNQSLKEDWIAYICREILQGLAHLHAHRVIHRDIKGQNVLLTHNAEVKLVDFGVSAQVSRTNGRRNSFIGTPYWMAPEVIDCDEDPRRSYDYRSDVWSVGITAIEMAEGAPPLCNLQPLEALFVILRESAPTVKSSGWSRKFHNFMEKCTIKNFLFRPTSANMLQHPFVRDIKNERHVVESLTRHLTGIIKKRQKKGFAVSQDHATALQPG

SEQ ID NO: 32575 - protein, 163 aa, Homo sapiens
  ENSP00000438148
MQVPRERIKIAFRLWIPILVIRIVVAGTWPQAPGLSTLGLNIIILPDCLGIGMMLTFNAEALSVEANEQLFKKILEMWKDIPSSIAFECTQRTTGWGQKAIEVRSLQSRVLESELKRRSIKKLRFLCTRGDKLFFTSTLRNHHSRVYFMTLGKLEELQSNYDV

SEQ ID NO: 32576 - protein, 1496 aa, Homo sapiens
  ENSP00000485887
MGTALLQRGGCFLLCLSLLLLGCWAELGSGLEFPGAEGQWTRFPKWNACCESEMSFQLKTRSARGLVLYFDDEGFCDFLELILTRGGRLQLSFSIFCAEPATLLADTPVNDGAWHSVRIRRQFRNTTLFIDQVEAKWVEVKSKRRDMTVFSGLFVGGLPPELRAAALKLTLASVREREPFKGWIRDVRVNSSQVLPVDSGEVKLDDEPPNSGGGSPCEAGEEGEGGVCLNGGVCSVVDDQAVCDCSRTGFRGKDCSQEDNNVEGLAHLMMGDQGKSKGKEEYIATFKGSEYFCYDLSQNPIQSSSDEITLSFKTLQRNGLMLHTGKSADYVNLALKNGAVSLVINLGSGAFEALVEPVNGKFNDNAWHDVKVTRNLRQVTISVDGILTTTGYTQEDYTMLGSDDFFYVGGSPSTADLPGSPVSNNFMGCLKEVVYKNNDVRLELSRLAKQGDPKMKIHGVVAFKCENVATLDPITFETPESFISLPKWNAKKTGSISFDFRTTEPNGLILFSHGKPRHQKDAKHPQMIKVDFFAIEMLDGHLYLLLDMGSGTIKIKALLKKVNDGEWYHVDFQRDGRSGTISVNTLRTPYTAPGESEILDLDDELYLGGLPENKAGLVFPTEVWTALLNYGYVGCIRDLFIDGQSKDIRQMAEVQSTAGVKPSCSKETAKPCLSNPCKNNGMCRDGWNRYVCDCSGTGYLGRSCEREATVLSYDGSMFMKIQLPVVMHTEAEDVSLRFRSQRAYGILMATTSRDSADTLRLELDAGRVKLTVNLDCIRINCNSSKGPETLFAGYNLNDNEWHTVRVVRRGKSLKLTVDDQQAMTGQMAGDHTRLEFHNIETGIITERRYLSSVPSNFIGHLQSLTFNGMAYIDLCKNGDIDYCELNARFGFRNIIADPVTFKTKSSYVALATLQAYTSMHLFFQFKTTSLDGLILYNSGDGNDFIVVELVKGYLHYVFDLGNGANLIKGSSNKPLNDNQWHNVMISRDTSNLHTVKIDTKITTQITAGARNLDLKSDLYIGGVAKETYKSLPKLVHAKEGFQGCLASVDLNGRLPDLISDALFCNGQIERGCEGPSTTCQEDSCSNQGVCLQQWDGFSCDCSMTSFSGPLCNDPGTTYIFSKGGGQITYKWPPNDRPSTRADRLAIGFSTVQKEAVLVRVDSSSGLGDYLELHIHQGKIGVKFNVGTDDIAIEESNAIINDGKYHVVRFTRSGGNATLQVDSWPVIERYPAGNNDNERLAIARQRIPYRLGRVVDEWLLDKGRQLTIFNSQATIIIGGKEQGQPFQGQLSGLYYNGLKVLNMAAENDANIAIVGNVRLVGEVPSSMTTESTATAMQSEMSTSIMETTTTLATSTARRGKPPTKEPISQTTDDILVASAECPSDDEDIDPCEPSSANPTRAGGREPYPGSAEVIRESSSTTGMVVGIVAAAALCILILLYAMYKYRNRDEGSYHVDESRNYISNSAQSNGAVVKEKQPSSAKSSNKNKKNKDKEYYV

SEQ ID NO: 32577 - protein, 1477 aa, Homo sapiens
  ENSP00000384311
MGTALLQRGGCFLLCLSLLLLGCWAELGSGLEFPGAEGQWTRFPKWNACCESEMSFQLKTRSARGLVLYFDDEGFCDFLELILTRGGRLQLSFSIFCAEPATLLADTPVNDGAWHSVRIRRQFRNTTLFIDQVEAKWVEVKSKRRDMTVFSGLFVGGLPPELRAAALKLTLASVREREPFKGWIRDVRVNSSQVLPVDSGEVKLDDEPPNSGGGSPCEAGEEGEGGVCLNGGVCSVVDDQAVCDCSRTGFRGKDCSQEDNNVEGLAHLMMGDQGKSKGKEEYIATFKGSEYFCYDLSQNPIQSSSDEITLSFKTLQRNGLMLHTGKSADYVNLALKNGAVSLVINLGSGAFEALVEPVNGKFNDNAWHDVKVTRNLRQHSGIGHAMVTISVDGILTTTGYTQEDYTMLGSDDFFYVGGSPSTADLPGSPVSNNFMGCLKEVVYKNNDVRLELSRLAKQGDPKMKIHGVVAFKCENVATLDPITFETPESFISLPKWNAKKTGSISFDFRTTEPNGLILFSHGKPRHQKDAKHPQMIKVDFFAIEMLDGHLYLLLDMGSGTIKIKALLKKVNDGEWYHVDFQRDGRSGTISVNTLRTPYTAPGESEILDLDDELYLGGLPENKAGLVFPTEVWTALLNYGYVGCIRDLFIDGQSKDIRQMAEVQSTAGVKPSCSKETAKPCLSNPCKNNGMCRDGWNRYVCDCSGTGYLGRSCEREATVLSYDGSMFMKIQLPVVMHTEAEDVSLRFRSQRAYGILMATTSRDSADTLRLELDAGRVKLTVNLDCIRINCNSSKGPETLFAGYNLNDNEWHTVRVVRRGKSLKLTVDDQQAMTGQMAGDHTRLEFHNIETGIITERRYLSSVPSNFIGHLQSLTFNGMAYIDLCKNGDIDYCELNARFGFRNIIADPVTFKTKSSYVALATLQAYTSMHLFFQFKTTSLDGLILYNSGDGNDFIVVELVKGYLHYVFDLGNGANLIKGSSNKPLNDNQWHNVMISRDTSNLHTVKIDTKITTQITAGARNLDLKSDLYIGGVAKETYKSLPKLVHAKEGFQGCLASVDLNGRLPDLISDALFCNGQIERGCEGPSTTCQEDSCSNQGVCLQQWDGFSCDCSMTSFSGPLCNDPGTTYIFSKGGGQITYKWPPNDRPSTRADRLAIGFSTVQKEAVLVRVDSSSGLGDYLELHIHQGKIGVKFNVGTDDIAIEESNAIINDGKYHVVRFTRSGGNATLQVDSWPVIERYPAGRQLTIFNSQATIIIGGKEQGQPFQGQLSGLYYNGLKVLNMAAENDANIAIVGNVRLVGEVPSSMTTESTATAMQSEMSTSIMETTTTLATSTARRGKPPTKEPISQTTDDILVASAECPSDDEDIDPCEPSSGGLANPTRAGGREPYPGSAEVIRESSSTTGMVVGIVAAAALCILILLYAMYKYRNRDEGSYHVDESRNYISNSAQSNGAVVKEKQPSSAKSSNKNKKNKDKEYYV

SEQ ID NO: 32578 - protein, 143 aa, Homo sapiens
  ENSP00000489745
MDMRWHCENLQVTTDDILVASAECPSDDEDIDPCEPSSGGLANPTRAGGREPYPGSAEVIRESSSTTGMVVGIVAAAALCILILLYAMYKYRNRDEGSYHVDESRNYISNSAQSNGAVVKEKQPSSAKSSNKNKKNKDKEYYV

SEQ ID NO: 32579 - protein, 62 aa, Homo sapiens
  ENSP00000489258
MDMRWHCENLQTTDDILVASAECPSDDEDIDPCEPSSGTKQTMWKTSRDHRILPNARRERKD

SEQ ID NO: 32580 - protein, 139 aa, Homo sapiens
  ENSP00000396738
MDMRWHCENLQTTDDILVASAECPSDDEDIDPCEPSSANPTRAGGREPYPGSAEVIRESSSTTGMVVGIVAAAALCILILLYAMYKYRNRDEGSYHVDESRNYISNSAQSNGAVVKEKQPSSAKSSNKNKKNKDKEYYV

SEQ ID NO: 32581 - protein, 1547 aa, Homo sapiens
  ENSP00000385142
MGTALLQRGGCFLLCLSLLLLGCWAELGSGLEFPGAEGQWTRFPKWNACCESEMSFQLKTRSARGLVLYFDDEGFCDFLELILTRGGRLQLSFSIFCAEPATLLADTPVNDGAWHSVRIRRQFRNTTLFIDQVEAKWVEVKSKRRDMTVFSGLFVGGLPPELRAAALKLTLASVREREPFKGWIRDVRVNSSQVLPVDSGEVKLDDEPPNSGGGSPCEAGEEGEGGVCLNGGVCSVVDDQAVCDCSRTGFRGKDCSQEIKFGLQCVLPVLLHDNDQGKYCCINTAKPLTEKDNNVEGLAHLMMGDQGKSKGKEEYIATFKGSEYFCYDLSQNPIQSSSDEITLSFKTLQRNGLMLHTGKSADYVNLALKNGAVSLVINLGSGAFEALVEPVNGKFNDNAWHDVKVTRNLRQHSGIGHAMVNKLHCSVTISVDGILTTTGYTQEDYTMLGSDDFFYVGGSPSTADLPGSPVSNNFMGCLKEVVYKNNDVRLELSRLAKQGDPKMKIHGVVAFKCENVATLDPITFETPESFISLPKWNAKKTGSISFDFRTTEPNGLILFSHGKPRHQKDAKHPQMIKVDFFAIEMLDGHLYLLLDMGSGTIKIKALLKKVNDGEWYHVDFQRDGRSGTISVNTLRTPYTAPGESEILDLDDELYLGGLPENKAGLVFPTEVWTALLNYGYVGCIRDLFIDGQSKDIRQMAEVQSTAGVKPSCSKETAKPCLSNPCKNNGMCRDGWNRYVCDCSGTGYLGRSCEREATVLSYDGSMFMKIQLPVVMHTEAEDVSLRFRSQRAYGILMATTSRDSADTLRLELDAGRVKLTVNLDCIRINCNSSKGPETLFAGYNLNDNEWHTVRVVRRGKSLKLTVDDQQAMTGQMAGDHTRLEFHNIETGIITERRYLSSVPSNFIGHLQSLTFNGMAYIDLCKNGDIDYCELNARFGFRNIIADPVTFKTKSSYVALATLQAYTSMHLFFQFKTTSLDGLILYNSGDGNDFIVVELVKGYLHYVFDLGNGANLIKGSSNKPLNDNQWHNVMISRDTSNLHTVKIDTKITTQITAGARNLDLKSDLYIGGVAKETYKSLPKLVHAKEGFQGCLASVDLNGRLPDLISDALFCNGQIERGCEGPSTTCQEDSCSNQGVCLQQWDGFSCDCSMTSFSGPLCNDPGTTYIFSKGGGQITYKWPPNDRPSTRADRLAIGFSTVQKEAVLVRVDSSSGLGDYLELHIHQGKIGVKFNVGTDDIAIEESNAIINDGKYHVVRFTRSGGNATLQVDSWPVIERYPAGNNDNERLAIARQRIPYRLGRVVDEWLLDKGRQLTIFNSQATIIIGGKEQGQPFQGQLSGLYYNGLKVLNMAAENDANIAIVGNVRLVGEVPSSMTTESTATAMQSEMSTSIMETTTTLATSTARRGKPPTKEPISQTTDDILVASAECPSDDEDIDPCEPSSGGLANPTRAGGREPYPGSAEVIRESSSTTGMVVGIVAAAALCILILLYAMYKYRNRDEGSYHVDESRNYISNSAQSNGAVVKEKQPSSAKSSNKNKKNKDKEYYV

SEQ ID NO: 32582 - protein, 442 aa, Homo sapiens
  ENSP00000341184
MYQRMLRCGAELGSPGGGGGGGGGGGAGGRLALLWIVPLTLSGLLGVAWGASSLGAHHIHHFHGSSKHHSVPIAIYRSPASLRGGHAGTTYIFSKGGGQITYKWPPNDRPSTRADRLAIGFSTVQKEAVLVRVDSSSGLGDYLELHIHQGKIGVKFNVGTDDIAIEESNAIINDGKYHVVRFTRSGGNATLQVDSWPVIERYPAGRQLTIFNSQATIIIGGKEQGQPFQGQLSGLYYNGLKVLNMAAENDANIAIVGNVRLVGEVPSSMTTESTATAMQSEMSTSIMETTTTLATSTARRGKPPTKEPISQTTDDILVASAECPSDDEDIDPCEPSSGGLANPTRAGGREPYPGSAEVIRESSSTTGMVVGIVAAAALCILILLYAMYKYRNRDEGSYHVDESRNYISNSAQSNGAVVKEKQPSSAKSSNKNKKNKDKEYYV

SEQ ID NO: 32583 - protein, 142 aa, Homo sapiens
  ENSP00000367510
MDMRWHCENLQTTDDILVASAECPSDDEDIDPCEPSSGGLANPTRAGGREPYPGSAEVIRESSSTTGMVVGIVAAAALCILILLYAMYKYRNRDEGSYHVDESRNYISNSAQSNGAVVKEKQPSSAKSSNKNKKNKDKEYYV

SEQ ID NO: 32584 - protein, 472 aa, Homo sapiens
  ENSP00000385580
MYQRMLRCGAELGSPGGGGGGGGGGGAGGRLALLWIVPLTLSGLLGVAWGASSLGAHHIHHFHGSSKHHSVPIAIYRSPASLRGGHAGTTYIFSKGGGQITYKWPPNDRPSTRADRLAIGFSTVQKEAVLVRVDSSSGLGDYLELHIHQGKIGVKFNVGTDDIAIEESNAIINDGKYHVVRFTRSGGNATLQVDSWPVIERYPAGNNDNERLAIARQRIPYRLGRVVDEWLLDKGRQLTIFNSQATIIIGGKEQGQPFQGQLSGLYYNGLKVLNMAAENDANIAIVGNVRLVGEVPSSMTTESTATAMQSEMSTSIMETTTTLATSTARRGKPPTKEPISQTTDDILVASAECPSDDEDIDPCEPSSGGLANPTRAGGREPYPGSAEVIRESSSTTGMVVGIVAAAALCILILLYAMYKYRNRDEGSYHVDESRNYISNSAQSNGAVVKEKQPSSAKSSNKNKKNKDKEYYV

SEQ ID NO: 32585 - protein, 123 aa, Homo sapiens
  ENSP00000490198
TLSGLLGVAWGASSLGAHHIHHFHGSSKHHSVPIAIYRSPASLRGGHAGTTYIFSKGGGQITYKWPPNDRPSTRADRLAIGFSTVQKEAVLVRVDSSSGLGDYLELHIAFESFTASRSSASRC

SEQ ID NO: 32586 - protein, 1507 aa, Homo sapiens
  ENSP00000385017
MGTALLQRGGCFLLCLSLLLLGCWAELGSGLEFPGAEGQWTRFPKWNACCESEMSFQLKTRSARGLVLYFDDEGFCDFLELILTRGGRLQLSFSIFCAEPATLLADTPVNDGAWHSVRIRRQFRNTTLFIDQVEAKWVEVKSKRRDMTVFSGLFVGGLPPELRAAALKLTLASVREREPFKGWIRDVRVNSSQVLPVDSGEVKLDDEPPNSGGGSPCEAGEEGEGGVCLNGGVCSVVDDQAVCDCSRTGFRGKDCSQEDNNVEGLAHLMMGDQGKSKGKEEYIATFKGSEYFCYDLSQNPIQSSSDEITLSFKTLQRNGLMLHTGKSADYVNLALKNGAVSLVINLGSGAFEALVEPVNGKFNDNAWHDVKVTRNLRQHSGIGHAMVTISVDGILTTTGYTQEDYTMLGSDDFFYVGGSPSTADLPGSPVSNNFMGCLKEVVYKNNDVRLELSRLAKQGDPKMKIHGVVAFKCENVATLDPITFETPESFISLPKWNAKKTGSISFDFRTTEPNGLILFSHGKPRHQKDAKHPQMIKVDFFAIEMLDGHLYLLLDMGSGTIKIKALLKKVNDGEWYHVDFQRDGRSGTISVNTLRTPYTAPGESEILDLDDELYLGGLPENKAGLVFPTEVWTALLNYGYVGCIRDLFIDGQSKDIRQMAEVQSTAGVKPSCSKETAKPCLSNPCKNNGMCRDGWNRYVCDCSGTGYLGRSCEREATVLSYDGSMFMKIQLPVVMHTEAEDVSLRFRSQRAYGILMATTSRDSADTLRLELDAGRVKLTVNLDCIRINCNSSKGPETLFAGYNLNDNEWHTVRVVRRGKSLKLTVDDQQAMTGQMAGDHTRLEFHNIETGIITERRYLSSVPSNFIGHLQSLTFNGMAYIDLCKNGDIDYCELNARFGFRNIIADPVTFKTKSSYVALATLQAYTSMHLFFQFKTTSLDGLILYNSGDGNDFIVVELVKGYLHYVFDLGNGANLIKGSSNKPLNDNQWHNVMISRDTSNLHTVKIDTKITTQITAGARNLDLKSDLYIGGVAKETYKSLPKLVHAKEGFQGCLASVDLNGRLPDLISDALFCNGQIERGCEGPSTTCQEDSCSNQGVCLQQWDGFSCDCSMTSFSGPLCNDPGTTYIFSKGGGQITYKWPPNDRPSTRADRLAIGFSTVQKEAVLVRVDSSSGLGDYLELHIHQGKIGVKFNVGTDDIAIEESNAIINDGKYHVVRFTRSGGNATLQVDSWPVIERYPAGNNDNERLAIARQRIPYRLGRVVDEWLLDKGRQLTIFNSQATIIIGGKEQGQPFQGQLSGLYYNGLKVLNMAAENDANIAIVGNVRLVGEVPSSMTTESTATAMQSEMSTSIMETTTTLATSTARRGKPPTKEPISQTTDDILVASAECPSDDEDIDPCEPSSGGLANPTRAGGREPYPGSAEVIRESSSTTGMVVGIVAAAALCILILLYAMYKYRNRDEGSYHVDESRNYISNSAQSNGAVVKEKQPSSAKSSNKNKKNKDKEYYV

SEQ ID NO: 32587 - protein, 75 aa, Homo sapiens
  ENSP00000486993
MVVGIVAAAALCILILLYAMYKYRNRDEGSYHVDESRNYISNSAQSNGAVVKEKQPSSAKSSNKNKKNKDKEYYV

SEQ ID NO: 32588 - protein, 469 aa, Homo sapiens
  ENSP00000485815
MYQRMLRCGAELGSPGGGGGGGGGGGAGGRLALLWIVPLTLSGLLGVAWGASSLGAHHIHHFHGSSKHHSVPIAIYRSPASLRGGHAGTTYIFSKGGGQITYKWPPNDRPSTRADRLAIGFSTVQKEAVLVRVDSSSGLGDYLELHIHQGKIGVKFNVGTDDIAIEESNAIINDGKYHVVRFTRSGGNATLQVDSWPVIERYPAGNNDNERLAIARQRIPYRLGRVVDEWLLDKGRQLTIFNSQATIIIGGKEQGQPFQGQLSGLYYNGLKVLNMAAENDANIAIVGNVRLVGEVPSSMTTESTATAMQSEMSTSIMETTTTLATSTARRGKPPTKEPISQTTDDILVASAECPSDDEDIDPCEPSSANPTRAGGREPYPGSAEVIRESSSTTGMVVGIVAAAALCILILLYAMYKYRNRDEGSYHVDESRNYISNSAQSNGAVVKEKQPSSAKSSNKNKKNKDKEYYV

SEQ ID NO: 32589 - protein, 1495 aa, Homo sapiens
  ENSP00000434015
MGTALLQRGGCFLLCLSLLLLGCWAELGSGLEFPGAEGQWTRFPKWNACCESEMSFQLKTRSARGLVLYFDDEGFCDFLELILTRGGRLQLSFSIFCAEPATLLADTPVNDGAWHSVRIRRQFRNTTLFIDQVEAKWVEVKSKRRDMTVFSGLFVGGLPPELRAAALKLTLASVREREPFKGWIRDVRVNSSQVLPVDSGEVKLDDEPPNSGGGSPCEAGEEGEGGVCLNGGVCSVVDDQAVCDCSRTGFRGKDCSQEDNNVEGLAHLMMGDQGKEEYIATFKGSEYFCYDLSQNPIQSSSDEITLSFKTLQRNGLMLHTGKSADYVNLALKNGAVSLVINLGSGAFEALVEPVNGKFNDNAWHDVKVTRNLRQVTISVDGILTTTGYTQEDYTMLGSDDFFYVGGSPSTADLPGSPVSNNFMGCLKEVVYKNNDVRLELSRLAKQGDPKMKIHGVVAFKCENVATLDPITFETPESFISLPKWNAKKTGSISFDFRTTEPNGLILFSHGKPRHQKDAKHPQMIKVDFFAIEMLDGHLYLLLDMGSGTIKIKALLKKVNDGEWYHVDFQRDGRSGTISVNTLRTPYTAPGESEILDLDDELYLGGLPENKAGLVFPTEVWTALLNYGYVGCIRDLFIDGQSKDIRQMAEVQSTAGVKPSCSKETAKPCLSNPCKNNGMCRDGWNRYVCDCSGTGYLGRSCEREATVLSYDGSMFMKIQLPVVMHTEAEDVSLRFRSQRAYGILMATTSRDSADTLRLELDAGRVKLTVNLDCIRINCNSSKGPETLFAGYNLNDNEWHTVRVVRRGKSLKLTVDDQQAMTGQMAGDHTRLEFHNIETGIITERRYLSSVPSNFIGHLQSLTFNGMAYIDLCKNGDIDYCELNARFGFRNIIADPVTFKTKSSYVALATLQAYTSMHLFFQFKTTSLDGLILYNSGDGNDFIVVELVKGYLHYVFDLGNGANLIKGSSNKPLNDNQWHNVMISRDTSNLHTVKIDTKITTQITAGARNLDLKSDLYIGGVAKETYKSLPKLVHAKEGFQGCLASVDLNGRLPDLISDALFCNGQIERGCEGPSTTCQEDSCSNQGVCLQQWDGFSCDCSMTSFSGPLCNDPGTTYIFSKGGGQITYKWPPNDRPSTRADRLAIGFSTVQKEAVLVRVDSSSGLGDYLELHIHQGKIGVKFNVGTDDIAIEESNAIINDGKYHVVRFTRSGGNATLQVDSWPVIERYPAGNNDNERLAIARQRIPYRLGRVVDEWLLDKGRQLTIFNSQATIIIGGKEQGQPFQGQLSGLYYNGLKVLNMAAENDANIAIVGNVRLVGEVPSSMTTESTATAMQSEMSTSIMETTTTLATSTARRGKPPTKEPISQTTDDILVASAECPSDDEDIDPCEPSSGGLANPTRAGGREPYPGSAEVIRESSSTTGMVVGIVAAAALCILILLYAMYKYRNRDEGSYHVDESRNYISNSAQSNGAVVKEKQPSSAKSSNKNKKNKDKEYYV

SEQ ID NO: 32590 - protein, 1499 aa, Homo sapiens
  ENSP00000486879
MGTALLQRGGCFLLCLSLLLLGCWAELGSGLEFPGAEGQWTRFPKWNACCESEMSFQLKTRSARGLVLYFDDEGFCDFLELILTRGGRLQLSFSIFCAEPATLLADTPVNDGAWHSVRIRRQFRNTTLFIDQVEAKWVEVKSKRRDMTVFSGLFVGGLPPELRAAALKLTLASVREREPFKGWIRDVRVNSSQVLPVDSGEVKLDDEPPNSGGGSPCEAGEEGEGGVCLNGGVCSVVDDQAVCDCSRTGFRGKDCSQEDNNVEGLAHLMMGDQGKSKGKEEYIATFKGSEYFCYDLSQNPIQSSSDEITLSFKTLQRNGLMLHTGKSADYVNLALKNGAVSLVINLGSGAFEALVEPVNGKFNDNAWHDVKVTRNLRQVTISVDGILTTTGYTQEDYTMLGSDDFFYVGGSPSTADLPGSPVSNNFMGCLKEVVYKNNDVRLELSRLAKQGDPKMKIHGVVAFKCENVATLDPITFETPESFISLPKWNAKKTGSISFDFRTTEPNGLILFSHGKPRHQKDAKHPQMIKVDFFAIEMLDGHLYLLLDMGSGTIKIKALLKKVNDGEWYHVDFQRDGRSGTISVNTLRTPYTAPGESEILDLDDELYLGGLPENKAGLVFPTEVWTALLNYGYVGCIRDLFIDGQSKDIRQMAEVQSTAGVKPSCSKETAKPCLSNPCKNNGMCRDGWNRYVCDCSGTGYLGRSCEREATVLSYDGSMFMKIQLPVVMHTEAEDVSLRFRSQRAYGILMATTSRDSADTLRLELDAGRVKLTVNLDCIRINCNSSKGPETLFAGYNLNDNEWHTVRVVRRGKSLKLTVDDQQAMTGQMAGDHTRLEFHNIETGIITERRYLSSVPSNFIGHLQSLTFNGMAYIDLCKNGDIDYCELNARFGFRNIIADPVTFKTKSSYVALATLQAYTSMHLFFQFKTTSLDGLILYNSGDGNDFIVVELVKGYLHYVFDLGNGANLIKGSSNKPLNDNQWHNVMISRDTSNLHTVKIDTKITTQITAGARNLDLKSDLYIGGVAKETYKSLPKLVHAKEGFQGCLASVDLNGRLPDLISDALFCNGQIERGCEGPSTTCQEDSCSNQGVCLQQWDGFSCDCSMTSFSGPLCNDPGTTYIFSKGGGQITYKWPPNDRPSTRADRLAIGFSTVQKEAVLVRVDSSSGLGDYLELHIHQGKIGVKFNVGTDDIAIEESNAIINDGKYHVVRFTRSGGNATLQVDSWPVIERYPAGNNDNERLAIARQRIPYRLGRVVDEWLLDKGRQLTIFNSQATIIIGGKEQGQPFQGQLSGLYYNGLKVLNMAAENDANIAIVGNVRLVGEVPSSMTTESTATAMQSEMSTSIMETTTTLATSTARRGKPPTKEPISQTTDDILVASAECPSDDEDIDPCEPSSGGLANPTRAGGREPYPGSAEVIRESSSTTGMVVGIVAAAALCILILLYAMYKYRNRDEGSYHVDESRNYISNSAQSNGAVVKEKQPSSAKSSNKNKKNKDKEYYV

SEQ ID NO: 32591 - protein, 903 aa, Homo sapiens
  ENSP00000489573
MTSGSKCPSTDSGKEEYIATFKGSEYFCYDLSQNPIQSSSDEITLSFKTLQRNGLMLHTGKSADYVNLALKNGAVSLVINLGSGAFEALVEPVNGKFNDNAWHDVKVTRNLRQVTISVDGILTTTGYTQEDYTMLGSDDFFYVGGSPSTADLPGSPVSNNFMGCLKEVVYKNNDVRLELSRLAKQGDPKMKIHGVVAFKCENVATLDPITFETPESFISLPKWNAKKTGSISFDFRTTEPNGLILFSHGKPRHQKDAKHPQMIKVDFFAIEMLDGHLYLLLDMGSGTIKIKALLKKVNDGEWYHVDFQRDGRSGTISVNTLRTPYTAPGESEILDLDDELYLGGLPENKAGLVFPTEVWTALLNYGYVGCIRDLFIDGQSKDIRQMAEVQSTAGVKPSCSKETAKPCLSNPCKNNGMCRDGWNRYVCDCSGTGYLGRSCEREATVLSYDGSMFMKIQLPVVMHTEAEDVSLRFRSQRAYGILMATTSRDSADTLRLELDAGRVKLTVNLGKGPETLFAGYNLNDNEWHTVRVVRRGKSLKLTVDDQQAMTGQMAGDHTRLEFHNIETGIITERRYLSSVPSNFIGHLQSLTFNGMAYIDLCKNGDIDYCELNARFGFRNIIADPVTFKTKSSYVALATLQAYTSMHLFFQFKTTSLDGLILYNSGDGNDFIVVELVKGYLHYVFDLGNGANLIKGSSNKPLNDNQWHNVMISRDTSNLHTVKIDTKITTQITAGARNLDLKSDLYIGGVAKETYKSLPKLVHAKEGFQGCLASVDLNGRLPDLISDALFCNGQIERGCEGPSTTCQEDSCSNQGVCLQQWDGFSCDCSMTSFSGPLCNDPGTTYIFSKGGGQITYKWPPNDRPSTRADRLAIGFSTVQKEAVLVRVDSSSGLGDYLELHITLQ

SEQ ID NO: 32592 - protein, 213 aa, Homo sapiens
  ENSP00000486253
DLGNGANLIKGSSNKPLNDNQWHNVMISRDTSNLHTVKIDTKITTQITAGARNLDLKSDLYIGGVAKETYKSLPKLVHAKEGFQGCLASVDLNGRLPDLISDALFCNGQIERGCEVALMKADLQGPSTTCQEDSCSNQGVCLQQWDGFSCDCSMTSFSGPLCNDPGTTYIFSKGGGQITYKWPPNDRPSTRADRLAIGFSTVQKEAVLVRVDS

SEQ ID NO: 32593 - protein, 169 aa, Homo sapiens
  ENSP00000486185
  MOD_RES (1)..(1): Any amino acid
XSNNFMGCLKEVVYKNNDVRLELSRLAKQGDPKMKIHGVVAFKCENVATLDPITFETPESFISLPKWNAKKTGSISFDFRTTEPNGLILFSHGKPRHQKDAKHPQMIKVDFFAIEMLDGHLYLLLDMGSGTIKIKALLKKVNDGEWYHVDFQRDGRSGQMAGDHTRLEF

SEQ ID NO: 32594 - protein, 33 aa, Homo sapiens
  ENSP00000490210
  MOD_RES (1)..(1): Any amino acid
XFQRDGRSDFPFASSLVPPSTQNSCPGTISVNT

SEQ ID NO: 32595 - protein, 56 aa, Homo sapiens
  ENSP00000485723
MTSGSKCPSTDSASLLPRKSRGLMAYILPLVQLTSSVGEDCSFQISTFLFDLSSIS

SEQ ID NO: 32596 - protein, 459 aa, Homo sapiens
  ENSP00000486544
MGTALLQRGGCFLLCLSLLLLGCWAELGSGLEFPGAEGQWTRFPKWNACCESEMSFQLKTRSARGLVLYFDDEGFCDFLELILTRGGRLQLSFSIFCAEPATLLADTPVNDGAWHSVRIRRQFRNTTLFIDQVEAKWVEVKSKRRDMTVFSGLFVGGLPPELRAAALKLTLASVREREPFKGWIRDVRVNSSQVLPVDSGEVKLDDEPPNSGGGSPCEAGEEGEGGVCLNGGVCSVVDDQAVCDCSRTGFRGKDCSQGKEEYIATFKGSEYFCYDLSQNPIQSSSDEITLSFKTLQRNGLMLHTGKSADYVNLALKNGAVSLVINLGSGAFEALVEPVNGKFNDNAWHDVKVTRNLRQVTISVDGILTTTGYTQEDYTMLGSDDFFYVGGSPSTADLPGSPVSNNFMGCLKEVNIVAIRIIPNSWSHHFRSSMKAPLLKTRCSRVKRHNFKFNILLLFM

SEQ ID NO: 32597 - protein, 176 aa, Homo sapiens
  ENSP00000489108
MTSGSKCPSTDSGKEEYIATFKGSEYFCYDLSQNPIQSSSDEITLSFKTLQRNGLMLHTGKSADYVNLALKNGAVSLVINLGSGAFEALVEPVNGKFNDNAWHDVKVTRNLRQVTISVDGILTTTGYTQEDYTMLGSDDFFYVGGSPSTADLPGSPIQHESTFAEDPMFQSQTAQL

SEQ ID NO: 32598 - protein, 136 aa, Homo sapiens
  ENSP00000487268
SSQVLPVDSGEVKLDDEPPNSGGGSPCEAGEEGEGGVCLNGGVCSVVDDQAVCDCSRTGFRGKDCSQEIKFGLQCVLPVLLHDNDQGKYCCINTAKPLTEKDNNVEGLAHLMMGDQGKSKEKLEIFRWIRKDFTNF

SEQ ID NO: 32599 - protein, 278 aa, Homo sapiens
  ENSP00000385310
MGTALLQRGGCFLLCLSLLLLGCWAELGSGLEFPGAEGQWTRFPKWNACCESEMSFQLKTRSARGLVLYFDDEGFCDFLELILTRGGRLQLSFSIFCAEPATLLADTPVNDGAWHSVRIRRQFRNTTLFIDQVEAKWVEVKSKRRDMTVFSGLFVGGLPPELRAAALKLTLASVREREPFKGWIRDVRVNSSQVLPVDSGEVKLDDEPPNSGGGSPCEAGEEGEGGVCLNGGVCSVVDDQAVCDCSRTGFRGKDCSQEDNNVEGLAHLMMGDQGKSKD

SEQ ID NO: 32600 - protein, 155 aa, Homo sapiens
  ENSP00000490017
  MOD_RES (1)..(1): Any amino acid
XVFSGLFVGGLPPELRAAALKLTLASVREREPFKGWIRDVRVNSSQVLPVDSGEVKLDDEPPNSGGGSPCEAGEEGEGGVCLNGGVCSVVDDQAVCDCSRTGFRGKDCSQEDNNVEGLAHLMMGDQGKSKELMLILLCSITTQGLETAKSLIMCT

SEQ ID NO: 32601 - protein, 293 aa, Homo sapiens
  ENSP00000490494
MGTALLQRGGCFLLCLSLLLLGCWAELGSGLEFPGAEGQWTRFPKWNACCESEMSFQLKTRSARGLVLYFDDEGFCDFLELILTRGGRLQLSFSIFCAEPATLLADTPVNDGAWHSVRIRRQFRNTTLFIDQVEAKWVEVKSKRRDMTVFSGLFVGGLPPELRAAALKLTLASVREREPFKGWIRDVRVNSSQVLPVDSGEVKLDDEPPNSGGGSPCEAGEEGEGGVCLNGGVCSVVDDQAVCDCSRTGFRGKDCSQEDNNVEGLAHLMMGDQGKSKEMNDYLNYKKVKICYT

SEQ ID NO: 32602 - protein, 277 aa, Homo sapiens
  ENSP00000485912
MGTALLQRGGCFLLCLSLLLLGCWAELGSGLEFPGAEGQWTRFPKWNACCESEMSFQLKTRSARGLVLYFDDEGFCDFLELILTRGGRLQLSFSIFCAEPATLLADTPVNDGAWHSVRIRRQFRNTTLFIDQVEAKWVEVKSKRRDMTVFSGLFVGGLPPELRAAALKLTLASVREREPFKGWIRDVRVNSSQVLPVDSGEVKLDDEPPNSGGGSPCEAGEEGEGGVCLNGGVCSVVDDQAVCDCSRTGFRGKDCSQDNNVEGLAHLMMGDQGKSKD

SEQ ID NO: 32603 - protein, 126 aa, Homo sapiens
  ENSP00000487165
  MOD_RES (1)..(1): Any amino acid
XPELRAAALKLTLASVREREPFKGWIRDVRVNSSQVLPVDSGEVKLDDEPPNSGGGSPCEAGEEGEGGVCLNGGVCSVVDDQAVCDCSRTGFRGKDCSQGLAHLMMGDQGMGSVPFPLCFQCFLVL

SEQ ID NO: 32604 - protein, 198 aa, Homo sapiens
  ENSP00000483634
MAAENDANIAIVGNVRLVGEVPSSMTTESTATAMQSEMSTSIMETTTTLATSTARRGKPPTKEPISQTTDDILVASAECPSDDEDIDPCEPSSGGLANPTRAGGREPYPGSAEVIRESSSTTGMVVGIVAAAALCILILLYAMYKYRNRDEGSYHVDESRNYISNSAQSNGAVVKEKQPSSAKSSNKNKKNKDKEYYV

SEQ ID NO: 32605 - protein, 851 aa, Homo sapiens
  ENSP00000385681
GKEEYIATFKGSEYFCYDLSQNPIQSSSDEITLSFKTLQRNGLMLHTGKSADYVNLALKNGAVSLVINLGSGAFEALVEPVNGKFNDNAWHDVKVTRNLRQHSGIGHAMVNKLHCSVTISVDGILTTTGYTQEDYTMLGSDDFFYVGGSPSTADLPGSPVSNNFMGCLKEVVYKNNDVRLELSRLAKQGDPKMKIHGVVAFKCENVATLDPITFETPESFISLPKWNAKKTGSISFDFRTTEPNGLILFSHGKPRHQKDAKHPQMIKVDFFAIEMLDGHLYLLLDMGSGTIKIKALLKKVNDGEWYHVDFQRDGRSGTISVNTLRTPYTAPGESEILDLDDELYLGGLPENKAGLVFPTEVWTALLNYGYVGCIRDLFIDGQSKDIRQMAEVQSTAGVKPSCSKETAKPCLSNPCKNNGMCRDGWNRYVCDCSGTGYLGRSCEREATVLSYDGSMFMKIQLPVVMHTEAEDVSLRFRSQRAYGILMATTSRDSADTLRLELDAGRVKLTVNLDCIRINCNSSKGPETLFAGYNLNDNEWHTVRVVRRGKSLKLTVDDQQAMTGQMAGDHTRLEFHNIETGIITERRYLSSVPSNFIGHLQSLTFNGMAYIDLCKNGDIDYCELNARFGFRNIIADPVTFKTKSSYVALATLQAYTSMHLFFQFKTTSLDGLILYNSGDGNDFIVVELVKGYLHYVFDLGNGANLIKGSSNKPLNDNQWHNVMISRDTSNLHTVKIDTKITTQITAGARNLDLKSDLYIGGVAKETYKSLPKLVHAKEGFQGCLASVDLNGRLPDLISDALFCNGQIERGCEGPSTTCQEDSCSNQGVCLQQWDGFSCDCSMTSFSGPLCND

SEQ ID NO: 32606 - protein, 836 aa, Homo sapiens
  ENSP00000385434
GKEEYIATFKGSEYFCYDLSQNPIQSSSDEITLSFKTLQRNGLMLHTGKSADYVNLALKNGAVSLVINLGSGAFEALVEPVNGKFNDNAWHDVKVTRNLRQVTISVDGILTTTGYTQEDYTMLGSDDFFYVGGSPSTADLPGSPVSNNFMGCLKEVVYKNNDVRLELSRLAKQGDPKMKIHGVVAFKCENVATLDPITFETPESFISLPKWNAKKTGSISFDFRTTEPNGLILFSHGKPRHQKDAKHPQMIKVDFFAIEMLDGHLYLLLDMGSGTIKIKALLKKVNDGEWYHVDFQRDGRSGTISVNTLRTPYTAPGESEILDLDDELYLGGLPENKAGLVFPTEVWTALLNYGYVGCIRDLFIDGQSKDIRQMAEVQSTAGVKPSCSKETAKPCLSNPCKNNGMCRDGWNRYVCDCSGTGYLGRSCEREATVLSYDGSMFMKIQLPVVMHTEAEDVSLRFRSQRAYGILMATTSRDSADTLRLELDAGRVKLTVNLDCIRINCNSSKGPETLFAGYNLNDNEWHTVRVVRRGKSLKLTVDDQQAMTGQMAGDHTRLEFHNIETGIITERRYLSSVPSNFIGHLQSLTFNGMAYIDLCKNGDIDYCELNARFGFRNIIADPVTFKTKSSYVALATLQAYTSMHLFFQFKTTSLDGLILYNSGDGNDFIVVELVKGYLHYVFDLGNGANLIKGSSNKPLNDNQWHNVMISRDTSNLHTVKIDTKITTQITAGARNLDLKSDLYIGGVAKETYKSLPKLVHAKEGFQGCLASVDLNGRLPDLISDALFCNGQIERGCEGPSTTCQEDSCSNQGVCLQQWDGFSCDCSMTSFSGPLCND

SEQ ID NO: 32607 - protein, 666 aa, Homo sapiens
  ENSP00000301894
MPPGGSGPGGCPRRPPALAGPLPPPPPPPPPPLLPLLPLLLLLLLGAAEGARVSSSLSTTHHVHHFHSKHGTVPIAINRMPFLTRGGHAGTTYIFGKGGALITYTWPPNDRPSTRMDRLAVGFSTHQRSAVLVRVDSASGLGDYLQLHIDQGTVGVIFNVGTDDITIDEPNAIVSDGKYHVVRFTRSGGNATLQVDSWPVNERYPAGNFDNERLAIARQRIPYRLGRVVDEWLLDKGRQLTIFNSQAAIKIGGRDQGRPFQGQVSGLYYNGLKVLALAAESDPNVRTEGHLRLVGEGPSVLLSAETTATTLLADMATTIMETTTTMATTTTRRGRSPTLRDSTTQNTDDLLVASAECPSDDEDLEECEPSTGGELILPIITEDSLDPPPVATRSPFVPPPPTFYPFLTGVGATQDTLPPPAARRPPSGGPCQAERDDSDCEEPIEASGFASGEVFDSSLPPTDDEDFYTTFPLVTDRTTLLSPRKPAPRPNLRTDGATGAPGVLFAPSAPAPNLPAGKMNHRDPLQPLLENPPLGPGAPTSFEPRRPPPLRPGVTSAPGFPHLPTANPTGPGERGPPGAVEVIRESSSTTGMVVGIVAAAALCILILLYAMYKYRNRDEGSYQVDQSRNYISNSAQSNGAVVKEKAPAAPKTPSKAKKNKDKEYYV

SEQ ID NO: 32608 - protein, 1712 aa, Homo sapiens
  ENSP00000366774
MASGSRWRPTPPPLLLLLLLALAARADGLEFGGGPGQWARYARWAGAASSGELSFSLRTNATRALLLYLDDGGDCDFLELLLVDGRLRLRFTLSCAEPATLQLDTPVADDRWHMVLLTRDARRTALAVDGEARAAEVRSKRREMQVASDLFVGGIPPDVRLSALTLSTVKYEPPFRGLLANLKLGERPPALLGSQGLRGATADPLCAPARNPCANGGLCTVLAPGEVGCDCSHTGFGGKFCSEEEHPMEGPAHLTLNSEVGSLLFSEGGAGRGGAGDVHQPTKGKEEFVATFKGNEFFCYDLSHNPIQSSTDEITLAFRTLQRNGLMLHTGKSADYVNLSLKSGAVWLVINLGSGAFEALVEPVNGKFNDNAWHDVRVTRNLRQHAGIGHAMVNKLHYLVTISVDGILTTTGYTQEDYTMLGSDDFFYIGGSPNTADLPGSPVSNNFMGCLKDVVYKNNDFKLELSRLAKEGDPKMKLQGDLSFRCEDVAALDPVTFESPEAFVALPRWSAKRTGSISLDFRTTEPNGLLLFSQGRRAGGGAGSHSSAQRADYFAMELLDGHLYLLLDMGSGGIKLRASSRKVNDGEWCHVDFQRDGRKGSISVNSRSTPFLATGDSEILDLESELYLGGLPEGGRVDLPLPPEVWTAALRAGYVGCVRDLFIDGRSRDLRGLAEAQGAVGVAPFCSRETLKQCASAPCRNGGVCREGWNRFICDCIGTGFLGRVCEREATVLSYDGSMYMKIMLPNAMHTEAEDVSLRFMSQRAYGLMMATTSRESADTLRLELDGGQMKLTVNLDCLRVGCAPSKGPETLFAGHKLNDNEWHTVRVVRRGKSLQLSVDNVTVEGQMAGAHMRLEFHNIETGIMTERRFISVVPSNFIGHLSGLVFNGQPYMDQCKDGDITYCELNARFGLRAIVADPVTFKSRSSYLALATLQAYASMHLFFQFKTTAPDGLLLFNSGNGNDFIVIELVKGYIHYVFDLGNGPSLMKGNSDKPVNDNQWHNVVVSRDPGNVHTLKIDSRTVTQHSNGARNLDLKGELYIGGLSKNMFSNLPKLVASRDGFQGCLASVDLNGRLPDLIADALHRIGQVERGCDGPSTTCTEESCANQGVCLQQWDGFTCDCTMTSYGGPVCNDPGTTYIFGKGGALITYTWPPNDRPSTRMDRLAVGFSTHQRSAVLVRVDSASGLGDYLQLHIDQGTVGVIFNVGTDDITIDEPNAIVSDGKYHVVRFTRSGGNATLQVDSWPVNERYPAGNFDNERLAIARQRIPYRLGRVVDEWLLDKGRQLTIFNSQAAIKIGGRDQGRPFQGQVSGLYYNGLKVLALAAESDPNVRTEGHLRLVGEGPSVLLSAETTATTLLADMATTIMETTTTMATTTTRRGRSPTLRDSTTQNTDDLLVASAECPSDDEDLEECEPSTGGELILPIITEDSLDPPPVATRSPFVPPPPTFYPFLTGVGATQDTLPPPAARRPPSGGPCQAERDDSDCEEPIEASGFASGEVFDSSLPPTDDEDFYTTFPLVTDRTTLLSPRKPAPRPNLRTDGATGAPGVLFAPSAPAPNLPAGKMNHRDPLQPLLENPPLGPGAPTSFEPRRPPPLRPGVTSAPGFPHLPTANPTGPGERGPPGAVEVIRESSSTTGMVVGIVAAAALCILILLYAMYKYRNRDEGSYQVDQSRNYISNSAQSNGAVVKEKAPAAPKTPSKAKKNKDKEYYV

SEQ ID NO: 32609 - protein, 1642 aa, Homo sapiens
  ENSP00000366782
MASGSRWRPTPPPLLLLLLLALAARADGLEFGGGPGQWARYARWAGAASSGELSFSLRTNATRALLLYLDDGGDCDFLELLLVDGRLRLRFTLSCAEPATLQLDTPVADDRWHMVLLTRDARRTALAVDGEARAAEVRSKRREMQVASDLFVGGIPPDVRLSALTLSTVKYEPPFRGLLANLKLGERPPALLGSQGLRGATADPLCAPARNPCANGGLCTVLAPGEVGCDCSHTGFGGKFCSEEEHPMEGPAHLTLNSEGKEEFVATFKGNEFFCYDLSHNPIQSSTDEITLAFRTLQRNGLMLHTGKSADYVNLSLKSGAVWLVINLGSGAFEALVEPVNGKFNDNAWHDVRVTRNLRQHAGIGHAMVTISVDGILTTTGYTQEDYTMLGSDDFFYIGGSPNTADLPGSPVSNNFMGCLKDVVYKNNDFKLELSRLAKEGDPKMKLQGDLSFRCEDVAALDPVTFESPEAFVALPRWSAKRTGSISLDFRTTEPNGLLLFSQGRRAGGGAGSHSSAQRADYFAMELLDGHLYLLLDMGSGGIKLRASSRKVNDGEWCHVDFQRDGRKGSISVNSRSTPFLATGDSEILDLESELYLGGLPEGGRVDLPLPPEVWTAALRAGYVGCVRDLFIDGRSRDLRGLAEAQGAVGVAPFCSRETLKQCASAPCRNGGVCREGWNRFICDCIGTGFLGRVCEREATVLSYDGSMYMKIMLPNAMHTEAEDVSLRFMSQRAYGLMMATTSRESADTLRLELDGGQMKLTVNLGKGPETLFAGHKLNDNEWHTVRVVRRGKSLQLSVDNVTVEGQMAGAHMRLEFHNIETGIMTERRFISVVPSNFIGHLSGLVFNGQPYMDQCKDGDITYCELNARFGLRAIVADPVTFKSRSSYLALATLQAYASMHLFFQFKTTAPDGLLLFNSGNGNDFIVIELVKGYIHYVFDLGNGPSLMKGNSDKPVNDNQWHNVVVSRDPGNVHTLKIDSRTVTQHSNGARNLDLKGELYIGGLSKNMFSNLPKLVASRDGFQGCLASVDLNGRLPDLIADALHRIGQVERGCDGPSTTCTEESCANQGVCLQQWDGFTCDCTMTSYGGPVCNDPGTTYIFGKGGALITYTWPPNDRPSTRMDRLAVGFSTHQRSAVLVRVDSASGLGDYLQLHIDQGTVGVIFNVGTDDITIDEPNAIVSDGKYHVVRFTRSGGNATLQVDSWPVNERYPAGRQLTIFNSQAAIKIGGRDQGRPFQGQVSGLYYNGLKVLALAAESDPNVRTEGHLRLVGEGPSVLLSAETTATTLLADMATTIMETTTTMATTTTRRGRSPTLRDSTTQNTDDLLVASAECPSDDEDLEECEPSTGGELILPIITEDSLDPPPVATRSPFVPPPPTFYPFLTGVGATQDTLPPPAARRPPSGGPCQAERDDSDCEEPIEASGFASGEVFDSSLPPTDDEDFYTTFPLVTDRTTLLSPRKPAPRPNLRTDGATGAPGVLFAPSAPAPNLPAGKMNHRDPLQPLLENPPLGPGAPTSFEPRRPPPLRPGVTSAPGFPHLPTANPTGPGERGPPGAVEVIRESSSTTGMVVGIVAAAALCILILLYAMYKYRNRDEGSYQVDQSRNYISNSAQSNGAVVKEKAPAAPKTPSKAKKNKDKEYYV

SEQ ID NO: 32610 - protein, 1705 aa, Homo sapiens
  ENSP00000386416
MASGSRWRPTPPPLLLLLLLALAARADGLEFGGGPGQWARYARWAGAASSGELSFSLRTNATRALLLYLDDGGDCDFLELLLVDGRLRLRFTLSCAEPATLQLDTPVADDRWHMVLLTRDARRTALAVDGEARAAEVRSKRREMQVASDLFVGGIPPDVRLSALTLSTVKYEPPFRGLLANLKLGERPPALLGSQGLRGATADPLCAPARNPCANGGLCTVLAPGEVGCDCSHTGFGGKFCSEEEHPMEGPAHLTLNSEVGSLLFSEGGAGRGGAGDVHQPTKGKEEFVATFKGNEFFCYDLSHNPIQSSTDEITLAFRTLQRNGLMLHTGKSADYVNLSLKSGAVWLVINLGSGAFEALVEPVNGKFNDNAWHDVRVTRNLRQHAGIGHAMVTISVDGILTTTGYTQEDYTMLGSDDFFYIGGSPNTADLPGSPVSNNFMGCLKDVVYKNNDFKLELSRLAKEGDPKMKLQGDLSFRCEDVAALDPVTFESPEAFVALPRWSAKRTGSISLDFRTTEPNGLLLFSQGRRAGGGAGSHSSAQRADYFAMELLDGHLYLLLDMGSGGIKLRASSRKVNDGEWCHVDFQRDGRKGSISVNSRSTPFLATGDSEILDLESELYLGGLPEGGRVDLPLPPEVWTAALRAGYVGCVRDLFIDGRSRDLRGLAEAQGAVGVAPFCSRETLKQCASAPCRNGGVCREGWNRFICDCIGTGFLGRVCEREATVLSYDGSMYMKIMLPNAMHTEAEDVSLRFMSQRAYGLMMATTSRESADTLRLELDGGQMKLTVNLDCLRVGCAPSKGPETLFAGHKLNDNEWHTVRVVRRGKSLQLSVDNVTVEGQMAGAHMRLEFHNIETGIMTERRFISVVPSNFIGHLSGLVFNGQPYMDQCKDGDITYCELNARFGLRAIVADPVTFKSRSSYLALATLQAYASMHLFFQFKTTAPDGLLLFNSGNGNDFIVIELVKGYIHYVFDLGNGPSLMKGNSDKPVNDNQWHNVVVSRDPGNVHTLKIDSRTVTQHSNGARNLDLKGELYIGGLSKNMFSNLPKLVASRDGFQGCLASVDLNGRLPDLIADALHRIGQVERGCDGPSTTCTEESCANQGVCLQQWDGFTCDCTMTSYGGPVCNDPGTTYIFGKGGALITYTWPPNDRPSTRMDRLAVGFSTHQRSAVLVRVDSASGLGDYLQLHIDQGTVGVIFNVGTDDITIDEPNAIVSDGKYHVVRFTRSGGNATLQVDSWPVNERYPAGNFDNERLAIARQRIPYRLGRVVDEWLLDKGRQLTIFNSQAAIKIGGRDQGRPFQGQVSGLYYNGLKVLALAAESDPNVRTEGHLRLVGEGPSVLLSAETTATTLLADMATTIMETTTTMATTTTRRGRSPTLRDSTTQNTDDLLVASAECPSDDEDLEECEPSTGGELILPIITEDSLDPPPVATRSPFVPPPPTFYPFLTGVGATQDTLPPPAARRPPSGGPCQAERDDSDCEEPIEASGFASGEVFDSSLPPTDDEDFYTTFPLVTDRTTLLSPRKPAPRPNLRTDGATGAPGVLFAPSAPAPNLPAGKMNHRDPLQPLLENPPLGPGAPTSFEPRRPPPLRPGVTSAPGFPHLPTANPTGPGERGPPGAVEVIRESSSTTGMVVGIVAAAALCILILLYAMYKYRNRDEGSYQVDQSRNYISNSAQSNGAVVKEKAPAAPKTPSKAKKNKDKEYYV

SEQ ID NO: 32611 - protein, 276 aa, Homo sapiens
  ENSP00000407374
LLLLLLGAAEGARVSSSLSTTHHVHHFHSKHGTVPIAINRMPFLTRGGHAGTTYIFGKGGALITYTWPPNDRPSTRMDRLAVGFSTHQRSAVLVRVDSASGLGDYLQLHIDQGTVGVIFNVGTDDITIDEPNAIVSDGKYHVVRFTRSGGNATLQVDSWPVNERYPAGRQLTIFNSQAAIKIGGRDQGRPFQGQVSGLYYNGLKVLALAAESDPNVRTEGHLRLVGEGPSVLLSAETTATTLLADMATTIMETTTTMATTTTRRGRSPTLRDSTTQ

SEQ ID NO: 32612 - protein, 292 aa, Homo sapiens
  ENSP00000388971
SVSPAATCGQPVWSEEHPMEGPAHLTLNSEVGSLLFSEGGAGRGGAGDVHQPTKGKEEFVATFKGNEFFCYDLSHNPIQSSTDEITLAFRTLQRNGLMLHTGKSADYVNLSLKSGAVWLVINLGSGAFEALVEPVNGKFNDNAWHDVRVTRNLRQVTISVDGILTTTGYTQEDYTMLGSDDFFYIGGSPNTADLPGSPVSNNFMGCLKDVVYKNNDFKLELSRLAKEGDPKMKLQGDLSFRCEDVAALDPVTFESPEAFVALPRWSAKRTGSISLDFRTTEPNGLLLFSQGR

SEQ ID NO: 32613 - protein, 206 aa, Homo sapiens
  ENSP00000411271
  MOD_RES (1)..(1): Any amino acid
XCSEEEHPMEGPAHLTLNSEVGSLLFSEGGAGRGGAGDVHQPTKGKEEFVATFKGNEFFCYDLSHNPIQSSTDEITLAFRTLQRNGLMLHTGKSADYVNLSLKSGAVWLVINLGSGAFEALVEPVNGKFNDNAWHDVRVTRNLRQVTISVDGILTTTGYTQEDYTMLGSDDFFYIGGSPNTADLPGSPVSNNFMGCLKDVVYKNND

SEQ ID NO: 32614 - protein, 215 aa, Homo sapiens
  ENSP00000412211
  MOD_RES (1)..(1): Any amino acid
XADPLCAPARNPCANGGLCTVLAPGEVGCDCSHTGFGGKFCSEEEHPMEVGSLLFSEGGAGRGGAGDVHQPTKGKEEFVATFKGNEFFCYDLSHNPIQSSTDEITLAFRTLQRNGLMLHTGKSADYVNLSLKSGAVWLVINLGSGAFEALVEPVNGKFNDNAWHDVRVTRNLRQVTISVDGILTTTGYTQEDYTMLGSDDFFYIGGSPNTADLPG

SEQ ID NO: 32615 - protein, 1712 aa, Homo sapiens; identical to SEQ ID NO: 32608
  ENSP00000265459

SEQ ID NO: 32616 - protein, 1664 aa, Homo sapiens
  ENSP00000488920
MSSTLHSVFFTLKVSILLGSLLGLCLGLEFMGLPNQWARYLRWDASTRSDLSFQFKTNVSTGLLLYLDDGGVCDFLCLSLVDGRVQLRFSMDCAETAVLSNKQVNDSSWHFLMVSRDRLRTVLMLDGEGQSGELQPQRPYMDVVSDLFLGGVPTDIRPSALTLDGVQAMPGFKGLILDLKYGNSEPRLLGSRGVQMDAEGPCGERPCENGGICFLLDGHPTCDCSTTGYGGKLCSEGLSHLMMSEQGRSKAREENVATFRGSEYLCYDLSQNPIQSSSDEITLSFKTWQRNGLILHTGKSADYVNLALKDGAVSLVINLGSGAFEAIVEPVNGKFNDNAWHDVKVTRNLRQVTISVDGILTTTGYTQEDYTMLGSDDFFYVGGSPSTADLPGSPVSNNFMGCLKEVVYKNNDIRLELSRLARIADTKMKIYGEVVFKCENVATLDPINFETPEAYISLPKWNTKRMGSISFDFRTTEPNGLILFTHGKPQERKDARSQKNTKVDFFAVELLDGNLYLLLDMGSGTIKVKATQKKANDGEWYHVDIQRDGRSGTISVNSRRTPFTASGESEILDLEGDMYLGGLPENRAGLILPTELWTAMLNYGYVGCIRDLFIDGRSKNIRQLAEMQNAAGVKSSCSRMSAKQCDSYPCKNNAVCKDGWNRFICDCTGTGYWGRTCEREASILSYDGSMYMKIIMPMVMHTEAEDVSFRFMSQRAYGLLVATTSRDSADTLRLELDGGRVKLMVNLGKGPETLYAGQKLNDNEWHTVRVVRRGKSLKLTVDDDVAEGTMVGDHTRLEFHNIETGIMTEKRYISVVPSSFIGHLQSLMFNGLLYIDLCKNGDIDYCELKARFGLRNIIADPVTFKTKSSYLSLATLQAYTSMHLFFQFKTTSPDGFILFNSGDGNDFIAVELVKGYIHYVFDLGNGPNVIKGNSDRPLNDNQWHNVVITRDNSNTHSLKVDTKVVTQVINGAKNLDLKGDLYMAGLAQGMYSNLPKLVASRDGFQGCLASVDLNGRLPDLINDALHRSGQIERGCEGPSTTCQEDSCANQGVCMQQWEGFTCDCSMTSYSGNQCNDPGATYIFGKSGGLILYTWPANDRPSTRSDRLAVGFSTTVKDGILVRIDSAPGLGDFLQLHIEQGKIGVVFNIGTVDISIKEERTPVNDGKYHVVRFTRNGGNATLQVDNWPVNEHYPTGNTDNERFQMVKQKIPFKYNRPVEEWLQEKGRQLTIFNTQAQIAIGGKDKGRLFQGQLSGLYYDGLKVLNMAAENNPNIKINGSVRLVGEVPSILGTTQTTSMPPEMSTTVMETTTTMATTTTRKNRSTASIQPTSDDLVSSAECSSDDEDFVECEPSTGRSGGELVIPLLVEDPLATPPIATRAPSITLPPTFRPLLTIIETTKDSLSMTSEAGLPCLSDQGSDGCDDDGLVISGYGSGETFDSNLPPTDDEDFYTTFSLVTDKSLSTSIFEGGYKAHAPKWESKDFRPNKVSETSRTTTTSLSPELIRFTASSSSGMVPKLPAGKMNNRDLKPQPDIVLLPLPTAYELDSTKLKSPLITSPMFRNVPTANPTEPGIRRVPGASEVIRESSSTTGMVVGIVAAAALCILILLYAMYKYRNRDEGSYQVDETRNYISNSAQSNGTLMKEKQQSSKSGHKKQKNKDREYYV

SEQ ID NO: 32617 - protein, 1392 aa, Homo sapiens
  ENSP00000450683
MSSTLHSVFFTLKVSILLGSLLGLCLGLEFMGLPNQWARYLRWDASTRSDLSFQFKTNVSTGLLLYLDDGGVCDFLCLSLVDGRVQLRFSMDCAETAVLSNKQVNDSSWHFLMVSRDRLRTVLMLDGEGQSGELQPQRPYMDVVSDLFLGGVPTDIRPSALTLDGVQAMPGFKGLILDLKYGNSEPRLLGSRGVQMDAEGPCGERPCENGGICFLLDGHPTCDCSTTGYGGKLCSEGLSHLMMSEQGRSKAREENVATFRGSEYLCYDLSQNPIQSSSDEITLSFKTWQRNGLILHTGKSADYVNLALKDGAVSLVINLGSGAFEAIVEPVNGKFNDNAWHDVKVTRNLRQVTISVDGILTTTGYTQEDYTMLGSDDFFYVGGSPSTADLPGSPVSNNFMGCLKEVVYKNNDIRLELSRLARIADTKMKIYGEVVFKCENVATLDPINFETPEAYISLPKWNTKRMGSISFDFRTTEPNGLILFTHGKPQERKDARSQKNTKVDFFAVELLDGNLYLLLDMGSGTIKVKATQKKANDGEWYHVDIQRDGRSGTISVNSRRTPFTASGESEILDLEGDMYLGGLPENRAGLILPTELWTAMLNYGYVGCIRDLFIDGRSKNIRQLAEMQNAAGVKSSCSRMSAKQCDSYPCKNNAVCKDGWNRFICDCTGTGYWGRTCEREASILSYDGSMYMKIIMPMVMHTEAEDVSFRFMSQRAYGLLVATTSRDSADTLRLELDGGRVKLMVNLGKGPETLYAGQKLNDNEWHTVRVVRRGKSLKLTVDDDVAEGTMVGDHTRLEFHNIETGIMTEKRYISVVPSSFIGHLQSLMFNGLLYIDLCKNGDIDYCELKARFGLRNIIADPVTFKTKSSYLSLATLQAYTSMHLFFQFKTTSPDGFILFNSGDGNDFIAVELVKGYIHYVFDLGNGPNVIKGNSDRPLNDNQWHNVVITRDNSNTHSLKVDTKVVTQVINGAKNLDLKGDLYMAGLAQGMYSNLPKLVASRDGFQGCLASVDLNGRLPDLINDALHRSGQIERGCEGPSTTCQEDSCANQGVCMQQWEGFTCDCSMTSYSGNQCNDPGATYIFGKSGGLILYTWPANDRPSTRSDRLAVGFSTTVKDGILVRIDSAPGLGDFLQLHIEQGKIGVVFNIGTVDISIKEERTPVNDGKYHVVRFTRNGGNATLQVDNWPVNEHYPTGNTDNERFQMVKQKIPFKYNRPVEEWLQEKGRQLTIFNTQAQIAIGGKDKGRLFQGQLSGLYYDGLKVLNMAAENNPNIKINGSVRLVGEVPSILGTTQTTSMPPEMSTTVMETTTTMATTTTRKNRSTASIQPTSDDLVSSAECSSDDEDFVECEPSTGRSARSSNAARSLRAALTWTWRLTYTFTPIIFISCVVHS

SEQ ID NO: 32618 - protein, 1571 aa, Homo sapiens
  ENSP00000489551
MSSTLHSVFFTLKVSILLGSLLGLCLGLEFMGLPNQWARYLRWDASTRSDLSFQFKTNVSTGLLLYLDDGGVCDFLCLSLVDGRVQLRFSMDCAETAVLSNKQVNDSSWHFLMVSRDRLRTVLMLDGEGQSGELQPQRPYMDVVSDLFLGGVPTDIRPSALTLDGVQAMPGFKGLILDLKYGNSEPRLLGSRGVQMDAEGPCGERPCENGGICFLLDGHPTCDCSTTGYGGKLCSEDVSQDPGLSHLMMSEQAREENVATFRGSEYLCYDLSQNPIQSSSDEITLSFKTWQRNGLILHTGKSADYVNLALKDGAVSLVINLGSGAFEAIVEPVNGKFNDNAWHDVKVTRNLRQVTISVDGILTTTGYTQEDYTMLGSDDFFYVGGSPSTADLPGSPVSNNFMGCLKEVVYKNNDIRLELSRLARIADTKMKIYGEVVFKCENVATLDPINFETPEAYISLPKWNTKRMGSISFDFRTTEPNGLILFTHGKPQERKDARSQKNTKVDFFAVELLDGNLYLLLDMGSGTIKVKATQKKANDGEWYHVDIQRDGRSGTISVNSRRTPFTASGESEILDLEGDMYLGGLPENRAGLILPTELWTAMLNYGYVGCIRDLFIDGRSKNIRQLAEMQNAAGVKSSCSRMSAKQCDSYPCKNNAVCKDGWNRFICDCTGTGYWGRTCEREASILSYDGSMYMKIIMPMVMHTEAEDVSFRFMSQRAYGLLVATTSRDSADTLRLELDGGRVKLMVNLDCIRINCNSSKGPETLYAGQKLNDNEWHTVRVVRRGKSLKLTVDDDVAEGTMVGDHTRLEFHNIETGIMTEKRYISVVPSSFIGHLQSLMFNGLLYIDLCKNGDIDYCELKARFGLRNIIADPVTFKTKSSYLSLATLQAYTSMHLFFQFKTTSPDGFILFNSGDGNDFIAVELVKGYIHYVFDLGNGPNVIKGNSDRPLNDNQWHNVVITRDNSNTHSLKVDTKVVTQVINGAKNLDLKGDLYMAGLAQGMYSNLPKLVASRDGFQGCLASVDLNGRLPDLINDALHRSGQIERGCEGPSTTCQEDSCANQGVCMQQWEGFTCDCSMTSYSGNQCNDPGATYIFGKSGGLILYTWPANDRPSTRSDRLAVGFSTTVKDGILVRIDSAPGLGDFLQLHIEQGKIGVVFNIGTVDISIKEERTPVNDGKYHVVRFTRNGGNATLQVDNWPVNEHYPTGNTDNERFQMVKQKIPFKYNRPVEEWLQEKGRQLTIFNTQAQIAIGGKDKGRLFQGQLSGLYYDGLKVLNMAAENNPNIKINGSVRLVGEVPSILGTTQTTSMPPEMSTTVMETTTTMATTTTRKNRSTASIQPTSDDLVSSAECSSDDEDFVECEPSTDKSLSTSIFEGGYKAHAPKWESKDFRPNKVSETSRTTTTSLSPELIRFTASSSSGMVPKLPAGKMNNRDLKPQPDIVLLPLPTAYELDSTKLKSPLITSPMFRNVPTANPTEPGIRRVPGASEVIRESSSTTGMVVGIVAAAALCILILLYAMYKYRNRDEGSYQVDETRNYISNSAQSNGTLMKEKQQSSKSGHKKQKNKDREYYV

SEQ ID NO: 32619 - protein, 175 aa, Homo sapiens
  ENSP00000451754
  MOD_RES (1)..(1): Any amino acid
XDVSQDPGLSHLMMSEQAREENVATFRGSEYLCYDLSQNPIQSSSDEITLSFKTWQRNGLILHTGKSADYVNLALKDGAVSLVINLGSGAFEAIVEPVNGKFNDNAWHDVKVTRNLRQHSGIGHAMVTISVDGILTTTGYTQEDYTMLGSDDFFYVGGSPSTADLPGSPVSNNFM

SEQ ID NO: 32620 - protein, 75 aa, Homo sapiens
  ENSP00000451947
MKIYGEVVFKCENVATLDPINFETPEAYISLPKWNTKRMGSISFDFRTTEPNGLILFTHGKPQERKDARSQKNTK

SEQ ID NO: 32621 - protein, 1061 aa, Homo sapiens
  ENSP00000451648
MLGSDDFFYVGGSPSTADLPGSPVSNNFMGCLKEVVYKNNDIRLELSRLARIADTKMKIYGEVVFKCENVATLDPINFETPEAYISLPKWNTKRMGSISFDFRTTEPNGLILFTHGKPQERKDARSQKNTKVDFFAVELLDGNLYLLLDMGSGTIKVKATQKKANDGEWYHVDIQRDGRSGTISVNSRRTPFTASGESEILDLEGDMYLGGLPENRAGLILPTELWTAMLNYGYVGCIRDLFIDGRSKNIRQLAEMQNAAGVKSSCSRMSAKQCDSYPCKNNAVCKDGWNRFICDCTGTGYWGRTCEREASILSYDGSMYMKIIMPMVMHTEAEDVSFRFMSQRAYGLLVATTSRDSADTLRLELDGGRVKLMVNLDCIRINCNSSKGPETLYAGQKLNDNEWHTVRVVRRGKSLKLTVDDDVAEGTMVGDHTRLEFHNIETGIMTEKRYISVVPSSFIGHLQSLMFNGLLYIDLCKNGDIDYCELKARFGLRNIIADPVTFKTKSSYLSLATLQAYTSMHLFFQFKTTSPDGFILFNSGDGNDFIAVELVKGYIHYVFDLGNGPNVIKGNSDRPLNDNQWHNVVITRDNSNTHSLKVDTKVVTQVINGAKNLDLKGDLYMAGLAQGMYSNLPKLVASRDGFQGCLASVDLNGRLPDLINDALHRSGQIERGCEGPSTTCQEDSCANQGVCMQQWEGFTCDCSMTSYSGNQCNDPGATYIFGKSGGLILYTWPANDRPSTRSDRLAVGFSTTVKDGILVRIDSAPGLGDFLQLHIEQGKIGVVFNIGTVDISIKEERTPVNDGKYHVVRFTRNGGNATLQVDNWPVNEHYPTGRQLTIFNTQAQIAIGGKDKGRLFQGQLSGLYYDGLKVLNMAAENNPNIKINGSVRLVGEVPSILGTTQTTSMPPEMSTTVMETTTTMATTTTRKNRSTASIQPTSDDLVSSAECSSDDEDFVECEPSTANPTEPGIRRVPGASEVIRESSSTTGMVVGIVAAAALCILILLYAMYKYRNRDEGSYQVDETRNYISNSAQSNGTLMKEKQQSSKSGHKKQKNKDREYYV

SEQ ID NO: 32622 - protein, 119 aa, Homo sapiens
  ENSP00000450462
MKIYGEVVFKCENVATLDPINFETPEAYISLPKWNTKRMGSISFDFRTTEPNGLILFTHGKPQERKDARSQKNTKVDFFAVELLDGNLYLLLDMGSGTIKVKATQKKANDGEWYHVDIQ

SEQ ID NO: 32623 - protein, 637 aa, Homo sapiens
  ENSP00000451672
MHLRIHARRSPPRRPAWTLGIWFLFWGCIVSSVWSSSNVASSSSTSSSPGSHSQHEHHFHGSKHHSVPISIYRSPVSLRGGHAGATYIFGKSGGLILYTWPANDRPSTRSDRLAVGFSTTVKDGILVRIDSAPGLGDFLQLHIEQGKIGVVFNIGTVDISIKEERTPVNDGKYHVVRFTRNGGNATLQVDNWPVNEHYPTGRQLTIFNTQAQIAIGGKDKGRLFQGQLSGLYYDGLKVLNMAAENNPNIKINGSVRLVGEVPSILGTTQTTSMPPEMSTTVMETTTTMATTTTRKNRSTASIQPTSDDLVSSAECSSDDEDFVECEPSTGGELVIPLLVEDPLATPPIATRAPSITLPPTFRPLLTIIETTKDSLSMTSEAGLPCLSDQGSDGCDDDGLVISGYGSGETFDSNLPPTDDEDFYTTFSLVTDKSLSTSIFEGGYKAHAPKWESKDFRPNKVSETSRTTTTSLSPELIRFTASSSSGMVPKLPAGKMNNRDLKPQPDIVLLPLPTAYELDSTKLKSPLITSPMFRNVPTANPTEPGIRRVPGASEVIRESSSTTGMVVGIVAAAALCILILLYAMYKYRNRDEGSYQVDETRNYISNSAQSNGTLMKEKQQSSKSGHKKQKNKDREYYV

SEQ ID NO: 32624 - protein, 432 aa, Homo sapiens
  ENSP00000281127
MHLRIHARRSPPRRPAWTLGIWFLFWGCIVSSVWSSSNVASSSSTSSSPGSHSQHEHHFHGSKHHSVPISIYRSPVSLRGGHAGATYIFGKSGGLILYTWPANDRPSTRSDRLAVGFSTTVKDGILVRIDSAPGLGDFLQLHIEQGKIGVVFNIGTVDISIKEERTPVNDGKYHVVRFTRNGGNATLQVDNWPVNEHYPTGRQLTIFNTQAQIAIGGKDKGRLFQGQLSGLYYDGLKVLNMAAENNPNIKINGSVRLVGEVPSILGTTQTTSMPPEMSTTVMETTTTMATTTTRKNRSTASIQPTSDDLVSSAECSSDDEDFVECEPSTGRSANPTEPGIRRVPGASEVIRESSSTTGMVVGIVAAAALCILILLYAMYKYRNRDEGSYQVDETRNYISNSAQSNGTLMKEKQQSSKSGHKKQKNKDREYYV

SEQ ID NO: 32625 - protein, 459 aa, Homo sapiens
  ENSP00000394426
MHLRIHARRSPPRRPAWTLGIWFLFWGCIVSSVWSSSNVASSSSTSSSPGSHSQHEHHFHGSKHHSVPISIYRSPVSLRGGHAGATYIFGKSGGLILYTWPANDRPSTRSDRLAVGFSTTVKDGILVRIDSAPGLGDFLQLHIEQGKIGVVFNIGTVDISIKEERTPVNDGKYHVVRFTRNGGNATLQVDNWPVNEHYPTGNTDNERFQMVKQKIPFKYNRPVEEWLQEKGRQLTIFNTQAQIAIGGKDKGRLFQGQLSGLYYDGLKVLNMAAENNPNIKINGSVRLVGEVPSILGTTQTTSMPPEMSTTVMETTTTMATTTTRKNRSTASIQPTSDDLVSSAECSSDDEDFVECEPSTANPTEPGIRRVPGASEVIRESSSTTGMVVGIVAAAALCILILLYAMYKYRNRDEGSYQVDETRNYISNSAQSNGTLMKEKQQSSKSGHKKQKNKDREYYV

SEQ ID NO: 32626 - protein, 398 aa, Homo sapiens
  ENSP00000451393
MHLRIHARRSPPRRPAWTLGIWFLFWGCIVSSVWSSSNVASSSSTSSSPGSHSQHEHHFHGSKHHSVPISIYRSPVSLRGGHAGATYIFGKSGGLILYTWPANDRPSTRSDRLAVGFSTTVKDGILVRIDSAPGLGDFLQLHIEQGKIGVVFNIGTVDISIKEERTPVNDGKYHVVRFTRNGGNATLQVDNWPVNEHYPTGNTDNERFQMVKQKIPFKYNRPVEEWLQEKGRQLTIFNTQAQIAIGGKDKGRLFQGQLSGLYYDGLKVLNMAAENNPNIKINGSVRLVGEVPSILGTTQTTSMPPEMSTTVMETTTTMATTTTRKNRSTASIQPTSDDLVSSAECSSDDEDFVECEPSTGRSARSSNAARSLRAALTWTWRLTYTFTPIIFISCVVHS

SEQ ID NO: 32627 - protein, 879 aa, Homo sapiens
  ENSP00000338349
MHPSTHFHRDLDEAREENVATFRGSEYLCYDLSQNPIQSSSDEITLSFKTWQRNGLILHTGKSADYVNLALKDGAVSLVINLGSGAFEAIVEPVNGKFNDNAWHDVKVTRNLRQVTISVDGILTTTGYTQEDYTMLGSDDFFYVGGSPSTADLPGSPVSNNFMGCLKEVVYKNNDIRLELSRLARIADTKMKIYGEVVFKCENVATLDPINFETPEAYISLPKWNTKRMGSISFDFRTTEPNGLILFTHGKPQERKDARSQKNTKVDFFAVELLDGNLYLLLDMGSGTIKVKATQKKANDGEWYHVDIQRDGRSGTISVNSRRTPFTASGESEILDLEGDMYLGGLPENRAGLILPTELWTAMLNYGYVGCIRDLFIDGRSKNIRQLAEMQNAAGVKSSCSRMSAKQCDSYPCKNNAVCKDGWNRFICDCTGTGYWGRTCEREASILSYDGSMYMKIIMPMVMHTEAEDVSFRFMSQRAYGLLVATTSRDSADTLRLELDGGRVKLMVNLDCIRINCNSSKGPETLYAGQKLNDNEWHTVRVVRRGKSLKLTVDDDVAEGTMVGDHTRLEFHNIETGIMTEKRYISVVPSSFIGHLQSLMFNGLLYIDLCKNGDIDYCELKARFGLRNIIADPVTFKTKSSYLSLATLQAYTSMHLFFQFKTTSPDGFILFNSGDGNDFIAVELVKGYIHYVFDLGNGPNVIKGNSDRPLNDNQWHNVVITRDNSNTHSLKVDTKVVTQVINGAKNLDLKGDLYMAGLAQGMYSNLPKLVASRDGFQGCLASVDLNGRLPDLINDALHRSGQIERGCEGPSTTCQEDSCANQGVCMQQWEGFTCDCSMTSYSGNQCNDRKYNNLSYWNFVKMFGDLENLKGQYVKGWLF

SEQ ID NO: 32628 - protein, 194 aa, Homo sapiens
  ENSP00000418780
WRQLFDVVIVQADKPSFFTDRRKPFRKLDEKGSLQWDRITRLEKGKIYRQGNLFDFLRLTEWRGPRVLYFGDHLYSDLADLMLRHGWRTGAIIPELEREIRIINTEQYMHSLTWQQALTGLLERMQTYQDAESRQVLAAWMKERQELSCLLNYRVDFTFYPRRTPLQHEAPLWMDQLCTGCMKTPFLGDMAHIR

SEQ ID NO: 32629 - protein, 520 aa, Homo sapiens
  ENSP00000302468
MRVESGSAQERGILLESLSTLLEKTTASHEGRAPGNRELTDLLPPEVCSLLNPAAIYANNEISLRDVEVYGFDYDYTLAQYADALHPEIFSTARDILIEHYKYPEGIRKYDYNPSFAIRGLHYDIQKSLLMKIDAFHYVQLGTAYRGLQPVPDEEVIELYGGTQHIPLYQMSGFYGKGPSIKQFMDIFSLPEMALLSCVVDYFLGHSLEFDQAHLYKDVTDAIRDVHVKGLMYQWIEQDMEKYILRGDETFAVLSRLVAHGKQLFLITNSPFSFVDKGMRHMVGPDWRQLFDVVIVQADKPSFFTDRRKPFRKLDEKGSLQWDRITRLEKGKIYRQGNLFDFLRLTEWRGPRVLYFGDHLYSDLADLMLRHGWRTGAIIPELEREIRIINTEQYMHSLTWQQALTGLLERMQTYQDAESRQVLAAWMKERQELRCITKALFNAQFGSIFRTFHNPTYFSRRLVRFSDLYMASLSCLLNYRVDFTFYPRRTPLQHEAPLWMDQLCTGCMKTPFLGDMAHIR

SEQ ID NO: 32630 - protein, 557 aa, Homo sapiens
  ENSP00000406933
MAGAGLRAAARRWLLCGGHGGPRAASSSPSCPGCGPPGPGAHCPGVPRSAPAQAPTSGADLSAHLWARYQDMRRLVHDLLPPEVCSLLNPAAIYANNEISLRDVEVYGFDYDYTLAQYADALHPEIFSTARDILIEHYKYPEGIRKYDYNPSFAIRGLHYDIQKSLLMKIDAFHYVQLGTAYRGLQPVPDEEVIELYGGTQHIPLYQMSGFYGKGPSIKQFMDIFSLPEMALLSCVVDYFLGHSLEFDQAHLYKDVTDAIRDVHVKGLMYQWIEQDMEKYILRGDETFAVLSRLVAHGKQLFLITNSPFSFVDKGMRHMVGPDWRQLFDVVIVQADKPSFFTDRRKPFRKLDEKGSLQWDRITRLEKGKIYRQGNLFDFLRLTEWRGPRVLYFGDHLYSDLADLMLRHGWRTGAIIPELEREIRIINTEQYMHSLTWQQALTGLLERMQTYQDAESRQVLAAWMKERQELRCITKALFNAQFGSIFRTFHNPTYFSRRLVRFSDLYMASLSCLLNYRVDFTFYPRRTPLQHEAPLWMDQLCTGCMKTPFLGDMAHIR

SEQ ID NO: 32631 - protein, 532 aa, Homo sapiens
  ENSP00000419547
MAGAGLRAAARRWLLCGGHGGPRAASSSPSCPGCGPPGPGAHCPGVPRSAPAQAPTSGADLSAHLWARYQDMRRLVHDLLPPEVCSLLNPAAIYANNEISLRDVEVYGFDYDYTLAQYADALHPEIFSTARDILIEHYKSLLMKIDAFHYVQLGTAYRGLQPVPDEEVIELYGGTQHIPLYQMSGFYGKGPSIKQFMDIFSLPEMALLSCVVDYFLGHSLEFDQAHLYKDVTDAIRDVHVKGLMYQWIEQDMEKYILRGDETFAVLSRLVAHGKQLFLITNSPFSFVDKGMRHMVGPDWRQLFDVVIVQADKPSFFTDRRKPFRKLDEKGSLQWDRITRLEKGKIYRQGNLFDFLRLTEWRGPRVLYFGDHLYSDLADLMLRHGWRTGAIIPELEREIRIINTEQYMHSLTWQQALTGLLERMQTYQDAESRQVLAAWMKERQELRCITKALFNAQFGSIFRTFHNPTYFSRRLVRFSDLYMASLSCLLNYRVDFTFYPRRTPLQHEAPLWMDQLCTGCMKTPFLGDMAHIR

SEQ ID NO: 32632 - protein, 111 aa, Homo sapiens
  ENSP00000419774
MRVESGSAQERGILLESLSTLLEKTTASHEGRAPGNRELTGQCGQLPRSEPSGRSDRGPQPCSARPSHLVSGRRLPCRPLGLPQRGPGTGKRGKGSLFVRPTSCPPRSAVS

SEQ ID NO: 32633 - protein, 258 aa, Homo sapiens
  ENSP00000417269
  MOD_RES (1)..(1): Any amino acid
XQDMRRLVHDLLPPEVCSLLNPAAIYANNEISLRDVEVYGFDYDYTLAQYADALHPEIFSTARDILIEHYKSLLMKIDAFHYVQLGTAYRGLQPVPDEEGPSIKQFMDIFSLPEMALLSCVVDYFLGHSLEFDQAHLYKDVTDAIRDVHVKGLMYQWIEQDMEKYILRGDETFAVLSRLVAHGKQLFLITNSPFSFVDKGMRHMVGPDWRQLFDVVIVQADKPSFFTDRRKPFRKLDEKGSLQWDRITRLEKGKIYRQ

SEQ ID NO: 32634 - protein, 85 aa, Homo sapiens
  ENSP00000418583
MKIDAFHYVQLGTAYRGLQPVPDEEGPSIKQFMDIFSLPEMALLSCVVDYFLGHSLEFDQAHLYKDVTDAIRDVHVKGLMYQWIE

SEQ ID NO: 32635 - protein, 264 aa, Homo sapiens
  ENSP00000358660
MCPRAARAPATLLLALGAVLWPAAGAWELTILHTNDVHSRLEQTSEDSSKCVNASRCMGGVARLFTKVQQIRRAEPNVLLLDAGDQYQGTIWFTVYKGAEVAHFMNALRYDAMALGNHEFDNGVEGLIEPLLKEAKFPILSANIKAKGPLASQISGLYLPYKVLPVGDEVVGIVGYTSKETPFLSNPGTNLVFEDEITALQPEVDKLKTLNVNKIIALGHSGFEMDKLIAQKVRGVDVVVGGHSNTFLYTGNCFKRIAWARMSR

SEQ ID NO: 32636 - protein, 574 aa, Homo sapiens
  ENSP00000257770
MCPRAARAPATLLLALGAVLWPAAGAWELTILHTNDVHSRLEQTSEDSSKCVNASRCMGGVARLFTKVQQIRRAEPNVLLLDAGDQYQGTIWFTVYKGAEVAHFMNALRYDAMALGNHEFDNGVEGLIEPLLKEAKFPILSANIKAKGPLASQISGLYLPYKVLPVGDEVVGIVGYTSKETPFLSNPGTNLVFEDEITALQPEVDKLKTLNVNKIIALGHSGFEMDKLIAQKVRGVDVVVGGHSNTFLYTGNPPSKEVPAGKYPFIVTSDDGRKVPVVQAYAFGKYLGYLKIEFDERGNVISSHGNPILLNSSIPEDPSIKADINKWRIKLDNYSTQELGKTIVYLDGSSQSCRFRECNMGNLICDAMINNNLRHTDEMFWNHVSMCILNGGGIRSPIDERNNGTITWENLAAVLPFGGTFDLVQLKGSTLKKAFEHSVHRYGQSTGEFLQVGGIHVVYDLSRKPGDRVVKLDVLCTKCRVPSYDPLKMDEVYKVILPNFLANGGDGFQMIKDELLRHDSGDQDINVVSTYISKMKVIYPAVEGRIKFSTGSHCHGSFSLIFLSLWAVIFVLYQ

SEQ ID NO: 32637 - protein, 230 aa, Homo sapiens
  ENSP00000414674
  MOD_RES (1)..(1): Any amino acid
XDVVVGGHSNTFLYTGNPPSKEVPAGKYPFIVTSDDGRKVPVVQAYAFGKYLGYLKIEFDERGNVISSHGNPILLNSSIPEDPSIKADINKWRIKLDNYSTQELGKTIVYLDGSSQSCRFRECNMGNLICDAMINNNLRHTDEMFWNHVSMCILNGGGIRSPIDERNNGIHVVYDLSRKPGDRVVKLDVLCTKCRVPSYDPLKMDEVYKVILPNFLANGGDGFQMIKDEL

SEQ ID NO: 32638 - protein, 179 aa, Homo sapiens
  ENSP00000387630
  MOD_RES (1)..(1): Any amino acid
XNPILLNSSIPEDPSIKADINKWRIKLDNYSTQELGKTIVYLDGSSQSCRFRECNMGNLICDAMINNNLRHTDEMFWNHVSMCILNGGGIRSPIDERNNGTITWENLAAVLPFGGTFDLVQLKGSTLKKAFEHSVHRYGQSTGEFLQVGDLKECCPICINQDDSWKEQPTAQTYLNTWF

SEQ ID NO: 32639 - protein, 524 aa, Homo sapiens
  ENSP00000358665
MCPRAARAPATLLLALGAVLWPAAGAWELTILHTNDVHSRLEQTSEDSSKCVNASRCMGGVARLFTKVQQIRRAEPNVLLLDAGDQYQGTIWFTVYKGAEVAHFMNALRYDAMALGNHEFDNGVEGLIEPLLKEAKFPILSANIKAKGPLASQISGLYLPYKVLPVGDEVVGIVGYTSKETPFLSNPGTNLVFEDEITALQPEVDKLKTLNVNKIIALGHSGFEMDKLIAQKVRGVDVVVGGHSNTFLYTGNPPSKEVPAGKYPFIVTSDDGRKVPVVQAYAFGKYLGYLKIEFDERGNVISSHGNPILLNSSIPEDPSIKADINKWRIKLDNYSTQELGKTIVYLDGSSQSCRFRECNMGNLICDAMINNNLRHTDEMFWNHVSMCILNGGGIRSPIDERNNGIHVVYDLSRKPGDRVVKLDVLCTKCRVPSYDPLKMDEVYKVILPNFLANGGDGFQMIKDELLRHDSGDQDINVVSTYISKMKVIYPAVEGRIKFSTGSHCHGSFSLIFLSLWAVIFVLYQ

SEQ ID NO: 32640 - protein, 270 aa, Homo sapiens
  ENSP00000397297
MVTFATILQVNKVMSILFYVIFLAYLRGIQGNNMDQRSLPEDSLNSLIIKLIQADILKNKLSKQMVDVKENYQSTLPKAEAPREPERGGPAKSAFQPVIAMDTELLRQQRRYNSPRVLLSDSTPLEPPPLYLMEDYVGSPVVANRTSRRKRYAEHKSHRGEYSVCDSESLWVTDKSSAIDIRGHQVTVLGEIKTGNSPVKQYFYETRCKEARPVKNGCRGIDDKHWNSQCKTSQTYVRALTSENNKLVGWRWIRIDTSCVCALSRKIGRT

SEQ ID NO: 32641 - protein, 257 aa, Homo sapiens
  ENSP00000328738
MSILFYVIFLAYLRGIQGNNMDQRSLPEDSLNSLIIKLIQADILKNKLSKQMVDVKENYQSTLPKAEAPREPERGGPAKSAFQPVIAMDTELLRQQRRYNSPRVLLSDSTPLEPPPLYLMEDYVGSPVVANRTSRRKRYAEHKSHRGEYSVCDSESLWVTDKSSAIDIRGHQVTVLGEIKTGNSPVKQYFYETRCKEARPVKNGCRGIDDKHWNSQCKTSQTYVRALTSENNKLVGWRWIRIDTSCVCALSRKIGRT

SEQ ID NO: 32642 - protein, 36 aa, Homo sapiens
  ENSP00000409221
MNGKRNGEGGKRWKWKGTGVPVRSGDATFPKAMDNV

SEQ ID NO: 32643 - protein, 191 aa, Homo sapiens
  ENSP00000448104
MNGKRNGEGGKRWKWKGTGVPVRSGDATFPKAMDNVTVRQGESATLRCTIDNRVTRVAWLNRSTILYAGNDKWCLDPRVVLLSNTQTQYSIEIQNVDVYDEGPYTCSVQTDNHPKTSRVHLIVQVSPKIVEISSDISINEGNNISLTCIATGRPEPTVTWRHISPKAVGFVSEDEYLEIQGITREQSGDYE

SEQ ID NO: 32644 - protein, 18 aa, Homo sapiens
  ENSP00000400205
MNGKRNGEGGKRWKWKGT

SEQ ID NO: 32645 - protein, 344 aa, Homo sapiens
  ENSP00000363918
MGVCGYLFLPWKCLVVVSLRLLFLVPTGVPVRSGDATFPKAMDNVTVRQGESATLRCTIDNRVTRVAWLNRSTILYAGNDKWCLDPRVVLLSNTQTQYSIEIQNVDVYDEGPYTCSVQTDNHPKTSRVHLIVQVSPKIVEISSDISINEGNNISLTCIATGRPEPTVTWRHISPKAVGFVSEDEYLEIQGITREQSGDYECSASNDVAAPVVRRVKVTVNYPPYISEAKGTGVPVGQKGTLQCEASAVPSAEFQWYKDDKRLIEGKKGVKVENRPFLSKLIFFNVSEHDYGNYTCVASNKLGHTNASIMLFGPGAVSEVSNGTSRRAGCVWLLPLLVLHLLLKF

SEQ ID NO: 32646 - protein, 355 aa, Homo sapiens
  ENSP00000396722
MGVCGYLFLPWKCLVVVSLRLLFLVPTGVPVRSGDATFPKAMDNVTVRQGESATLRCTIDNRVTRVAWLNRSTILYAGNDKWCLDPRVVLLSNTQTQYSIEIQNVDVYDEGPYTCSVQTDNHPKTSRVHLIVQVSPKIVEISSDISINEGNNISLTCIATGRPEPTVTWRHISPKAVGFVSEDEYLEIQGITREQSGDYECSASNDVAAPVVRRVKVTVNYPPYISEAKGTGVPVGQKGTLQCEASAVPSAEFQWYKDDKRLIEGKKGVKVENRPFLSKLIFFNVSEHDYGNYTCVASNKLGHTNASIMLFEVKTTALTPWKGPGAVSEVSNGTSRRAGCVWLLPLLVLHLLLKF

SEQ ID NO: 32647 - protein, 316 aa, Homo sapiens
  ENSP00000363916
MGVCGYLFLPWKCLVVVSLRLLFLVPTGVPVRSGDATFPKAMDNVTVRQGESATLRCTIDNRVTRVAWLNRSTILYAGNDKWCLDPRVVLLSNTQTQYSIEIQNVDVYDEGPYTCSVQTDNHPKTSRVHLIVQVSPKIVEISSDISINEGNNISLTCIATGRPEPTVTWRHISPKAVGFVSEDEYLEIQGITREQSGDYECSASNDVAAPVVRRVKVTVNYPPYISEAKGTGVPVGQKGTLQCEASAVPSAEFQWYKDDKRLIEGKKGVKVENRPFLSKLIFFNVSEHDYGNYTCVASNKLGHTNASIMLFGETVL

SEQ ID NO: 32648 - protein, 119 aa, Homo sapiens
  ENSP00000387984
  MOD_RES (1)..(1): Any amino acid
XSAEFQWYKDDKRLIEGKKGVKVENRPFLSKLIFFNVSEHDYGNYTCVASNKLGHTNASIMLFELNEPTSSTLLQEVKTTALTPWKGPGAVSEVSNGTSRRAGCVWLLPLLVLHLLLKF

SEQ ID NO: 32649 - protein, 168 aa, Homo sapiens
  ENSP00000437668
VGFVSEDEYLEIQGITREQSGDYECSASNDVAAPVVRRVKVTVNYPPYISEAKGTGVPVGQKGTLQCEASAVPSAEFQWYKDDKRLIEGKKGVKVENRPFLSKLIFFNVSEHDYGNYTCVASNKLGHTNASIMLFGPGAVSEVSNGTSRRAGCVWLLPLLVLHLLLKF

SEQ ID NO: 32650 - protein, 179 aa, Homo sapiens
  ENSP00000416320
VGFVSEDEYLEIQGITREQSGDYECSASNDVAAPVVRRVKVTVNYPPYISEAKGTGVPVGQKGTLQCEASAVPSAEFQWYKDDKRLIEGKKGVKVENRPFLSKLIFFNVSEHDYGNYTCVASNKLGHTNASIMLFEVKTTALTPWKGPGAVSEVSNGTSRRAGCVWLLPLLVLHLLLKF

SEQ ID NO: 32651 - protein, 344 aa, Homo sapiens
  ENSP00000363923
MKTIQPKMHNSISWAIFTGLAALCLFQGVPVRSGDATFPKAMDNVTVRQGESATLRCTIDNRVTRVAWLNRSTILYAGNDKWCLDPRVVLLSNTQTQYSIEIQNVDVYDEGPYTCSVQTDNHPKTSRVHLIVQVSPKIVEISSDISINEGNNISLTCIATGRPEPTVTWRHISPKAVGFVSEDEYLEIQGITREQSGDYECSASNDVAAPVVRRVKVTVNYPPYISEAKGTGVPVGQKGTLQCEASAVPSAEFQWYKDDKRLIEGKKGVKVENRPFLSKLIFFNVSEHDYGNYTCVASNKLGHTNASIMLFGPGAVSEVSNGTSRRAGCVWLLPLLVLHLLLKF

SEQ ID NO: 32652 - protein, 604 aa, Homo sapiens
  ENSP00000173229
MMRAVWEALAALAAVACLVGAVRGGPGLSMFAGQAAQPDPCSDENGHPRRCIPDFVNAAFGKDVRVSSTCGRPPARYCVVSERGEERLRSCHLCNASDPKKAHPPAFLTDLNNPHNLTCWQSENYLQFPHNVTLTLSLGKKFEVTYVSLQFCSPRPESMAIYKSMDYGRTWVPFQFYSTQCRKMYNRPHRAPITKQNEQEAVCTDSHTDMRPLSGGLIAFSTLDGRPSAHDFDNSPVLQDWVTATDIRVAFSRLHTFGDENEDDSELARDSYFYAVSDLQVGGRCKCNGHAARCVRDRDDSLVCDCRHNTAGPECDRCKPFHYDRPWQRATAREANECVACNCNLHARRCRFNMELYKLSGRKSGGVCLNCRHNTAGRHCHYCKEGYYRDMGKPITHRKACKACDCHPVGAAGKTCNQTTGQCPCKDGVTGITCNRCAKGYQQSRSPIAPCIKIPVAPPTTAASSVEEPEDCDSYCKASKGKLKINMKKYCKKDYAVQIHILKADKAGDWWKFTVNIISVYKQGTSRIRRGDQSLWIRSRDIACKCPKIKPLKKYLLLGNAEDSPDQSGIVADKSSLVIQWRDTWARRLRKFQQREKKGKCKKA

SEQ ID NO: 32653 - protein, 153 aa, Homo sapiens
  ENSP00000389375
HYCKEGYYRDMGKPITHRKACKACDCHPVGAAGKTCNQTTGQCPCKDGVTGITCNRCAKGYQQSRSPIAPCIKIPVAPPTTAASSVEEPEAARQPNTFQAEGLSLLPGAAEKEGARCWGYRRRLGHRVAQAECRGPRSWAWGRITSSFSFASN

SEQ ID NO: 32654 - protein, 628 aa, Homo sapiens
  ENSP00000340998
MGSCARLLLLWGCTVVAAGLSGVAGVSSRCEKACNPRMGNLALGRKLWADTTCGQNATELYCFYSENTDLTCRQPKCDKCNAAYPHLAHLPSAMADSSFRFPRTWWQSAEDVHREKIQLDLEAEFYFTHLIVMFKSPRPAAMVLDRSQDFGKTWKPYKYFATNCSATFGLEDDVVKKGAICTSKYSSPFPCTGGEVIFKALSPPYDTENPYSAKVQEQLKITNLRVQLLKRQSCPCQRNDLNEEPQHFTHYAIYDFIVKGSCFCNGHADQCIPVHGFRPVKAPGTFHMVHGKCMCKHNTAGSHCQHCAPLYNDRPWEAADGKTGAPNECRTCKCNGHADTCHFDVNVWEASGNRSGGVCDDCQHNTEGQYCQRCKPGFYRDLRRPFSAPDACKPCSCHPVGSAVLPANSVTFCDPSNGDCPCKPGVAGRRCDRCMVGYWGFGDYGCRPCDCAGSCDPITGDCISSHTDIDWYHEVPDFRPVHNKSEPAWEWEDAQGFSALLHSGKCECKEQTLGNAKAFCGMKYSYVLKIKILSAHDKGTHVEVNVKIKKVLKSTKLKIFRGKRTLYPESWTDRGCTCPILNPGLEYLVAGHEDIRTGKLIVNMKSFVQHWKPSLGRKVMDILKRECK

SEQ ID NO: 32655 - protein, 591 aa, Homo sapiens
  ENSP00000339436
MGNLALGRKLWADTTCGQNATELYCFYSENTDLTCRQPKCDKCNAAYPHLAHLPSAMADSSFRFPRTWWQSAEDVHREKIQLDLEAEFYFTHLIVMFKSPRPAAMVLDRSQDFGKTWKPYKYFATNCSATFGLEDDVVKKGAICTSKYSSPFPCTGGEVIFKALSPPYDTENPYSAKVQEQLKITNLRVQLLKRQSCPCQRNDLNEEPQHFTHYAIYDFIVKGSCFCNGHADQCIPVHGFRPVKAPGTFHMVHGKCMCKHNTAGSHCQHCAPLYNDRPWEAADGKTGAPNECRTCKCNGHADTCHFDVNVWEASGNRSGGVCDDCQHNTEGQYCQRCKPGFYRDLRRPFSAPDACKPCSCHPVGSAVLPANSVTFCDPSNGDCPCKPGVAGRRCDRCMVGYWGFGDYGCRPCDCAGSCDPITGDCISSHTDIDWYHEVPDFRPVHNKSEPAWEWEDAQGFSALLHSGKCECKEQTLGNAKAFCGMKYSYVLKIKILSAHDKGTHVEVNVKIKKVLKSTKLKIFRGKRTLYPESWTDRGCTCPILNPGLEYLVAGHEDIRTGKLIVNMKSFVQHWKPSLGRKVMDILKRECK

SEQ ID NO: 32656 - protein, 591 aa, Homo sapiens; identical to SEQ ID NO: 32655
  ENSP00000444432

SEQ ID NO: 32657 - protein, 605 aa, Homo sapiens
  ENSP00000447292
MGSCARLLLLWGCTVVAAGLSGVAGVSSRCEKACNPRMGNLALGRKLWADTTCGQNATELYCFYSENTDLTCRQPKCDKCNAAYPHLAHLPSAMADSSFRFPRTWWQSAEDVHREKIQLDLEAEFYFTHLIVMFKSPRPAAMVLDRSQDFGKTWKPYKYFATNCSATFGLEDDVVKKGAICTSKYSSPFPCTGGEVIFKALSPPYDTENPYSAKVQEQLKITNLRVQLLKRQSCPCQRNDLNEEPQHFTHYAIYDFIVKGSCFCNGHADQCIPVHGFRPVKAPGTFHMVHGKCMCKHNTAGSHCQHCAPLYNDRPWEAADGKTGAPNECRTCKCNGHADTCHFDVNVWEASGNRSGGVCDDCQHNTEGQYCQRCKPGFYRDLRRPFSAPDACKPCSCHPVGSAVLPANSVTFCDPSNGDCPCKPGVAGRRCDRCMVGYWGFGDYGCRPCDCAGSCDPITGDCISSHTDIDWYHEVPDFRPVHNKSEPAWEWEDAQGFSALLHSVLKIKILSAHDKGTHVEVNVKIKKVLKSTKLKIFRGKRTLYPESWTDRGCTCPILNPGLEYLVAGHEDIRTGKLIVNMKSFVQHWKPSLGRKVMDILKRECK

SEQ ID NO: 32658 - protein, 176 aa, Homo sapiens
  ENSP00000447594
MGNLALGRKLWADTTCGQNATELYCFYSENTDLTCRQPKCDKCNAAYPHLAHLPSAMADSSFRFPRTWWQSAEDVHREKIQLDLEAEFYFTHLIVMFKSPRPAAMVLDRSQDFGKTWKPYKYFATNCSATFGLEDDVVKKGAICTSKYSSPFPCTGGEVIFKALSPPYDTENPYSA

SEQ ID NO: 32659 - protein, 438 aa, Homo sapiens
  ENSP00000359091
MYLSRFLSIHALWVTVSSVMQPYPLVWGHYDLCKTQIYTEEGKVWDYMACQPESTDMTKYLKVKLDPPDITCGDPPETFCAMGNPYMCNNECDASTPELAHPPELMFDFEGRHPSTFWQSATWKEYPKPLQVNITLSWSKTIELTDNIVITFESGRPDQMILEKSLDYGRTWQPYQYYATDCLDAFHMDPKSVKDLSQHTVLEIICTEEYSTGYTTNSKIIHFEIKDRFAFFAGPRLRNMASLYGQLDTTKKLRDFFTVTDLRIRLLRPAVGEIFVDELHLARYFYAISDIKVRGRCKCNLHATVCVYDNSKLTCECEHNTTGPDCGKCKKNYQGRPWSPGSYLPIPKGTANTCIPSISSIGTNVCDNELLHCQNGGTCHNNVRCLCPAAYTGILCEKLRCEEAGSCGSDSGQGAPPHGSPALLLLTTLLGTASPLVF

SEQ ID NO: 32660 - protein, 539 aa, Homo sapiens
  ENSP00000359085
MYLSRFLSIHALWVTVSSVMQPYPLVWGHYDLCKTQIYTEEGKVWDYMACQPESTDMTKYLKVKLDPPDITCGDPPETFCAMGNPYMCNNECDASTPELAHPPELMFDFEGRHPSTFWQSATWKEYPKPLQVNITLSWSKTIELTDNIVITFESGRPDQMILEKSLDYGRTWQPYQYYATDCLDAFHMDPKSVKDLSQHTVLEIICTEEYSTGYTTNSKIIHFEIKDRFAFFAGPRLRNMASLYGQLDTTKKLRDFFTVTDLRIRLLRPAVGEIFVDELHLARYFYAISDIKVRGRCKCNLHATVCVYDNSKLTCECEHNTTGPDCGKCKKNYQGRPWSPGSYLPIPKGTANTCIPSISSIGNCECFGHSNRCSYIDLLNTVICVSCKHNTRGQHCELCRLGYFRNASAQLDDENVCIECYCNPLGSIHDRCNGSGFCECKTGTTGPKCDECLPGNSWHYGCQPNVCDNELLHCQNGGTCHNNVRCLCPAAYTGILCEKLRCEEAGSCGSDSGQGAPPHGSPALLLLTTLLGTASPLVF

SEQ ID NO: 32661 - protein, 460 aa, Homo sapiens
  ENSP00000359084
MYLSRFLSIHALWVTVSSVMQPYPLVWGHYDLCKTQIYTEEGKVWDYMACQPESTDMTKYLKVKLDPPDITCGDPPETFCAMGNPYMCNNECDASTPELAHPPELMFDFEGRHPSTFWQSATWKEYPKPLQVNITLSWSKTIELTDNIVITFESGRPDQMILEKSLDYGRTWQPYQYYATDCLDAFHMDPKSVKDLSQHTVLEIICTEEYSTGYTTNSKIIHFEIKDRFAFFAGPRLRNMASLYGQLDTTKKLRDFFTVTDLRIRLLRPAVGEIFVDELHLARYFYAISDIKVRGRCKCNLHATVCVYDNSKLTCECEHNTTGPDCGKCKKNYQGRPWSPGSYLPIPKGTANTCIPSISSIGNPPKFNRIWPNISSLEVSNPKQANVCDNELLHCQNGGTCHNNVRCLCPAAYTGILCEKLRCEEAGSCGSDSGQGAPPHGSPALLLLTTLLGTASPLVF

SEQ ID NO: 32662 - protein, 480 aa, Homo sapiens
  ENSP00000359083
MYLSRFLSIHALWVTVSSVMQPYPLVWGHYDLCKTQIYTEEGKVWDYMACQPESTDMTKYLKVKLDPPDITCGDPPETFCAMGNPYMCNNECDASTPELAHPPELMFDFEGRHPSTFWQSATWKEYPKPLQVNITLSWSKTIELTDNIVITFESGRPDQMILEKSLDYGRTWQPYQYYATDCLDAFHMDPKSVKDLSQHTVLEIICTEEYSTGYTTNSKIIHFEIKDRFAFFAGPRLRNMASLYGQLDTTKKLRDFFTVTDLRIRLLRPAVGEIFVDELHLARYFYAISDIKVRGRCKCNLHATVCVYDNSKLTCECEHNTTGPDCGKCKKNYQGRPWSPGSYLPIPKGTANTCIPSISSIGNPPKFNRIWPNISSLEVSNPKQVAPKLALSTVSSVQVANHKRANVCDNELLHCQNGGTCHNNVRCLCPAAYTGILCEKLRCEEAGSCGSDSGQGAPPHGSPALLLLTTLLGTASPLVF

SEQ ID NO: 32663 - protein, 494 aa, Homo sapiens
  ENSP00000359082
MYLSRFLSIHALWVTVSSVMQPYPLVWGHYDLCKTQIYTEEGKVWDYMACQPESTDMTKYLKVKLDPPDITCGDPPETFCAMGNPYMCNNECDASTPELAHPPELMFDFEGRHPSTFWQSATWKEYPKPLQVNITLSWSKTIELTDNIVITFESGRPDQMILEKSLDYGRTWQPYQYYATDCLDAFHMDPKSVKDLSQHTVLEIICTEEYSTGYTTNSKIIHFEIKDRFAFFAGPRLRNMASLYGQLDTTKKLRDFFTVTDLRIRLLRPAVGEIFVDELHLARYFYAISDIKVRGRCKCNLHATVCVYDNSKLTCECEHNTTGPDCGKCKKNYQGRPWSPGSYLPIPKGTANTCIPSISSIGNCECFGHSNRCSYIDLLNTVICVSCKHNTRGQHCELCRLGYFRNASAQLDDENVCIANVCDNELLHCQNGGTCHNNVRCLCPAAYTGILCEKLRCEEAGSCGSDSGQGAPPHGSPALLLLTTLLGTASPLVF

SEQ ID NO: 32664 - protein, 480 aa, Homo sapiens; identical to SEQ ID NO: 32662
  ENSP00000359088

SEQ ID NO: 32665 - protein, 539 aa, Homo sapiens; identical to SEQ ID NO: 32660
  ENSP00000359090

SEQ ID NO: 32666 - protein, 530 aa, Homo sapiens
  ENSP00000376921
MLHLLALFLHCLPLASGDYDICKSWVTTDEGPTWEFYACQPKVMRLKDYVKVKVEPSGITCGDPPERFCSHENPYLCSNECDASNPDLAHPPRLMFDKEEEGLATYWQSITWSRYPSPLEANITLSWNKTVELTDDVVMTFEYGRPTVMVLEKSLDNGRTWQPYQFYAEDCMEAFGMSARRARDMSSSSAHRVLCTEEYSRWAGSKKEKHVRFEVRDRFAIFAGPDLRNMDNLYTRLESAKGLKEFFTLTDLRMRLLRPALGGTYVQRENLYKYFYAISNIEVIGRCKCNLHANLCSMREGSLQCECEHNTTGPDCGKCKKNFRTRSWRAGSYLPLPHGSPNACATAGSFGNCECYGHSNRCSYIDFLNVVTCVSCKHNTRGQHCQHCRLGYYRNGSAELDDENVCIECNCNQIGSVHDRCNETGFCECREGAAGPKCDDCLPTHYWRQGCYPNVCDDDQLLCQNGGTCLQNQRCACPRGYTGVRCEQPRCDPADDDGGLDCDRAPGAAPRPATLLGCLLLLGLAARLGR

SEQ ID NO: 32667 - protein, 422 aa, Homo sapiens
  ENSP00000361252
MLHLLALFLHCLPLASGDYDICKSWVTTDEGPTWEFYACQPKVMRLKDYVKVKVEPSGITCGDPPERFCSHENPYLCSNECDASNPDLAHPPRLMFDKEEEGLATYWQSITWSRYPSPLEANITLSWNKTVELTDDVVMTFEYGRPTVMVLEKSLDNGRTWQPYQFYAEDCMEAFGMSARRARDMSSSSAHRVLCTEEYSRWAGSKKEKHVRFEVRDRFAIFAGPDLRNMDNLYTRLESAKGLKEFFTLTDLRMRLLRPALGGTYVQRENLYKYFYAISNIEVIGRCKCNLHANLCSMREGSLQCECEHNTTGPDCGKCKKNFRTRSWRAGSYLPLPHGSPNACATAGSFGTLQTPPPGRSPSALRGSRRGLANVKEPAGSRPQISEMLLGCTVTLHQGSVGPHIPPKLSLPDPGGPWLGSQ

SEQ ID NO: 32668 - protein, 418 aa, Homo sapiens
  ENSP00000359532
MRLNSSAPGTPGTPAADPFQRAQAGLEEALLAPGFGNASGNASERVLAAPSSELDVNTDIYSKVLVTAVYLALFVVGTVGNTVTAFTLARKKSLQSLQSTVHYHLGSLALSDLLTLLLAMPVELYNFIWVHHPWAFGDAGCRGYYFLRDACTYATALNVASLSVERYLAICHPFKAKTLMSRSRTKKFISAIWLASALLAVPMLFTMGEQNRSADGQHAGGLVCTPTIHTATVKVVIQVNTFMSFIFPMVVISVLNTIIANKLTVMVRQAAEQGQVCTVGGEHSTFSMAIEPGRVQALRHGVRVLRAVVIAFVVCWLPYHVRRLMFCYISDEQWTPFLYDFYHYFYMVTNALFYVSSTINPILYNLVSANFRHIFLATLACLCPVWRRRRKRPAFSRKADSVSSNHTLSSNATRETLY

SEQ ID NO: 32669 - protein, 410 aa, Homo sapiens
  ENSP00000303686
METSSPRPPRPSSNPGLSLDARLGVDTRLWAKVLFTALYALIWALGAAGNALSAHVVLKARAGRAGRLRHHVLSLALAGLLLLLVGVPVELYSFVWFHYPWVFGDLGCRGYYFVHELCAYATVLSVAGLSAERCLAVCQPLRARSLLTPRRTRWLVALSWAASLGLALPMAVIMGQKHELETADGEPEPASRVCTVLVSRTALQVFIQVNVLVSFVLPLALTAFLNGVTVSHLLALCSQVPSTSTPGSSTPSRLELLSEEGLLSFIVWKKTFIQGGQVSLVRHKDVRRIRSLQRSVQVLRAIVVMYVICWLPYHARRLMYCYVPDDAWTDPLYNFYHYFYMVTNTLFYVSSAVTPLLYNAVSSSFRKLFLEAVSSLCGEHHPMKRLPPKPQSPTLMDTASGFGDPPETRT

SEQ ID NO: 32670 - protein, 186 aa, Homo sapiens
  ENSP00000404020
MISNYRNGSELVCFNSGVGCFLIGCDWAFTVLVNTFFSFLRRKTDFFIGGEEGMAEKLITQTFSHHNQLAQKTRREKRARQEAERREKAERAARLAKEAKSETSGPQIKELTDEEAERLQLEIDQKKDAENHEAQLKNGSLDSPGKQDTEEDEEEDEKDKGKLKPNLGNGADLPNYRWTQTLSELD

SEQ ID NO: 32671 - protein, 331 aa, Homo sapiens
  ENSP00000319664
MGGEQEEERFDGMLLAMAQQHEGGVQELVNTFFSFLRRKTDFFIGGEEGMAEKLITQTFSHHNQLAQKTRREKRARQEAERREKAERAARLAKEAKSETSGPQIKELTDEEAERLQLEIDQKKDAENHEAQLKNGSLDSPGKQDTEEDEEEDEKDKGKLKPNLGNGADLPNYRWTQTLSELDLAVPFCVNFRLKGKDMVVDIQRRHLRVGLKGQPAIIDGELYNEVKVEESSWLIEDGKVVTVHLEKINKMEWWSRLVSSDPEINTKKINPENSKLSDLDSETRSMVEKMMYDQRQKSMGLPTSDEQKKQEILKKFMDQHPEMDFSKAKFN

SEQ ID NO: 32672 - protein, 133 aa, Homo sapiens
  ENSP00000400981
MAEKLITQTFSHHNQLAQKTRREKRARQEAERREKAERAARLAKEAKSETSGPQIKELTDEEAERLQLEIDQKKDAENHEAQLKNGSLDSPGKQDTEEDEEEDEKDKGKLKPNLGNGADLPNYRWTQTLSELD

SEQ ID NO: 32673 - protein, 361 aa, Homo sapiens
  ENSP00000347626
METGAAELYDQALLGILQHVGNVQDFLRVLFGFLYRKTDFYRLLRHPSDRMGFPPGAAQALVLQVFKTFDHMARQDDEKRRQELEEKIRRKEEEEAKTVSAAAAEKEPVPVPVQEIEIDSTTELDGHQEVEKVQPPGPVKEMAHGSQEAEAPGAVAGAAEVPREPPILPRIQEQFQKNPDSYNGAVRENYTWSQDYTDLEVRVPVPKHVVKGKQVSVALSSSSIRVAMLEENGERVLMEGKLTHKINTESSLWSLEPGKCVLVNLSKVGEYWWNAILEGEEPIDIDKINKERSMATVDEEEQAVLDRLTFDYHQKLQGKPQSHELKVHEMLKKGWDAEGSPFRGQRFDPAMFNISPGAVQF

SEQ ID NO: 32674 - protein, 181 aa, Homo sapiens
  ENSP00000338352
MMKFKPNQTRTYDREGFKKRAACLCFRSEQEDEVLLVSSSRYPDQWIVPGGGMEPEEEPGGAAVREVYEEAGVKGKLGRLLGIFEQNQDRKHRTYVYVLTVTEILEDWEDSVNIGRKREWFKVEDAIKVLQCHKPVHAEYLEKLKLGCSPANGNSTVPSLPDNNALFVTAAQTSGLPSSVR

SEQ ID NO: 32675 - protein, 180 aa, Homo sapiens
  ENSP00000406612
MMKFKPNQTRTYDREGFKKRAACLCFRSEQEDEVLLVSSSRYPDQWIVPGGGMEPEEEPGGAAVREVYEEAGVKGKLGRLLGIFENQDRKHRTYVYVLTVTEILEDWEDSVNIGRKREWFKVEDAIKVLQCHKPVHAEYLEKLKLGCSPANGNSTVPSLPDNNALFVTAAQTSGLPSSVR

SEQ ID NO: 32676 - protein, 95 aa, Homo sapiens
  ENSP00000448504
MEPEEEPGGAAVREVYEEAGVKGKLGRLLGIFENQDRKHRTYVYVLTVTEILEDWEDSVNIGRKREWFKVEDAIKVLQCHKPVHAEYLEKLKLGC

SEQ ID NO: 32677 - protein, 128 aa, Homo sapiens
  ENSP00000449552
MEPEEEPGGAAVREVYEEAGVKGKLGRLLGIFENQDRKHRTYVYVLTVTEILEDWEDSVNIGRKREWFKVEDAIKVLQCHKPVHAEYLEKLKLGCSPANGNSTVPSLPDNNALFVTAAQTSGLPSSVR

SEQ ID NO: 32678 - protein, 128 aa, Homo sapiens; identical to SEQ ID NO: 32677
  ENSP00000449724

SEQ ID NO: 32679 - protein, 129 aa, Homo sapiens
  ENSP00000448032
MEPEEEPGGAAVREVYEEAGVKGKLGRLLGIFEQNQDRKHRTYVYVLTVTEILEDWEDSVNIGRKREWFKVEDAIKVLQCHKPVHAEYLEKLKLGCSPANGNSTVPSLPDNNALFVTAAQTSGLPSSVR

SEQ ID NO: 32680 - protein, 112 aa, Homo sapiens
  ENSP00000448620
MEPEEEPGGAAVREVYEEAGVKGKLGRLLGIFENQDRKHRTYVYVLTVTEILEDWEDSVNIGRKREWFKVEDAIKVLQCHKPVHAEYLEKLKLGCSPANGNSTVPSLPDNNA

SEQ ID NO: 32681 - protein, 609 aa, Homo sapiens
  ENSP00000252891
MSRSAAASGGPRRPERHLPPAPCGAPGPPETCRTEPDGAGTMNKLRQSLRRRKPAYVPEASRPHQWQADEDAVRKGTCSFPVRYLGHVEVEESRGMHVCEDAVKKLKAMGRKSVKSVLWVSADGLRVVDDKTKDLLVDQTIEKVSFCAPDRNLDKAFSYICRDGTTRRWICHCFLALKDSGERLSHAVGCAFAACLERKQRREKECGVTAAFDASRTSFAREGSFRLSGGGRPAEREAPDKKKAEAAAAPTVAPGPAQPGHVSPTPATTSPGEKGEAGTPVAAGTTAAAIPRRHAPLEQLVRQGSFRGFPALSQKNSPFKRQLSLRLNELPSTLQRRTDFQVKGTVPEMEPPGAGDSDSINALCTQISSSFASAGAPAPGPPPATTGTSAWGEPSVPPAAAFQPGHKRTPSEAERWLEEVSQVAKAQQQQQQQQQQQQQQQQQQQQAASVAPVPTMPPALQPFPAPVGPFDAAPAQVAVFLPPPHMQPPFVPAYPGLGYPPMPRVPVVGITPSQMVANAFCSAAQLQPQPATLLGKAGAFPPPAIPSAPGSQARPRPNGAPWPPEPAPAPAPELDPFEAQWAALEGKATVEKPSNPFSGDLQKTFEIEL

SEQ ID NO: 32682 - protein, 568 aa, Homo sapiens
  ENSP00000472400
MNKLRQSLRRRKPAYVPEASRPHQWQADEDAVRKGTCSFPVRYLGHVEVEESRGMHVCEDAVKKLKAMGRKSVKSVLWVSADGLRVVDDKTKDLLVDQTIEKVSFCAPDRNLDKAFSYICRDGTTRRWICHCFLALKDSGERLSHAVGCAFAACLERKQRREKECGVTAAFDASRTSFAREGSFRLSGGGRPAEREAPDKKKAEAAAAPTVAPGPAQPGHVSPTPATTSPGEKGEAGTPVAAGTTAAAIPRRHAPLEQLVRQGSFRGFPALSQKNSPFKRQLSLRLNELPSTLQRRTDFQVKGTVPEMEPPGAGDSDSINALCTQISSSFASAGAPAPGPPPATTGTSAWGEPSVPPAAAFQPGHKRTPSEAERWLEEVSQVAKAQQQQQQQQQQQQQQQQQQQQAASVAPVPTMPPALQPFPAPVGPFDAAPAQVAVFLPPPHMQPPFVPAYPGLGYPPMPRVPVVGITPSQMVANAFCSAAQLQPQPATLLGKAGAFPPPAIPSAPGSQARPRPNGAPWPPEPAPAPAPELDPFEAQWAALEGKATVEKPSNPFSGDLQKTFEIEL

SEQ ID NO: 32683 - protein, 568 aa, Homo sapiens; identical to SEQ ID NO: 32682
  ENSP00000442759

SEQ ID NO: 32684 - protein, 214 aa, Homo sapiens
  ENSP00000469310
  MOD_RES (1)..(1): Any amino acid
XCEDAVKKLKAMGRKSVKSVLWVSADGLRVVDDKTKDLLVDQTIEKVSFCAPDRNLDKAFSYICRDGTTRRWICHCFLALKDSGERLSHAVGCAFAACLERKQRREKECGVTAAFDASRTSFAREGSFRLSGGGRPAEREAPDKKKEAAAAPTVAPGPAQPGHVSPTPATTSPGEKGEAGTPVAAGTTAAAIPRRHAPLEQLVRQGSFRGFPAL

SEQ ID NO: 32685 - protein, 235 aa, Homo sapiens
  ENSP00000469736
MNKLRQSLRRRKPAYVPEASRPHQWQADEDAVRKGTCSFPVRYLGHVEVEESRGMHVCEDAVKKLKAMGRKSVKSVLWVSADGLRVVDDKTKDLLVDQTIEKVSFCAPDRNLDKAFSYICRDGTTRRWICHCFLALKDSGERLSHAVGCAFAACLERKQRREKECGVTAAFDASRTSFAREGSFRLSGGGRPAEREAPDKKKAEAAAAPTVAPGPAQPGHVSPTPATTSPGEKGE

SEQ ID NO: 32686 - protein, 115 aa, Homo sapiens
  ENSP00000470794
MNKLRQSLRRRKPAYVPEASRPHQWQADEDAVRKGTCSFPVRYLGHVEVEESRGMHVCEDAVKKLKAMGRKSVKSVLWVSADGLRVVDDKTKDLLVDQTIEKVSFCAPDRNLDKA

SEQ ID NO: 32687 - protein, 110 aa, Homo sapiens
  ENSP00000471376
MNKLRQSLRRRKPAYVPEASRPHQWQADEDAVRKGTCSFPVRYLGHVEVEESRGMHVCEDAVKKLKAMGRKSVKSVLWVSADGLRVVDDKTKDLLVDQTIEKVSFCAPDR

SEQ ID NO: 32688 - protein, 599 aa, Homo sapiens
  ENSP00000371155
MSTGFSFGSGTLGSTTVAAGGTSTGGVFSFGTGASSNPSVGLNFGNLGSTSTPATTSAPSSGFGTGLFGSKPATGFTLGGTNTGIATTITTGLTLGTPATTSAATTGFSLGFNKPAASATPFALPITSTSASGLTLSSALTSTPAASTGFTLNNLGGTTATTTTASTGLSLGGALAGLGGSLFQSTNTGTSGLGQNALGLTLGTTAATSTAGNEGLGGIDFSSSSDKKSDKTGTRPEDSKALKDENLPPVICQDVENLQKFVKEQKQVQEEISRMSSKAMLKVQEDIKALKQLLSLAANGIQRNTLNIDKLKIETAQELKNAEIALRTQKTPPGLQHEYAAPADYFRILVQQFEVQLQQYRQQIEELENHLATQANNSHITPQDLSMAMQKIYQTFVALAAQLQSIHENVKVLKEQYLGYRKMFLGDAVDVFETRRAEAKKWQNTPRVTTGPTPFSTMPNAAAVAMAATLTQQQQPATGPQPSLGVSFGTPFGSGIGTGLQSSGLGSSNLGGFGTSSGFGCSTTGASTFGFGTTNKPSGSLSAGFGSSSTSGFNFSNPGITASAGLTFGVSNPASAGFGTGGQLLQLKKPPAGNKRGKR

SEQ ID NO: 32689 - protein, 62 aa, Homo sapiens
  ENSP00000418341
MSTGFSFGSGTLGSTTVAAGGTSTGGVFSFGTGASSSTTLLRLLSFVEQIFIGQIPMCKALF

SEQ ID NO: 32690 - protein, 128 aa, Homo sapiens
  ENSP00000418904
MSTGFSFGSGTLGSTTVAAGGTSTGGVFSFGTGASSNPSVGLNFGNLGSTSTPATTSAPSSGFGTGLFGSKPATGFTLGGTNTGIATTITTGLTLENNTSVYQQSFGLDQLQTQERQPLHLQLQQASV

SEQ ID NO: 32691 - protein, 36 aa, Homo sapiens
  ENSP00000418244
MSTGFSFGSGTLGSTTVAAGGTSTGGVFSFGTGASR

SEQ ID NO: 32692 - protein, 485 aa, Homo sapiens
  ENSP00000418555
MSTGFSFGSGTLGSTTVAAGGTSTGGVFSFGTGASSNPSVGLNFGNLGSTSTPATTSAPSSGFGTGLFGSKPATGFTLGGTNTGIATTITTGLTLGTPATTSAATTGFSLGFNKPAASATPFALPITSTSASGLTLSSALTSTPAASTGFTLNNLGGTTATTTTASTGLSLGGALAGLGGSLFQSTNTGTSGLGQNALGLTLGTTAATSTAGNEGLGGIDFSSSSDKKSDKTGTRPEDSKALKDENLPPVICQDVENLQKFVKEQKQVQEEISRMSSKAMLKVQEDIKALKQLLSLAANGIQRNTLNIDKLKIETAQELKNAEIALRTQKTPPGLQHEYAAPADYFRILVQQFEVQLQQYRQQIEELENHLATQANNSHITPQDLSMAMQKIYQTFVALAAQLQSIHENVKVLKEQYLGYRKMFLGDAVDVFETRRAEAKKWQNTPRVTTGPTPFSTMPNAAAVAMAATLTQQQQPATGLNAFKL

SEQ ID NO: 32693 - protein, 587 aa, Homo sapiens
  ENSP00000371137
MSTGFSFGSGTLGSTTVAAGGTSTGGVFSFGTGASSNPSVGLNFGNLGSTSTPATTSAPSSGFGTGLFGSKPATGFTLGGTNTGTPATTSAATTGFSLGFNKPAASATPFALPITSTSASGLTLSSALTSTPAASTGFTLNNLGGTTATTTTASTGLSLGGALAGLGGSLFQSTNTGTSGLGQNALGLTLGTTAATSTAGNEGLGGIDFSSSSDKKSDKTGTRPEDSKALKDENLPPVICQDVENLQKFVKEQKQVQEEISRMSSKAMLKVQEDIKALKQLLSLAANGIQRNTLNIDKLKIETAQELKNAEIALRTQKTPPGLQHEYAAPADYFRILVQQFEVQLQQYRQQIEELENHLATQANNSHITPQDLSMAMQKIYQTFVALAAQLQSIHENVKVLKEQYLGYRKMFLGDAVDVFETRRAEAKKWQNTPRVTTGPTPFSTMPNAAAVAMAATLTQQQQPATGPQPSLGVSFGTPFGSGIGTGLQSSGLGSSNLGGFGTSSGFGCSTTGASTFGFGTTNKPSGSLSAGFGSSSTSGFNFSNPGITASAGLTFGVSNPASAGFGTGGQLLQLKKPPAGNKRGKR

SEQ ID NO: 32694 - protein, 510 aa, Homo sapiens
  ENSP00000371166
MSTGFSFGSGTLGSTTVAAGGTSTGGVFSFGTGASSNPSVGLNFGNLGSTSTPATTSAPSSGFGTGLFGSKPATGFTLGGTNTGIATTITTGLTLGTPATTSAATTGFSLGFNKPAASATPFALPITSTSASGLTLSSALTSTPAASTGFTLNNLGGTTATTTTASTGLSLGGALAGLGGSLFQSTNTGTSGLGQNALGLTLGTTAATSTAGNEGLGGIDFSSSSDKKSDKTGTRPEDSKALKDENLPPVICQDVENLQKFVKEQKQVQEEISRMSSKAMLKVQEDIKALKQLLSLAANGIQRNTLNIDKLKIETAQELKNAEIALRTQKTPPGLQHEYAAPADYFRILVQQFEVQLQQYRQQIEELENHLATQANNSHITPQDLSMAMQKIYQTFVALAAQLQSIHENVKVLKEQYLGYRKMFLGDAVDVFETRRAEAKKWQNTPRVTTGPTPFSTMPNAAAVAMAATLTQQQQPATGDKWCNVAELKNRTQLSLFVNKLELSCYCVID

SEQ ID NO: 32695 - protein, 463 aa, Homo sapiens
  ENSP00000408147
LNFGNLGSTSTPATTSAPSSGFGTGLFGSKPATGFTLGGTNTGTPATTSAATTGFSLGFNKPAASATPFALPITSTSASGLTLSSALTSTPAASTGFTLNNLGGTTATTTTASTGLSLGGALAGLGGSLFQSTNTGTSGLGQNALGLTLGTTAATSTAGNEGLGGIDFSSSSDKKSDKTGTRPEDSKALKDENLPPVICQDVENLQKFVKEQKQVQEEISRMSSKAMLKVQEDIKALKQLLSLAANGIQRNTLNIDKLKIETAQELKNAEIALRTQKTPPGLQHEYAAPADYFRILVQQFEVQLQQYRQQIEELENHLATQANNSHITPQDLSMAMQKIYQTFVALAAQLQSIHENVKVLKEQYLGYRKMFLGDAVDVFETRRAEAKKWQNTPRVTTGPTPFSTMPNAAAVAMAATLTQQQQPATGDKWCNVAELKNRTQLSLFVNKLELSCYCVIDLLYNEQ

SEQ ID NO: 32696 - protein, 184 aa, Homo sapiens
  ENSP00000361544
MQFTSISNSLTSTAAIGLSFTTSTTTTATFTTNTTTTITSGFTVNQNQLLSRGFENLVPYTSTVSVVATPVMTYGHLEGLINEWNLELEDQEKYFLLQATQVNAWDHTLIENGEMIRILHGEVNKVKLDQKRLEQELDFILSQQQELEFLLTYLEESTRDQSGLHYLQDADEEHVEISTRSAEF

SEQ ID NO: 32697 - protein, 72 aa, Homo sapiens
  ENSP00000433269
MQFTSISNSLTSTAAIGLSFTTSTTTTATFTTNTTTTITSGFTVNQNQLLSRGFENLVPYTSTVRFVFYMEK

SEQ ID NO: 32698 - protein, 198 aa, Homo sapiens
  ENSP00000408612
  MOD_RES (1)..(1): Any amino acid
XPVMTYGHLEGLINEWNLELEDQEKYFLLQATQVNAWDHTLIENGEMIRILHGEVNKVKLDQKRLEQELDFILSQQQELEFLLTYLEESTRDQSGLHYLQDADEEHVEIYRLAESIDAQLKQMAQDLKDVVNHLNTFESSSDTTDPLHQICRILNAHMDSLQWIDRNSGMLRRKVEVVTRVFEDYRHEEHAHNVNTAF

SEQ ID NO: 32699 - protein, 136 aa, Homo sapiens
  ENSP00000405906
MQFTSISNSLTSTAAIGLSFTTSTTTTATFTTNTTTTITSGFTVNQNQLLSRGFENLVPYTSTVSVVATPVMTYGHLEGLINEWNLELEDQEKYFLLQATQVNAWDHTLIENGEMIRILHGEVNKVKLDQKRLEQE

SEQ ID NO: 32700 - protein, 819 aa, Homo sapiens
  ENSP00000310668
MDTEGFGELLQQAEQLAAETEGISELPHVERNLQEIQQAGERLRSRTLTRTSQETADVKASVLLGSRGLDISHISQRLESLSAATTFEPLEPVKDTDIQGFLKNEKDNALLSAIEESRKRTFGMAEEYHRESMLVEWEQVKQRILHTLLASGEDALDFTQESEPSYISDVGPPGRSSLDNIEMAYARQIYIYNEKIVNGHLQPNLVDLCASVAELDDKSISDMWTMVKQMTDVLLTPATDALKNRSSVEVRMEFVRQALAYLEQSYKNYTLVTVFGNLHQAQLGGVPGTYQLVRSFLNIKLPAPLPGLQDGEVEGHPVWALIYYCMRCGDLLAASQVVNRAQHQLGEFKTWFQEYMNSKDRRLSPATENKLRLHYRRALRNNTDPYKRAVYCIIGRCDVTDNQSEVADKTEDYLWLKLNQVCFDDDGTSSPQDRLTLSQFQKQLLEDYGESHFTVNQQPFLYFQVLFLTAQFEAAVAFLFRMERLRCHAVHVALVLFELKLLLKSSGQSAQLLSHEPGDPPCLRRLNFVRLLMLYTRKFESTDPREALQYFYFLRDEKDSQGENMFLRCVSELVIESREFDMILGKLENDGSRKPGVIDKFTSDTKPIINKVASVAENKGLFEEAAKLYDLAKNADKVLELMNKLLSPVVPQISAPQSNKERLKNMALSIAERYRAQGISANKFVDSTFYLLLDLITFFDEYHSGHIDRAFDIIERLKLVPLNQESVEERVAAFRNFSDEIRHNLSEVLLATMNILFTQFKRLKGTSPSSSSRPQRVIEDRDSQLRSQARTLITFAGMIPYRTSGDTNARLVQMEVLMN

SEQ ID NO: 32701 - protein, 229 aa, Homo sapiens
  ENSP00000455230
MDTEGFELDDKSISDMWTMVKQMTDVLLTPATDALKNRSSVEVRMEFVRQALAYLEQSYKNYTLVTVFGNLHQAQLGGVPGTYQLVRSFLNIKLPAPLPGLQDGEVEGHPVWALIYYCMRCGDLLAASQVVNRAQHQLGEFKTWFQEYMNSKDRRLSPATENKLRLHYRRALRNNTDPYKRAVYCIIGRCDVTDNQSEVADKTEDYLWLKLNQVCFDDDGTSSPQDRLT

SEQ ID NO: 32702 - protein, 151 aa, Homo sapiens
  ENSP00000456264
MDTEGFGELLQQAEQLAAETEGISELPHVERNLQEIQQAGERLRSRTLTRTSQETADVKASVLLGSRGLDISHISQRLESLSAATTFEPLEPVKDTDIQGFLKNEKDNALLSAIEESRKRTFGMAEEYHRESMLVEWEQVKQRILHTLLAS

SEQ ID NO: 32703 - protein, 880 aa, Homo sapiens
  ENSP00000458101
MDTEGFGELLQQAEQLAAETEGISELPHVERNLQEIQQAGERLRSRTLTRTSQETADVKASVLLGSRGLDISHISQRLESLSAATTFEPLEPVKDTDIQGFLKNEKDNALLSAIEESRKRTFGMAEEYHRESMLVEWEQVKQRILHTLLASGEDALDFTQESEPSYISDVGPPGRSSLDNIEMAYARQIYIYNEKIVNGHLQPNLVDLCASVAELDDKSISDMWTMVKQMTDVLLTPATDALKNRSSVEVRMEFVRQALAYLEQSYKNYTLVTVFGNLHQAQLGGVPGTYQLVRSFLNIKLPAPLPGLQDGEVEGHPVWALIYYCMRCGDLLAASQVVNRAQHQLGEFKTWFQEYMNSKDRRLSPATENKLRLHYRRALRNNTDPYKRAVYCIIGRCDVTDNQSEVADKTEDYLWLKLNQVCFDDDGTSSPQDRLTLSQFQKQLLEDYGESHFTVNQQPFLYFQVLFLTAQFEAAVAFLFRMERLRCHAVHVALVLFELKLLLKSSGQSAQLLSHEPGDPPCLRRLNFVRLLMLYTRKFESTDPREALQYFYFLRDEKDSQGENMFLRCVSELVIESREFDMILGKLENDGSRKPGVIDKFTSDTKPIINKVASVAENKGLFEEAAKLYDLAKNADKVLELMNKLLSPVVPQISAPQSNKERLKNMALSIAERYRAQGISANKFVDSTFYLLLDLITFFDEYHSGHIDRAFDIIERLKLVPLNQESVEERVAAFRNFSDEIRHNLSEVLLATMNILFTQFKRLKGTSPSSSSRPQRVIEDRDSGLALLPRLECNDTISAHCNLYLLGSSHPPTSPSQVAGTTATPKSSPHSDYLCWNDTIPNVWGHQCEAGADGGPHELSAMLCGSLGRHTVSTSGTWAH

SEQ ID NO: 32704 - protein, 125 aa, Homo sapiens
  ENSP00000454587
MAEEYHRESMLVEWEQVKQRILHTLLASGEDALDFTQESEPSYISDVGPPGRSSLDNIEMAYARQIYIYNEKIVNGHLQPNLVDLCASVAELDDKSISDMWTMVKQMTDVLLTPATDALKNRSSV

SEQ ID NO: 32705 - protein, 136 aa, Homo sapiens
  ENSP00000457902
MDTEGFGELLQQAEQLAAETEGISELPHVERNLQEIQQAGERLRSRTLTRTSQETADVKASVLLGSRGLDISHISQRLESLSAATTFEPLEPVKDTDIQGFLKNEKDNALLSAIEESRKRTFGMAEEYHRESMLVE

SEQ ID NO: 32706 - protein, 178 aa, Homo sapiens
  ENSP00000454285
MDTEGFGELLQQAEQLAAETEGISELPHVERNLQEIQQAGERLRSRTLTRTSQETADVKASVLLGSRGLDISHISQRLESLSAATTFEPLEPVKDTDIQGFLKNEKDNALLSAIEESRKRTFGMAEEYHRESMLVEWEQVKQRILHTLLASGEDALDFTQESEPSYISDVGPPGRSSL

SEQ ID NO: 32707 - protein, 132 aa, Homo sapiens
  ENSP00000454935
  MOD_RES (1)..(1): Any amino acid
XEIQQAGERLRSRTLTRTSQETADVKASVLLGSRGLDISHISQRLESLSAATTFEPLEPVKDTDIQGFLKNEKDNALLSAIEESRKRTFGMAEEYHRESMLVEWEQVKQRILHTLLASGEDALDFTQESEVA

SEQ ID NO: 32708 - protein, 696 aa, Homo sapiens
  ENSP00000458039
MAEEYHRESMLVEWEQVKQRILHTLLASGEDALDFTQESEPSYISDVGPPGRSSLDNIEMAYARQIYIYNEKIVNGHLQPNLVDLCASVAELDDKSISDMWTMVKQMTDVLLTPATDALKNRSSVEVRMEFVRQALAYLEQSYKNYTLVTVFGNLHQAQLGGVPGTYQLVRSFLNIKLPAPLPGLQDGEVEGHPVWALIYYCMRCGDLLAASQVVNRAQHQLGEFKTWFQEYMNSKDRRLSPATENKLRLHYRRALRNNTDPYKRAVYCIIGRCDVTDNQSEVADKTEDYLWLKLNQVCFDDDGTSSPQDRLTLSQFQKQLLEDYGESHFTVNQQPFLYFQVLFLTAQFEAAVAFLFRMERLRCHAVHVALVLFELKLLLKSSGQSAQLLSHEPGDPPCLRRLNFVRLLMLYTRKFESTDPREALQYFYFLRDEKDSQGENMFLRCVSELVIESREFDMILGKLENDGSRKPGVIDKFTSDTKPIINKVASVAENKGLFEEAAKLYDLAKNADKVLELMNKLLSPVVPQISAPQSNKERLKNMALSIAERYRAQGISANKFVDSTFYLLLDLITFFDEYHSGHIDRAFDIIERLKLVPLNQESVEERVAAFRNFSDEIRHNLSEVLLATMNILFTQFKRLKGTSPSSSSRPQRVIEDRDSQLRSQARTLITFAGMIPYRTSGDTNARLVQMEVLMN

SEQ ID NO: 32709 - protein, 156 aa, Homo sapiens
  ENSP00000455210
MAEEYHRESMLVEWEQVKQRILHTLLASGEDALDFTQESEPSYISDVGPPGRSSLDNIEMAYARQIYIYNEKIVNGHLQPNLVDLCASVAELDDKSISDMWTMVKQMTDVLLTPATDALKNRSSVEVRMEFVRQALAYLEQSYKNYTLVTVFGNLH

SEQ ID NO: 32710 - protein, 40 aa, Homo sapiens
  ENSP00000454844
MAEEYHRESMLVEWEQVKQRILHTLLASGEDALDFTQESE

SEQ ID NO: 32711 - protein, 16 aa, Homo sapiens
  ENSP00000455181
MAEEYHRESMLVEWEQ

SEQ ID NO: 32712 - protein, 696 aa, Homo sapiens; identical to SEQ ID NO: 32708
  ENSP00000440235

SEQ ID NO: 32713 - protein, 117 aa, Homo sapiens
  ENSP00000458078
SDTKPIINKVASVAENKGLFEEAAKLYDLAKNADKVLELMNKLLSPVVPQISAPQSNKERLKNMALSIAERYRAQGISANKFVDSTFYLLLDLITFFDEYHSGHIDRAFDVSFRKGV

SEQ ID NO: 32714 - protein, 140 aa, Homo sapiens
  ENSP00000456196
  MOD_RES (1)..(1): Any amino acid
XELMNKLLSPVVPQISAPQSNKERLKNMALSIAERYRAQGISANKFVDSTFYLLLDLITFFDEYHSGHIDRAFDIIERLKLVPLNQESVEERVAAFRNFSDEVSSFFLSCGIPFSPLPPKAFSFPVPNSFKNSSYSNYPD

SEQ ID NO: 32715 - protein, 84 aa, Homo sapiens
  ENSP00000457907
LDLITFFDEYHSGHIDRAFDIIERLKLVPLNQESVEERVAAFRNFSDEQLRSQARTLITFAGMIPYRTSGDTNARLVQMEVLMN

SEQ ID NO: 32716 - protein, 179 aa, Homo sapiens
  ENSP00000428224
MQRGKPCRALPTLKCQTFCQRHGLMFEVVDLRWGIRNIEATDHLTTELCLEEVDRCWKTSIGPAFVALIGDQYGPCLIPSRIDEKEWEVLRDHLTARPSDLELVARYFQRDENAFPPTYVLQAPGTGEACEPEEATLTSVLRSGAQEARRLGLITQEQWQHYHRSGEAAGTPLWRPTRN

SEQ ID NO: 32717 - protein, 1432 aa, Homo sapiens
  ENSP00000428579
MQRGKPCRALPTLKCQTFCQRHGLMFEVVDLRWGIRNIEATDHLTTELCLEEVDRCWKTSIGPAFVALIGDQYGPCLIPSRIDEKEWEVLRDHLTARPSDLELVARYFQRDENAFPPTYVLQAPGTGEACEPEEATLTSVLRSGAQEARRLGLITQEQWQHYHRSVIEWEIERSLLSSEDREQGATVFLREIQDLHKHILEDCALRMVDRLADGCLDADAQNLLSSLKSHITDMHPGVLKTHRLPWSRDLVNPKNKTHACYLKELGEQFVVRANHQVLTRLRELDTAGQELAWLYQEIRHHLWQSSEVIQTFCGRQELLARLGQQLRHDDSKQHTPLVLFGPPGIGKTALMCKLAEQMPRLLGHKTVTVLRLLGTSQMSSDARGLLKSICFQVCLAYGLPLPPAQVLDAHTRVVQFFHTLLHTVSCRNFESLVLLLDAMDDLDSVRHARRVPWLPLNCPPRVHLILSACSGALGVLDTLQRVLLDPEAYWEVKPLSGNQGQQMIQLLLAAARRTLSPVHTDLLWASLPECGNPGRLRLAFEEARKWASFTVPVPLATTAEEATHQLCTRLEQTHGQLLVAHVLGYIVSSRHGLSEAELKDVLSLDDEVLQDVYRDWTPPSKELLRFPPLLWVRLRRDLGYYLARRPVDGFTLLAIAHRQLVEVVRERYLSGSERAKRHGVLADFFSGTWSQGTKKLITLPLVGKPLNLDRKVAPQPLWFSHTVANLRKLKELPYHLLHSGRLEELKQEVLGSMSWISCRGISGGIEDLLDDFDLCAPHLDSPEVGLVREALQLCRPAVELRGMERSLLYTELLARLHFFATSHPALVGQLCQQAQSWFQLCAHPVLVPLGGFLQPPGGPLRATLSGCHKGITAMAWGVEEKLLVIGTQDGIMAVWDMEEQHVIHMLTGHTGEVRCVKIFAKGTLANSASKDYTLHLWNLLSGQEKFTIWDGGSKNPAEPQIWNLHVDEAHKVVYSASGSKINAWNLETAEPVFHILGDASDPWMCMAVLASQATLLTVSRDGVVSLWSSATGKLQGKQHMSSIKEETPTCAVSVQKQGKLVTGFSNGSISLVSSKGDRLLEKLPDAVRFLVVSEDESLLAAGFGRSVRIFLADSRGFRRFMAMDLEHEDMVETAVFGTENNLIITGSLDALIQVWSLSEQGTLLDILEGVGAPVSLLARGGALVASASPQSSSFKVWDLSDAHRSRVPAPFLDRTGLTAVSHNGSYVYFPKIGDKNKVTIWDLAEGEEQDSLDTSSEIRCLEVAEQRKLLFTGLVSGVVLVFPLNSRQDVICIPPPEARKAINCMSLSKCEDRLAIAYDNIVLVLDITSGDPCPVIDGPRYTFYTQLPETLSSVAILTDYRVVYSMTNGDLFLYECATSKAFPLETHRSRVACVEVSHKEQLVVSGSEDALLCLWDLQARKWKFEMSYTAPC

SEQ ID NO: 32718 - protein, 1522 aa, Homo sapiens
  ENSP00000447548
MQRGKPCRALPTLKCQTFCQRHGLMFEVVDLRWGIRNIEATDHLTTELCLEEVDRCWKTSIGPAFVALIGDQYGPCLIPSRIDEKEWEVLRDHLTARPSDLELVARYFQRDENAFPPTYVLQAPGTGEACEPEEATLTSVLRSGAQEARRLGLITQEQWQHYHRSVIEWEIERSLLSSEDREQGATVFLREIQDLHKHILEDCALRMVDRLADGCLDADAQNLLSSLKSHITDMHPGVLKTHRLPWSRDLVNPKNKTHACYLKELGEQFVVRANHQVLTRLRELDTAGQELAWLYQEIRHHLWQSSEVIQTFCGRQELLARLGQQLRHDDSKQHTPLVLFGPPGIGKTALMCKLAEQMPRLLGHKTVTVLRLLGTSQMSSDARGLLKSICFQVCLAYGLPLPPAQVLDAHTRVVQFFHTLLHTVSCRNFESLVLLLDAMDDLDSVRHARRVPWLPLNCPPRVHLILSACSGALGVLDTLQRVLLDPEAYWEVKPLSGNQGQQMIQLLLAAARRTLSPVHTDLLWASLPECGNPGRLRLAFEEARKWASFTVPVPLATTAEEATHQLCTRLEQTHGQLLVAHVLGYIVSSRHGLSEAELKDVLSLDDEVLQDVYRDWTPPSKELLRFPPLLWVRLRRDLGYYLARRPVDGFTLLAIAHRQLVEVVRERYLSGSERAKRHGVLADFFSGTWSQGTKKLITLPLVGKPLNLDRKVAPQPLWFSHTVANLRKLKELPYHLLHSGRLEELKQEVLGSMSWISCRGISGGIEDLLDDFDLCAPHLDSPEVGLVREALQLCRPAVELRGMERSLLYTELLARLHFFATSHPALVGQLCQQAQSWFQLCAHPVLVPLGGFLQPPGGPLRATLSGCHKGITAMAWGVEEKLLVIGTQDGIMAVWDMEEQHVIHMLTGHTGEVRCVKIFAKGTLANSASKDYTLHLWNLLSGQEKFTIWDGGSKNPAEPQIWNLHVDEAHKVVYSASGSKINAWNLETAEPVFHILGDASDPWMCMAVLASQATLLTVSRDGVVSLWSSATGKLQGKQHMSSIKEETPTCAVSVQKQGKLVTGFSNGSISLVSSKGDRLLEKLPDAVRFLVVSEDESLLAAGFGRSVRIFLADSRGFRRFMAMDLEHEDMVETAVFGTENNLIITGSLDALIQVWDLSDAHRSRVPAPFLDRTGLTAVSHNGSYVYFPKIGDKNKVTIWDLAEGEEQDSLDTSSEIRCLEVAEQRKLLFTGLVSGVVLVFPLNSRQDVICIPPPEARKAINCMSLSKCEDRLAIAYDNIVLVLDITSGDPCPVIDGPRYTFYTQLPETLSSVAILTDYRVVYSMTNGDLFLYECATSKAFPLETHRSRVACVEVSHKEQLVVSGSEDALLCLWDLQARKWKFEMSYTSSYCRGVQCACFSKDDKYVYVGLKDRSILVWSVLDGTLLTVQFVHAVVNRIIPTTSGFIAPTRHGYLIRENFQCLSAKASPQDPLKNFKKAMWMVKSRQREELVAAAGAPQDLESESAQGNETKSNKCSQVCLIV

SEQ ID NO: 32719 - protein, 76 aa, Homo sapiens
  ENSP00000400248
MQRGKPCRALPTLKCQTFCQRHGLMFEVVDLRWGIRNIEATDHLTTELCLEEVDRCWKTSIGPAFVEKCADPCPGQ

SEQ ID NO: 32720 - protein, 1564 aa, Homo sapiens
  ENSP00000447224
MQRGKPCRALPTLKCQTFCQRHGLMFEVVDLRWGIRNIEATDHLTTELCLEEVDRCWKTSIGPAFVALIGDQYGPCLIPSRIDEKEWEVLRDHLTARPSDLELVARYFQRDENAFPPTYVLQAPGTGEACEPEEATLTSVLRSGAQEARRLGLITQEQWQHYHRSVIEWEIERSLLSSEDREQGATVFLREIQDLHKHILEDCALRMVDRLADGCLDADAQNLLSSLKSHITDMHPGVLKTHRLPWSRDLVNPKNKTHACYLKELGEQFVVRANHQVLTRLRELDTAGQELAWLYQEIRHHLWQSSEVIQTFCGRQELLARLGQQLRHDDSKQHTPLVLFGPPGIGKTALMCKLAEQMPRLLGHKTVTVLRLLGTSQMSSDARGLLKSICFQVCLAYGLPLPPAQVLDAHTRVVQFFHTLLHTVSCRNFESLVLLLDAMDDLDSVRHARRVPWLPLNCPPRVHLILSACSGALGVLDTLQRVLLDPEAYWEVKPLSGNQGQQMIQLLLAAARRTLSPVHTDLLWASLPECGNPGRLRLAFEEARKWASFTVPVPLATTAEEATHQLCTRLEQTHGQLLVAHVLGYIVSSRHGLSEAELKDVLSLDDEVLQDVYRDWTPPSKELLRFPPLLWVRLRRDLGYYLARRPVDGFTLLAIAHRQLVEVVRERYLSGSERAKRHGVLADFFSGTWSQGTKKLITLPLVGKPLNLDRKVAPQPLWFSHTVANLRKLKELPYHLLHSGRLEELKQEVLGSMSWISCRGISGGIEDLLDDFDLCAPHLDSPEVGLVREALQLCRPAVELRGMERSLLYTELLARLHFFATSHPALVGQLCQQAQSWFQLCAHPVLVPLGGFLQPPGGPLRATLSGCHKGITAMAWGVEEKLLVIGTQDGIMAVWDMEEQHVIHMLTGHTGEVRCVKIFAKGTLANSASKDYTLHLWNLLSGQEKFTIWDGGSKNPAEPQIWNLHVDEAHKVVYSASGSKINAWNLETAEPVFHILGDASDPWMCMAVLASQATLLTVSRDGVVSLWSSATGKLQGKQHMSSIKEETPTCAVSVQKQGKLVTGFSNGSISLVSSKGDRLLEKLPDAVRFLVVSEDESLLAAGFGRSVRIFLADSRGFRRFMAMDLEHEDMVETAVFGTENNLIITGSLDALIQVWSLSEQGTLLDILEGVGAPVSLLARGGALVASASPQSSSFKVWDLSDAHRSRVPAPFLDRTGLTAVSHNGSYVYFPKIGDKNKVTIWDLAEGEEQDSLDTSSEIRCLEVAEQRKLLFTGLVSGVVLVFPLNSRQDVICIPPPEARKAINCMSLSKCEDRLAIAYDNIVLVLDITSGDPCPVIDGPRYTFYTQLPETLSSVAILTDYRVVYSMTNGDLFLYECATSKAFPLETHRSRVACVEVSHKEQLVVSGSEDALLCLWDLQARKWKFEMSYTSSYCRGVQCACFSKDDKYVYVGLKDRSILVWSVLDGTLLTVQFVHAVVNRIIPTTSGFIAPTRHGYLIRENFQCLSAKASPQDPLKNFKKAMWMVKSRQREELVAAAGAPQDLESESAQGNETKSNKCSQVCLIV

SEQ ID NO: 32721 - protein, 1432 aa, Homo sapiens; identical to SEQ ID NO: 32717
  ENSP00000369136

SEQ ID NO: 32722 - protein, 120 aa, Homo sapiens
  ENSP00000486232
MSGFLEELLGEKLVTGGGEEVDVHSLGARGISLLGLYFGCSLSAPCAQLSASLAAFYGRLRGDAAAGPGPGAGAGAAAEPEPRRRLEIVFVSSDQDQRQWQDFVRDMPWLALPYKEKHRK

SEQ ID NO: 32723 - protein, 327 aa, Homo sapiens
  ENSP00000461038
MADVSLHRNPATLKLWNKYRISNIPSLIFLDATTGKVVCRNGLLVIRDDPEGLEFPWGPKPFREVIAGPLLRNNGQSLESSSLEGSHVGVYFSAHWCPPCRSLTRVLVESYRKIKEAGQNFEIIFVSADRSEESFKQYFSEMPWLAVPYTDEARRSRLNRLYGIQGIPTLIMLDPQGEVITRQGRVEVLNDEDCREFPWHPKPVLELSDSNAAQLNEGPCLVLFVDSEDDGESEAAKQLIQPIAEKIIAKYKAKEEEAPLLFFVAGEDDMTDSLRDYTNLPEAAPLLTILDMSARAKYVMDVEEITPAIVEAFVNDFLAEKLKPEPI

SEQ ID NO: 32724 - protein, 435 aa, Homo sapiens
  ENSP00000337443
MSGFLEELLGEKLVTGGGEEVDVHSLGARGISLLGLYFGCSLSAPCAQLSASLAAFYGRLRGDAAAGPGPGAGAGAAAEPEPRRRLEIVFVSSDQDQRQWQDFVRDMPWLALPYKEKHRKLKLWNKYRISNIPSLIFLDATTGKVVCRNGLLVIRDDPEGLEFPWGPKPFREVIAGPLLRNNGQSLESSSLEGSHVGVYFSAHWCPPCRSLTRVLVESYRKIKEAGQNFEIIFVSADRSEESFKQYFSEMPWLAVPYTDEARRSRLNRLYGIQGIPTLIMLDPQGEVITRQGRVEVLNDEDCREFPWHPKPVLELSDSNAAQLNEGPCLVLFVDSEDDGESEAAKQLIQPIAEKIIAKYKAKEEEAPLLFFVAGEDDMTDSLRDYTNLPEAAPLLTILDMSARAKYVMDVEEITPAIVEAFVNDFLAEKLKPEPI

SEQ ID NO: 32725 - protein, 230 aa, Homo sapiens
  ENSP00000461562
  MOD_RES (1)..(1): Any amino acid
XCRNGLLVIRDDPEGLEFPWGPKPFREVIAGPLLRNNGQSLESSSLEGSHVGVYFSAHWCPPCRSLTRVLVESYRKIKEAGQNFEIIFVSADRSEESFKQYFSEMPWLAVPYTDEARRSRLNRLYGIQDSEDDGESEAAKQLIQPIAEKIIAKYKAKEEEAPLLFFVAGEDDMTDSLRDYTNLPEAAPLLTILDMSARAKYVMDVEEITPAIVEAFVNDFLAEKLKPEPI

SEQ ID NO: 32726 - protein, 186 aa, Homo sapiens
  ENSP00000446446
MPWLAVPYTDEARRSRLNRLYGIQGIPTLIMLDPQGEVITRQGRVEVLNDEDCREFPWHPKPVLELSDSNAAQLNEGPCLVLFVDSEDDGESEAAKQLIQPIAEKIIAKYKAKEEEAPLLFFVAGEDDMTDSLRDYTNLPEAAPLLTILDMSARAKYVMDVEEITPAIVEAFVNDFLAEKLKPEPI

SEQ ID NO: 32727 - protein, 120 aa, Homo sapiens; identical to SEQ ID NO: 32722
  ENSP00000485936

SEQ ID NO: 32728 - protein, 135 aa, Homo sapiens
  ENSP00000365015
MVDILGERHLVTCKGATVEAEAALQNKVVALYFAAARCAPSRDFTPLLCDFYTALVAEARRPAPFEVVFVSADGSSQEMLDFMRELHGAWLALPFHDPYRQRSLALLPRLECSGVILAHCNLCLLGSSDSLALAS

SEQ ID NO: 32729 - protein, 156 aa, Homo sapiens
  ENSP00000365014
MVDILGERHLVTCKGATVEAEAALQNKVVALYFAAARCAPSRDFTPLLCDFYTALVAEARRPAPFEVVFVSADGSSQEMLDFMRELHGAWLALPFHDPYRHELRKRYNVTAIPKLVIVKQNGEVITNKGRKQIRERGLACFQDWVEAADIFQNFSV

SEQ ID NO: 32730 - protein, 135 aa, Homo sapiens [sequence omitted]

SEQ ID NO: 32731 - protein, 3 aa, Homo sapiens
  ENSP00000418381
MWT

SEQ ID NO: 32732 - protein, 559 aa, Homo sapiens
  ENSP00000273347
MWTNFFKLRLFCCLLAVLMVVVLVINVTQVEYLDHETVSATFIDSSGQFVSSQVTGISRNPYCGYDQQTLSSQERMEEDSLLAALHRQVPDVGPVPFVKSTDPSSSYFVILNSAAFFKVGSQLEVLVHVQDFQRKPKKYGGDYLQARIHSLKLQAGAVGRVVDYQNGFYKVFFTLLWPGKVKVSVSLVHPSEGIRVLQRLQEDKPDRVYFKSLFRSGRISETTECNVCLPGNLPLCNFTDLYTGEPWFCFKPKKLPCSSRITHFKGGYLKGLLTAAESAFFQSGVNIKMPVNSSGPDWVTVIPRRIKETNSLELSQGSGTFPSGYYYKDQWRPRKFKMRQFNDPDNITECLQRKVVHLFGDSTIRQWFEYLTTFVPDLVEFNLGSPKNVGPFLAVDQKHNILLKYRCHGPPIRFTTVFSNELHYVANELNGIVGGKNTVVAIAVWSHFSTFPLEVYIRRLRNIRRAVVRLLDRSPKTVVVIRTANAQELGPEVSLFNSDWYNFQLDTILRRMFSGVGVYLVDAWEMTLAHYLPHKLHPDEVIVKNQLDMFLSFVCPLET

SEQ ID NO: 32733 - protein, 53 aa, Homo sapiens
  ENSP00000419667
MWTNFFKLRLFCCLLAVLMVVVLVINVTQVEYLDHETVSATFIDSSGQFVSSQ

SEQ ID NO: 32734 - protein, 559 aa, Homo sapiens; identical to SEQ ID NO: 32732
  ENSP00000417485

SEQ ID NO: 32735 - protein, 559 aa, Homo sapiens; identical to SEQ ID NO: 32732
  ENSP00000418369

SEQ ID NO: 32736 - protein, 89 aa, Homo sapiens
  ENSP00000478069
MPVNSSGPDWVTVIPRRIKETNSLELSQGSGTFPSGYYYKDQWRPRKFKMRQFNDPTTLQSAYKEKWCIYLVTQQSGNGLNTLLHLFQI

SEQ ID NO: 32737 - protein, 653 aa, Homo sapiens
  ENSP00000490942
MISSKMMSSNPEEDPLDTFLQYIEDMGMKAYDGLVIQNASDIARENDRLRNETNLAYLKEKNEKRRRQEEAIKRIGGEVGRGHEGSYVGKHFRMGFMTMPAPQDRLPHPCSSGFSVRSQSLHSVGGTDDDSSCGSRRQPPPKPKRDPSTKLSTSSETVSSTAASKSGKTPERTEASAKPRPHSDEYSKKIPPPKPKRNPNTQLSTSFDETYIKKHGPRRTSLPRDSSLSQMGSPAGDPEEEEPVYIEMVGNILRDFRKEDDDQSEAVYEEMKYPIFDDLGQDAKCDFDHHSCSSQCATPTVPDLDFAKASVPCPPKGLLCDIPPPFPNLLSHRPPLLVFPPAPVHCSPNSDESPLTPLEVTKLPVLENVSYMKQPAGASPSTLPSHVPGHAKLEKEQAAALGPASATPALSSSPPPPSTLYRTQSPHGYPKSHSTSPSPVSMGRSLTPLSLKRPPPYDAVHSGSLSRSSPSVPHSTPRPVSQDGAKMVNAAVNTYGAAPGGSRSRTPTSPLEELTSLFSSGRSLLRKSSSGRRSKEPAEKSTEELKVRSHSTEPLPKLDNKERGHHGASSSREPVKAQEWDGTPGTPVVTSRLGRCSVSPTLLAGNHSSEPKVSCKLGRSASTSGVPPPSVTPLRQSSDLQQSQVPSSLANRD

SEQ ID NO: 32738 - protein, 653 aa, Homo sapiens; identical to SEQ ID NO: 32737
  ENSP00000272907

SEQ ID NO: 32739 - protein, 481 aa, Homo sapiens
  ENSP00000340328
MKGRGMLVLLLHAVVLGLPSAWAVGACARACPAACACSTVERGCSVRCDRAGLLRVPAELPCEAVSIDLDRNGLRFLGERAFGTLPSLRRLSLRHNNLSFITPGAFKGLPRLAELRLAHNGDLRYLHARTFAALSRLRRLDLAACRLFSVPERLLAELPALRELAAFDNLFRRVPGALRGLANLTHAHLERGRIEAVASSSLQGLRRLRSLSLQANRVRAVHAGAFGDCGVLEHLLLNDNLLAELPADAFRGLRRLRTLNLGGNALDRVARAWFADLAELELLYLDRNSIAFVEEGAFQNLSGLLALHLNGNRLTVLAWVAFQPGFFLGRLFLFRNPWCCDCRLEWLRDWMEGSGRVTDVPCASPGSVAGLDLSQVTFGRSSDGLCVDPEELNLTTSSPGPSPEPAATTVSRFSSLLSKLLAPRVPVEEAANTTGGLANASLSDSLSSRGVGGAGRQPWFLLASCLLPSVAQHVVFGLQMD

SEQ ID NO: 32740 - protein, 481 aa, Homo sapiens; identical to SEQ ID NO: 32739
  ENSP00000367465

SEQ ID NO: 32741 - protein, 439 aa, Homo sapiens
  ENSP00000357838
MFSKLAHLQRFAVLSRGVHSSVASATSVATKKTVQGPPTSDDIFEREYKYGAHNYHPLPVALERGKGIYLWDVEGRKYFDFLSSYSAVNQGHCHPKIVNALKSQVDKLTLTSRAFYNNVLGEYEEYITKLFNYHKVLPMNTGVEAGETACKLARKWGYTVKGIQKYKAKIVFAAGNFWGRTLSAISSSTDPTSYDGFGPFMPGFDIIPYNDLPALERALQDPNVAAFMVEPIQGEAGVVVPDPGYLMGVRELCTRHQVLFIADEIQTGLARTGRWLAVDYENVRPDIVLLGKALSGGLYPVSAVLCDDDIMLTIKPGEHGSTYGGNPLGCRVAIAALEVLEEENLAENADKLGIILRNELMKLPSDVVTAVRGKGLLNAIVIKETKDWDAWKVCLRLRDNGLLAKPTHGDIIRFAPPLVIKEDELRESIEIINKTILSF

SEQ ID NO: 32742 - protein, 301 aa, Homo sapiens
  ENSP00000439042
MNTGVEAGETACKLARKWGYTVKGIQKYKAKIVFAAGNFWGRTLSAISSSTDPTSYDGFGPFMPGFDIIPYNDLPALERALQDPNVAAFMVEPIQGEAGVVVPDPGYLMGVRELCTRHQVLFIADEIQTGLARTGRWLAVDYENVRPDIVLLGKALSGGLYPVSAVLCDDDIMLTIKPGEHGSTYGGNPLGCRVAIAALEVLEEENLAENADKLGIILRNELMKLPSDVVTAVRGKGLLNAIVIKETKDWDAWKVCLRLRDNGLLAKPTHGDIIRFAPPLVIKEDELRESIEIINKTILSF

SEQ ID NO: 32743 - protein, 1010 aa, Homo sapiens
  ENSP00000363216
MSQLRLLPSRLGVQAARLLAAHDVPVFGWRSRSSGPPATFPSSKGGGGSSYMEEMYFAWLENPQSVHKSWDSFFREASEEAFSGSAQPRPPSVVHESRSAVSSRTKTSKLVEDHLAVQSLIRAYQIRGHHVAQLDPLGILDADLDSFVPSDLITTIDKLAFYDLQEADLDKEFQLPTTTFIGGSENTLSLREIIRRLENTYCQHIGLEFMFINDVEQCQWIRQKFETPGVMQFSSEEKRTLLARLVRSMRFEDFLARKWSSEKRFGLEGCEVMIPALKTIIDKSSEMGIENVILGMPHRGRLNVLANVIRKDLEQIFCQFDPKLEAADEGSGDVKYHLGMYHERINRVTNRNITLSLVANPSHLEAVDPVVQGKTKAEQFYRGDAQGKKVMSILVHGDAAFAGQGVVYETFHLSDLPSYTTNGTVHVVVNNQIGFTTDPRMARSSPYPTDVARVVNAPIFHVNADDPEAVIYVCSVAAEWRNTFNKDVVVDLVCYRRRGHNEMDEPMFTQPLMYKQIHRQVPVLKKYADKLIAEGTVTLQEFEEEIAKYDRICEEAYGRSKDKKILHIKHWLDSPWPGFFNVDGEPKSMTCPATGIPEDMLTHIGSVASSVPLEDFKIHTGLSRILRGRADMTKNRTVDWALAEYMAFGSLLKEGIHVRLSGQDVERGTFSHRHHVLHDQEVDRRTCVPMNHLWPDQAPYTVCNSSLSEYGVLGFELGYAMASPNALVLWEAQFGDFHNTAQCIIDQFISTGQAKWVRHNGIVLLLPHGMEGMGPEHSSARPERFLQMSNDDSDAYPAFTKDFEVSQLYDCNWIVVNCSTPANYFHVLRRQILLPFRKPLIIFTPKSLLRHPEAKSSFDQMVSGTSFQRVIPEDGAAARAPEQVQRLIFCTGKVYYDLVKERSSQDLEEKVAITRLEQISPFPFDLIKQEAEKYPGAELAWCQEEHKNMGYYDYISPRFMTILRRARPIWYVGRDPAAAPATGNRNTHLVSLKKFLDTAFNLQAFEGKTF

SEQ ID NO: 32744 - protein, 953 aa, Homo sapiens
  ENSP00000401356
MSQLRLLPSRLGVQAARLLAAHDVPVFGWRSRSSGPPATFPSSKGGGGSSYMEEMYFAWLENPQSVHKIRGHHVAQLDPLGILDADLDSFVPSDLITTIDKLAFYDLQEADLDKEFQLPTTTFIGGSENTLSLREIIRRLENTYCQHIGLEFMFINDVEQCQWIRQKFETPGVMQFSSEEKRTLLARLVRSMRFEDFLARKWSSEKRFGLEGCEVMIPALKTIIDKSSEMGIENVILGMPHRGRLNVLANVIRKDLEQIFCQFDPKLEAADEGSGDVKYHLGMYHERINRVTNRNITLSLVANPSHLEAVDPVVQGKTKAEQFYRGDAQGKKVMSILVHGDAAFAGQGVVYETFHLSDLPSYTTNGTVHVVVNNQIGFTTDPRMARSSPYPTDVARVVNAPIFHVNADDPEAVIYVCSVAAEWRNTFNKDVVVDLVCYRRRGHNEMDEPMFTQPLMYKQIHRQVPVLKKYADKLIAEGTVTLQEFEEEIAKYDRICEEAYGRSKDKKILHIKHWLDSPWPGFFNVDGEPKSMTCPATGIPEDMLTHIGSVASSVPLEDFKIHTGLSRILRGRADMTKNRTVDWALAEYMAFGSLLKEGIHVRLSGQDVERGTFSHRHHVLHDQEVDRRTCVPMNHLWPDQAPYTVCNSSLSEYGVLGFELGYAMASPNALVLWEAQFGDFHNTAQCIIDQFISTGQAKWVRHNGIVLLLPHGMEGMGPEHSSARPERFLQMSNDDSDAYPAFTKDFEVSQLYDCNWIVVNCSTPANYFHVLRRQILLPFRKPLIIFTPKSLLRHPEAKSSFDQMVSGTSFQRVIPEDGAAARAPEQVQRLIFCTGKVYYDLVKERSSQDLEEKVAITRLEQISPFPFDLIKQEAEKYPGAELAWCQEEHKNMGYYDYISPRFMTILRRARPIWYVGRDPAAAPATGNRNTHLVSLKKFLDTAFNLQAFEGKTF

SEQ ID NO: 32745 - protein, 801 aa, Homo sapiens
  ENSP00000390240
MFINDVEQCQWIRQKFETPGVMQFSSEEKRTLLARLVRSMRFEDFLARKWSSEKRFGLEGCEVMIPALKTIIDKSSEMGIENVILGMPHRGRLNVLANVIRKDLEQIFCQFDPKLEAADEGSGDVKYHLGMYHERINRVTNRNITLSLVANPSHLEAVDPVVQGKTKAEQFYRGDAQGKKVMSILVHGDAAFAGQGVVYETFHLSDLPSYTTNGTVHVVVNNQIGFTTDPRMARSSPYPTDVARVVNAPIFHVNADDPEAVIYVCSVAAEWRNTFNKDVVVDLVCYRRRGHNEMDEPMFTQPLMYKQIHRQVPVLKKYADKLIAEGTVTLQEFEEEIAKYDRICEEAYGRSKDKKILHIKHWLDSPWPGFFNVDGEPKSMTCPATGIPEDMLTHIGSVASSVPLEDFKIHTGLSRILRGRADMTKNRTVDWALAEYMAFGSLLKEGIHVRLSGQDVERGTFSHRHHVLHDQEVDRRTCVPMNHLWPDQAPYTVCNSSLSEYGVLGFELGYAMASPNALVLWEAQFGDFHNTAQCIIDQFISTGQAKWVRHNGIVLLLPHGMEGMGPEHSSARPERFLQMSNDDSDAYPAFTKDFEVSQLYDCNWIVVNCSTPANYFHVLRRQILLPFRKPLIIFTPKSLLRHPEAKSSFDQMVSGTSFQRVIPEDGAAARAPEQVQRLIFCTGKVYYDLVKERSSQDLEEKVAITRLEQISPFPFDLIKQEAEKYPGAELAWCQEEHKNMGYYDYISPRFMTILRRARPIWYVGRDPAAAPATGNRNTHLVSLKKFLDTAFNLQAFEGKTF

SEQ ID NO: 32746 - protein, 167 aa, Homo sapiens
  ENSP00000360864
MPGRWRWQRDMHPARKLLSLLFLILMGTELTQNKRENKAEKMGGPESERKTTGEKTLNELPLFCLEAHAGSLALPRMCSPNPNPAVGLCRPAYPQSPSPGAAQTISQSLLERFCMASRRGFLGPRKAWWRVVVVHCCWTDAFIHVHTHTHTCTHRGADTCREEPTRS

SEQ ID NO: 32747 - protein, 135 aa, Homo sapiens
  ENSP00000277415
MPGRWRWQRDMHPARKLLSLLFLILMGTELTQVLPTNPEESWQVYSSAQDSEGRCICTVVAPQQTMCSRDARTKQLRQLLEKVQNMSQSIEVLDRRTQRDLQYVEKMENQMKGLESKFKQVEESHKQHLARQFKG

SEQ ID NO: 32748 - protein, 467 aa, Homo sapiens
  ENSP00000252854
MPGRWRWQRDMHPARKLLSLLFLILMGTELTQVLPTNPEESWQVYSSAQDSEGRCICTVVAPQQTMCSRDARTKQLRQLLEKVQNMSQSIEVLDRRTQRDLQYVEKMENQMKGLESKFKQVEESHKQHLARQFKAIKAKMDELRPLIPVLEEYKADAKLVLQFKEEVQNLTSVLNELQEEIGAYDYDELQSRVSNLEERLRACMQKLACGKLTGISDPVTVKTSGSRFGSWMTDPLAPEGDNRVWYMDGYHNNRFVREYKSMVDFMNTDNFTSHRLPHPWSGTGQVVYNGSIYFNKFQSHIIIRFDLKTETILKTRSLDYAGYNNMYHYAWGGHSDIDLMVDESGLWAVYATNQNAGNIVVSRLDPVSLQTLQTWNTSYPKRSAGEAFIICGTLYVTNGYSGGTKVHYAYQTNASTYEYIDIPFQNKYSHISMLDYNPKDRALYAWNNGHQILYNVTLFHVIRSDEL

SEQ ID NO: 32749 - protein, 129 aa, Homo sapiens
  ENSP00000360866
MPGRWRWQRDMHPARKLLSLLFLILMGTELTQDSAAPDSLLRSSKGSTRGSLAAIVIWRGKSESRIAKTPGIFRGGGTLVLPPTHTPEWLILPLGITLPLGAPETGGGDCAAETWKGSQRAGQLCALLA

SEQ ID NO: 32750 - protein, 163 aa, Homo sapiens
  ENSP00000340318
MEGPGGSGFHLRLEAFCKCKSPINVFDPVRPALQVGLTRVLPTNPEESWQVYSSAQDSEGRCICTVVAPQQTMCSRDARTKQLRQLLEKVQNMSQSIEVLDRRTQRDLQYVEKMENQMKGLESKFKQVEESHKQHLARQFKAIKAKMDELRPLIPVLEEYKAD

SEQ ID NO: 32751 - protein, 458 aa, Homo sapiens
  ENSP00000360861
MGEAPGREGRGPCPQLESPRRRRVLPTNPEESWQVYSSAQDSEGRCICTVVAPQQTMCSRDARTKQLRQLLEKVQNMSQSIEVLDRRTQRDLQYVEKMENQMKGLESKFKQVEESHKQHLARQFKAIKAKMDELRPLIPVLEEYKADAKLVLQFKEEVQNLTSVLNELQEEIGAYDYDELQSRVSNLEERLRACMQKLACGKLTGISDPVTVKTSGSRFGSWMTDPLAPEGDNRVWYMDGYHNNRFVREYKSMVDFMNTDNFTSHRLPHPWSGTGQVVYNGSIYFNKFQSHIIIRFDLKTETILKTRSLDYAGYNNMYHYAWGGHSDIDLMVDESGLWAVYATNQNAGNIVVSRLDPVSLQTLQTWNTSYPKRSAGEAFIICGTLYVTNGYSGGTKVHYAYQTNASTYEYIDIPFQNKYSHISMLDYNPKDRALYAWNNGHQILYNVTLFHVIRSDEL

SEQ ID NO: 32752 - protein, 129 aa, Homo sapiens
  ENSP00000444296
MCSRDARTKQLRQLLEKVQNMSQSIEVLDRRTQRDLQYVEKMENQMKGLESKFKQVEESHKQHLARQFKAIKAKMDELRPLIPVLEEYKADAKLVLQFKEEVQNLTSVLNELQEEIGAYDYDELQSRVS

SEQ ID NO: 32753 - protein, 153 aa, Homo sapiens
  ENSP00000376717
MSVPLLKIGVVLSTMAMITNWMSQTLPSLVGLNTTKLSAAGGGTLDRSTGVLPTNPEESWQVYSSAQDSEGRCICTVVAPQQTMCSRDARTKQLRQLLEKVQNMSQSIEVLDRRTQRDLQYVEKMENQMKGLESKFKQVEESHKQHLARQFKG

SEQ ID NO: 32754 - protein, 485 aa, Homo sapiens
  ENSP00000360858
MSVPLLKIGVVLSTMAMITNWMSQTLPSLVGLNTTKLSAAGGGTLDRSTGVLPTNPEESWQVYSSAQDSEGRCICTVVAPQQTMCSRDARTKQLRQLLEKVQNMSQSIEVLDRRTQRDLQYVEKMENQMKGLESKFKQVEESHKQHLARQFKAIKAKMDELRPLIPVLEEYKADAKLVLQFKEEVQNLTSVLNELQEEIGAYDYDELQSRVSNLEERLRACMQKLACGKLTGISDPVTVKTSGSRFGSWMTDPLAPEGDNRVWYMDGYHNNRFVREYKSMVDFMNTDNFTSHRLPHPWSGTGQVVYNGSIYFNKFQSHIIIRFDLKTETILKTRSLDYAGYNNMYHYAWGGHSDIDLMVDESGLWAVYATNQNAGNIVVSRLDPVSLQTLQTWNTSYPKRSAGEAFIICGTLYVTNGYSGGTKVHYAYQTNASTYEYIDIPFQNKYSHISMLDYNPKDRALYAWNNGHQILYNVTLFHVIRSDEL

SEQ ID NO: 32755 - protein, 208 aa, Homo sapiens
  ENSP00000443806
MSQSIEVLDRRTQRDLQYVEKMENQMKGLESKFKQVEESHKQHLARQFKAIKAKMDELRPLIPVLEEYKADAKLVLQFKEEVQNLTSVLNELQEEIGAYDYDELQSRVSNLEERLRACMQKLACGKLTGISDPVTVKTSGSRFGSWMTDPLAPEGDNRVWYMDGYHNNRFVREYKSMVDFMNTDNFTSHRLPHPWSGTGQVVYNGSIY

SEQ ID NO: 32756 - protein, 99 aa, Homo sapiens
  ENSP00000437906
  MOD_RES (1)..(1): Any amino acid
XSHKQHLARQFKAIKAKMDELRPLIPVLEEYKADAKLVLQFKEEVQNLTSVLNELQEEIGAYDYDELQSRVSNLEERLRACMQKLGVVHGRLSQQPLRT

SEQ ID NO: 32757 - protein, 454 aa, Homo sapiens
  ENSP00000264833
MWPLTVPPPLLLLLCSGLAGQTLFQNPEEGWQLYTSAQAPDGKCICTAVIPAQSTCSRDGRSRELRQLMEKVQNVSQSMEVLELRTYRDLQYVRGMETLMRSLDARLRAADGSLSAKSFQELKDRMTELLPLSSVLEQYKADTRTIVRLREEVRNLSGSLAAIQEEMGAYGYEDLQQRVMALEARLHACAQKLGCGKLTGVSNPITVRAMGSRFGSWMTDTMAPSADSRVWYMDGYYKGRRVLEFRTLGDFIKGQNFIQHLLPQPWAGTGHVVYNGSLFYNKYQSNVVVKYHFRSRSVLVQRSLPGAGYNNTFPYSWGGFSDMDFMVDESGLWAVYTTNQNAGNIVVSRLDPHTLEVMRSWDTGYPKRSAGEAFMICGVLYVTNSHLAGAKVYFAYFTNTSSYEYTDVPFHNQYSHISMLDYNPRERALYTWNNGHQVLYNVTLFHVISTSGDP

SEQ ID NO: 32758 - protein, 376 aa, Homo sapiens
  ENSP00000464877
MEVLELRTYRDLQYVRGMETLMRSLDARLRAADGSLSAKSFQELKDRMTELLPLSSVLEQYKADTRTIVRLREEVRNLSGSLAAIQEEMGAYGYEDLQQRVMALEARLHACAQKLGCGKLTGVSNPITVRAMGSRFGSWMTDTMAPSADSRVWYMDGYYKGRRVLEFRTLGDFIKGQNFIQHLLPQPWAGTGHVVYNGSLFYNKYQSNVVVKYHFRSRSVLVQRSLPGAGYNNTFPYSWGGFSDMDFMVDESGLWAVYTTNQNAGNIVVSRLDPHTLEVMRSWDTGYPKRSAGEAFMICGVLYVTNSHLAGAKVYFAYFTNTSSYEYTDVPFHNQYSHISMLDYNPRERALYTWNNGHQVLYNVTLFHVISTSGDP

SEQ ID NO: 32759 - protein, 78 aa, Homo sapiens
  ENSP00000466018
MEVLELRTYRDLQYVRGMETLMRSLDARLRAADGSLSAKSFQELKDRMTELLPLSSVLEQYKADTRTIVRLREEAVGS

SEQ ID NO: 32760 - protein, 335 aa, Homo sapiens
  ENSP00000465809
MSVPLLKIGAVLSTMAMVTNWMSQTLPSLVGLNGTVSRAGASEKITLFQNPEEGWQLYTSAQAPDGKCICTAVIPAQSTCSRDGRSRELRQLMEKVQNVSQSMEVLELRTYRDLQYVRGMETLMRSLDARLRAADGSLSAKSFQELKDRMTELLPLSSVLEQYKADTRTIVRLREEVRNLSGSLAAIQEEMGAYGYEDLQQRVMALEARLHACAQKLGCGKLTGVSNPITVRAMGSRFGSWMTDTMAPSADSRVWYMDGYYKGRRVLEFRTLGDFIKGQNFIQHLLPQPWAGTGHVVYNGSLFYNKYQSNVVVKYHFRSRSVLVQRSLPGAGYNN

SEQ ID NO: 32761 - protein, 478 aa, Homo sapiens
  ENSP00000345192
MSPPLLKLGAVLSTMAMISNWMSQTLPSLVGLNTTRLSTPDTLTQISPKEGWQVYSSAQDPDGRCICTVVAPEQNLCSRDAKSRQLRQLLEKVQNMSQSIEVLNLRTQRDFQYVLKMETQMKGLKAKFRQIEDDRKTLMTKHFQELKEKMDELLPLIPVLEQYKTDAKLITQFKEEIRNLSAVLTGIQEEIGAYDYEELHQRVLSLETRLRDCMKKLTCGKLMKITGPVTVKTSGTRFGAWMTDPLASEKNNRVWYMDSYTNNKIVREYKSIADFVSGAESRTYNLPFKWAGTNHVVYNGSLYFNKYQSNIIIKYSFDMGRVLAQRSLEYAGFHNVYPYTWGGFSDIDLMADEIGLWAVYATNQNAGNIVISQLNQDTLEVMKSWSTGYPKRSAGESFMICGTLYVTNSHLTGAKVYYSYSTKTSTYEYTDIPFHNQYFHISMLDYNARDRALYAWNNGHQVLFNVTLFHIIKTEDDT

SEQ ID NO: 32762 - protein, 458 aa, Homo sapiens
  ENSP00000359121
MQATSNLLNLLLLSLFAGLDPSKTQISPKEGWQVYSSAQDPDGRCICTVVAPEQNLCSRDAKSRQLRQLLEKVQNMSQSIEVLNLRTQRDFQYVLKMETQMKGLKAKFRQIEDDRKTLMTKHFQELKEKMDELLPLIPVLEQYKTDAKLITQFKEEIRNLSAVLTGIQEEIGAYDYEELHQRVLSLETRLRDCMKKLTCGKLMKITGPVTVKTSGTRFGAWMTDPLASEKNNRVWYMDSYTNNKIVREYKSIADFVSGAESRTYNLPFKWAGTNHVVYNGSLYFNKYQSNIIIKYSFDMGRVLAQRSLEYAGFHNVYPYTWGGFSDIDLMADEIGLWAVYATNQNAGNIVISQLNQDTLEVMKSWSTGYPKRSAGESFMICGTLYVTNSHLTGAKVYYSYSTKTSTYEYTDIPFHNQYFHISMLDYNARDRALYAWNNGHQVLFNVTLFHIIKTEDDT

SEQ ID NO: 32763 - protein, 140 aa, Homo sapiens
  ENSP00000443471
MSQSIEVLNLRTQRDFQYVLKMETQMKGLKAKFRQIEDDRKTLMTKHFQELKEKMDELLPLIPVLEQYKTDAKLITQFKEEIRNLSAVLTGIQEEIGAYDYEELHQRVLSLETRLRDCMKKLIDLKKRKEEEKRQQKGEA

SEQ ID NO: 32764 - protein, 271 aa, Homo sapiens
  ENSP00000371785
MYYAVSQARVNAVPGTMLRPQRPGDLQLGASLYELVGYRQPPSSSSSSTSSTSSTSSSSTTAPLLPKAAREKPEAPAEPPGPGPGSGAHPGGSARPDAKEEQQQQLRRKINSRERKRMQDLNLAMDALREVILPYSAAHCQGAPGRKLSKIATLLLARNYILLLGSSLQELRRALGEGAGPAAPRLLLAGLPLLAAAPGSVLLAPGAVGPPDALRPAKYLSLALDEPPCGQFALPGGGAGGPGLCTCAVCKFPHLVPASLGLAAVQAQFSK

SEQ ID NO: 32765 - protein, 32 aa, Homo sapiens
  ENSP00000414840
  MOD_RES (1)..(1): Any amino acid
XGPGLCTCAVCKFPHLVPASLGLAAVQAQFSK

SEQ ID NO: 32766 - protein, 323 aa, Homo sapiens
  ENSP00000371794
MDSDASLVSSRPSSPEPDDLFLPARSKGSSGSAFTGGTVSSSTPSDCPPELSAELRGAMGSAGAHPGDKLGGSGFKSSSSSTSSSTSSAAASSTKKDKKQMTEPELQQLRLKINSRERKRMHDLNIAMDGLREVMPYAHGPSVRKLSKIATLLLARNYILMLTNSLEEMKRLVSEIYGGHHAGFHPSACGGLAHSAPLPAATAHPAAAAHAAHHPAVHHPILPPAAAAAAAAAAAAAVSSASLPGSGLPSVGSIRPPHGLLKSPSAAAAAPLGGGGGGSGASGGFQHWGGMPCPCSMCQVPPPHHHVSAMGAGSLPRLTSDAK

SEQ ID NO: 32767 - protein, 62 aa, Homo sapiens
  ENSP00000391183
MDSDASLVSSRPSSPEPDDLFLPARSKGSSGSAFTGGTVSSSTPSDCPPELSAELRGAMGSA

SEQ ID NO: 32768 - protein, 323 aa, Homo sapiens; identical to SEQ ID NO: 32766
  ENSP00000331040

SEQ ID NO: 32769 - protein, 323 aa, Homo sapiens; identical to SEQ ID NO: 32766
  ENSP00000371794

SEQ ID NO: 32770 - protein, 62 aa, Homo sapiens; identical to SEQ ID NO: 32767
  ENSP00000391183

SEQ ID NO: 32771 - protein, 323 aa, Homo sapiens; identical to SEQ ID NO: 32766
  ENSP00000331040

SEQ ID NO: 32772 - protein, 465 aa, Homo sapiens
  ENSP00000302630
MNAQLTMEAIGELHGVSHEPVPAPADLLGGSPHARSSVAHRGSHLPPAHPRSMGMASLLDGGSGGGDYHHHHRAPEHSLAGPLHPTMTMACETPPGMSMPTTYTTLTPLQPLPPISTVSDKFPHHHHHHHHHHHPHHHQRLAGNVSGSFTLMRDERGLASMNNLYTPYHKDVAGMGQSLSPLSSSGLGSIHNSQQGLPHYAHPGAAMPTDKMLTPNGFEAHHPAMLGRHGEQHLTPTSAGMVPINGLPPHHPHAHLNAQGHGQLLGTAREPNPSVTGAQVSNGSNSGQMEEINTKEVAQRITTELKRYSIPQAIFAQRVLCRSQGTLSDLLRNPKPWSKLKSGRETFRRMWKWLQEPEFQRMSALRLAACKRKEQEHGKDRGNTPKKPRLVFTDVQRRTLHAIFKENKRPSKELQITISQQLGLELSTVSNFFMNARRRSLDKWQDEGSSNSGNSSSSSSTCTKA

SEQ ID NO: 32773 - protein, 66 aa, Homo sapiens
  ENSP00000453718
MESQKSFIKHAKGKNKNMGRIEATHPKSPGWSSQMSSVELYMQYSRKISVHPKNCKSPFPSSWGWS

SEQ ID NO: 32774 - protein, 182 aa, Homo sapiens
  ENSP00000476168
  MOD_RES (1)..(1): Any amino acid
XLYTPYHKDVAGMGQSLSPLSSSGLGSIHNSQQGLPHYAHPGAAMPTDKMLTPNGFEAHHPAMLGRHGEQHLTPTSAGMVPINGLPPHHPHAHLNAQGHGQLLGTAREPNPSVTGAQAIFAQRVLCRSQGTLSDLLRNPKPWSKLKSGRETFRRMWKWLQEPEFQRMSALRLAGTAREARTA

SEQ ID NO: 32775 - protein, 504 aa, Homo sapiens
  ENSP00000419185
MKAAYTAYRCLTKDLEGCAMNPELTMESLGTLHGPAGGGSGGGGGGGGGGGGGGPGHEQELLASPSPHHAGRGAAGSLRGPPPPPTAHQELGTAAAAAAAASRSAMVTSMASILDGGDYRPELSIPLHHAMSMSCDSSPPGMGMSNTYTTLTPLQPLPPISTVSDKFHHPHPHHHPHHHHHHHHQRLSGNVSGSFTLMRDERGLPAMNNLYSPYKEMPGMSQSLSPLAATPLGNGLGGLHNAQQSLPNYGPPGHDKMLSPNFDAHHTAMLTRGEQHLSRGLGTPPAAMMSHLNGLHHPGHTQSHGPVLAPSRERPPSSSSGSQVATSGQLEEINTKEVAQRITAELKRYSIPQAIFAQRVLCRSQGTLSDLLRNPKPWSKLKSGRETFRRMWKWLQEPEFQRMSALRLAACKRKEQEPNKDRNNSQKKSRLVFTDLQRRTLFAIFKENKRPSKEMQITISQQLGLELTTVSNFFMNARRRSLEKWQDDLSTGGSSSTSSTCTKA

SEQ ID NO: 32776 - protein, 141 aa, Homo sapiens
  ENSP00000360214
MSFSLNFTLPANTTSSPVTGGKETDCGPSLGLAAGIPLLVATALLVALLFTLIHRRRSSIEAMEESDRPCEISEIDDNPKISENPRRSPTHEKNTMGAQEAHIYVKTVAGSEEPVHDRYRPTIEMERRRGLWWLVPRLSLE

SEQ ID NO: 32777 - protein, 131 aa, Homo sapiens
  ENSP00000484599
MRMTSSPVTGGKETDCGPSLGLAAGIPLLVATALLVALLFTLIHRRRSSIEAMEESDRPCEISEIDDNPKISENPRRSPTHEKNTMGAQEAHIYVKTVAGSEEPVHDRYRPTIEMERRRGLWWLVPRLSLE

SEQ ID NO: 32778 - protein, 118 aa, Homo sapiens
  ENSP00000377449
MDCGPSLGLAAGIPLLVATALLVALLFTLIHRRRSSIEAMEESDRPCEISEIDDNPKISENPRRSPTHEKNTMGAQEAHIYVKTVAGSEEPVHDRYRPTIEMERRRGLWWLVPRLSLE

SEQ ID NO: 32779 - protein, 79 aa, Homo sapiens
  ENSP00000445125
MEESDRPCEISEIDDNPKISENPRRSPTHEKNTMGAQEAHIYVKTVAGSEEPVHDRYRPTIEMERRRGLWWLVPRLSLE

SEQ ID NO: 32780 - protein, 130 aa, Homo sapiens
  ENSP00000398025
MSFSLNFTLPANTDCGPSLGLAAGIPLLVATALLVALLFTLIHRRRSSIEAMEESDRPCEISEIDDNPKISENPRRSPTHEKNTMGAQEAHIYVKTVAGSEEPVHDRYRPTIEMERRRGLWWLVPRLSLE

SEQ ID NO: 32781 - protein, 129 aa, Homo sapiens
  ENSP00000377448
MTSSPVTGGKETDCGPSLGLAAGIPLLVATALLVALLFTLIHRRRSSIEAMEESDRPCEISEIDDNPKISENPRRSPTHEKNTMGAQEAHIYVKTVAGSEEPVHDRYRPTIEMERRRGLWWLVPRLSLE

SEQ ID NO: 32782 - protein, 802 aa, Homo sapiens
  ENSP00000347710
MGHPPLEFSDCYLDSPDFRERLKCYEQELERTNKFIKDVIKDGNALISAMRNYSSAVQKFSQTLQSFQFDFIGDTLTDDEINIAESFKEFAELLNEVENERMMMVHNASDLLIKPLENFRKEQIGFTKERKKKFEKDGERFYSLLDRHLHLSSKKKESQLQEADLQVDKERHNFFESSLDYVYQIQEVQESKKFNIVEPVLAFLHSLFISNSLTVELTQDFLPYKQQLQLSLQNTRNHFSSTREEMEELKKRMKEAPQTCKLPGQPTIEGYLYTQEKWALGISWVKYYCQYEKETKTLTMTPMEQKPGAKQGPLDLTLKYCVRRKTESIDKRFCFDIETNERPGTITLQALSEANRRLWMEAMDGKEPIYHSPITKQQEMELNEVGFKFVRKCINIIETKGIKTEGLYRTVGSNIQVQKLLNAFFDPKCPGDVDFHNSDWDIKTITSSLKFYLRNLSEPVMTYRLHKELVSAAKSDNLDYRLGAIHSLVYKLPEKNREMLELLIRHLVNVCEHSKENLMTPSNMGVIFGPTLMRAQEDTVAAMMNIKFQNIVVEILIEHFGKIYLGPPEESAAPPVPPPRVTARRHKPITISKRLLRERTVFYTSSLDESEDEIQHQTPNGTITSSIEPPKPPQHPKLPIQRSGETDPGRKSPSRPILDGKLEPCPEVDVGKLVSRLQDGGTKITPKATNGPMPGSGPTKTPSFHIKRPAPRPLAHHKEGDADSFSKVRPPGEKPTIIRPPVRPPDPPCRAATPQKPEPKPDIVAGNAGEITSSVVASRTRFFETASRKTGSSQGRLPGDES

SEQ ID NO: 32783 - protein, 1288 aa, Homo sapiens
  ENSP00000480476
MGSPEGRFHFAIDRGGTFTDVFAQCPGGHVRVLKLLSEDPANYADAPTEGIRRILEQEAGMLLPRDQPLDSSHIASIRMGTTVATNALLERKGERVALLVTRGFRDLLHIGTQARGDLFDLAVPMPEVLYEEVLEVDERVVLHRGEAGTGTPVKGRTGDLLEVQQPVDLGALRGKLEGLLSRGIRSLAVVLMHSYTWAQHEQQVGVLARELGFTHVSLSSEAMPMVRIVPRGHTACADAYLTPAIQRYVQGFCRGFQGQLKDVQVLFMRSDGGLAPMDTFSGSSAVLSGPAGGVVGYSATTYQQEGGQPVIGFDMGGTSTDVSRYAGEFEHVFEASTAGVTLQAPQLDINTVAAGGGSRLFFRSGLFVVGPESAGAHPGPACYRKGGPVTVTDANLVLGRLLPASFPCIFGPGENQPLSPEASRKALEAVATEVNSFLTNGPCPASPLSLEEVAMGFVRVANEAMCRPIRALTQARGHDPSAHVLACFGGAGGQHACAIARALGMDTVHIHRHSGLLSALGLALADVVHEAQEPCSLLYAPETFVQLDQRLSRLEEQCVDALQAQGFPRSQISTESFLHLRYQGTDCALMVSAHQHPATARSPRAGDFGAAFVERYMREFGFVIPERPVVVDDVRVRGTGRSGLRLEDAPKAQTGPPRVDKMTQCYFEGGYQETPVYLLAELGYGHKLHGPCLIIDSNSTILVEPGCQAEVTKTGDICISVGAEVPGTVGPQLDPIQLSIFSHRFMSIAEQMGRILQRTAISTNIKERLDFSCALFGPDGGLVSNAPHIPVHLGAMQETVQFQIQHLGADLHPGDVLLSNHPSAGGSHLPDLTVITPVFWPGQTRPVFYVASRGHHADIGGITPGSMPPHSTMLQQEGAVFLSFKLVQGGVFQEEAVTEALRAPGKVPNCSGTRNLHDNLSDLRAQVAANQKGIQLVGELIGQYGLDVVQAYMGHIQANAELAVRDMLRAFGTSRQARGLPLEVSSEDHMDDGSPIRLRVQISLSQGSAVFDFSGTGPEVFGNLNAPRAVTLSALIYCLRCLVGRDIPLNQGCLAPVRVVIPRGSILDPSPEAAVVGGNVLTSQRVVDVILGAFGACAASQGCMNNVTLGNAHMGYYETVAGGAGAGPSWHGRSGVHSHMTNTRITDPEILESRYPVILRRFELRRGSGGRGRFRGGDGVTRELLFREEALLSVLTERRAFRPYGLHGGEPGARGLNLLIRKNGRTVNLGGKTSVTVYPGDVFCLHTPGGGGYGDPEDPAPPPGSPPQALAFPEHGSVYEYRRAQEAV

SEQ ID NO: 32784 - protein, 253 aa, Homo sapiens
  ENSP00000481640
MSLLSSYEGLRQEIQRLAQENEELRRLVQLIQENQELKLVLRNRGSSLGFCSSGFLAEVAASPWLPRRRTIKFKNAERVFPGLPAEELLWDSSPTTMGSPEGRFHFAIDRGGTFTDVFAQCPGGHVRVLKLLSEDPANYADAPTEGIRRILEQEAGMLLPRDQPLDSSHIASIRMGTTVATNALLERKGERVALLVTRGFRDLLHIGTQARGDLFDLAVPMPEVLYEEVLEVDERVVLHRGEAGTGTPVKGRT

SEQ ID NO: 32785 - protein, 372 aa, Homo sapiens
  ENSP00000234961
MEPAPSAGAELQPPLFANASDAYPSACPSAGANASGPPGARSASSLALAIAITALYSAVCAVGLLGNVLVMFGIVRYTKMKTATNIYIFNLALADALATSTLPFQSAKYLMETWPFGELLCKAVLSIDYYNMFTSIFTLTMMSVDRYIAVCHPVKALDFRTPAKAKLINICIWVLASGVGVPIMVMAVTRPRDGAVVCMLQFPSPSWYWDTVTKICVFLFAFVVPILIITVCYGLMLLRLRSVRLLSGSKEKDRSLRRITRMVLVVVGAFVVCWAPIHIFVIVWTLVDIDRRDPLVVAALHLCIALGYANSSLNPVLYAFLDENFKRCFRQLCRKPCGRPDPSSFSRAREATARERVTACTPSDGPGGGAAA

SEQ ID NO: 32786 - protein, 324 aa, Homo sapiens
  ENSP00000477970
MEPAPSAGAELQPPLFANASDAYPSACPSAGANASGPPGARSASSLALAIAITALYSAVCAVGLLGNVLVMFGIVRYTKMKTATNIYIFNLALADALATSTLPFQSAKYLMETWPFGELLCKAVLSIDYYNMFTSIFTLTMMSVDRYIAVCHPVKALDFRTPAKAKLINICIWVLASGVGVPIMVMAVTRPRDGAVVCMLQFPSPSWYWDTVTKICVFLFAFVVCWAPIHIFVIVWTLVDIDRRDPLVVAALHLCIALGYANSSLNPVLYAFLDENFKRCFRQLCRKPCGRPDPSSFSRAREATARERVTACTPSDGPGGGAAA

SEQ ID NO: 32787 - protein, 332 aa, Homo sapiens
  ENSP00000356191
MRLLAFLSLLALVLQETGTASLPRKERKRREEQMPREGDSFEVLPLRNDVLNPDNYGEVIDLSNYEELTDYGDQLPEVKVTSLAPATSISPAKSTTAPGTPSSNPTMTRPTTAGLLLSSQPNHGLPTCLVCVCLGSSVYCDDIDLEDIPPLPRRTAYLYARFNRISRIRAEDFKGLTKLKRIDLSNNLISSIDNDAFRLLHALQDLILPENQLEALPVLPSGIEFLDVRLNRLQSSGIQPAAFRAMEKLQFLYLSDNLLDSIPGPLPLSLRSVHLQNNLIETMQRDVFCDPEEHKHTRRQLEDIRLDGNPINLSLFPSAYFCLPRLPIGRFT

SEQ ID NO: 32788 - protein, 174 aa, Homo sapiens
  ENSP00000399491
MRLLAFLSLLALVLQETGTASLPRKERKRREEQMPREGDSFEVLPLRNDVLNPDNYGEVIDLSNYEELTDYGDQLPEVKVTSLAPATSISPAKSTTAPGTPSSNPTMTRPTTAGLLLSSQPNHEDIPPLPRRTAYLYARFNRISRIRAEDFKGLTKLKRIDLSNNLISSIDNDA

SEQ ID NO: 32789 - protein, 807 aa, Homo sapiens
  ENSP00000263847
MAATELRGVVGPGPAAIAALGGGGAGPPVVGGGGGRGDAGPGSGAASGTVVAAAAGGPGPGAGGVAAAGPAPAPPTGGSGGSGAGGSGSAREGWLFKWTNYIKGYQRRWFVLSNGLLSYYRSKAEMRHTCRGTINLATANITVEDSCNFIISNGGAQTYHLKASSEVERQRWVTALELAKAKAVKMLAESDESGDEESVSQTDKTELQNTLRTLSSKVEDLSTCNDLIAKHGTALQRSLSELESLKLPAESNEKIKQVNERATLFRITSNAMINACRDFLMLAQTHSKKWQKSLQYERDQRIRLEETLEQLAKQHNHLERAFRGATVLPANTPGNVGSGKDQCCSGKGDMSDEDDENEFFDAPEIITMPENLGHKRTGSNISGASSDISLDEQYKHQLEETKKEKRTRIPYKPNYSLNLWSIMKNCIGKELSKIPMPVNFNEPLSMLQRLTEDLEYHELLDRAAKCENSLEQLCYVAAFTVSSYSTTVFRTSKPFNPLLGETFELDRLEENGYRSLCEQVSHHPPAAAHHAESKNGWTLRQEIKITSKFRGKYLSIMPLGTIHCIFHATGHHYTWKKVTTTVHNIIVGKLWIDQSGEIDIVNHKTGDKCNLKFVPYSYFSRDVARKVTGEVTDPSGKVHFALLGTWDEKMECFKVQPVIGENGGDARQRGHEAEESRVMLWKRNPLPKNAENMYYFSELALTLNAWESGTAPTDSRLRPDQRLMENGRWDEANAEKQRLEEKQRLSRKKREAEAMKATEDGTPYDPYKALWFERKKDPVTKELTHIYRGEYWECKEKQDWSSCPDIF

SEQ ID NO: 32790 - protein, 171 aa, Homo sapiens
  ENSP00000432399
  MOD_RES (1)..(1): Any amino acid
XSGASSDISLDEQYKHQLEETKKEKRTRIPYKPNYSLNLWSIMKNCIGKELSKIPMPVNFNEPLSMLQRLTEDLEYHELLDRAAKCENSLEQLCYVAAFTVSSYSTTVFRTSKPFNPLLGETFELDRLEENGYRSLCEQVPFIVFSMQLGTTTLGRKLPQLYTTLLWASCG

SEQ ID NO: 32791 - protein, 764 aa, Homo sapiens
  ENSP00000379804
MERAVQGTDGGGGSNSSSRSSSRATSAGSSPSCSLAGRGVSSRSAAAGLGGGGSRSSPGSVAASPSGGGGRRREPALEGVLSKYTNLLQGWQNRYFVLDFEAGILQYFVNEQSKHQKPRGVLSLSGAIVSLSDEAPHMLVVYSANGEMFKLRAADAKEKQFWVTQLRACAKYHMEMNSKSAPSSRSRSLTLLPHGTPNSASPCSQRHLSVGAPGVVTITHHKSPAAARRAKSQYSGQLHEVREMMNQVEGQQKNLVHAIESLPGSGPLTALDQDLLLLKATSAATLSCLGECLNLLQQSVHQAGQPSQKPGASENILGWHGSKSHSTEQLKNGTLGSLPSASANITWAILPNSAEDEQTSQPEPEPNSGSELVLSEDEKSDNEDKEETELGVMEDQRSIILHLISQLKLGMDLTKVVLPTFILEKRSLLEMYADFMAHPDLLLAITAGATPEERVICFVEYYLTAFHEGRKGALAKKPYNPIIGETFHCSWEVPKDRVKPKRTASRSPASCHEHPMADDPSKSYKLRFVAEQVSHHPPISCFYCECEEKRLCVNTHVWTKSKFMGMSVGVSMIGEGVLRLLEHGEEYVFTLPSAYARSILTIPWVELGGKVSINCAKTGYSATVIFHTKPFYGGKVHRVTAEVKHNPTNTIVCKAHGEWNGTLEFTYNNGETKVIDTTTLPVYPKKIRPLEKQGPMESRNLWREVTRYLRLGDIDAATEQKRHLEEKQRVEERKRENLRTPWKPKYFIQEGDGWVYFNPLWKAH

SEQ ID NO: 32792 - protein, 538 aa, Homo sapiens
  ENSP00000416078
  MOD_RES (1)..(1): Any amino acid
XQYSGQLHEVREMMNQVEGQQKNLVHAIESLPGSGPLTALDQDLLLLKATSAATLSCLGECLNLLQQSVHQAGQPSQKPGASENILGWHGSKSHSTEQLKNGTLGSLPSASANITWAILPNSAEDEQTSQPEPEPNSGSELVLSEDEKSDNEDKEETELGVMEDQRSIILHLISQLKLGMDLTKVVLPTFILEKRSLLEMYADFMAHPDLLLAITAGATPEERVICFVEYYLTAFHEGRKGALAKKPYNPIIGETFHCSWEVPKDRVKPKRTASRSPASCHEHPMADDPSKSYKLRFVAEQVSHHPPISCFYCECEEKRLCVNTHVWTKSKFMGMSVGVSMIGEGVLRLLEHGEEYVFTLPSAYARSILTIPWVELGGKVSINCAKTGYSATVIFHTKPFYGGKVHRVTAEVKHNPTNTIVCKAHGEWNGTLEFTYNNGETKVIDTTTLPVYPKKIRPLEKQGPMESRNLWREVTRYLRLGDIDAATEQKRHLEEKQRVEERKRENLRTPWKPKYFIQEVTLPPVIGPLPRRELVLRG

SEQ ID NO: 32793 - protein, 700 aa, Homo sapiens
  ENSP00000406124
MERAVQGTDGGGGSNSSSRSSSRATSAGSSPSCSLAGRGVSSRSAAAGLGGGGSRSSPGSVAASPSGGGGRRREPALEGVLSKYTNLLQGWQNRYFVLDFEAGILQYFVNEQSKHQKPRGVLSLSGAIVSLSDEAPHMLVVYSANGEMFKLRAADAKEKQFWVTQLRACAKYHMEMNSKMMNQVEGQQKNLVHAIESLPGSGPLTALDQDLLLLKATSAATLSCLGECLNLLQQSVHQAGQPSQKPGASENILGWHGSKSHSTEQLKNGTLGSLPSASANITWAILPNSAEDEQTSQPEPEPNSGSELVLSEDEKSDNEDKEETELGVMEDQRSIILHLISQLKLGMDLTKVVLPTFILEKRSLLEMYADFMAHPDLLLAITAGATPEERVICFVEYYLTAFHEGRKGALAKKPYNPIIGETFHCSWEVPKDRVKPKRTASRSPASCHEHPMADDPSKSYKLRFVAEQVSHHPPISCFYCECEEKRLCVNTHVWTKSKFMGMSVGVSMIGEGVLRLLEHGEEYVFTLPSAYARSILTIPWVELGGKVSINCAKTGYSATVIFHTKPFYGGKVHRVTAEVKHNPTNTIVCKAHGEWNGTLEFTYNNGETKVIDTTTLPVYPKKIRPLEKQGPMESRNLWREVTRYLRLGDIDAATEQKRHLEEKQRVEERKRENLRTPWKPKYFIQEGDGWVYFNPLWKAH

SEQ ID NO: 32794 - protein, 173 aa, Homo sapiens
  ENSP00000399200
KSPAAARRAKSQYSGQLHEVREVKACMLNNMCEVTQRVIGIVKTQTQLIFLMMNQVEGQQKNLVHAIESLPGSGPLTALDQDLLLLKATSAATLSCLGECLNLLQQSVHQAGQPSQKPGASENILGWHGSKSHSTEQLKNGTLGSLPSASANITWAILPNSAEDEQTSQPEPE

SEQ ID NO: 32795 - protein, 887 aa, Homo sapiens
  ENSP00000315410
MMSDEKNLGVSQKLVSPSRSTSSCSSKQGSRQDSWEVVEGLRGEMNYTQEPPVQKGFLLKKRKWPLKGWHKRFFYLDKGILKYAKSQTDIEREKLHGCIDVGLSVMSVKKSSKCIDLDTEEHIYHLKVKSEEVFDEWVSKLRHHRMYRQNEIAMFPHEVNHFFSGSTITDSSSGVFDSISSRKRSSISKQNLFQTGSNVSFSCGGETRVPLWLQSSEDMEKCSKDLAHCHAYLVEMSQLLQSMDVLHRTYSAPAINAIQGGSFESPKKEKRSHRRWRSRAIGKDAKGTLQVPKPFSGPVRLHSSNPNLSTLDFGEEKNYSDGSETSSEFSKMQEDLCHIAHKVYFTLRSAFNIMSAEREKLKQLMEQDASSSPSAQVIGLKNALSSALAQNTDLKERLRRIHAESLLLDSPAVAKSGDNLAEENSRDENRALVHQLSNESRLSITDSLSEFFDAQEVLLSPSSSENEISDDDSYVSDISDNLSLDNLSNDLDNERQTLGPVLDSGREAKSRRRTCLPAPCPSSSNISLWNILRNNIGKDLSKVAMPVELNEPLNTLQRLCEELEYSELLDKAAQIPSPLERMVYVAAFAISAYASSYYRAGSKPFNPVLGETYECIREDKGFQFFSEQVSHHPPISACHAESRNFVFWQDVRWKNKFWGKSMEIVPIGTTHVTLPVFGDHFEWNKVTSCIHNILSGQRWIEHYGEIVIKNLHDDSCYCKVNFIKAKYWSTNAHEIEGTVFDRSGKAVHRLFGKWHESIYCGGGSSSACVWRANPMPKGYEQYYSFTQFALELNEMDPSSKSLLPPTDTRFRPDQRFLEEGNLEEAEIQKQRIEQLQRERRRVLEENHVEHQPRFFRKSDDDSWVSNGTYLELRKDLGFSKLDHPVLW

SEQ ID NO: 32796 - protein, 611 aa, Homo sapiens
  ENSP00000386429
MMSDEKNLGVSQKLVSPSRSTSSCSSKQGSRQDSWEVVEGLRGEMNYTQEPPVQKGFLLKKRKWPLKGWHKRFFYLDKGILKYAKSQTDIEREKLHGCIDVGLSVMSVKKSSKCIDLDTEEHIYHLKVKSEEVFDEWVSKLRHHRMYRQNEIAMFPHEVNHFFSGSTITDSSSGVFDSISSRKRSSISKQNLFQTGSNVSFSCGGETRVPLWLQSSEDMEKCSKDLAHCHAYLVEMSQLLQSMDVLHRTYSAPAINAIQVPKPFSGPVRLHSSNPNLSTLDFGEEKNYSDGSETSSEFSKMQEDLCHIAHKVYFTLRSAFNIMSAEREKLKQLMEQDASSSPSAQVIGLKNALSSALAQNTDLKERLRRIHAESLLLDSPAVAKSGDNLAEENSRDENRALVHQLSNESRLSITDSLSEFFDAQEVLLSPSSSENEISDDDSYVSDISDNLSLDNLSNDLDNERQTLGPVLDSGREAKSRRRTCLPAPCPSSSNISLWNILRNNIGKDLSKVAMPVELNEPLNTLQRLCEELEYSELLDKAAQIPSPLERMVRSQPSLATVQPRSPSHEAIHGAHQRDSPCSLRFHFDCSVNRFITQSCLASSAWLFPVTL

SEQ ID NO: 32797 - protein, 856 aa, Homo sapiens
  ENSP00000379708
MMSDEKNLGVSQKLVSPSRSTSSCSSKQGSRQDSWEVVEGLRGEMNYTQEPPVQKGFLLKKRKWPLKGWHKRFFYLDKGILKYAKSQTDIEREKLHGCIDVGLSVMSVKKSSKCIDLDTEEHIYHLKVKSEEVFDEWVSKLRHHRMYRQNEIAMFPHEVNHFFSGSTITDSSSGVFDSISSRKRSSISKQNLFQTGSNVSFSCGGETRVPLWLQSSEDMEKCSKDLAHCHAYLVEMSQLLQSMDVLHRTYSAPAINAIQVPKPFSGPVRLHSSNPNLSTLDFGEEKNYSDGSETSSEFSKMQEDLCHIAHKVYFTLRSAFNIMSAEREKLKQLMEQDASSSPSAQVIGLKNALSSALAQNTDLKERLRRIHAESLLLDSPAVAKSGDNLAEENSRDENRALVHQLSNESRLSITDSLSEFFDAQEVLLSPSSSENEISDDDSYVSDISDNLSLDNLSNDLDNERQTLGPVLDSGREAKSRRRTCLPAPCPSSSNISLWNILRNNIGKDLSKVAMPVELNEPLNTLQRLCEELEYSELLDKAAQIPSPLERMVYVAAFAISAYASSYYRAGSKPFNPVLGETYECIREDKGFQFFSEQVSHHPPISACHAESRNFVFWQDVRWKNKFWGKSMEIVPIGTTHVTLPVFGDHFEWNKVTSCIHNILSGQRWIEHYGEIVIKNLHDDSCYCKVNFIKAKYWSTNAHEIEGTVFDRSGKAVHRLFGKWHESIYCGGGSSSACVWRANPMPKGYEQYYSFTQFALELNEMDPSSKSLLPPTDTRFRPDQRFLEEGNLEEAEIQKQRIEQLQRERRRVLEENHVEHQPRFFRKSDDDSWVSNGTYLELRKDLGFSKLDHPVLW

SEQ ID NO: 32798 - protein, 642 aa, Homo sapiens
  ENSP00000386801
MMSDEKNLGVSQKLVSPSRSTSSCSSKQGSRQDSWEVVEGLRGEMNYTQEPPVQKGFLLKKRKWPLKGWHKRFFYLDKGILKYAKSQTDIEREKLHGCIDVGLSVMSVKKSSKCIDLDTEEHIYHLKVKSEEVFDEWVSKLRHHRMYRQNEIAMFPHEVNHFFSGSTITDSSSGVFDSISSRKRSSISKQNLFQTGSNVSFSCGGETRVPLWLQSSEDMEKCSKDLAHCHAYLVEMSQLLQSMDVLHRTYSAPAINAIQGGSFESPKKEKRSHRRWRSRAIGKDAKGTLQVPKPFSGPVRLHSSNPNLSTLDFGEEKNYSDGSETSSEFSKMQEDLCHIAHKVYFTLRSAFNIMSAEREKLKQLMEQDASSSPSAQVIGLKNALSSALAQNTDLKERLRRIHAESLLLDSPAVAKSGDNLAEENSRDENRALVHQLSNESRLSITDSLSEFFDAQEVLLSPSSSENEISDDDSYVSDISDNLSLDNLSNDLDNERQTLGPVLDSGREAKSRRRTCLPAPCPSSSNISLWNILRNNIGKDLSKVAMPVELNEPLNTLQRLCEELEYSELLDKAAQIPSPLERMVRSQPSLATVQPRSPSHEAIHGAHQRDSPCSLRFHFDCSVNRFITQSCLASSAWLFPVTL

SEQ ID NO: 32799 - protein, 606 aa, Homo sapiens
  ENSP00000386325
MMSDEKNLGVSQKLVSPSRSTSSCSSKQGSRQDSWEVVEGLRGEMNYTQEPPVQKGFLLKKRKWPLKGWHKRFFYLDKGILKYAKSQTDIEREKLHGCIDVGLSVMSVKKSSKCIDLDTEEHIYHLKVKSEEVFDEWVSKLRHHRMYRQNEIAMFPHEVNHFFSGSTITDSSSGVFDSISSRKRSSISKQNLFQTGSNVSFSCGGETRVPLWLQSSEDMEKCSKDLAHCHAYLVEMSQLLQSMDVLHRTYSAPAINAIQGGSFESPKKEKRSHRRWRSRAIGKDAKGTLQVPKPFSGPVRLHSSNPNLSTLDFGEEKNYSDGSETSSEFSKMQEDLCHIAHKVYFTLRSAFNIMSAEREKLKQLMEQDASSSPSAQVIGLKNALSSENSRDENRALVHQLSNESRLSITDSLSEFFDAQEVLLSPSSSENEISDDDSYVSDISDNLSLDNLSNDLDNERQTLGPVLDSGREAKSRRRTCLPAPCPSSSNISLWNILRNNIGKDLSKVAMPVELNEPLNTLQRLCEELEYSELLDKAAQIPSPLERMVRSQPSLATVQPRSPSHEAIHGAHQRDSPCSLRFHFDCSVNRFITQSCLASSAWLFPVTL

SEQ ID NO: 32800 - protein, 575 aa, Homo sapiens
  ENSP00000386990
MMSDEKNLGVSQKLVSPSRSTSSCSSKQGSRQDSWEVVEGLRGEMNYTQEPPVQKGFLLKKRKWPLKGWHKRFFYLDKGILKYAKSQTDIEREKLHGCIDVGLSVMSVKKSSKCIDLDTEEHIYHLKVKSEEVFDEWVSKLRHHRMYRQNEIAMFPHEVNHFFSGSTITDSSSGVFDSISSRKRSSISKQNLFQTGSNVSFSCGGETRVPLWLQSSEDMEKCSKDLAHCHAYLVEMSQLLQSMDVLHRTYSAPAINAIQVPKPFSGPVRLHSSNPNLSTLDFGEEKNYSDGSETSSEFSKMQEDLCHIAHKVYFTLRSAFNIMSAEREKLKQLMEQDASSSPSAQVIGLKNALSSENSRDENRALVHQLSNESRLSITDSLSEFFDAQEVLLSPSSSENEISDDDSYVSDISDNLSLDNLSNDLDNERQTLGPVLDSGREAKSRRRTCLPAPCPSSSNISLWNILRNNIGKDLSKVAMPVELNEPLNTLQRLCEELEYSELLDKAAQIPSPLERMVRSQPSLATVQPRSPSHEAIHGAHQRDSPCSLRFHFDCSVNRFITQSCLASSAWLFPVTL

SEQ ID NO: 32801 - protein, 851 aa, Homo sapiens
  ENSP00000379706
MMSDEKNLGVSQKLVSPSRSTSSCSSKQGSRQDSWEVVEGLRGEMNYTQEPPVQKGFLLKKRKWPLKGWHKRFFYLDKGILKYAKSQTDIEREKLHGCIDVGLSVMSVKKSSKCIDLDTEEHIYHLKVKSEEVFDEWVSKLRHHRMYRQNEIAMFPHEVNHFFSGSTITDSSSGVFDSISSRKRSSISKQNLFQTGSNVSFSCGGETRVPLWLQSSEDMEKCSKDLAHCHAYLVEMSQLLQSMDVLHRTYSAPAINAIQGGSFESPKKEKRSHRRWRSRAIGKDAKGTLQVPKPFSGPVRLHSSNPNLSTLDFGEEKNYSDGSETSSEFSKMQEDLCHIAHKVYFTLRSAFNIMSAEREKLKQLMEQDASSSPSAQVIGLKNALSSENSRDENRALVHQLSNESRLSITDSLSEFFDAQEVLLSPSSSENEISDDDSYVSDISDNLSLDNLSNDLDNERQTLGPVLDSGREAKSRRRTCLPAPCPSSSNISLWNILRNNIGKDLSKVAMPVELNEPLNTLQRLCEELEYSELLDKAAQIPSPLERMVYVAAFAISAYASSYYRAGSKPFNPVLGETYECIREDKGFQFFSEQVSHHPPISACHAESRNFVFWQDVRWKNKFWGKSMEIVPIGTTHVTLPVFGDHFEWNKVTSCIHNILSGQRWIEHYGEIVIKNLHDDSCYCKVNFIKAKYWSTNAHEIEGTVFDRSGKAVHRLFGKWHESIYCGGGSSSACVWRANPMPKGYEQYYSFTQFALELNEMDPSSKSLLPPTDTRFRPDQRFLEEGNLEEAEIQKQRIEQLQRERRRVLEENHVEHQPRFFRKSDDDSWVSNGTYLELRKDLGFSKLDHPVLW

SEQ ID NO: 32802 - protein, 820 aa, Homo sapiens
  ENSP00000386953
MMSDEKNLGVSQKLVSPSRSTSSCSSKQGSRQDSWEVVEGLRGEMNYTQEPPVQKGFLLKKRKWPLKGWHKRFFYLDKGILKYAKSQTDIEREKLHGCIDVGLSVMSVKKSSKCIDLDTEEHIYHLKVKSEEVFDEWVSKLRHHRMYRQNEIAMFPHEVNHFFSGSTITDSSSGVFDSISSRKRSSISKQNLFQTGSNVSFSCGGETRVPLWLQSSEDMEKCSKDLAHCHAYLVEMSQLLQSMDVLHRTYSAPAINAIQVPKPFSGPVRLHSSNPNLSTLDFGEEKNYSDGSETSSEFSKMQEDLCHIAHKVYFTLRSAFNIMSAEREKLKQLMEQDASSSPSAQVIGLKNALSSENSRDENRALVHQLSNESRLSITDSLSEFFDAQEVLLSPSSSENEISDDDSYVSDISDNLSLDNLSNDLDNERQTLGPVLDSGREAKSRRRTCLPAPCPSSSNISLWNILRNNIGKDLSKVAMPVELNEPLNTLQRLCEELEYSELLDKAAQIPSPLERMVYVAAFAISAYASSYYRAGSKPFNPVLGETYECIREDKGFQFFSEQVSHHPPISACHAESRNFVFWQDVRWKNKFWGKSMEIVPIGTTHVTLPVFGDHFEWNKVTSCIHNILSGQRWIEHYGEIVIKNLHDDSCYCKVNFIKAKYWSTNAHEIEGTVFDRSGKAVHRLFGKWHESIYCGGGSSSACVWRANPMPKGYEQYYSFTQFALELNEMDPSSKSLLPPTDTRFRPDQRFLEEGNLEEAEIQKQRIEQLQRERRRVLEENHVEHQPRFFRKSDDDSWVSNGTYLELRKDLGFSKLDHPVLW

SEQ ID NO: 32803 - protein, 112 aa, Homo sapiens
  ENSP00000407829
MMSDEKNLGVSQKLVSPSRSTSSCSSKQGSRQDSWEVVEGLRGEMNYTQEPPVQKGFLLKKRKWPLKGWHKRFFYLDKGILKYAKSQTDIEREKLHGCIDVGLSVMSVKKSS

SEQ ID NO: 32804 - protein, 89 aa, Homo sapiens
  ENSP00000403374
MMSDEKNLGVSQKLVSPSRSTSSCSSKQGSRQDSWEVVEGLRGEMNYTQEPPVQKGFLLKKRKWPLKGWHKRFFYLDKGILKYAKSQTD

SEQ ID NO: 32805 - protein, 61 aa, Homo sapiens
  ENSP00000411249
MMSDEKNLGVSQKLVSPSRSTSSCSSKQGSRQDSWEVVEGLRGEMNYTQEPPVQKGFLLKK

SEQ ID NO: 32806 - protein, 323 aa, Homo sapiens
  ENSP00000285420
MEPRVRVEGWKVPTSRCRFLLARVLGYLVVMEAVLTEELDEEEQLLRRHRKEKKELQAKIQGMKNAVPKNDKKRRKQLTEDVAKLEKEMEQKHREELEQLKLTTKENKIDSVAVNISNLVLENQPPRISKAQKRREKKAALEKEREERIAEAEIENLTGARHMESEKLAQILAARQLEIKQIPSDGHCMYKAIEDQLKEKDCALTVVALRSQTAEYMQSHVEDFLPFLTNPNTGDMYTPEEFQKYCEDIVNTAAWGGQLELRALSHILQTPIEIIQADSPPIIVGEEYSKKPLILVYMRHAYGLGEHYNSVTRLVNIVTENCS

SEQ ID NO: 32807 - protein, 108 aa, Homo sapiens
  ENSP00000428528
MEAVLTEELDEEEQLLRRHRKEKKELQAKIQGMKNAVPKNDKKRRKQLTEDVAKLEKEMEQKHREELEQLKLTTKENKIDSVAVNISNLVLENQPPRISKAQKRRVPG

SEQ ID NO: 32808 - protein, 293 aa, Homo sapiens
  ENSP00000384190
MEAVLTEELDEEEQLLRRHRKEKKELQAKIQGMKNAVPKNDKKRRKQLTEDVAKLEKEMEQKHREELEQLKLTTKENKIDSVAVNISNLVLENQPPRISKAQKRREKKAALEKEREERIAEAEIENLTGARHMESEKLAQILAARQLEIKQIPSDGHCMYKAIEDQLKEKDCALTVVALRSQTAEYMQSHVEDFLPFLTNPNTGDMYTPEEFQKYCEDIVNTAAWGGQLELRALSHILQTPIEIIQADSPPIIVGEEYSKKPLILVYMRHAYGLGEHYNSVTRLVNIVTENCS

SEQ ID NO: 32809 - protein, 323 aa, Homo sapiens; identical to SEQ ID NO: 32806
  ENSP00000483706

SEQ ID NO: 32810 - protein, 192 aa, Homo sapiens
  ENSP00000481196
MISKEKKAALEKEREERIAEAEIENLTGARHMESEKLAQILAARQLEIKQIPSDGHCMYKAIEDQLKEKDCALTVVALRSQTAEYMQSHVEDFLPFLTNPNTGDMYTPEEFQKYCEDIVNTAAWGGQLELRALSHILQTPIEIIQADSPPIIVGEEYSKKPLILVYMRHAYGLGEHYNSVTRLVNIVTENCS

SEQ ID NO: 32811 - protein, 468 aa, Homo sapiens
  ENSP00000415851
MSEDSSALPWSINRDDYELQEVIGSGATAVVQAAYCAPKKEKVAIKRINLEKCQTSMDELLKEIQAMSQCHHPNIVSYYTSFVVKDELWLVMKLLSGGSVLDIIKHIVAKGEHKSGVLDESTIATILREVLEGLEYLHKNGQIHRDVKAGNILLGEDGSVQIADFGVSAFLATGGDITRNKVRKTFVGTPCWMAPEVMEQVRGYDFKADIWSFGITAIELATGAAPYHKYPPMKVLMLTLQNDPPSLETGVQDKEMLKKYGKSFRKMISLCLQKDPEKRPTAAELLRHKFFQKAKNKEFLQEKTLQRAPTISERAKKVRRVPGSSGRLHKTEDGGWEWSDDEFDEESEEGKAAISQLRSPRVKESISNSELFPTTDPVGTLLQVPEQISAHLPQPAGQIATQPTQVSLPPTAEPAKTAQALSSGSGSQETKIPISLVLRLRNSKKELNDIRFEFTPGRGEASNGLKTK

SEQ ID NO: 32812 - protein, 527 aa, Homo sapiens
  ENSP00000311713
MSEDSSALPWSINRDDYELQEVIGSGATAVVQAAYCAPKKEKVAIKRINLEKCQTSMDELLKEIQAMSQCHHPNIVSYYTSFVVKDELWLVMKLLSGGSVLDIIKHIVAKGEHKSGVLDESTIATILREVLEGLEYLHKNGQIHRDVKAGNILLGEDGSVQIADFGVSAFLATGGDITRNKVRKTFVGTPCWMAPEVMEQVRGYDFKADIWSFGITAIELATGAAPYHKYPPMKVLMLTLQNDPPSLETGVQDKEMLKKYGKSFRKMISLCLQKDPEKRPTAAELLRHKFFQKAKNKEFLQEKTLQRAPTISERAKKVRRVPGSSGRLHKTEDGGWEWSDDEFDEESEEGKAAISQLRSPRVKESISNSELFPTTDPVGTLLQVPEQISAHLPQPAGQIATQPTQVSLPPTAEPAKTAQALSSGSGSQETKIPISLVLRLRNSKKELNDIRFEFTPGRDTAEGVSQELISAGLVDGRDLVIVAANLQKIVEEPQSNRSVTFKLASGVEGSDIPDDGKLIGFAQLSIS

SEQ ID NO: 32813 - protein, 113 aa, Homo sapiens
  ENSP00000398356
MSEDSSALPWSINRDDYELQEVIGSGATAVVQAAYCAPKKEKVAIKRINLEKCQTSMDELLKEIQAMSQCHHPNIVSYYTSFVVKDELWLVMKLLSGVTHWRNWIALLKALFI

SEQ ID NO: 32814 - protein, 373 aa, Homo sapiens
  ENSP00000304767
MTEVLWPAVPNGTDAAFLAGPGSSWGNSTVASTAAVSSSFKCALTKTGFQFYYLPAVYILVFIIGFLGNSVAIWMFVFHMKPWSGISVYMFNLALADFLYVLTLPALIFYYFNKTDWIFGDAMCKLQRFIFHVNLYGSILFLTCISAHRYSGVVYPLKSLGRLKKKNAICISVLVWLIVVVAISPILFYSGTGVRKNKTITCYDTTSDEYLRSYFIYSMCTTVAMFCVPLVLILGCYGLIVRALIYKDLDNSPLRRKSIYLVIIVLTVFAVSYIPFHVMKTMNLRARLDFQTPAMCAFNDRVYATYQVTRGLASLNSCVDPILYFLAGDTFRRRLSRATRKASRRSEANLQSKSEDMTLNILPEFKQNGDTSL

SEQ ID NO: 32815 - protein, 342 aa, Homo sapiens
  ENSP00000307259
MQAVDNLTSAPGNTSLCTRDYKITQVLFPLLYTVLFFVGLITNGLAMRIFFQIRSKSNFIIFLKNTVISDLLMILTFPFKILSDAKLGTGPLRTFVCQVTSVIFYFTMYISISFLGLITIDRYQKTTRPFKTSNPKNLLGAKILSVVIWAFMFLLSLPNMILTNRQPRDKNVKKCSFLKSEFGLVWHEIVNYICQVIFWINFLIVIVCYTLITKELYRSYVRTRGVGKVPRKKVNVKVFIIIAVFFICFVPFHFARIPYTLSQTRDVFDCTAENTLFYVKESTLWLTSLNACLDPFIYFFLCKSFRNSLISMLKCPNSATSLSQDNRKKEQDGGDPNEETPM

SEQ ID NO: 32816 - protein, 534 aa, Homo sapiens
  ENSP00000307318
MIWYILIIGILLPQSLAHPGFFTSIGQMTDLIHTEKDLVTSLKDYIKAEEDKLEQIKKWAEKLDRLTSTATKDPEGFVGHPVNAFKLMKRLNTEWSELENLVLKDMSDGFISNLTIQRQYFPNDEDQVGAAKALLRLQDTYNLDTDTISKGNLPGVKHKSFLTAEDCFELGKVAYTEADYYHTELWMEQALRQLDEGEISTIDKVSVLDYLSYAVYQQGDLDKALLLTKKLLELDPEHQRANGNLKYFEYIMAKEKDVNKSASDDQSDQKTTPKKKGVAVDYLPERQKYEMLCRGEGIKMTPRRQKKLFCRYHDGNRNPKFILAPAKQEDEWDKPRIIRFHDIISDAEIEIVKDLAKPRLRRATISNPITGDLETVHYRISKSAWLSGYENPVVSRINMRIQDLTGLDVSTAEELQVANYGVGGQYEPHFDFARKDEPDAFKELGTGNRIATWLFYMSDVSAGGATVFPEVGASVWPKKGTAVFWYNLFASGEGDYSTRHAACPVLVGNKWVSNKWLHERGQEFRRPCTLSELE

SEQ ID NO: 32817 - protein, 534 aa, Homo sapiens
  ENSP00000362099
MIWYILIIGILLPQSLAHPGFFTSIGQMTDLIHTEKDLVTSLKDYIKAEEDKLEQIKKWAEKLDRLTSTATKDPEGFVGHPVNAFKLMKRLNTEWSELENLVLKDMSDGFISNLTIQRQYFPNDEDQVGAAKALLRLQDTYNLDTDTISKGNLPGVKHKSFLTAEDCFELGKVAYTEADYYHTELWMEQALRQLDEGEISTIDKVSVLDYLSYAVYQQGDLDKALLLTKKLLELDPEHQRANGNLKYFEYIMAKEKDVNKSASDDQSDQKTTPKKKGVAVDYLPERQKYEMLCRGEGIKMTPRRQKKLFCRYHDGNRNPKFILAPAKQEDEWDKPRIIRFHDIISDAEIEIVKDLAKPRLSRATVHDPETGKLTTAQYRVSKSAWLSGYENPVVSRINMRIQDLTGLDVSTAEELQVANYGVGGQYEPHFDFARKDEPDAFKELGTGNRIATWLFYMSDVSAGGATVFPEVGASVWPKKGTAVFWYNLFASGEGDYSTRHAACPVLVGNKWVSNKWLHERGQEFRRPCTLSELE

SEQ ID NO: 32818 - protein, 516 aa, Homo sapiens
  ENSP00000414464
MIWYILIIGILLPQSLAHPGFFTSIGQMTDLIHTEKDLVTSLKDYIKAEEDKLEQIKKWAEKLDRLTSTATKDPEGFVGHPVNAFKLMKRLNTEWSELENLVLKDMSDGFISNLTIQRQYFPNDEDQVGAAKALLRLQDTYNLDTDTISKGNLPGVKHKSFLTAEDCFELGKVAYTEADYYHTELWMEQALRQLDEGEISTIDKVSVLDYLSYAVYQQGDLDKALLLTKKLLELDPEHQRANGNLKYFEYIMAKEKDVNKSASDDQSDQKTTPKKKGVAVDYLPERQKYEMLCRGEGIKMTPRRQKKLFCRYHDGNRNPKFILAPAKQEDEWDKPRIIRFHDIISDAEIEIVKDLAKPRLSRATVHDPETGKLTTAQYRVSKSAWLSGYENPVVSRINMRIQDLTGLDVSTAEELQKDEPDAFKELGTGNRIATWLFYMSDVSAGGATVFPEVGASVWPKKGTAVFWYNLFASGEGDYSTRHAACPVLVGNKWVSNKWLHERGQEFRRPCTLSELE

SEQ ID NO: 32819 - protein, 534 aa, Homo sapiens; identical to SEQ ID NO: 32816
  ENSP00000378353

SEQ ID NO: 32820 - protein, 534 aa, Homo sapiens; identical to SEQ ID NO: 32817
  ENSP00000263556

SEQ ID NO: 32821 - protein, 535 aa, Homo sapiens
  ENSP00000384999
MKLWVSALLMAWFGVLSCVQAEFFTSIGHMTDLIYAEKELVQSLKEYILVEEAKLSKIKSWANKMEALTSKSAADAEGYLAHPVNAYKLVKRLNTDWPALEDLVLQDSAAGFIANLSVQRQFFPTDEDEIGAAKALMRLQDTYRLDPGTISRGELPGTKYQAMLSVDDCFGMGRSAYNEGDYYHTVLWMEQVLKQLDAGEEATTTKSQVLDYLSYAVFQLGDLHRALELTRRLLSLDPSHERAGGNLRYFEQLLEEEREKTLTNQTEAELATPEGIYERPVDYLPERDVYESLCRGEGVKLTPRRQKRLFCRYHHGNRAPQLLIAPFKEEDEWDSPHIVRYYDVMSDEEIERIKEIAKPKLARATVRDPKTGVLTVASYRVSKSSWLEEDDDPVVARVNRRMQHITGLTVKTAELLQVANYGVGGQYEPHFDFSRNDERDTFKHLGTGNRVATFLNYMSDVEAGGATVFPDLGAAIWPKKGTAVFWYNLLRSGEGDYRTRHAACPVLVGCKWVSNKWFHERGQEFLRPCGSTEVD

SEQ ID NO: 32822 - protein, 533 aa, Homo sapiens
  ENSP00000368379
MKLWVSALLMAWFGVLSCVQAEFFTSIGHMTDLIYAEKELVQSLKEYILVEEAKLSKIKSWANKMEALTSKSAADAEGYLAHPVNAYKLVKRLNTDWPALEDLVLQDSAAGFIANLSVQRQFFPTDEDEIGAAKALMRLQDTYRLDPGTISRGELPGTKYQAMLSVDDCFGMGRSAYNEGDYYHTVLWMEQVLKQLDAGEEATTTKSQVLDYLSYAVFQLGDLHRALELTRRLLSLDPSHERAGGNLRYFEQLLEEEREKTLTNQTEAELATPEGIYERPVDYLPERDVYESLCRGEGVKLTPRRQKRLFCRYHHGNRAPQLLIAPFKEEDEWDSPHIVRYYDVMSDEEIERIKEIAKPKLARATVRDPKTGVLTVASYRVSKSSWLEEDDDPVVARVNRRMQHITGLTVKTAELLQVANYGVGGQYEPHFDFSRRPFDSGLKTEGNRLATFLNYMSDVEAGGATVFPDLGAAIWPKKGTAVFWYNLLRSGEGDYRTRHAACPVLVGCKWVSNKWFHERGQEFLRPCGSTEVD

SEQ ID NO: 32823 - protein, 535 aa, Homo sapiens; identical to SEQ ID NO: 32821
  ENSP00000166534

SEQ ID NO: 32824 - protein, 533 aa, Homo sapiens; identical to SEQ ID NO: 32822
  ENSP00000353772

SEQ ID NO: 32825 - protein, 204 aa, Homo sapiens
  ENSP00000389523
MKLWVSALLMAWFGVLSCVQAEFFTSIGHMTDLIYAEKELVQSLKEYILVEEAKLSKIKSWANKMEALTSKSAADAEGYLAHPVNAYKLVKRLNTDWPALEDLVLQDSAAGFIANLSVQRQFFPTDEDEIGAAKALMRLQDTYRLDPGTISRGELPGTKYQAMLSVDDCFGMGRSAYNEGDYYHTVLWMEQVLKQLDAGEEATT

SEQ ID NO: 32826 - protein, 236 aa, Homo sapiens
  ENSP00000391257
MKRQLVTNSFLHHLLIGQKRPRNAPRTLPSVTMKLWVSALLMAWFGVLSCVQAEFFTSIGHMTDLIYAEKELVQSLKEYILVEEAKLSKIKSWANKMEALTSKSAADAEGYLAHPVNAYKLVKRLNTDWPALEDLVLQDSAAGFIANLSVQRQFFPTDEDEIGAAKALMRLQDTYRLDPGTISRGELPGTKYQAMLSVDDCFGMGRSAYNEGDYYHTVLWMEQVLKQLDAGEEATT

SEQ ID NO: 32827 - protein, 184 aa, Homo sapiens
  ENSP00000405406
MKLWVSALLMAWFGVLSCVQAEFFTSIGHMTDLIYAEKELVQSLKEYILVEEAKLSKIKSWANKMEALTSKSAADAEGYLAHPVNAYKLVKRLNTDWPALEDLVLQDSAAGFIANLSVQRQFFPTDEDEIGAAKALMRLQDTYRLDPGTISRGELPGTKYQAMLSVDDCFGMGRSAYNEGDYYH

SEQ ID NO: 32828 - protein, 167 aa, Homo sapiens
  ENSP00000378593
MKLWVSALLMAWFGVLSCVQAEFFTSIGHMTDLIYAEKELVQSLKEYILVEEAKLSKIKSWANKMEALTSKSAADAEGYLAHPVNAYKLVKRLNTDWPALEDLVLQDSAAGFIANLSVQRQFFPTDEDEIGAAKALMRLQDTYRLDPGTISRGELPGTKYQAMLSVD

SEQ ID NO: 32829 - protein, 153 aa, Homo sapiens
  ENSP00000413542
MKLWVSALLMAWFGVLSCVQAEFFTSIGHMTDLIYAEKELVQSLKEYILVEEAKLSKIKSWANKMEALTSKSAADAEGYLAHPVNAYKLVKRLNTDWPALEDLVLQDSAAGFIANLSVQRQFFPTDEDEIGAAKALMRLQDTYRLDPGTISRG

SEQ ID NO: 32830 - protein, 146 aa, Homo sapiens
  ENSP00000396495
MKLWVSALLMAWFGVLSCVQAEFFTSIGHMTDLIYAEKELVQSLKEYILVEEAKLSKIKSWANKMEALTSKSAADAEGYLAHPVNAYKLVKRLNTDWPALEDLVLQDSAAGFIANLSVQRQFFPTDEDEIGAAKALMRLQDTYRLD

SEQ ID NO: 32831 - protein, 114 aa, Homo sapiens
  ENSP00000403883
MKLWVSALLMAWFGVLSCVQAEFFTSIGHMTDLIYAEKELVQSLKEYILVEEAKLSKIKSWANKMEALTSKSAADAEGYLAHPVNAYKLVKRLNTDWPALEDLVLQDSAAGFIA

SEQ ID NO: 32832 - protein, 101 aa, Homo sapiens
  ENSP00000394953
MKLWVSALLMAWFGVLSCVQAEFFTSIGHMTDLIYAEKELVQSLKEYILVEEAKLSKIKSWANKMEALTSKSAADAEGYLAHPVNAYKLVKRLNTDWPALE

SEQ ID NO: 32833 - protein, 50 aa, Homo sapiens
  ENSP00000395956
MKLWVSALLMAWFGVLSCVQAEFFTSIGHMTDLIYAEKELVQSLKEYILV

SEQ ID NO: 32834 - protein, 533 aa, Homo sapiens; identical to SEQ ID NO: 32822
  ENSP00000368394

SEQ ID NO: 32835 - protein, 535 aa, Homo sapiens; identical to SEQ ID NO: 32821
  ENSP00000368398

SEQ ID NO: 32836 - protein, 814 aa, Homo sapiens
  ENSP00000393524
MQGSKRILRSHEIVLPPSGQVETDLALTFSLQYPHFLKREGNKLQIMLQRRKRYKNRTILGYKTLAAGSISMAEVMQHPSEGGQVLSLCSSIKEAPVKAAEIWIASLSSQPIDHEDSTMQAGPKAKSTDNYSEEEYESFSSEQEASDDAVQGQDLDEDDFDVGKPKKQRRSIQQNFKQKVVALLRRFKVSDEVLDSEQDPAEHIPEAEEDLDLLYDTLDMEHPSDSGPDMEDDDSVLSTPKPKLRPYFEGLSHSSSQTEIGSIHSARSHKEPPSPADVPEKTRSLGGRQPSDSVSDTVALGVPGPREHPGQPEDSPEAEASTLDVFTERLPPSGRITKTESLVIPSTRSEGKQAGRRGRSTSLKERQAARPQNERANSLDNERCPDARSQLQIPRKTVYDQLNHILISDDQLPENIILVNTSDWQGQFLSDVLQRHTLPVVCTCSPADVQAAFSTIVSRIQRYCNCNSQPPTPVKIAVAGAQHYLSAILRLFVEQLSHKTPDWLGYMRFLVIPLGSHPVARYLGSVDYRYNNFFQDLAWRDLFNKLEAQSAVQDTPDIVSRITQYIAGANCAHQLPIAEAMLTYKQKSPDEESSQKFIPFVGVVKVGIVEPSSATSGDSDDAAPSGSGTLSSTPPSASPAAKEASPTPPSSPSVSGGLSSPSQGVGAELMGLQVDYWTAAQPADRKRDAEKKDLPVTKNTLKCTFRSLQVSRLPSSGEAAATPTMSMTVVTKEKNKKVMFLPKKAKDKDVESKSQCIEGISRLICTARQQQNMLRVLIDGVECSDVKFFQLAAQWSSHVKHFPICIFGHSKATF

SEQ ID NO: 32837 - protein, 889 aa, Homo sapiens
  ENSP00000321834
MAERGRLGLPGAPGALNTPVPMNLFATWEVDGSSPSCVPRLCSLTLKKLVVFKELEKELISVVIAVKMQGSKRILRSHEIVLPPSGQVETDLALTFSLQYPHFLKREGNKLQIMLQRRKRYKNRTILGYKTLAAGSISMAEVMQHPSEGGQVLSLCSSIKEAPVKAAEIWIASLSSQPIDHEDSTMQAGPKAKSTDNYSEEEYESFSSEQEASDDAVQGQDLDEDDFDVGKPKKQRRSIVRTTSMTRQQNFKQKVVALLRRFKVSDEVLDSEQDPAEHIPEAEEDLDLLYDTLDMEHPSDSGPDMEDDDSVLSTPKPKLRPYFEGLSHSSSQTEIGSIHSARSHKEPPSPADVPEKTRSLGGRQPSDSVSDTVALGVPGPREHPGQPEDSPEAEASTLDVFTERLPPSGRITKTESLVIPSTRSEGKQAGRRGRSTSLKERQAARPQNERANSLDNERCPDARSQLQIPRKTVYDQLNHILISDDQLPENIILVNTSDWQGQFLSDVLQRHTLPVVCTCSPADVQAAFSTIVSRIQRYCNCNSQPPTPVKIAVAGAQHYLSAILRLFVEQLSHKTPDWLGYMRFLVIPLGSHPVARYLGSVDYRYNNFFQDLAWRDLFNKLEAQSAVQDTPDIVSRITQYIAGANCAHQLPIAEAMLTYKQKSPDEESSQKFIPFVGVVKVGIVEPSSATSGDSDDAAPSGSGTLSSTPPSASPAAKEASPTPPSSPSVSGGLSSPSQGVGAELMGLQVDYWTAAQPADRKRDAEKKDLPVTKNTLKCTFRSLQVSRLPSSGEAAATPTMSMTVVTKEKNKKVMFLPKKAKDKDVESKSQCIEGISRLICTARQQQNMLRVLIDGVECSDVKFFQLAAQWSSHVKHFPICIFGHSKATF

SEQ ID NO: 32838 - protein, 904 aa, Homo sapiens
  ENSP00000393559
MAERGRLGLPGAPGALNTPVPMNLFATWEVDGSSPSCVPRLCSLTLKKLVVFKELEKELISVVIAVKMQGSKRILRSHEIVLPPSGQVETDLALTFSLQYPHFLKREGNKLQIMLQRRKRYKNRTILGYKTLAAGSISMAEVMQHPSEGGQVLSLCSSIKEAPVKAAEIWIASLSSQPIDHEDSTMQAGPKAKSTDNYSEEEYESFSSEQEASDDAVQGQDLDEDDFDVGKPKKQRRSIVRTTSMTRQQNFKQKVVALLRRFKVSDEVLDSEQDPAEHIPEAEEDLDLLYDTLDMEHPSDSGPDMEDDDSVLSTPKPKLRPYFEGLSHSSSQTEIGSIHSARSHKEPPSPADVPEKTRSLGGRQPSDSVSDTVALGVPGPREHPGQPEDSPEAEASTLDVFTERLPPSGRITKTESLVIPSTRSEGKQAGRRGRSTSLKERQAARPQNERANSLDNERCPDARSQLQVQLQIPRKTVYDQLNHILISDDQLPENIILVNTSDWQGQFLSDVLQRHTLPVVCTCSPADVQAAFSTIVSRIQRYCNCNSQPPTPVKIAVAGAQHYLSAILRLFVEQLSHKTPDWLGYMRFLVIPLGSHPVARYLGSVDYRYNNFFQDLAWRDLFNKLEAQSAVQDTPDIVSRITQYIAGANCAHQLPIAEAMLTYKQKRKKHFHFDFTLSPDEESSQKFIPFVGVVKVGIVEPSSATSGDSDDAAPSGSGTLSSTPPSASPAAKEASPTPPSSPSVSGGLSSPSQGVGAELMGLQVDYWTAAQPADRKRDAEKKDLPVTKNTLKCTFRSLQVSRLPSSGEAAATPTMSMTVVTKEKNKKVMFLPKKAKDKDVESKSQCIEGISRLICTARQQQNMLRVLIDGVECSDVKFFQLAAQWSSHVKHFPICIFGHSKATF

SEQ ID NO: 32839 - protein, 859 aa, Homo sapiens
  ENSP00000449525
MAERGRLGLPGAPGALNTPVPMNLFATWEVDGSSPSCVPRLCSLTLKKLVVFKELEKELISVVIAVKMQYPHFLKREGNKLQIMLQRRKRYKNRTILGYKTLAAGSISMAEVMQHPSEGGQVLSLCSSIKEAPVKAAEIWIASLSSQPIDHEDSTMQAGPKAKSTDNYSEEEYESFSSEQEASDDAVQGQDLDEDDFDVGKPKKQRRSIVRTTSMTRQQNFKQKVVALLRRFKVSDEVLDSEQDPAEHIPEAEEDLDLLYDTLDMEHPSDSGPDMEDDDSVLSTPKPKLRPYFEGLSHSSSQTEIGSIHSARSHKEPPSPADVPEKTRSLGGRQPSDSVSDTVALGVPGPREHPGQPEDSPEAEASTLDVFTERLPPSGRITKTESLVIPSTRSEGKQAGRRGRSTSLKERQAARPQNERANSLDNERCPDARSQLQIPRKTVYDQLNHILISDDQLPENIILVNTSDWQGQFLSDVLQRHTLPVVCTCSPADVQAAFSTIVSRIQRYCNCNSQPPTPVKIAVAGAQHYLSAILRLFVEQLSHKTPDWLGYMRFLVIPLGSHPVARYLGSVDYRYNNFFQDLAWRDLFNKLEAQSAVQDTPDIVSRITQYIAGANCAHQLPIAEAMLTYKQKSPDEESSQKFIPFVGVVKVGIVEPSSATSGDSDDAAPSGSGTLSSTPPSASPAAKEASPTPPSSPSVSGGLSSPSQGVGAELMGLQVDYWTAAQPADRKRDAEKKDLPVTKNTLKCTFRSLQVSRLPSSGEAAATPTMSMTVVTKEKNKKVMFLPKKAKDKDVESKSQCIEGISRLICTARQQQNMLRVLIDGVECSDVKFFQLAAQWSSHVKHFPICIFGHSKATF

SEQ ID NO: 32840 - protein, 86 aa, Homo sapiens
  ENSP00000447229
MQGSKRILRSHEIVLPPSGQVETDLALTFSLQYPHFLKREGNKLQIMLQRRKRYKNRTILGYKTLAAGSISMAEVMQHPSEGGQVL

SEQ ID NO: 32841 - protein, 82 aa, Homo sapiens
  ENSP00000461087
MVLSQRQRDELNRAIADYLRSNGYEEAYSVFKKEAELDVNEELDKKYAGLLEKKWTSVIRLQKKVMELESKLNEAKEEFTSG

SEQ ID NO: 32842 - protein, 410 aa, Homo sapiens
  ENSP00000380378
MVLSQRQRDELNRAIADYLRSNGYEEAYSVFKKEAELDVNEELDKKYAGLLEKKWTSVIRLQKKVMELESKLNEAKEEFTSGGPLGQKRDPKEWIPRPPEKYALSGHRSPVTRVIFHPVFSVMVSASEDATIKVWDYETGDFERTLKGHTDSVQDISFDHSGKLLASCSADMTIKLWDFQGFECIRTMHGHDHNVSSVAIMPNGDHIVSASRDKTIKMWEVQTGYCVKTFTGHREWVRMVRPNQDGTLIASCSNDQTVRVWVVATKECKAELREHEHVVECISWAPESSYSSISEATGSETKKSGKPGPFLLSGSRDKTIKMWDVSTGMCLMTLVGHDNWVRGVLFHSGGKFILSCADDKTLRVWDYKNKRCMKTLNAHEHFVTSLDFHKTAPYVVTGSVDQTVKVWECR

SEQ ID NO: 32843 - protein, 14 aa, Homo sapiens
  ENSP00000460258
MVLSQRQRDELMKN

SEQ ID NO: 32844 - protein, 208 aa, Homo sapiens
  ENSP00000460591
SADMTIKLWDFQGFECIRTMHGHDHNVSSVAIMPNGDHIVSASRDKTIKMWEVQTGYCVKTFTGHREWVRMVRPNQDGTLIASCSNDQTVRVWVVATKECKAELREHEHVVECISWAPESSYSSISEATGSEVGHDNWVRGVLFHSGGKFILSCADDKTLRVWDYKNKRCMKTLNAHEHFVTSLDFHKTAPYVVTGSVDQTVKVWECR

SEQ ID NO: 32845 - protein, 254 aa, Homo sapiens
  ENSP00000326519
MSLARGHGDTAASTAAPLSEEGEVTSGLQALAVEDTGGPSASAGKAEDEGEGGREETEREGSGGEEAQGEVPSAGGEEPAEEDSEDWCVPCSDEEVELPADGQPWMPPPSEIQRLYELLAAHGTLELQAEILPRRPPTPEAQSEEERSDEEPEAKEEEEEKPHMPTEFDFDDEPVTPKDSLIDRRRTPGSSARSQKREARLDKVLSDMKRHKKLEEQILRTGRDLFSLDSEDPSPASPPLRSSGSSLFPRQRKY

SEQ ID NO: 32846 - protein, 719 aa, Homo sapiens
  ENSP00000367679
MFGKKKKKIEISGPSNFEHRVHTGFDPQEQKFTGLPQQWHSLLADTANRPKPMVDPSCITPIQLAPMKTIVRGNKPCKETSINGLLEDFDNISVTRSNSLRKESPPTPDQGASSHGPGHAEENGFITFSQYSSESDTTADYTTEKYREKSLYGDDLDPYYRGSHAAKQNGHVMKMKHGEAYYSEVKPLKSDFARFSADYHSHLDSLSKPSEYSDLKWEYQRASSSSPLDYSFQFTPSRTAGTSGCSKESLAYSESEWGPSLDDYDRRPKSSYLNQTSPQPTMRQRSRSGSGLQEPMMPFGASAFKTHPQGHSYNSYTYPRLSEPTMCIPKVDYDRAQMVLSPPLSGSDTYPRGPAKLPQSQSKSGYSSSSHQYPSGYHKATLYHHPSLQSSSQYISTASYLSSLSLSSSTYPPPSWGSSSDQQPSRVSHEQFRAALQLVVSPGDPREYLANFIKIGEGSTGIVCIATEKHTGKQVAVKKMDLRKQQRRELLFNEVVIMRDYHHDNVVDMYSSYLVGDELWVVMEFLEGGALTDIVTHTRMNEEQIATVCLSVLRALSYLHNQGVIHRDIKSDSILLTSDGRIKLSDFGFCAQVSKEVPKRKSLVGTPYWMAPEVISRLPYGTEVDIWSLGIMVIEMIDGEPPYFNEPPLQAMRRIRDSLPPRVKDLHKVSSVLRGFLDLMLVREPSQRATAQELLGHPFLKLAGPPSCIVPLMRQYRHH

SEQ ID NO: 32847 - protein, 719 aa, Homo sapiens; identical to SEQ ID NO: 32846
  ENSP00000322957

SEQ ID NO: 32848 - protein, 719 aa, Homo sapiens; identical to SEQ ID NO: 32846
  ENSP00000367686

SEQ ID NO: 32849 - protein, 379 aa, Homo sapiens
  ENSP00000363656
MEMAEAELHKERLQAIAEKRKRQTEIEGKRQQLDEQILLLQHSKSKVLREKWLLQGIPAGTAEEEEARRRQSEEDEFRVKQLEDNIQRLEQEIQTLESEESQISAKEQIILEKLKETEKSFKDFQKGFSSTDGAVYAMEINVEKDKQTGETKILSTSTIGPEGVHQKGVKVYDDGTKVVYEVRSGGTVVENGVHKLSTKDVEELIQKAGQSSLGGGHVSERTVIADGSLSHPKEHMLCKEAKLEMVHKSRKDHSSGNPGQQAQAPSAAGPEANLDQPVTMIFMGYQNIEDEEETKKVLGYDETIKAELVLIDEDDEKSLREKTVTDVSTIDGNAAELVSGRPVSDTTEPSSPEGKEESLATEPAPGTQKKKRCQCCVVM

SEQ ID NO: 32850 - protein, 377 aa, Homo sapiens
  ENSP00000417525
MAEAELHKERLQAIAEKRKRQTEIEGKRQQLDEQILLLQHSKSKVLREKWLLQGIPAGTAEEEEARRRQSEEDEFRVKQLEDNIQRLEQEIQTLESEESQISAKEQIILEKLKETEKSFKDFQKGFSSTDGAVYAMEINVEKDKQTGETKILSTSTIGPEGVHQKGVKVYDDGTKVVYEVRSGGTVVENGVHKLSTKDVEELIQKAGQSSLGGGHVSERTVIADGSLSHPKEHMLCKEAKLEMVHKSRKDHSSGNPGQQAQAPSAAGPEANLDQPVTMIFMGYQNIEDEEETKKVLGYDETIKAELVLIDEDDEKSLREKTVTDVSTIDGNAAELVSGRPVSDTTEPSSPEGKEESLATEPAPGTQKKKRCQCCVVM

SEQ ID NO: 32851 - protein, 411 aa, Homo sapiens
  ENSP00000323805
MAEAELHKERLQAIAEKRKRQTEIEGKRQQLDEQILLLQHSKSKVLREKWLLQGIPAGTAEEEEARRRQSEEDEFRVKQLEDNIQRLEQEIQTLESEESQISAKEQIILEKLKETEKSFKDFQKGFSSTDGDAVNYISSQLPDLPILCSRTAEPSPGQDGTSRAAAVYAMEINVEKDKQTGETKILSTSTIGPEGVHQKGVKVYDDGTKVVYEVRSGGTVVENGVHKLSTKDVEELIQKAGQSSLGGGHVSERTVIADGSLSHPKEHMLCKEAKLEMVHKSRKDHSSGNPGQQAQAPSAAGPEANLDQPVTMIFMGYQNIEDEEETKKVLGYDETIKAELVLIDEDDEKSLREKTVTDVSTIDGNAAELVSGRPVSDTTEPSSPEGKEESLATEPAPGTQKKKRCQCCVVM

SEQ ID NO: 32852 - protein, 180 aa, Homo sapiens
  ENSP00000419747
MEKRKRQTEIEGKRQQLDEQILLLQHSKSKVLREKWLLQGIPAGTAEEEEARRRQSEEDEFRVKQLEDNIQRLEQEIQTLESEESQISAKEQIILEKLKETEKSFKDFQKGFSSTDGDAVNYISSQLPDLPILCSRTAEPSPGQDGTSRAAAVYAMEINVEKDKQTGETKILSTSTIGPE

SEQ ID NO: 32853 - protein, 29 aa, Homo sapiens
  ENSP00000421569
MAGRVPSLLVLLVFPSSCLAFRSPLSVFK

SEQ ID NO: 32854 - protein, 25 aa, Homo sapiens
  ENSP00000420851
MAGRVPSLLVLLVFPSSCLAFRSPL

SEQ ID NO: 32855 - protein, 68 aa, Homo sapiens
  ENSP00000426448
MAGRVPSLLVLLVFPSSCLAFRSPLSVFKRFKETTRPFSNECLGTTRPVVPIDSSDFALDIRMPGVTP

SEQ ID NO: 32856 - protein, 42 aa, Homo sapiens
  ENSP00000421823
MAGRVPSLLVLLVFPSSCLAFRSPLSVFKRFKETTRPFSNEC

SEQ ID NO: 32857 - protein, 28 aa, Homo sapiens
  ENSP00000423611
MAGRVPSLLVLLVFPSSCLAFRSPLSVF

SEQ ID NO: 32858 - protein, 53 aa, Homo sapiens
  ENSP00000423763
MAGRVPSLLVLLVFPSSCLAFRSPLSVFKRFKETTRPFSNECLGTTRPVVPID

SEQ ID NO: 32859 - protein, 973 aa, Homo sapiens [sequence omitted]

SEQ ID NO: 32860 - protein, 887 aa, Homo sapiens
  ENSP00000282992
MAGRVPSLLVLLVFPSSCLAFRSPLSVFKRFKETTRPFSNECLGTTRPVVPIDSSDFALDIRMPGVTPKQSDTYFCMSMRIPVDEEAFVIDFKPRASMDTVHHMLLFGCNMPSSTGSYWFCDEGTCTDKANILYAWARNAPPTRLPKGVGFRVGGETGSKYFVLQVHYGDISAFRDNNKDCSGVSLHLTRLPQPLIAGMYLMMSVDTVIPAGEKVVNSDISCHYKNYPMHVFAYRVHTHHLGKVVSGYRVRNGQWTLIGRQSPQLPQAFYPVGHPVDVSFGDLLAARCVFTGEGRTEATHIGGTSSDEMCNLYIMYYMEAKHAVSFMTCTQNVAPDMFRTIPPEANIPIPVKSDMVMMHEHHKETEYKDKIPLLQQPKREEEEVLDQGDFYSLLSKLLGEREDVVHVHKYNPTEKAESESDLVAEIANVVQKKDLGRSDAREGAEHERGNAILVRDRIHKFHRLVSTLRPPESRVFSLQQPPPGEGTWEPEHTGDFHMEEALDWPGVYLLPGQVSGVALDPKNNLVIFHRGDHVWDGNSFDSKFVYQQIGLGPIEEDTILVIDPNNAAVLQSSGKNLFYLPHGLSIDKDGNYWVTDVALHQVFKLDPNNKEGPVLILGRSMQPGSDQNHFCQPTDVAVDPGTGAIYVSDGYCNSRIVQFSPSGKFITQWGEESSGSSPLPGQFTVPHSLALVPLLGQLCVADRENGRIQCFKTDTKEFVREIKHSSFGRNVFAISYIPGLLFAVNGKPHFGDQEPVQGFVMNFSNGEIIDIFKPVRKHFDMPHDIVASEDGTVYIGDAHTNTVWKFTLTEKLEHRSVKKAGIEVQEIKGKGSGGLNLGNFFASRKGYSRKGFDRLSTEGSDQEKEDDGSESEEEYSAPLPALAPSSS

SEQ ID NO: 32861 - protein, 175 aa, Homo sapiens
  ENSP00000302544
MAGRVPSLLVLLVFPSSCLAFRSPLSVFKRFKETTRPFSNECLGTTRPVVPIDSSDFALDIRMPGVTPKQLTSSLEPAWILSITCYFLDAICLHPLEVTGFVMKEPVQIKPIFCMPGREMLPLPGSPKVLDSELEERLEVNTLYYRYTMGILVLLEIITRTVLVCPYTSHVCHSL

SEQ ID NO: 32862 - protein, 866 aa, Homo sapiens
  ENSP00000314638
MAGRVPSLLVLLVFPSSCLAFRSPLSVFKRFKETTRPFSNECLGTTRPVVPIDSSDFALDIRMPGVTPKQSDTYFCMSMRIPVDEEAFVIDFKPRASMDTVHHMLLFGCNMPSSTGSYWFCDEGTCTDKANILYAWARNAPPTRLPKGVGFRVGGETGSKYFVLQVHYGDISAFRDNNKDCSGVSLHLTRLPQPLIAGMYLMMSVDTVIPAGEKVVNSDISCHYKNYPMHVFAYRVHTHHLGKVVSGYRVRNGQWTLIGRQSPQLPQAFYPVGHPVDVSFGDLLAARCVFTGEGRTEATHIGGTSSDEMCNLYIMYYMEAKHAVSFMTCTQNVAPDMFRTIPPEANIPIPVKSDMVMMHEHHKETEYKDKIPLLQQPKREEEEVLDQDFHMEEALDWPGVYLLPGQVSGVALDPKNNLVIFHRGDHVWDGNSFDSKFVYQQIGLGPIEEDTILVIDPNNAAVLQSSGKNLFYLPHGLSIDKDGNYWVTDVALHQVFKLDPNNKEGPVLILGRSMQPGSDQNHFCQPTDVAVDPGTGAIYVSDGYCNSRIVQFSPSGKFITQWGEESSGSSPLPGQFTVPHSLALVPLLGQLCVADRENGRIQCFKTDTKEFVREIKHSSFGRNVFAISYIPGLLFAVNGKPHFGDQEPVQGFVMNFSNGEIIDIFKPVRKHFDMPHDIVASEDGTVYIGDAHTNTVWKFTLTEKLEHRSVKKAGIEVQEIKEAEAVVETKMENKPTSSELQKMQEKQKLIKEPGSGVPVVLITTLLVIPVVVLLAIAIFIRWKKSRAFGDSEHKLETSSGRVLGRFRGKGSGGLNLGNFFASRKGYSRKGFDRLSTEGSDQEKEDDGSESEEEYSAPLPALAPSSS

SEQ ID NO: 32863 - protein, 974 aa, Homo sapiens
  ENSP00000306100
MAGRVPSLLVLLVFPSSCLAFRSPLSVFKRFKETTRPFSNECLGTTRPVVPIDSSDFALDIRMPGVTPKQSDTYFCMSMRIPVDEEAFVIDFKPRASMDTVHHMLLFGCNMPSSTGSYWFCDEGTCTDKANILYAWARNAPPTRLPKGVGFRVGGETGSKYFVLQVHYGDISAFRDNNKDCSGVSLHLTRLPQPLIAGMYLMMSVDTVIPAGEKVVNSDISCHYKNYPMHVFAYRVHTHHLGKVVSGYRVRNGQWTLIGRQSPQLPQAFYPVGHPVDVSFGDLLAARCVFTGEGRTEATHIGGTSSDEMCNLYIMYYMEAKHAVSFMTCTQNVAPDMFRTIPPEANIPIPVKSDMVMMHEHHKETEYKDKIPLLQQPKREEEEVLDQGDFYSLLSKLLGEREDVVHVHKYNPTEKAESESDLVAEIANVVQKKDLGRSDAREGAEHERGNAILVRDRIHKFHRLVSTLRPPESRVFSLQQPPPGEGTWEPEHTGDFHMEEALDWPGVYLLPGQVSGVALDPKNNLVIFHRGDHVWDGNSFDSKFVYQQIGLGPIEEDTILVIDPNNAAVLQSSGKNLFYLPHGLSIDKDGNYWVTDVALHQVFKLDPNNKEGPVLILGRSMQPGSDQNHFCQPTDVAVDPGTGAIYVSDGYCNSRIVQFSPSGKFITQWGEESSGSSPLPGQFTVPHSLALVPLLGQLCVADRENGRIQCFKTDTKEFVREIKHSSFGRNVFAISYIPGLLFAVNGKPHFGDQEPVQGFVMNFSNGEIIDIFKPVRKHFDMPHDIVASEDGTVYIGDAHTNTVWKFTLTEKLEHRSVKKAGIEVQEIKEAEAVVETKMENKPTSSELQKMQEKQKLIKEPGSGVPVVLITTLLVIPVVVLLAIAIFIRWKKSRAFGADSEHKLETSSGRVLGRFRGKGSGGLNLGNFFASRKGYSRKGFDRLSTEGSDQEKEDDGSESEEEYSAPLPALAPSSS

SEQ ID NO: 32864 - protein, 905 aa, Homo sapiens
  ENSP00000403461
MAGRVPSLLVLLVFPSSCLAFRSPLSVFKRFKETTRPFSNECLGTTRPVVPIDSSDFALDIRMPGVTPKQSDTYFCMSMRIPVDEEAFVIDFKPRASMDTVHHMLLFGCNMPSSTGSYWFCDEGTCTDKANILYAWARNAPPTRLPKGVGFRVGGETGSKYFVLQVHYGDISAFRDNNKDCSGVSLHLTRLPQPLIAGMYLMMSVDTVIPAGEKVVNSDISCHYKNYPMHVFAYRVHTHHLGKVVSGYRVRNGQWTLIGRQSPQLPQAFYPVGHPVDVSFGDLLAARCVFTGEGRTEATHIGGTSSDEMCNLYIMYYMEAKHAVSFMTCTQNVAPDMFRTIPPEANIPIPVKSDMVMMHEHHKETEYKDKIPLLQQPKREEEEVLDQGDFYSLLSKLLGEREDVVHVHKYNPTEKAESESDLVAEIANVVQKKDLGRSDAREGAEHERGNAILVRDRIHKFHRLVSTLRPPESRVFSLQQPPPGEGTWEPEHTGDFHMEEALDWPGVYLLPGQVSGVALDPKNNLVIFHRGDHVWDGNSFDSKFVYQQIGLGPIEEDTILVIDPNNAAVLQSSGKNLFYLPHGLSIDKDGNYWVTDVALHQVFKLDPNNKEGPVLILGRSMQPGSDQNHFCQPTDVAVDPGTGAIYVSDGYCNSRIVQFSPSGKFITQWGEESSGSSPLPGQFTVPHSLALVPLLGQLCVADRENGRIQCFKTDTKEFVREIKHSSFGRNVFAISYIPGLLFAVNGKPHFGDQEPVQGFVMNFSNGEIIDIFKPVRKHFDMPHDIVASEDGTVYIGDAHTNTVWKFTLTEKLEHRSVKKAGIEVQEIKDSEHKLETSSGRVLGRFRGKGSGGLNLGNFFASRKGYSRKGFDRLSTEGSDQEKEDDGSESEEEYSAPLPALAPSSS

SEQ ID NO: 32865 - protein, 679 aa, Homo sapiens
  ENSP00000369125
  MOD_RES (1)..(1): Any amino acid
XMHVFAYRVHTHHLGKVVSGYRVRNGQWTLIGRQSPQLPQAFYPVGHPVDVSFGDLLAARCVFTGEGRTEATHIGGTSSDEMCNLYIMYYMEAKHAVSFMTCTQNVAPDMFRTIPPEANIPIPVKSDMVMMHEHHKETEYKDKIPLLQQPKREEEEVLDQGDFYSLLSKLLGEREDVVHVHKYNPTEKAESESDLVAEIANVVQKKDLGRSDAREGAEHERGNAILVRDRIHKFHRLVSTLRPPESRVFSLQQPPPGEGTWEPEHTGDFHMEEALDWPGVYLLPGQVSGVALDPKNNLVIFHRGDHVWDGNSFDSKFVYQQIGLGPIEEDTILVIDPNNAAVLQSSGKNLFYLPHGLSIDKDGNYWVTDVALHQVFKLDPNNKEGPVLILGRSMQPGSDQNHFCQPTDVAVDPGTGAIYVSDGYCNSRIVQFSPSGKFITQWGEESSGSSPLPGQFTVPHSLALVPLLGQLCVADRENGRIQCFKTDTKEFVREIKHSSFGRNVFAISYIPGLLFAVNGKPHFGDQEPVQGFVMNFSNGEIIDIFKPVRKHFDMPHDIVASEDGTVYIGDAHTNTVWKFTLTEKLEHRSVKKAGIEVQEIKADSEHKLETSSGRVLGRFRGKGSGGLNLGNFFASRKGYSRKGFDRLSTEGSDQEKEDDGSESEEEYSAPLPALAPSSS

SEQ ID NO: 32866 - protein, 250 aa, Homo sapiens
  ENSP00000424203
  MOD_RES (1)..(1): Any amino acid
XRIQCFKTDTKEFVREIKHSSFGRNVFAISYIPGLLFAVNGKPHFGDQEPVQGFVMNFSNGEIIDIFKPVRKHFDMPHDIVASEDGTVYIGDAHTNTVWKFTLTEKLEHRSVKKAGIEVQEIKEAEAVVETKMENKPTSSELQKMQEKQKLIKEPGSGVPVVLITTLLVIPVVVLLAIAIFIRWKKSRAFGGKGSGGLNLGNFFASRKGYSRKGFDRLSTEGSDQEKEDDGSESEEEYSAPLPALAPSSS

SEQ ID NO: 32867 - protein, 643 aa, Homo sapiens
  ENSP00000159647
MHHLLEQSADMATALLAGEKLRELILPGAQDDKAGALAALLLQLKLELPFDRVVTIGTVLVPILLVTLVFTKNFAEEPIYCYTPHNFTRDQALYARGYCWTELRDALPGVDASLWPSLFEHKFLPYALLAFAAIMYVPALGWEFLASTRLTSELNFLLQEIDNCYHRAAEGRAPKIEKQIQSKGPGITEREKREIIENAEKEKSPEQNLFEKYLERRGRSNFLAKLYLARHVLILLLSAVPISYLCTYYATQKQNEFTCALGASPDGAAGAGPAVRVSCKLPSVQLQRIIAGVDIVLLCVMNLIILVNLIHLFIFRKSNFIFDKLHKVGIKTRRQWRRSQFCDINILAMFCNENRDHIKSLNRLDFITNESDLMYDNVVRQLLAALAQSNHDATPTVRDSGVQTVDPSANPAEPDGAAEPPVVKRPRKKMKWIPTSNPLPQPFKEPLAIMRVENSKAEKPKPARRKTATDTLIAPLLDRSAHHYKGGGGDPGPGPAPAPAPPPAPDKKHARHFSLDVHPYILGTKKAKAEAVPAALPASRSQEGGFLSQAEDCGLGLAPAPIKDAPLPEKEIPYPTEPARAGLPSGGPFHVRSPPAAPAVAPLTPASLGKAEPLTILSRNATHPLLHINTLSSSPPSTSRERS

SEQ ID NO: 32868 - protein, 677 aa, Homo sapiens
  ENSP00000379183
MHHLLEQSADMATALLAGEKLRELILPGAQDDKAGALAALLLQLKLELPFDRVVTIGTVLVPILLVTLVFTKNFAEEPIYCYTPHNFTRDQALYARGYCWTELRDALPGVDASLWPSLFEHKFLPYALLAFAAIMYVPALGWEFLASTRLTSELNFLLQEIDNCYHRAAEGRAPKIEKQIQSKGPGITEREKREIIENAEKEKSPEQNLFEKYLERRGRSNFLAKLYLARHVLILLLSAVPISYLCTYYATQKQNEFTCALGASPDGAAGAGPAVRVSCKLPSVQLQRIIAGVDIVLLCVMNLIILVNLIHLFIFRKSNFIFDKLHKVGIKTRRQWRRSQFCDINILAMFCNENRDHIKSLNRLDFITNESDLMYDNVVRQLLAALAQSNHDATPTVRDSGVQTVDPSANPAEPDGAAEPPVVKRPRKKMKWIPTSNPLPQPFKEPLAIMRVENSKAEKPKPARRKTATDTLIAPLLDRSAHHYKGGGGDPGPGPAPAPAPPPAPDKKHARHFSLDVHPYILGTKKAKAEAVPAALPASRSQEGGFLSQAEDCGLGLAPAPIKDAPLPEKEIPYPTEPARAGLPSGGPFHVRSPPAAPAVAPLTPASLGKAEPLTILSRNATHPLLHINTLYEAREEEDGGPRLPQDVGDLIAIPAPQQILIATFDEPRTVVSTVEF

SEQ ID NO: 32869 - protein, 77 aa, Homo sapiens
  ENSP00000384148
MATALLAGEKLRELILPGAQDDKAGALAALLLQLKLELPFDRVVTIGTVLVPILLVTLVFTKNFAGWTLFSGSWDWL

SEQ ID NO: 32870 - protein, 273 aa, Homo sapiens
  ENSP00000321804
MAFLAGPRLLDWASSPPHLQFNKFVLTGYRPASSGSGCLRSLFYLHNELGNIYTHGLALLGFLVLVPMTMPWGQLGKDGWLGGTHCVACLAPPAGSVLYHLFMCHQGGSAVYARLLALDMCGVCLVNTLGALPIIHCTLACRPWLRPAALVGYTVLSGVAGWRALTAPSTSARLRAFGWQAAARLLVFGARGVGLGSGAPGSLPCYLRMDALALLGGLVNVARLPERWGPGRFDYWGNSHQIMHLLSVGSILQLHAGVVPDLLWAAHHACPRD

SEQ ID NO: 32871 - protein, 234 aa, Homo sapiens
  ENSP00000293978
MAFLAGPRLLDWASSPPHLQFNKFVLTGYRPASSGSGCLRSLFYLHNELGNIYTHGSVLYHLFMCHQGGSAVYARLLALDMCGVCLVNTLGALPIIHCTLACRPWLRPAALVGYTVLSGVAGWRALTAPSTSARLRAFGWQAAARLLVFGARGVGLGSGAPGSLPCYLRMDALALLGGLVNVARLPERWGPGRFDYWGNSHQIMHLLSVGSILQLHAGVVPDLLWAAHHACPRD

SEQ ID NO: 32872 - protein, 206 aa, Homo sapiens
  ENSP00000460326
MTMPWGQLGKDGWLGGTHCVACLAPPAGSVLYHLFMCHQGGSAVYARLLALDMCGVCLVNTLGALPIIHCTLACRPWLRPAALVGYTVLSGVAGWRALTAPSTSARLRAFGWQAAARLLVFGARGVGLGSGAPGSLPCYLRMDALALLGGLVNVARLPERWGPGRFDYWGNSHQIMHLLSVGSILQLHAGVVPDLLWAAHHACPRD

SEQ ID NO: 32873 - protein, 199 aa, Homo sapiens
  ENSP00000459418
MAFLAGPRLLDWASSPPHLQFNKFVLTGYRPASSGSGCLRSLFYLHNELGNIYTHGALPIIHCTLACRPWLRPAALVGYTVLSGVAGWRALTAPSTSARLRAFGWQAAARLLVFGARGVGLGSGAPGSLPCYLRMDALALLGGLVNVARLPERWGPGRFDYWGNSHQIMHLLSVGSILQLHAGVVPDLLWAAHHACPRD

SEQ ID NO: 32874 - protein, 206 aa, Homo sapiens; identical to SEQ ID NO: 32872
  ENSP00000458683

SEQ ID NO: 32875 - protein, 344 aa, Homo sapiens
  ENSP00000292291
MLSLKLPQLLQVHQVPRVFWEDGIMSGYRRPTSSALDCVLSSFQMTNETVNIWTHFLPTWYFLWRLLALAGGPGFRAEPYHWPLLVFLLPACLYPFASCCAHTFSSMSPRMRHICYFLDYGALSLYSLGCAFPYAAYSMPASWLHGHLHQFFVPAAALNSFLCTGLSCYSRFLELESPGLSKVLRTGAFAYPFLFDNLPLFYRLGLCWGRGHGCGQEALSTSHGYHLFCALLTGFLFASHLPERLAPGRFDYIGHSHQLFHICAVLGTHFQLEAVLADMGSRRAWLATQEPALGLAGTVATLVLAAAGNLLIIAAFTATLLRAPSTCPLLQGGPLEGGTQAKQQ

SEQ ID NO: 32876 - protein, 351 aa, Homo sapiens
  ENSP00000338330
MSPRMRHICYFLDYGALSLYSLGCAFPYAAYSMPASWLHGHLHQFFVPAAALNSFLCTGLSCYSRFLELESPGLSKVLRTGAFAYPFLFDNLPLFYRLGLCWGRGHGCGQEALSTSHGYHLFCALLTGFLFASHLPERLAPGRFDYIGEGTPGPAREEAGADAFPEHRMNWATATSYSTSVQCWAPTSSWRQCWLIWDHAEPGWPHRNLPWAWQAQWPHWSWLQLGTYSLLLLSQPPCFGPPVHALCCRVAHWRGVPRPNNSEAPSLTLSWRGQRPGPSADEEPRFGPNQVGTHLSLEPTGAEERGHRREGREEEGCLGGLAECERDREGALDGSGRSAEGLRGEMHACPG

SEQ ID NO: 32877 - protein, 363 aa, Homo sapiens
  ENSP00000341926
TLPPSAWLAAALDSARGALGLLTHQLRSTHQALGVLGRWHHVWLPPPHQLGFGLCPQLLPDDQRDGQHLDSLPAHLVRGGSAPGRGLELRGGTQAGRDRPGPRAAAAVAGVRGGLSTRPPQVLPVAAPGAGGRPRLPCGAVPLAAAGLPAARLPLPLRVVLRAHLQLHVAPHAPHLLLPRLRRAQPLQSGFLELESPGLSKVLRTGAFAYPFLFDNLPLFYRLGLCWGRGHGCGQEALSTSHGYHLFCALLTGFLFASHLPERLAPGRFDYIGHSHQLFHICAVLGTHFQLEAVLADMGSRRAWLATQEPALGLAGTVATLVLAAAGNLLIIAAFTATLLRAPSTCPLLQGGPLEGGTQAKQQ

SEQ ID NO: 32878 - protein, 320 aa, Homo sapiens
  ENSP00000357253
MSGYRRPTSSALDCVLSSFQMTNETVNIWTHFLPTWYFLWRLLALAGGPGFRAEPYHWPLLVFLLPACLYPFASCCAHTFSSMSPRMRHICYFLDYGALSLYSLGCAFPYAAYSMPASWLHGHLHQFFVPAAALNSFLCTGLSCYSRFLELESPGLSKVLRTGAFAYPFLFDNLPLFYRLGLCWGRGHGCGQEALSTSHGYHLFCALLTGFLFASHLPERLAPGRFDYIGHSHQLFHICAVLGTHFQLEAVLADMGSRRAWLATQEPALGLAGTVATLVLAAAGNLLIIAAFTATLLRAPSTCPLLQGGPLEGGTQAKQQ

SEQ ID NO: 32879 - protein, 211 aa, Homo sapiens
  ENSP00000485607
MATISSARCSLASSSPPTCLKGWHQDALITSATATSYSTSVQCWAPTSSWRQCWLIWDHAEPGWPHRNLPWAWQAQWPHWSWLQLGTYSLLLLSQPPCFGPPVHALCCRVAHWRGVPRPNNSEAPSLTLSWRGQRPGPSADEEPRFGPNQVGTHLSLEPTGAEERGHRREGREEEGCLGGLAECERDREGALDGSGRSAEGLRGEMHACPG

SEQ ID NO: 32880 - protein, 211 aa, Homo sapiens; identical to SEQ ID NO: 32879
  ENSP00000479864

SEQ ID NO: 32881 - protein, 341 aa, Homo sapiens
  ENSP00000349474
MLSLKLPQLLQVHQVFWEDGIMSGYRRPTSSALDCVLSSFQMTNETVNIWTHFLPTWYFLWRLLALAGGPGFRAEPYHWPLLVFLLPACLYPFASCCAHTFSSMSPRMRHICYFLDYGALSLYSLGCAFPYAAYSMPASWLHGHLHQFFVPAAALNSFLCTGLSCYSRFLELESPGLSKVLRTGAFAYPFLFDNLPLFYRLGLCWGRGHGCGQEALSTSHGYHLFCALLTGFLFASHLPERLAPGRFDYIGHSHQLFHICAVLGTHFQLEAVLADMGSRRAWLATQEPALGLAGTVATLVLAAAGNLLIIAAFTATLLRAPSTCPLLQGGPLEGGTQAKQQ

SEQ ID NO: 32882 - protein, 211 aa, Homo sapiens; identical to SEQ ID NO: 32879
  ENSP00000443167

SEQ ID NO: 32883 - protein, 283 aa, Homo sapiens
  ENSP00000482685
MPPTPCRPPGCTATCTSSLCLPPHSTPSCAPASPATPVSWSWKALGSVRSSAQEPSPIHSCSTTSHSFIGLAPGRFDYIGEGTPGPAREEAGADAFPEHRMNWATATSYSTSVQCWAPTSSWRQCWLIWDHAEPGWPHRNLPWAWQAQWPHWSWLQLGTYSLLLLSQPPCFGPPVHALCCRVAHWRGVPRPNNSEAPSLTLSWRGQRPGPSADEEPRFGPNQVGTHLSLEPTGAEERGHRREGREEEGCLGGLAECERDREGALDGSGRSAEGLRGEMHACPG

SEQ ID NO: 32884 - protein, 1356 aa, Homo sapiens
  ENSP00000363921
MKVTVCFGRTRVVVPCGDGHMKVFSLIQQAVTRYRKAIAKDPNYWIQVHRLEHGDGGILDLDDILCDVADDKDRLVAVFDEQDPHHGGDGTSASSTGTQSPEIFGSELGTNNVSAFQPYQATSEIEVTPSVLRANMPLHVRRSSDPALIGLSTSVSDSNFSSEEPSRKNPTRWSTTAGFLKQNTAGSPKTCDRKKDENYRSLPRDTSNWSNQFQRDNARSSLSASHPMVGKWLEKQEQDEDGTEEDNSRVEPVGHADTGLEHIPNFSLDDMVKLVEVPNDGGPLGIHVVPFSARGGRTLGLLVKRLEKGGKAEHENLFRENDCIVRINDGDLRNRRFEQAQHMFRQAMRTPIIWFHVVPAANKEQYEQLSQSEKNNYYSSRFSPDSQYIDNRSVNSAGLHTVQRAPRLNHPPEQIDSHSRLPHSAHPSGKPPSAPASAPQNVFSTTVSSGYNTKKIGKRLNIQLKKGTEGLGFSITSRDVTIGGSAPIYVKNILPRGAAIQDGRLKAGDRLIEVNGVDLVGKSQEEVVSLLRSTKMEGTVSLLVFRQEDAFHPRELNAEPSQMQIPKETKAEDEDIVLTPDGTREFLTFEVPLNDSGSAGLGVSVKGNRSKENHADLGIFVKSIINGGAASKDGRLRVNDQLIAVNGESLLGKTNQDAMETLRRSMSTEGNKRGMIQLIVARRISKCNELKSPGSPPGPELPIETALDDRERRISHSLYSGIEGLDESPSRNAALSRIMGESGKYQLSPTVNMPQDDTVIIEDDRLPVLPPHLSDQSSSSSHDDVGFVTADAGTWAKAAISDSADCSLSPDVDPVLAFQREGFGRQSMSEKRTKQFSDASQLDFVKTRKSKSMDLGIADETKLNTVDDQKAGSPSRDVGPSLGLKKSSSLESLQTAVAEVTLNGDIPFHRPRPRIIRGRGCNESFRAAIDKSYDKPAVDDDDEGMETLEEDTEESSRSGRESVSTASDQPSHSLERQMNGNQEKGDKTDRKKDKTGKEKKKDRDKEKDKMKAKKGMLKGLGDMFRFGKHRKDDKIEKTGKIKIQESFTSEEERIRMKQEQERIQAKTREFRERQARERDYAEIQDFHRTFGCDDELMYGGVSSYEGSMALNARPQSPREGHMMDALYAQVKKPRNSKPSPVDSNRSTPSNHDRIQRLRQEFQQAKQDEDVEDRRRTYSFEQPWPNARPATQSGRHSVSVEVQMQRQRQEERESSQQAQRQYSSLPRQSRKNASSVSQDSWEQNYSPGEGFQSAKENPRYSSYQGSRNGYLGGHGFNARVMLETQELLRQEQRRKEQQMKKQPPSEGPSNYDSYKKVQDPSYAPPKGPFRQDVPPSPSQVARLNRLQTPEKGRPFYS

SEQ ID NO: 32885 - protein, 1353 aa, Homo sapiens
  ENSP00000363920
MKVTVCFGRTRVVVPCGDGHMKVFSLIQQAVTRYRKAIAKDPNYWIQVHRLEHGDGGILDLDDILCDVADDKDRLVAVFDEQDPHHGGDGTSASSTGTQSPEIFGSELGTNNVSAFQPYQATSEIEVTPSVLRANMPLHVRRSSDPALIGLSTSVSDSNFSSEEPSRKNPTRWSTTAGFLKQNTAGSPKTCDRKKDENYRSLPRDTSNWSNQFQRDNARSSLSASHPMVGKWLEKQEQDEDGTEEDNSRVEPVGHADTGLEHIPNFSLDDMVKLVEVPNDGGPLGIHVVPFSARGGRTLGLLVKRLEKGGKAEHENLFRENDCIVRINDGDLRNRRFEQAQHMFRQAMRTPIIWFHVVPAANKEQYEQLSQSEKNNYYSSRFSPDSQYIDNRSVNSAGLHTVQRAPRLNHPPEQIDSHSRLPHSAHPSGKPPSAPASAPQNVFSTTVSSGYNTKKIGKRLNIQLKKGTEGLGFSITSRDVTIGGSAPIYVKNILPRGAAIQDGRLKAGDRLIEVNGVDLVGKSQEEVVSLLRSTKMEGTVSLLVFRQEDAFHPRELNAEPSQMQIPKETKAEDEDIVLTPDGTREFLTFEVPLNDSGSAGLGVSVKGNRSKENHADLGIFVKSIINGGAASKDGRLRVNDQLIAVNGESLLGKTNQDAMETLRRSMSTEGNKRGMIQLIVARRISKCNELKSPGSPPGPELPIETALDDRERRISHSLYSGIEGLDESPSRNAALSRIMGKYQLSPTVNMPQDDTVIIEDDRLPVLPPHLSDQSSSSSHDDVGFVTADAGTWAKAAISDSADCSLSPDVDPVLAFQREGFGRQSMSEKRTKQFSDASQLDFVKTRKSKSMDLGIADETKLNTVDDQKAGSPSRDVGPSLGLKKSSSLESLQTAVAEVTLNGDIPFHRPRPRIIRGRGCNESFRAAIDKSYDKPAVDDDDEGMETLEEDTEESSRSGRESVSTASDQPSHSLERQMNGNQEKGDKTDRKKDKTGKEKKKDRDKEKDKMKAKKGMLKGLGDMFRFGKHRKDDKIEKTGKIKIQESFTSEEERIRMKQEQERIQAKTREFRERQARERDYAEIQDFHRTFGCDDELMYGGVSSYEGSMALNARPQSPREGHMMDALYAQVKKPRNSKPSPVDSNRSTPSNHDRIQRLRQEFQQAKQDEDVEDRRRTYSFEQPWPNARPATQSGRHSVSVEVQMQRQRQEERESSQQAQRQYSSLPRQSRKNASSVSQDSWEQNYSPGEGFQSAKENPRYSSYQGSRNGYLGGHGFNARVMLETQELLRQEQRRKEQQMKKQPPSEGPSNYDSYKKVQDPSYAPPKGPFRQDVPPSPSQVARLNRLQTPEKGRPFYS

SEQ ID NO: 32886 - protein, 1319 aa, Homo sapiens
  ENSP00000340591
MKVTVCFGRTRVVVPCGDGHMKVFSLIQQAVTRYRKAIAKDPNYWIQVHRLEHGDGGILDLDDILCDVADDKDRLVAVFDEQDPHHGGDGTSASSTGTQSPEIFGSELGTNNVSAFQPYQATSEIEVTPSVLRANMPLHVRRSSDPALIGLSTSVSDSNFSSEEPSRKNPTRWSTTAGFLKQNTAGSPKTCDRKKDENYRSLPRDTSNWSNQFQRDNARSSLSASHPMVGKWLEKQEQDEDGTEEDNSRVEPVGHADTGLEHIPNFSLDDMVKLVEVPNDGGPLGIHVVPFSARGGRTLGLLVKRLEKGGKAEHENLFRENDCIVRINDGDLRNRRFEQAQHMFRQAMRTPIIWFHVVPAANKEQYEQLSQSEKNNYYSSRFSPDSQYIDNRSVNSAGLHTVQRAPRLNHPPEQIDSHSRLPHSAHPSGKPPSAPASAPQNVFSTTVSSGYNTKKIGKRLNIQLKKGTEGLGFSITSRDVTIGGSAPIYVKNILPRGAAIQDGRLKAGDRLIEVNGVDLVGKSQEEVVSLLRSTKMEGTVSLLVFRQEDAFHPRELNAEPSQMQIPKETKAEDEDIVLTPDGTREFLTFEVPLNDSGSAGLGVSVKGNRSKENHADLGIFVKSIINGGAASKDGRLRVNDQLIAVNGESLLGKTNQDAMETLRRSMSTEGNKRGMIQLIVARRISKCNELKSPGSPPGPELPIETALDDRERRISHSLYSGIEGLDESPSRNAALSRIMGESGKYQLSPTVNMPQDDTVIIEDDRLPVLPPHLSDQSSSSSHDDVGFVTADAGTWAKAAISDSADCSLSPDVDPVLAFQREGFGRQSMSEKRTKQFSDASQLDFVKTRKSKSMDLGIADETKLNTVDDQKAGSPSRDVGPSLGLKKSSSLESLQTAVAEVTLNGDIPFHRPRPRIIRGRGCNESFRAAIDKSYDKPAVDDDDEGMETLEEDTEESSRSGRESVSTASDQPSHSLERQMNGNQEKGDKTDRKKDKTGKEKKKDRDKEKDKMKAKKGMLKGLGDMFRIQAKTREFRERQARERDYAEIQDFHRTFGCDDELMYGGVSSYEGSMALNARPQSPREGHMMDALYAQVKKPRNSKPSPVDSNRSTPSNHDRIQRLRQEFQQAKQDEDVEDRRRTYSFEQPWPNARPATQSGRHSVSVEVQMQRQRQEERESSQQAQRQYSSLPRQSRKNASSVSQDSWEQNYSPGEGFQSAKENPRYSSYQGSRNGYLGGHGFNARVMLETQELLRQEQRRKEQQMKKQPPSEGPSNYDSYKKVQDPSYAPPKGPFRQDVPPSPSQVARLNRLQTPEKGRPFYS

SEQ ID NO: 32887 - protein, 1244 aa, Homo sapiens
  ENSP00000363926
MKVTVCFGRTRVVVPCGDGHMKVFSLIQQAVTRYRKAIAKDPNYWIQVHRLEHGDGGILDLDDILCDVADDKDRLVAVFDEQDPHHGGDGTSASSTGTQSPEIFGSELGTNNVSAFQPYQATSEIEVTPSVLRANMPLHVRRSSDPALIGLSTSVSDSNFSSEEPSRKNPTRWSTTAGFLKQNTAGSPKTCDRKDEDGTEEDNSRVEPVGHADTGLEHIPNFSLDDMVKLVEVPNDGGPLGIHVVPFSARGGRTLGLLVKRLEKGGKAEHENLFRENDCIVRINDGDLRNRRFEQAQHMFRQAMRTPIIWFHVVPAANKEQYEQLSQSEKNNYYSSRFSPDSQYIDNRSVNSAGLHTVQRAPRLNHPPEQIDSHSRLPHSAHPSGKPPSAPASAPQNVFSTTVSSGYNTKKIGKRLNIQLKKGTEGLGFSITSRDVTIGGSAPIYVKNILPRGAAIQDGRLKAGDRLIEVNGVDLVGKSQEEVVSLLRSTKMEGTVSLLVFRQEDAFHPRELKAEDEDIVLTPDGTREFLTFEVPLNDSGSAGLGVSVKGNRSKENHADLGIFVKSIINGGAASKDGRLRVNDQLIAVNGESLLGKTNQDAMETLRRSMSTEGNKRGMIQLIVARRISKCNELKSPGSPPGPELPIETALDDRERRISHSLYSGIEGLDESPSRNAALSRIMGKYQLSPTVNMPQDDTVIIEDDRLPVLPPHLSDQSSSSSHDDVGFVTADAGTWAKAAISDSADCSLSPDVDPVLAFQREGFGRQSMSEKRTKQFSDASQLDFVKTRKSKSMDLGSSPSRDVGPSLGLKKSSSLESLQTAVAEVTLNGDIPFHRPRPRIIRGRGCNESFRAAIDKSYDKPAVDDDDEGMETLEEDTEESSRSGRESVSTASDQPSHSLERQMNGNQEKGDKTDRKKDKTGKEKKKDRDKEKDKMKAKKGMLKGLGDMFRIQAKTREFRERQARERDYAEIQDFHRTFGCDDELMYGGVSSYEGSMALNARPQSPREGHMMDALYAQVKKPRNSKPSPVDSNRSTPSNHDRIQRLRQEFQQAKQDEDVEDRRRTYSFEQPWPNARPATQSGRHSVSVEVQMQRQRQEERESSQQAQRQYSSLPRQSRKNASSVSQDSWEQNYSPGEGFQSAKENPRYSSYQGSRNGYLGGHGFNARVMLETQELLRQEQRRKEQQMKKQPPSEGPSNYDSYKKVQDPSYAPPKGPFRQDVPPSPSQVARLNRLQTPEKGRPFYS

SEQ ID NO: 32888 - protein, 1310 aa, Homo sapiens
  ENSP00000311986
MKVTVCFGRTRVVVPCGDGHMKVFSLIQQAVTRYRKAIAKDPNYWIQVHRLEHGDGGILDLDDILCDVADDKDRLVAVFDEQDPHHGGDGTSASSTGTQSPEIFGSELGTNNVSAFQPYQATSEIEVTPSVLRANMPLHVRRSSDPALIGLSTSVSDSNFSSEEPSRKNPTRWSTTAGFLKQNTAGSPKTCDRKKDENYRSLPRDTSNWSNQFQRDNARSSLSASHPMVGKWLEKQEQDEDGTEEDNSRVEPVGHADTGLEHIPNFSLDDMVKLVEVPNDGGPLGIHVVPFSARGGRTLGLLVKRLEKGGKAEHENLFRENDCIVRINDGDLRNRRFEQAQHMFRQAMRTPIIWFHVVPAANKEQYEQLSQSEKNNYYSSRFSPDSQYIDNRSVNSAGLHTVQRAPRLNHPPEQIDSHSRLPHSAHPSGKPPSAPASAPQNVFSTTVSSGYNTKKIGKRLNIQLKKGTEGLGFSITSRDVTIGGSAPIYVKNILPRGAAIQDGRLKAGDRLIEVNGVDLVGKSQEEVVSLLRSTKMEGTVSLLVFRQEDAFHPRELKAEDEDIVLTPDGTREFLTFEVPLNDSGSAGLGVSVKGNRSKENHADLGIFVKSIINGGAASKDGRLRVNDQLIAVNGESLLGKTNQDAMETLRRSMSTEGNKRGMIQLIVARRISKCNELKSPGSPPGPELPIETALDDRERRISHSLYSGIEGLDESPSRNAALSRIMGKYQLSPTVNMPQDDTVIIEDDRLPVLPPHLSDQSSSSSHDDVGFVTADAGTWAKAAISDSADCSLSPDVDPVLAFQREGFGRQIADETKLNTVDDQKAGSPSRDVGPSLGLKKSSSLESLQTAVAEVTLNGDIPFHRPRPRIIRGRGCNESFRAAIDKSYDKPAVDDDDEGMETLEEDTEESSRSGRESVSTASDQPSHSLERQMNGNQEKGDKTDRKKDKTGKEKKKDRDKEKDKMKAKKGMLKGLGDMFRFGKHRKDDKIEKTGKIKIQESFTSEEERIRMKQEQERIQAKTREFRERQARERDYAEIQDFHRTFGCDDELMYGGVSSYEGSMALNARPQSPREGHMMDALYAQVKKPRNSKPSPVDSNRSTPSNHDRIQRLRQEFQQAKQDEDVEDRRRTYSFEQPWPNARPATQSGRHSVSVEVQMQRQRQEERESSQQAQRQYSSLPRQSRKNASSVSQDSWEQNYSPGEGFQSAKENPRYSSYQGSRNGYLGGHGFNARVMLETQELLRQEQRRKEQQMKKQPPSEGPSNYDSYKKVQDPSYAPPKGPFRQDVPPSPSQVARLNRLQTPEKGRPFYS

SEQ ID NO: 32889 - protein, 1296 aa, Homo sapiens
  ENSP00000363922
MKVTVCFGRTRVVVPCGDGHMKVFSLIQQAVTRYRKAIAKDPNYWIQVHRLEHGDGGILDLDDILCDVADDKDRLVAVFDEQDPHHGGDGTSASSTGTQSPEIFGSELGTNNVSAFQPYQATSEIEVTPSVLRANMPLHVRRSSDPALIGLSTSVSDSNFSSEEPSRKNPTRWSTTAGFLKQNTAGSPKTCDRKDEDGTEEDNSRVEPVGHADTGLEHIPNFSLDDMVKLVEVPNDGGPLGIHVVPFSARGGRTLGLLVKRLEKGGKAEHENLFRENDCIVRINDGDLRNRRFEQAQHMFRQAMRTPIIWFHVVPAANKEQYEQLSQSEKNNYYSSRFSPDSQYIDNRSVNSAGLHTVQRAPRLNHPPEQIDSHSRLPHSAHPSGKPPSAPASAPQNVFSTTVSSGYNTKKIGKRLNIQLKKGTEGLGFSITSRDVTIGGSAPIYVKNILPRGAAIQDGRLKAGDRLIEVNGVDLVGKSQEEVVSLLRSTKMEGTVSLLVFRQEDAFHPRELKAEDEDIVLTPDGTREFLTFEVPLNDSGSAGLGVSVKGNRSKENHADLGIFVKSIINGGAASKDGRLRVNDQLIAVNGESLLGKTNQDAMETLRRSMSTEGNKRGMIQLIVARRISKCNELKSPGSPPGPELPIETALDDRERRISHSLYSGIEGLDESPSRNAALSRIMGKYQLSPTVNMPQDDTVIIEDDRLPVLPPHLSDQSSSSSHDDVGFVTADAGTWAKAAISDSADCSLSPDVDPVLAFQREGFGRQSMSEKRTKQFSDASQLDFVKTRKSKSMDLGIADETKLNTVDDQKAGSPSRDVGPSLGLKKSSSLESLQTAVAEVTLNGDIPFHRPRPRIIRGRGCNESFRAAIDKSYDKPAVDDDDEGMETLEEDTEESSRSGRESVSTASDQPSHSLERQMNGNQEKGDKTDRKKDKTGKEKKKDRDKEKDKMKAKKGMLKGLGDMFRFGKHRKDDKIEKTGKIKIQESFTSEEERIRMKQEQERIQAKTREFRERQARERDYAEIQDFHRTFGCDDELMYGGVSSYEGSMALNARPQSPREGHMMDALYAQVKKPRNSKPSPVDSNRSTPSNHDRIQRLRQEFQQAKQDEDVEDRRRTYSFEQPWPNARPATQSGRHSVSVEVQMQRQRQEERESSQQAQRQYSSLPRQSRKNASSVSQDSWEQNYSPGEGFQSAKENPRYSSYQGSRNGYLGGHGFNARVMLETQELLRQEQRRKEQQMKKQPPSEGPSNYDSYKKVQDPSYAPPKGPFRQDVPPSPSQVARLNRLQTPEKGRPFYS

SEQ ID NO: 32890 - protein, 988 aa, Homo sapiens
  ENSP00000363908
MKVTVCFGRTRVVVPCGDGHMKVFSLIQQAVTRYRKAIAKDPNYWIQVHRLEHGDGGILDLDDILCDVADDKDRLVAVFDEQDPHHGGDGTSASSTGTQSPEIFGSELGTNNVSAFQPYQATSEIEVTPSVLRANMPLHVRRSSDPALIGLSTSVSDSNFSSEEPSRKNPTRWSTTAGFLKQNTAGSPKTCDRKKDENYRSLPRDTSNWSNQFQRDNARSSLSASHPMVGKWLEKQEQDEDGTEEDNSRVEPVGHADTGLEHIPNFSLDDMVKLVEVPNDGGPLGIHVVPFSARGGRTLGLLVKRLEKGGKAEHENLFRENDCIVRINDGDLRNRRFEQAQHMFRQAMRTPIIWFHVVPAANKEQYEQLSQSEKNNYYSSRFSPDSQYIDNRSVNSAGLHTVQRAPRLNHPPEQIDSHSRLPHSAHPSGKPPSAPASAPQNVFSTTVSSGYNTKKIGKRLNIQLKKGTEGLGFSITSRDVTIGGSAPIYVKNILPRGAAIQDGRLKAGDRLIEVNGVDLVGKSQEEVVSLLRSTKMEGTVSLLVFRQEDAFHPRELKAEDEDIVLTPDGTREFLTFEVPLNDSGSAGLGVSVKGNRSKENHADLGIFVKSIINGGAASKDGRLRVNDQLIAVNGESLLGKTNQDAMETLRRSMSTEGNKRGMIQLIVARRISKCNELKSPGSPPGPELPIETALDDRERRISHSLYSGIEGLDESPSRNAALSRIMGKYQLSPTVNMPQDDTVIIEDDRLPVLPPHLSDQSSSSSHDDVGFVTADAGTWAKAAISDSADCSLSPDVDPVLAFQREGFGRQIADETKLNTVDDQKAGSPSRDVGPSLGLKKSSSLESLQTAVAEVTLNGDIPFHRPRPRIIRGRGCNESFRAAIDKSYDKPAVDDDDEGMETLEEDTEESSRSGRESVSTASDQPSHSLERQMNGNQEKGDKTDRKKDKTGKEKKKDRDKEKDKMKAKKGMLKGLGDMFSLAKLKPEKR

SEQ ID NO: 32891 - protein, 1001 aa, Homo sapiens
  ENSP00000363905
MKVTVCFGRTRVVVPCGDGHMKVFSLIQQAVTRYRKAIAKDPNYWIQVHRLEHGDGGILDLDDILCDVADDKDRLVAVFDEQDPHHGGDGTSASSTGTQSPEIFGSELGTNNVSAFQPYQATSEIEVTPSVLRANMPLHVRRSSDPALIGLSTSVSDSNFSSEEPSRKNPTRWSTTAGFLKQNTAGSPKTCDRKKDENYRSLPRDTSNWSNQFQRDNARSSLSASHPMVGKWLEKQEQDEDGTEEDNSRVEPVGHADTGLEHIPNFSLDDMVKLVEVPNDGGPLGIHVVPFSARGGRTLGLLVKRLEKGGKAEHENLFRENDCIVRINDGDLRNRRFEQAQHMFRQAMRTPIIWFHVVPAANKEQYEQLSQSEKNNYYSSRFSPDSQYIDNRSVNSAGLHTVQRAPRLNHPPEQIDSHSRLPHSAHPSGKPPSAPASAPQNVFSTTVSSGYNTKKIGKRLNIQLKKGTEGLGFSITSRDVTIGGSAPIYVKNILPRGAAIQDGRLKAGDRLIEVNGVDLVGKSQEEVVSLLRSTKMEGTVSLLVFRQEDAFHPRELNAEPSQMQIPKETKAEDEDIVLTPDGTREFLTFEVPLNDSGSAGLGVSVKGNRSKENHADLGIFVKSIINGGAASKDGRLRVNDQLIAVNGESLLGKTNQDAMETLRRSMSTEGNKRGMIQLIVARRISKCNELKSPGSPPGPELPIETALDDRERRISHSLYSGIEGLDESPSRNAALSRIMGKYQLSPTVNMPQDDTVIIEDDRLPVLPPHLSDQSSSSSHDDVGFVTADAGTWAKAAISDSADCSLSPDVDPVLAFQREGFGRQIADETKLNTVDDQKAGSPSRDVGPSLGLKKSSSLESLQTAVAEVTLNGDIPFHRPRPRIIRGRGCNESFRAAIDKSYDKPAVDDDDEGMETLEEDTEESSRSGRESVSTASDQPSHSLERQMNGNQEKGDKTDRKKDKTGKEKKKDRDKEKDKMKAKKGMLKGLGDMFSLAKLKPEKR

SEQ ID NO: 32892 - protein, 179 aa, Homo sapiens
  ENSP00000363900
MQIPKETKAEDEDIVLTPDGTREFLTFEVPLNDSGSAGLGVSVKGNRSKENHADLGIFVKSIINGGAASKDGRLRVNDQLIAVNGESLLGKTNQDAMETLRRSMSTEGNKRGMIQLIVARRISKCNELKSPGSPPGPELPIETALDDRERRISHSLYSGIEGLDESPSRNAALSRIMGT

SEQ ID NO: 32893 - protein, 1031 aa, Homo sapiens
  ENSP00000341844
MKVTVCFGRTRVVVPCGDGHMKVFSLIQQAVTRYRKAIAKDPNYWIQVHRLEHGDGGILDLDDILCDVADDKDRLVAVFDEQDPHHGGDGTSASSTGTQSPEIFGSELGTNNVSAFQPYQATSEIEVTPSVLRANMPLHVRRSSDPALIGLSTSVSDSNFSSEEPSRKNPTRWSTTAGFLKQNTAGSPKTCDRKKDENYRSLPRDTSNWSNQFQRDNARSSLSASHPMVGKWLEKQEQDEDGTEEDNSRVEPVGHADTGLEHIPNFSLDDMVKLVEVPNDGGPLGIHVVPFSARGGRTLGLLVKRLEKGGKAEHENLFRENDCIVRINDGDLRNRRFEQAQHMFRQAMRTPIIWFHVVPAANKEQYEQLSQSEKNNYYSSRFSPDSQYIDNRSVNSAGLHTVQRAPRLNHPPEQIDSHSRLPHSAHPSGKPPSAPASAPQNVFSTTVSSGYNTKKIGKRLNIQLKKGTEGLGFSITSRDVTIGGSAPIYVKNILPRGAAIQDGRLKAGDRLIEVNGVDLVGKSQEEVVSLLRSTKMEGTVSLLVFRQEDAFHPRELNAEPSQMQIPKETKAEDEDIVLTPDGTREFLTFEVPLNDSGSAGLGVSVKGNRSKENHADLGIFVKSIINGGAASKDGRLRVNDQLIAVNGESLLGKTNQDAMETLRRSMSTEGNKRGMIQLIVARRISKCNELKSPGSPPGPELPIETALDDRERRISHSLYSGIEGLDESPSRNAALSRIMGKYQLSPTVNMPQDDTVIIEDDRLPVLPPHLSDQSSSSSHDDVGFVTADAGTWAKAAISDSADCSLSPDVDPVLAFQREGFGRQSMSEKRTKQFSDASQLDFVKTRKSKSMDLGIADETKLNTVDDQKAGSPSRDVGPSLGLKKSSSLESLQTAVAEVTLNGDIPFHRPRPRIIRGRGCNESFRAAIDKSYDKPAVDDDDEGMETLEEDTEESSRSGRESVSTASDQPSHSLERQMNGNQEKGDKTDRKKDKTGKEKKKDRDKEKDKMKAKKGMLKGLGDMFSLAKLKPEKR

SEQ ID NO: 32894 - protein, 1266 aa, Homo sapiens
  ENSP00000440857
MKVTVCFGRTRVVVPCGDGHMKVFSLIQQAVTRYRKAIAKDPNYWIQVHRLEHGDGGILDLDDILCDVADDKDRLVAVFDEQDPHHGGDGTSASSTGTQSPEIFGSELGTNNVSAFQPYQATSEIEVTPSVLRANMPLHVRRSSDPALIGLSTSVSDSNFSSEEPSRKNPTRWSTTAGFLKQNTAGSPKTCDRKDEDGTEEDNSRVEPVGHADTGLEHIPNFSLDDMVKLVEVPNDGGPLGIHVVPFSARGGRTLGLLVKRLEKGGKAEHENLFRENDCIVRINDGDLRNRRFEQAQHMFRQAMRTPIIWFHVVPAANKEQYEQLSQSEKNNYYSSRFSPDSQYIDNRSVNSAGLHTVQRAPRLNHPPEQIDSHSRLPHSAHPSGKPPSAPASAPQNVFSTTVSSGYNTKKIGKRLNIQLKKGTEGLGFSITSRDVTIGGSAPIYVKNILPRGAAIQDGRLKAGDRLIEVNGVDLVGKSQEEVVSLLRSTKMEGTVSLLVFRQEDAFHPRELKAEDEDIVLTPDGTREFLTFEVPLNDSGSAGLGVSVKGNRSKENHADLGIFVKSIINGGAASKDGRLRVNDQLIAVNGESLLGKTNQDAMETLRRSMSTEGNKRGMIQLIVARRISKCNELKSPGSPPGPELPIETALDDRERRISHSLYSGIEGLDESPSRNAALSRIMGKYQLSPTVNMPQDDTVIIEDDRLPVLPPHLSDQSSSSSHDDVGFVTADAGTWAKAAISDSADCSLSPDVDPVLAFQREGFGRQIADETKLNTVDDQKAGSPSRDVGPSLGLKKSSSLESLQTAVAEVTLNGDIPFHRPRPRIIRGRGCNESFRAAIDKSYDKPAVDDDDEGMETLEEDTEESSRSGRESVSTASDQPSHSLERQMNGNQEKGDKTDRKKDKTGKEKKKDRDKEKDKMKAKKGMLKGLGDMFRFGKHRKDDKIEKTGKIKIQESFTSEEERIRMKQEQERIQAKTREFRERQARERDYAEIQDFHRTFGCDDELMYGGVSSYEGSMALNARPQSPREGHMMDALYAQVKKPRNSKPSPVDSNRSTPSNHDRIQRLRQEFQQAKQDEDVEDRRRTYSFEQPWPNARPATQSGRHSVSVEVQMQRQRQEERESSQQAQRQYSSLPRQSRKNASSVSQDSWEQNYSPGEGFQSAKENPRYSSYQGSRNGYLGGHGFNARVMLETQELLRQEQRRKEQQMKKQPPSEGPSNYDSYKKVQDPSYAPPKGPFRQDVPPSPSQVARLNRLQTPEKGRPFYS

SEQ ID NO: 32895 - protein, 1340 aa, Homo sapiens
  ENSP00000443147
MKVTVCFGRTRVVVPCGDGHMKVFSLIQQAVTRYRKAIAKDPNYWIQVHRLEHGDGGILDLDDILCDVADDKDRLVAVFDEQDPHHGGDGTSASSTGTQSPEIFGSELGTNNVSAFQPYQATSEIEVTPSVLRANMPLHVRRSSDPALIGLSTSVSDSNFSSEEPSRKNPTRWSTTAGFLKQNTAGSPKTCDRKKDENYRSLPRDTSNWSNQFQRDNARSSLSASHPMVGKWLEKQEQDEDGTEEDNSRVEPVGHADTGLEHIPNFSLDDMVKLVEVPNDGGPLGIHVVPFSARGGRTLGLLVKRLEKGGKAEHENLFRENDCIVRINDGDLRNRRFEQAQHMFRQAMRTPIIWFHVVPAANKEQYEQLSQSEKNNYYSSRFSPDSQYIDNRSVNSAGLHTVQRAPRLNHPPEQIDSHSRLPHSAHPSGKPPSAPASAPQNVFSTTVSSGYNTKKIGKRLNIQLKKGTEGLGFSITSRDVTIGGSAPIYVKNILPRGAAIQDGRLKAGDRLIEVNGVDLVGKSQEEVVSLLRSTKMEGTVSLLVFRQEDAFHPRELKAEDEDIVLTPDGTREFLTFEVPLNDSGSAGLGVSVKGNRSKENHADLGIFVKSIINGGAASKDGRLRVNDQLIAVNGESLLGKTNQDAMETLRRSMSTEGNKRGMIQLIVARRISKCNELKSPGSPPGPELPIETALDDRERRISHSLYSGIEGLDESPSRNAALSRIMGKYQLSPTVNMPQDDTVIIEDDRLPVLPPHLSDQSSSSSHDDVGFVTADAGTWAKAAISDSADCSLSPDVDPVLAFQREGFGRQSMSEKRTKQFSDASQLDFVKTRKSKSMDLGIADETKLNTVDDQKAGSPSRDVGPSLGLKKSSSLESLQTAVAEVTLNGDIPFHRPRPRIIRGRGCNESFRAAIDKSYDKPAVDDDDEGMETLEEDTEESSRSGRESVSTASDQPSHSLERQMNGNQEKGDKTDRKKDKTGKEKKKDRDKEKDKMKAKKGMLKGLGDMFRFGKHRKDDKIEKTGKIKIQESFTSEEERIRMKQEQERIQAKTREFRERQARERDYAEIQDFHRTFGCDDELMYGGVSSYEGSMALNARPQSPREGHMMDALYAQVKKPRNSKPSPVDSNRSTPSNHDRIQRLRQEFQQAKQDEDVEDRRRTYSFEQPWPNARPATQSGRHSVSVEVQMQRQRQEERESSQQAQRQYSSLPRQSRKNASSVSQDSWEQNYSPGEGFQSAKENPRYSSYQGSRNGYLGGHGFNARVMLETQELLRQEQRRKEQQMKKQPPSEGPSNYDSYKKVQDPSYAPPKGPFRQDVPPSPSQVARLNRLQTPEKGRPFYS

SEQ ID NO: 32896 - protein, 747 aa, Homo sapiens
  ENSP00000444429
MVKLVEVPNDGGPLGIHVVPFSARGGRTLGLLVKRLEKGGKAEHENLFRENDCIVRINDGDLRNRRFEQAQHMFRQAMRTPIIWFHVVPAANKEQYEQLSQSEKNNYYSSRFSPDSQYIDNRSVNSAGLHTVQRAPRLNHPPEQIDSHSRLPHSAHPSGKPPSAPASAPQNVFSTTVSSGYNTKKIGKRLNIQLKKGTEGLGFSITSRDVTIGGSAPIYVKNILPRGAAIQDGRLKAGDRLIEVNGVDLVGKSQEEVVSLLRSTKMEGTVSLLVFRQEDAFHPRELKAEDEDIVLTPDGTREFLTFEVPLNDSGSAGLGVSVKGNRSKENHADLGIFVKSIINGGAASKDGRLRVNDQLIAVNGESLLGKTNQDAMETLRRSMSTEGNKRGMIQLIVARRISKCNELKSPGSPPGPELPIETALDDRERRISHSLYSGIEGLDESPSRNAALSRIMGKYQLSPTVNMPQDDTVIIEDDRLPVLPPHLSDQSSSSSHDDVGFVTADAGTWAKAAISDSADCSLSPDVDPVLAFQREGFGRQSMSEKRTKQFSDASQLDFVKTRKSKSMDLVADETKLNTVDDQKAGSPSRDVGPSLGLKKSSSLESLQTAVAEVTLNGDIPFHRPRPRIIRGRGCNESFRAAIDKSYDKPAVDDDDEGMETLEEDTEESSRSGRESVSTASDQPSHSLERQMNGNQEKGDKTDRKKDKTGKEKKKDRDKEKDKMKAKKGMLKGLGDMFSLAKLKPEKR

SEQ ID NO: 32897 - protein, 79 aa, Homo sapiens
  ENSP00000407718
MKVTVCFGRTGIVVPCKEGQLRVGELTQQALQRYLKTREKVSAARRSGARLQPRHLPGSWLLGEDSSLRIYRWRNPGSR

SEQ ID NO: 32898 - protein, 1205 aa, Homo sapiens
  ENSP00000385848
MKVTVCFGRTGIVVPCKEGQLRVGELTQQALQRYLKTREKGPGYWVKIHHLEYTDGGILDPDDVLADVVEDKDKLIAVFEEQEPLHKIESPSGNPADRQSPDAFETEVAAQLAAFKPIGGEIEVTPSALKLGTPLLVRRSSDPVPGPPADTQPSASHPGGQSLKLVVPDSTQNLEDREVLNGVQTELLTSPRTKDTLSDMTRTVEISGEGGPLGIHVVPFFSSLSGRILGLFIRGIEDNSRSKREGLFHENECIVKINNVDLVDKTFAQAQDVFRQAMKSPSVLLHVLPPQNREQYEKSVIGSLNIFGNNDGVLKTKVPPPVHGKSGLKTANLTGTDSPETDASASLQQNKSPRVPRLGGKPSSPSLSPLMGFGSNKNAKKIKIDLKKGPEGLGFTVVTRDSSIHGPGPIFVKNILPKGAAIKDGRLQSGDRILEVNGRDVTGRTQEELVAMLRSTKQGETASLVIARQEGHFLPRELKGEPDCCALSLETSEQLTFEIPLNDSGSAGLGVSLKGNKSRETGTDLGIFIKSIIHGGAAFKDGRLRMNDQLIAVNGESLLGKSNHEAMETLRRSMSMEGNIRGMIQLVILRRPERPMEDPAECGAFSKPCFENCQNAVTTSRRNDNSILHPLGTCSPQDKQKGLLLPNDGWAESEVPPSPTPHSALGLGLEDYSHSSGVDSAVYFPDQHINFRSVTPARQPESINLKASKSMDLVPDESKVHSLAGQKSESPSKDFGPTLGLKKSSSLESLQTAVAEVRKNDLPFHRPRPHMVRGRGCNESFRAAIDKSYDGPEEIEADGLSDKSSHSGQGALNCESAPQGNSELEDMENKARKVKKTKEKEKKKEKGKLKVKEKKRKEENEDPERKIKKKGFGAMLRFGKKKEDKGGKAEQKGTLKHGGLREEELEKMKEERERIGAKHQELREKQARGLLDYATGAIGSVYDMDDDEMDPNYARVNHFREPCTSANVFRSPSPPRAGPFGYPRDGHPLSPERDHLEGLYAKVNKPYHPLVPADSGRPTGGSTDRIQKLRKEYYQARREGFPLYEDDEGRARPSEYDLLWVPGRGPDGNAHNLRFEGMERQYASLPRGGPADPVDYLPAAPRGLYKERELPYYPGAHPMHPPKGSYPRPTELRVADLRYPQHYPPPPAPQHKGPFRQDVPPSPPQHQRMPAYQETGRPGPRGGSPDQYPYRTQDSRQKNPMTAAV

SEQ ID NO: 32899 - protein, 935 aa, Homo sapiens
  ENSP00000473503
MKVTVCFGRTGIVVPCKEGQLRVGELTQQALQRYLKTREKGPGYWVKIHHLEYTDGGILDPDDVLADVVEDKDKLIAVFEEQEPLHKIESPSGNPADRQSPDAFETEVAAQLAAFKPIGGEIEVTPSALKLGTPLLVRRSSDPVPGPPADTQPSASHPGGQSLKLVVPDSTQNLEDREVLNGVQTELLTSPRTKDTLSDMTRTVEISGEGGPLGIHVVPFFSSLSGRILGLFIRGIEDNSRSKREGLFHENECIVKINNVDLVDKTFAQAQDVFRQAMKSPSVLLHVLPPQNREQYEKSVIGSLNIFGNNDGVLKTKVPPPVHGKSGLKTANLTGTDSPETDASASLQQNKSPRVPRLGGKPSSPSLSPLMGFGSNKNAKKIKIDLKKGPEGLGFTVVTRDSSIHGPGPIFVKNILPKGAAIKDGRLQSGDRILEVNGRDVTGRTQEELVAMLRSTKQGETASLVIARQEGHFLPRELKGEPDCCALSLETSEQLTFEIPLNDSGSAGLGVSLKGNKSRETGTDLGIFIKSIIHGGAAFKDGRLRMNDQLIAVNGESLLGKSNHEAMETLRRSMSMEGNIRGMIQLVILRRPERPMEDPAECGAFSKPCFENCQNAVTTSRRNDNSILHPLGTCSPQDKQKGLLLPNDGWAESEVPPSPTPHSALGLGLEDYSHSSGVDSAVYFPDQHINFRSVTPARQPESINLKASKSMDLVPDESKVHSLAGQKSESPSKDFGPTLGLKKSSSLESLQTAVAEVRKNDLPFHRPRPHMVRGRGCNESFRAAIDKSYDGPEEIEADGLSDKSSHSGQGALNCESAPQGNSELEDMENKARKVKKTKEKEKKKEKGKLKVKEKKRKEENEDPERKIKKKGFGAMLRYGPALKAKLVLILSLLKKAHAFPRLQPNAYGSQFCARSLSAEAEELFGESYSDDRTLS

SEQ ID NO: 32900 - protein, 1143 aa, Homo sapiens
  ENSP00000351618
MKVTVCFGRTGIVVPCKEGQLRVGELTQQALQRYLKTREKGPGYWVKIHHLEYTDGGILDPDDVLADVVEDKDKLIAVFEEQEPLHKIESPSGNPADRQSPDAFETEVAAQLAAFKPIGGEIEVTPSALKLGTPLLVRRSSDPVPGPPADTQPSASHPGGQSLKLVVPDSTQNLEDREVLNGVQTELLTSPRTKDTLSDMTRTVEISGEGGPLGIHVVPFFSSLSGRILGLFIRGIEDNSRSKREGLFHENECIVKINNVDLVDKTFAQAQDVFRQAMKSPSVLLHVLPPQNREQYEKSVIGSLNIFGNNDGVLKTKVPPPVHGKSGLKTANLTGTDSPETDASASLQQNKSPRVPRLGGKPSSPSLSPLMGFGSNKNAKKIKIDLKKGPEGLGFTVVTRDSSIHGPGPIFVKNILPKGAAIKDGRLQSGDRILEVNGRDVTGRTQEELVAMLRSTKQGETASLVIARQEGHFLPRELDGRLRMNDQLIAVNGESLLGKSNHEAMETLRRSMSMEGNIRGMIQLVILRRPERPMEDPAECGAFSKPCFENCQNAVTTSRRNDNSILHPLGTCSPQDKQKGLLLPNDGWAESEVPPSPTPHSALGLGLEDYSHSSGVDSAVYFPDQHINFRSVTPARQPESINLKASKSMDLVPDESKVHSLAGQKSESPSKDFGPTLGLKKSSSLESLQTAVAEVRKNDLPFHRPRPHMVRGRGCNESFRAAIDKSYDGPEEIEADGLSDKSSHSGQGALNCESAPQGNSELEDMENKARKVKKTKEKEKKKEKGKLKVKEKKRKEENEDPERKIKKKGFGAMLRFGKKKEDKGGKAEQKGTLKHGGLREEELEKMKEERERIGAKHQELREKQARGLLDYATGAIGSVYDMDDDEMDPNYARVNHFREPCTSANVFRSPSPPRAGPFGYPRDGHPLSPERDHLEGLYAKVNKPYHPLVPADSGRPTGGSTDRIQKLRKEYYQARREGFPLYEDDEGRARPSEYDLLWVPGRGPDGNAHNLRFEGMERQYASLPRGGPADPVDYLPAAPRGLYKERELPYYPGAHPMHPPKGSYPRPTELRVADLRYPQHYPPPPAPQHKGPFRQDVPPSPPQHQRMPAYQETGRPGPRGGSPDQYPYRTQDSRQKNPMTAAV

SEQ ID NO: 32901 - protein, 1136 aa, Homo sapiens
  ENSP00000317261
MKVTVCFGRTGIVVPCKEGQLRVGELTQQALQRYLKTREKGPGYWVKIHHLEYTDGGILDPDDVLADVVEDKDKLIAVFEEQEPLHKIESPSGNPADRQSPDAFETEVAAQLAAFKPIGGEIEVTPSALKLGTPLLVRRSSDPVPGPPADTQPSASHPGGQSLKLVVPDSTQNLEDREVLNGVQTELLTSPRTKDTLSDMTRTVEISGEGGPLGIHVVPFFSSLSGRILGLFIRGIEDNSRSKREGLFHENECIVKINNVDLVDKTFAQAQDVFRQAMKSPSVLLHVLPPQNREQYEKSVIGSLNIFGNNDGVLKTKVPPPVHGKSGLKTANLTGTDSPETDASASLQQNKSPRVPRLGGKPSSPSLSPLMGFGSNKNAKKIKIDLKKGPEGLGFTVVTRDSSIHGPGPIFVKNILPKGAAIKDGRLQSGDRILEVNGRDVTGRTQEELVAMLRSTKQGETASLVIARQEGHFLPRELKGEPDCCALSLETSEQLTFEIPLNDSGSAGLGVSLKGNKSRETGTDLGIFIKSIIHGGAAFKDGRLRMNDQLIAVNGESLLGKSNHEAMETLRRSMSMEGNIRGMIQLVILRRPERPMEDPAECGAFSKPCFENCQNAVTTSRRNDNSILHPLGTCSPQDKQKGLLLPNDGWAESEVPPSPTPHSALGLGLEDYSHSSGVDSAVYFPDQHINFRSVTPARQPESINLKASKSMDLVPDESKVHSLAGQKSDGLSDKSSHSGQGALNCESAPQGNSELEDMENKARKVKKTKEKEKKKEKGKLKVKEKKRKEENEDPERKIKKKGFGAMLRFGKKKEDKGGKAEQKGTLKHGGLREEELEKMKEERERIGAKHQELREKQARGLLDYATGAIGSVYDMDDDEMDPNYARVNHFREPCTSANVFRSPSPPRAGPFGYPRDGHPLSPERDHLEGLYAKVNKPYHPLVPADSGRPTGGSTDRIQKLRKEYYQARREGFPLYEDDEGRARPSEYDLLWVPGRGPDGNAHNLRFEGMERQYASLPRGGPADPVDYLPAAPRGLYKERELPYYPGAHPMHPPKGSYPRPTELRVADLRYPQHYPPPPAPQHKGPFRQDVPPSPPQHQRMPAYQETGRPGPRGGSPDQYPYRTQDSRQKNPMTAAV

SEQ ID NO: 32902 - protein, 1104 aa, Homo sapiens
  ENSP00000340280
MKVTVCFGRTGIVVPCKEGQLRVGELTQQALQRYLKTREKGPGYWVKIHHLEYTDGGILDPDDVLADVVEDKDKLIAVFEEQEPLHKIESPSGNPADRQSPDAFETEVAAQLAAFKPIGGEIEVTPSALKLGTPLLVRRSSDPVPGPPADTQPSASHPGGQSLKLVVPDSTQNLEDREVLNGVQTELLTSPRTKDTLSDMTRTVEISGEGGPLGIHVVPFFSSLSGRILGLFIRGIEDNSRSKREGLFHENECIVKINNVDLVDKTFAQAQDVFRQAMKSPSVLLHVLPPQNREQYEKSVIGSLNIFGNNDGVLKTKVPPPVHGKSGLKTANLTGTDSPETDASASLQQNKSPRVPRLGGKPSSPSLSPLMGFGSNKNAKKIKIDLKKGPEGLGFTVVTRDSSIHGPGPIFVKNILPKGAAIKDGRLQSGDRILEVNGRDVTGRTQEELVAMLRSTKQGETASLVIARQEGHFLPRELKGEPDCCALSLETSEQLTFEIPLNDSGSAGLGVSLKGNKSRETGTDLGIFIKSIIHGGAAFKDGRLRMNDQLIAVNGESLLGKSNHEAMETLRRSMSMEGNIRGMIQLVILRRPERPMEDPAECGAFSKPCFENCQNAVTTSRRNDNSILHPLGTCSPQDKQKGLLLPNDGWAESEVPPSPTPHSALGLGLEDYSHSSGVDSAVYFPDQHINFRSVTPARQPESINLKASKSMDLVPDESKVHSLAGQKSESPSKDFGPTLGLKKSSSLESLQTAVAEVRKNDLPFHRPRPHMVRGRGCNESFRAAIDKSYDGPEEIEADGLSDKSSHSGQGALNCESAPQGNSELEDMENKARKVKKTKEKEKKKEKGKLKVKEKKRKEENEDPERKIKKKGFGAMLRFGKKKEDKGGKAEQKGTLKHGGLREEELEKMKEERESGRPTGGSTDRIQKLRKEYYQARREGFPLYEDDEGRARPSEYDLLWVPGRGPDGNAHNLRFEGMERQYASLPRGGPADPVDYLPAAPRGLYKERELPYYPGAHPMHPPKGSYPRPTELRVADLRYPQHYPPPPAPQHKGPFRQDVPPSPPQHQRMPAYQETGRPGPRGGSPDQYPYRTQDSRQKNPMTAAV

SEQ ID NO: 32903 - protein, 1069 aa, Homo sapiens
  ENSP00000484434
LIAVFEEQEPLHKIESPSGNPADRQSPDAFETEVAAQLAAFKPIGGEIEVTPSALKLGTPLLVRRSSDPVPGPPADTQPSASHPGGQSLKLVVPDSTQNLEDREVLNGVQTELLTSPRTKDTLSDMTRTVEISGEGGPLGIHVVPFFSSLSGRILGLFIRGIEDNSRSKREGLFHENECIVKINNVDLVDKTFAQAQDVFRQAMKSPSVLLHVLPPQNREQYEKSVIGSLNIFGNNDGVLKTKVPPPVHGKSGLKTANLTGTDSPETDASASLQQNKSPRVPRLGGKPSSPSLSPLMGFGSNKNAKKIKIDLKKGPEGLGFTVVTRDSSIHGPGPIFVKNILPKGAAIKDGRLQSGDRILEVNGRDVTGRTQEELVAMLRSTKQGETASLVIARQEGHFLPRELDGRLRMNDQLIAVNGESLLGKSNHEAMETLRRSMSMEGNIRGMIQLVILRRPERPMEDPAECGAFSKPCFENCQNAVTTSRRNDNSILHPLGTCSPQDKQKGLLLPNDGWAESEVPPSPTPHSALGLGLEDYSHSSGVDSAVYFPDQHINFRSVTPARQPESINLKASKSMDLVPDESKVHSLAGQKSESPSKDFGPTLGLKKSSSLESLQTAVAEVRKNDLPFHRPRPHMVRGRGCNESFRAAIDKSYDGPEEIEADGLSDKSSHSGQGALNCESAPQGNSELEDMENKARKVKKTKEKEKKKEKGKLKVKEKKRKEENEDPERKIKKKGFGAMLRFGKKKEDKGGKAEQKGTLKHGGLREEELEKMKEERERIGAKHQELREKQARGLLDYATGAIGSVYDMDDDEMDPNYARVNHFREPCTSANVFRSPSPPRAGPFGYPRDGHPLSPERDHLEGLYAKVNKPYHPLVPADSGRPTGGSTDRIQKLRKEYYQARREGFPLYEDDEGRARPSEYDLLWVPGRGPDGNAHNLRFEGMERQYASLPRGGPADPVDYLPAAPRGLYKERELPYYPGAHPMHPPKGSYPRPTELRVADLRYPQHYPPPPAPQHKGPFRQDVPPSPPQHQRMPAYQETGRPGPRGGSPDQYPYRTQDSRQKNPMTAAV

SEQ ID NO: 32904 - protein, 1062 aa, Homo sapiens
  ENSP00000481918
LIAVFEEQEPLHKIESPSGNPADRQSPDAFETEVAAQLAAFKPIGGEIEVTPSALKLGTPLLVRRSSDPVPGPPADTQPSASHPGGQSLKLVVPDSTQNLEDREVLNGVQTELLTSPRTKDTLSDMTRTVEISGEGGPLGIHVVPFFSSLSGRILGLFIRGIEDNSRSKREGLFHENECIVKINNVDLVDKTFAQAQDVFRQAMKSPSVLLHVLPPQNREQYEKSVIGSLNIFGNNDGVLKTKVPPPVHGKSGLKTANLTGTDSPETDASASLQQNKSPRVPRLGGKPSSPSLSPLMGFGSNKNAKKIKIDLKKGPEGLGFTVVTRDSSIHGPGPIFVKNILPKGAAIKDGRLQSGDRILEVNGRDVTGRTQEELVAMLRSTKQGETASLVIARQEGHFLPRELKGEPDCCALSLETSEQLTFEIPLNDSGSAGLGVSLKGNKSRETGTDLGIFIKSIIHGGAAFKDGRLRMNDQLIAVNGESLLGKSNHEAMETLRRSMSMEGNIRGMIQLVILRRPERPMEDPAECGAFSKPCFENCQNAVTTSRRNDNSILHPLGTCSPQDKQKGLLLPNDGWAESEVPPSPTPHSALGLGLEDYSHSSGVDSAVYFPDQHINFRSVTPARQPESINLKASKSMDLVPDESKVHSLAGQKSDGLSDKSSHSGQGALNCESAPQGNSELEDMENKARKVKKTKEKEKKKEKGKLKVKEKKRKEENEDPERKIKKKGFGAMLRFGKKKEDKGGKAEQKGTLKHGGLREEELEKMKEERERIGAKHQELREKQARGLLDYATGAIGSVYDMDDDEMDPNYARVNHFREPCTSANVFRSPSPPRAGPFGYPRDGHPLSPERDHLEGLYAKVNKPYHPLVPADSGRPTGGSTDRIQKLRKEYYQARREGFPLYEDDEGRARPSEYDLLWVPGRGPDGNAHNLRFEGMERQYASLPRGGPADPVDYLPAAPRGLYKERELPYYPGAHPMHPPKGSYPRPTELRVADLRYPQHYPPPPAPQHKGPFRQDVPPSPPQHQRMPAYQETGRPGPRGGSPDQYPYRTQDSRQKNPMTAAV

SEQ ID NO: 32905 - protein, 1030 aa, Homo sapiens
  ENSP00000482649
LIAVFEEQEPLHKIESPSGNPADRQSPDAFETEVAAQLAAFKPIGGEIEVTPSALKLGTPLLVRRSSDPVPGPPADTQPSASHPGGQSLKLVVPDSTQNLEDREVLNGVQTELLTSPRTKDTLSDMTRTVEISGEGGPLGIHVVPFFSSLSGRILGLFIRGIEDNSRSKREGLFHENECIVKINNVDLVDKTFAQAQDVFRQAMKSPSVLLHVLPPQNREQYEKSVIGSLNIFGNNDGVLKTKVPPPVHGKSGLKTANLTGTDSPETDASASLQQNKSPRVPRLGGKPSSPSLSPLMGFGSNKNAKKIKIDLKKGPEGLGFTVVTRDSSIHGPGPIFVKNILPKGAAIKDGRLQSGDRILEVNGRDVTGRTQEELVAMLRSTKQGETASLVIARQEGHFLPRELKGEPDCCALSLETSEQLTFEIPLNDSGSAGLGVSLKGNKSRETGTDLGIFIKSIIHGGAAFKDGRLRMNDQLIAVNGESLLGKSNHEAMETLRRSMSMEGNIRGMIQLVILRRPERPMEDPAECGAFSKPCFENCQNAVTTSRRNDNSILHPLGTCSPQDKQKGLLLPNDGWAESEVPPSPTPHSALGLGLEDYSHSSGVDSAVYFPDQHINFRSVTPARQPESINLKASKSMDLVPDESKVHSLAGQKSESPSKDFGPTLGLKKSSSLESLQTAVAEVRKNDLPFHRPRPHMVRGRGCNESFRAAIDKSYDGPEEIEADGLSDKSSHSGQGALNCESAPQGNSELEDMENKARKVKKTKEKEKKKEKGKLKVKEKKRKEENEDPERKIKKKGFGAMLRFGKKKEDKGGKAEQKGTLKHGGLREEELEKMKEERESGRPTGGSTDRIQKLRKEYYQARREGFPLYEDDEGRARPSEYDLLWVPGRGPDGNAHNLRFEGMERQYASLPRGGPADPVDYLPAAPRGLYKERELPYYPGAHPMHPPKGSYPRPTELRVADLRYPQHYPPPPAPQHKGPFRQDVPPSPPQHQRMPAYQETGRPGPRGGSPDQYPYRTQDSRQKNPMTAAV

SEQ ID NO: 32906 - protein, 376 aa, Homo sapiens
  ENSP00000343144
MNRSFHKSQTLRFYDCSAVEVKSKFGAEFRRFSLDRHKPGKFEDFYKLVVHTHHISNSDVTIGYADVHGDLLPINNDDNFCKAVSSANPLLRVFIQKREEAERGSLGAGSLCRRRRALGALRDEGPRRRAHLDIGLPRDFRPVSSIIDVDLVPETHRRVRLHRHGCEKPLGFYIRDGASVRVTPHGLEKVPGIFISRMVPGGLAESTGLLAVNDEVLEVNGIEVAGKTLDQVTDMMIANSHNLIVTVKPANQRNNVVRGGRALGSSGPPSDGTAGFVGPPAPRVLQNFHPDEAESDEDNDVVIEGTLEPARPPQTPGAPAGSLSRVNGAGLAQRLQRDLALDGGLQRLLSSLRADPRHSLALPPGGVEEHGPAVTL

SEQ ID NO: 32907 - protein, 107 aa, Homo sapiens
  ENSP00000468735
MNRSFHKSQTLRFYDCSAVEVKSKFGAEFRRFSLDRHKPGKFEDFYKLVVHTHHISNSDVTIGYADVHGDLLPINNDDNFCKAVSSANPLLRVFIQKRDDGALRPGT

SEQ ID NO: 32908 - protein, 61 aa, Homo sapiens
  ENSP00000466076
FEDFYKLVVHTHHISNSDVTIGYADVHGDLLPINNDDNFCKAVSSANPLLRVFIQKRGGEH

SEQ ID NO: 32909 - protein, 68 aa, Homo sapiens
  ENSP00000424276
MVYKTLFALCILTAGSIAAITVTVIAVVLLVFGVAAYLKIRHSSYGRLLDDHDYGSWGNYNNPLYDDS

SEQ ID NO: 32910 - protein, 310 aa, Homo sapiens
  ENSP00000370224
MVYKTLFALCILTAGWRVQSLPTSAPLSVSLPTNIVPPTTIWTSSPQNTDADTASPSNGTHNNSVLPVTASAPTSLLPKNISIESREEEITSPGSNWEGTNTDPSPSGFSSTSGGVHLTTTLEEHSSGTPEAGVAATLSQSAAEPPTLISPQAPASSPSSLSTSPPEVFSASVTTNHSSTVTSTQPTGAPTAPESPTEESSSDHTPTSHATAEPVPQEKTPPTTVSGKVMCELIDMETTTTFPRVIMQEVEHALSSGSIAAITVTVIAVVLLVFGVAAYLKIRHSSYGRLLDDHDYGSWGNYNNPLYDDS

SEQ ID NO: 32911 - protein, 1801 aa, Homo sapiens
  ENSP00000360200
MPENPATDKLQVLQVLDRLKMKLQEKGDTSQNEKLSMFYETLKSPLFNQILTLQQSIKQLKGQLNHIPSDCSANFDFSRKGLLVFTDGSITNGNVHRPSNNSTVSGLFPWTPKLGNEDFNSVIQQMAQGRQIEYIDIERPSTGGLGFSVVALRSQNLGKVDIFVKDVQPGSVADRDQRLKENDQILAINHTPLDQNISHQQAIALLQQTTGSLRLIVAREPVHTKSSTSSSLNDTTLPETVCWGHVEEVELINDGSGLGFGIVGGKTSGVVVRTIVPGGLADRDGRLQTGDHILKIGGTNVQGMTSEQVAQVLRNCGNSVRMLVARDPAGDISVTPPAPAALPVALPTVASKGPGSDSSLFETYNVELVRKDGQSLGIRIVGYVGTSHTGEASGIYVKSIIPGSAAYHNGHIQVNDKIVAVDGVNIQGFANHDVVEVLRNAGQVVHLTLVRRKTSSSTSPLEPPSDRGTVVEPLKPPALFLTGAVETETNVDGEDEEIKERIDTLKNDNIQALEKLEKVPDSPENELKSRWENLLGPDYEVMVATLDTQIADDAELQKYSKLLPIHTLRLGVEVDSFDGHHYISSIVSGGPVDTLGLLQPEDELLEVNGMQLYGKSRREAVSFLKEVPPPFTLVCCRRLFDDEASVDEPRRTETSLPETEVDHNMDVNTEEDDDGELALWSPEVKIVELVKDCKGLGFSILDYQDPLDPTRSVIVIRSLVADGVAERSGGLLPGDRLVSVNEYCLDNTSLAEAVEILKAVPPGLVHLGICKPLVEDNEEESCYILHSSSNEDKTEFSGTIHDINSSLILEAPKGFRDEPYFKEELVDEPFLDLGKSFHSQQKEIEQSKEAWEMHEFLTPRLQEMDEEREILVDEEYELYQDPSPSMELYPLSHIQEATPVPSVNELHFGTQWLHDNEPSESQEARTGRTVYSQEAQPYGYCPENVMKENFVMESLPSVPSTEGNSQQGRFDDLENLNSLAKTSLDLGMIPNDVQGPSLLIDLPVVAQRREQEDLPLYQHQATRVISKASAYTGMLSSRYATDTCELPEREEGEGEETPNFSHWGPPRIVEIFREPNVSLGISIVGGQTVIKRLKNGEELKGIFIKQVLEDSPAGKTNALKTGDKILEVSGVDLQNASHSEAVEAIKNAGNPVVFIVQSLSSTPRVIPNVHNKANKITGNQNQDTQEKKEKRQGTAPPPMKLPPPYKALTDDSDENEEEDAFTDQKIRQRYADLPGELHIIELEKDKNGLGLSLAGNKDRSRMSIFVVGINPEGPAAADGRMRIGDELLEINNQILYGRSHQNASAIIKTAPSKVKLVFIRNEDAVNQMAVTPFPVPSSSPSSIEDQSGTEPISSEEDGSVEVGIKQLPESESFKLAVSQMKQQKYPTKVSFSSQEIPLAPASSYHSTDADFTGYGGFQAPLSVDPATCPIVPGQEMIIEISKGRSGLGLSIVGGKDTPLNAIVIHEVYEEGAAARDGRLWAGDQILEVNGVDLRNSSHEEAITALRQTPQKVRLVVYRDEAHYRDEENLEIFPVDLQKKAGRGLGLSIVGKRNGSGVFISDIVKGGAADLDGRLIQGDQILSVNGEDMRNASQETVATILKCAQGLVQLEIGRLRAGSWTSARTTSQNSQGSQQSAHSSCHPSFAPVITGLQNLVGTKRVSDPSQKNSGTDMEPRTVEINRELSDALGISIAGGRGSPLGDIPVFIAMIQASGVAARTQKLKVGDRIVSINGQPLDGLSHADVVNLLKNAYGRIILQVVADTNISAIAAQLENMSTGYHLGSPTAEHHPEDTEEQLQMTAD

SEQ ID NO: 32912 - protein, 683 aa, Homo sapiens
  ENSP00000489335
MPENPATDKLQVLQVLDRLKMKLQEKGDTSQNEKLSMFYETLKSPLFNQILTLQQSIKQLKGQLNHIPSDCSANFDFSRKGLLVFTDGSITNGNVHRPSNNSTVSGLFPWTPKLGNEDFNSVIQQMAQGRQIEYIDIERPSTGGLGFSVVALRSQNLGKVDIFVKDVQPGSVADRDQRLKENDQILAINHTPLDQNISHQQAIALLQQTTGSLRLIVAREPVHTKSSTSSSLNDTTLPETVCWGHVEEVELINDGSGLGFGIVGGKTSGVVVRTIVPGGLADRDGRLQTGDHILKIGGTNVQGMTSEQVAQVLRNCGNSVRMLVARDPAGDISVTPPAPAALPVALPTVASKGPGSDSSLFETYNVELVRKDGQSLGIRIVGYVGTSHTGEASGIYVKSIIPGSAAYHNGHIQVNDKIVAVDGVNIQGFANHDVVEVLRNAGQVVHLTLVRRKTSSSTSPLEPPSDRGTVVEPLKPPALFLTGAVETETNVDGEDEEIKERIDTLKNDNIQALEKLEKVPDSPENELKSRWENLLGPDYEVMVATLDTQIADDAELQKYSKLLPIHTLRLGVEVDSFDGHHYISSIVSGGPVDTLGLLQPEDELLEVNGMQLYGKSRREAVSFLKEVPPPFTLVCCRRLFDDEASVDEPRRTETSLPETENSLKYKRLTTIWMSILKKMMMGN

SEQ ID NO: 32913 - protein, 1134 aa, Homo sapiens
  ENSP00000433669
MVATLDTQIADDAELQKYSKLLPIHTLRLGVEVDSFDGHHYISSIVSGGPVDTLGLLQPEDELLEVNGMQLYGKSRREAVSFLKEVPPPFTLVCCRRLFDDEASVDEPRRTETSLPETEVDHNMDVNTEEDDDGELALWSPEVKIVELVKDCKGLGFSILDYQDPLDPTRSVIVIRSLVADGVAERSGGLLPGDRLVSVNEYCLDNTSLAEAVEILKAVPPGLVHLGICKPLVEDNEEESCYILHSSSNEDKTEFSGTIHDINSSLILEAPKGFRDEPYFKEELVDEPFLDLGKSFHSQQKEIEQSKEAWEMHEFLTPRLQEMDEEREILVDEEYELYQDPSPSMELYPLSHIQEATPVPSVNELHFGTQWLHDNEPSESQEARTGRTVYSQEAQPYGYCPENVMKENFVMESLPSVPSTEGNSQQGRFDDLENLNSLAKTSLDLGMIPNDVQGPSLLIDLPVVAQRREQEDLPLYQHQATRVISKASAYTGMLSSRYATDTCELPEREEGEGEETPNFSHWGPPRIVEIFREPNVSLGISIVGGQTVIKRLKNGEELKGIFIKQVLEDSPAGKTNALKTGDKILEVSGVDLQNASHSEAVEAIKNAGNPVVFIVQSLSSTPRVIPNVHNKANKITGNQNQDTQEKKEKRQGTAPPPMKLPPPYKALTDDSDENEEEDAFTDQKIRQRYADLPGELHIIELEKDKNGLGLSLAGNKDRSRMSIFVVGINPEGPAAADGRMRIGDELLEINNQILYGRSHQNASAIIKTAPSKVKLVFIRNEDAVNQMAVTPFPVPSSSPSSIEDQSGTEPISSEEDGSVEVGIKQLPESESFKLAVSQMKQQKYPTKVSFSSQEIPLAPASSYHSTDADFTGYGGFQAPLSVDPATCPIVPGQEMIIEISKGRSGLGLSIVGGKDTPLNAIVIHEVYEEGAAARDGRLWAGDQILEVNGVDLRNSSHEEAITALRQTPQKVRLVVYRDEAHYRDEENLEIFPVDLQKKAGRGLGLSIVGKRNGSGVFISDIVKGGAADLDGRLIQGDQILSVNGEDMRNASQETVATILKCAQGLVQLEIGRLRAGSWTSARTTSQNSQSAECTQQLSSLLRSCHHWPAKPGWHKKSFRSFPEKFRHRYGTKDC

SEQ ID NO: 32914 - protein, 146 aa, Homo sapiens
  ENSP00000489200
  MOD_RES (1)..(1): Any amino acid
XVQSLSSTPRVIPNVHNKANKITGNQNQDTQEKKEKRQGTAPPPMKLPPPYKALTDDSDENEEEDAFTDQKIRQRYADLPGELHIIELEKDKNGLGLSLAGNKDRSRMSIFVVGINPEGPAAADGRMRIGDELLETLTQNRIYSHP

SEQ ID NO: 32915 - protein, 111 aa, Homo sapiens
  ENSP00000489475
QEKKEKRQGTAPPPMKLPPPYKALTDDSDENEEEDAFTDQKIRQRYADLPGELHIIELEKDKNGLGLSLAGNKDRSRMSIFVVGINPEGPAAADGRMRIGDELLEVRSMCF

SEQ ID NO: 32916 - protein, 593 aa, Homo sapiens
  ENSP00000489159
MVQGGFPEKIRQRYADLPGELHIIELEKDKNGLGLSLAGNKDRSRMSIFVVGINPEGPAAADGRMRIGDELLEINNQILYGRSHQNASAIIKTAPSKVKLVFIRNEDAVNQMAVTPFPVPSSSPSSIEDQSGTEPISSEEDGSVEVGIKQLPESESFKLAVSQMKQQKYPTKVSFSSQEIPLAPASSYHSTDADFTGYGGFQAPLSVDPATCPIVPGQEMIIEISKGRSGLGLSIVGGKDTPLNAIVIHEVYEEGAAARDGRLWAGDQILEVNGVDLRNSSHEEAITALRQTPQKVRLVVYRDEAHYRDEENLEIFPVDLQKKAGRGLGLSIVGKRNGSGVFISDIVKGGAADLDGRLIQGDQILSVNGEDMRNASQETVATILKCAQGLVQLEIGRLRAGSWTSARTTSQNSQGSQQSAHSSCHPSFAPVITGLQNLVGTKRVSDPSQKNSGTDMEPRTVEINRELSDALGISIAGGRGSPLGDIPVFIAMIQASGVAARTQKLKVGDRIVSINGQPLDGLSHADVVNLLKNAYGRIILQVVADTNISAIAAQLENMSTGYHLGSPTAEHHPEDTERCCNCPMDSPCPLLLG

SEQ ID NO: 32917 - protein, 452 aa, Homo sapiens
  ENSP00000307496
MVQGGFPEKIRQRYADLPGELHIIELEKDKNGLGLSLAGNKDRSRMSIFVVGINPEGPAAADGRMRIGDELLEINNQILYGRSHQNASAIIKTAPSKVKLVFIRNEDAVNQMAVTPFPVPSSSPSSIEDQSGTEPISSEEDGSVEVGIKQLPESESFKLAVSQMKQQKYPTKVSFSSQEIPLAPASSYHSTDADFTGYGGFQAPLSVDPATCPIVPGQEMIIEISKGRSGLGLSIVGGKDTPLFWRLGSPRAWSQHLVRAFMLHHPVTEVEGQNAIVIHEVYEEGAAARDGRLWAGDQILEVNGVDLRNSSHEEAITALRQTPQKVRLVVYRDEAHYRDEENLEIFPVDLQKKAGRGLGLSIVGKRNGSGVFISDIVKGGAADLDGRLIQGDQILSVNGEDMRNASQETVATILKCAQGLVQLEIGRLRAGSWTSARTTSQNSQVVDGFSSD

SEQ ID NO: 32918 - protein, 139 aa, Homo sapiens
  ENSP00000489130
  MOD_RES (1)..(1): Any amino acid
XAITALRQTPQKVRLVVYRDEAHYRDEENLEIFPVDLQKKAGRGLGLSIVGKRNGSGVFISDIVKGGAADLDGRLIQGDQILSVNGEDMRNASQETVATILKCAQGLVQLEIGRLRAGSWTSARTTSQNSQVVDGFSSD

SEQ ID NO: 32919 - protein, 1181 aa, Homo sapiens
  ENSP00000326199
MPENPATDKLQVLQVLDRLKMKLQEKGDTSQNEKLSMFYETLKSPLFNQILTLQQSIKQLKGQLNHIPSDCSANFDFSRKGLLVFTDGSITNGNVHRPSNNSTVSGLFPWTPKLGNEDFNSVIQQMAQGRQIEYIDIERPSTGGLGFSVVALRSQNLGKVDIFVKDVQPGSVADRDQRLKENDQILAINHTPLDQNISHQQAIALLQQTTGSLRLIVAREPVHTKSSTSSSLNDTTLPETVCWGHVEEVELINDGSGLGFGIVGGKTSGVVVRTIVPGGLADRDGRLQTGDHILKIGGTNVQGMTSEQVAQVLRNCGNSVRMLVARDPAGDISVTPPAPAALPVALPTVASKGPGSDSSLFETYNVELVRKDGQSLGIRIVGYVGTSHTGEASGIYVKSIIPGSAAYHNGHIQVNDKIVAVDGVNIQGFANHDVVEVLRNAGQVVHLTLVRRKTSSSTSPLEPPSDRGTVVEPLKPPALFLTGAVETETNVDGEDEEIKERIDTLKNDNIQALEKLEKVPDSPENELKSRWENLLGPDYEVMVATLDTQIADDAELQKYSKLLPIHTLRLGVEVDSFDGHHYISSIVSGGPVDTLGLLQPEDELLEVNGMQLYGKSRREAVSFLKEVPPPFTLVCCRRLFDDEASVDEPRRTETSLPETEVDHNMDVNTEEDDDGELALWSPEVKIVELVKDCKGLGFSILDYQDPLDPTRSVIVIRSLVADGVAERSGGLLPGDRLVSVNEYCLDNTSLAEAVEILKAVPPGLVHLGICKPLVEDNEEESCYILHSSSNEDKTEFSGTIHDINSSLILEAPKGFRDEPYFKEELVDEPFLDLGKSFHSQQKEIEQSKEAWEMHEFLTPRLQEMDEEREILVDEEYELYQDPSPSMELYPLSHIQEATPVPSVNELHFGTQWLHDNEPSESQEARTGRTVYSQEAQPYGYCPENVMKENFVMESLPSVPSTEGNSQQGRFDDLENLNSLAKTSLDLGMIPNDVQGPSLLIDLPVVAQRREQEDLPLYQHQATRVISKASAYTGMLSSRYATDTCELPEREEGEGEETPNFSHWGPPRIVEIFREPNVSLGISIVGGQTVIKRLKNGEELKGIFIKQVLEDSPAGKTNALKTGDKILEVSGVDLQNASHSEAVEAIKNAGNPVVFIVQSLSSTPPWTTERDSVSKKKKRKER

SEQ ID NO: 32920 - protein, 1182 aa, Homo sapiens
  ENSP00000479041
MPENPATDKLQVLQVLDRLKMKLQEKGDTSQNEKLSMFYETLKSPLFNQILTLQQSIKQLKGQLNHIPSDCSANFDFSRKGLLVFTDGSITNGNVHRPSNNSTVSGLFPWTPKLGNEDFNSVIQQMAQGRQIEYIDIERPSTGGLGFSVVALRSQNLGKVDIFVKDVQPGSVADRDQRLKENDQILAINHTPLDQNISHQQAIALLQQTTGSLRLIVAREPVHTKSSTSSSLNDTTLPETVCWGHVEEVELINDGSGLGFGIVGGKTSGVVVRTIVPGGLADRDGRLQTGDHILKIGGTNVQGMTSEQVAQVLRNCGNSVRMLVARDPAGDISVTPPAPAALPVALPTVASKGPGSDSSLFETYNVELVRKDGQSLGIRIVGYVGTSHTGEASGIYVKSIIPGSAAYHNGHIQVNDKIVAVDGVNIQGFANHDVVEVLRNAGQVVHLTLVRRKTSSSTSPLEPPSDRGTVVEPLKPPALFLTGAVETETNVDGEDEEIKERIDTLKNDNIQALEKLEKVPDSPENELKSRWENLLGPDYEVMVATLDTQIADDAELQKYSKLLPIHTLRLGVEVDSFDGHHYISSIVSGGPVDTLGLLQPEDELLEVNGMQLYGKSRREAVSFLKEVPPPFTLVCCRRLFDDEASVDEPRRTETSLPETEVDHNMDVNTEEDDDGELALWSPEVKIVELVKDCKGLGFSILDYQDPLDPTRSVIVIRSLVADGVAERSGGLLPGDRLVSVNEYCLDNTSLAEAVEILKAVPPGLVHLGICKPLVEDNEEESCYILHSSSNEDKTEFSGTIHDINSSLILEAPKGFRDEPYFKEELVDEPFLDLGKSFHSQQKEIEQSKEAWEMHEFLTPRLQEMDEEREILVDEEYELYQDPSPSMELYPLSHIQEATPVPSVNELHFGTQWLHDNEPSESQEARTGRTVYSQEAQPYGYCPENVMKENFVMESLPSVPSTEGNSQQGRFDDLENLNSLAKTSLDLGMIPNDVQGPSLLIDLPVVAQRREQEDLPLYQHQATRVISKASAYTGMLSSRYATDTCELPEREEGEGEETPNFSHWGPPRIVEIFREPNVSLGISIVGGQTVIKRLKNGEELKGIFIKQVLEDSPAGKTNALKTGDKILEASGVDKELCNQFVSPAEGRKIATWEVCSEPSSCHSTPAWVTEQDSVSKKKKNHEG

SEQ ID NO: 32921 - protein, 394 aa, Homo sapiens
  ENSP00000347385
MDMHCKADPFSAMHPGHGGVNQLGGVFVNGRPLPDVVRQRIVELAHQGVRPCDISRQLRVSHGCVSKILGRYYETGSIKPGVIGGSKPKVATPKVVDKIAEYKRQNPTMFAWEIRDRLLAEGICDNDTVPSVSSINRIIRTKVQQPFHPTPDGAGTGVTAPGHTIVPSTASPPVSSASNDPVGSYSINGILGIPRSNGEKRKRDEDVSEGSVPNGDSQSGVDSLRKHLRADTFTQQQLEALDRVFERPSYPDVFQASEHIKSEQGNEYSLPALTPGLDEVKSSLSASTNPELGSNVSGTQTYPVVTGRDMASTTLPGYPPHVPPTGQGSYPTSTLAGMVPGSEFSGNPYSHPQYTAYNEAWRFSNPALLSSPYYYSAAPRGSAPAAAAAAYDRH

SEQ ID NO: 32922 - protein, 396 aa, Homo sapiens
  ENSP00000359319
MDMHCKADPFSAMHPGHGGVNQLGGVFVNGRPLPDVVRQRIVELAHQGVRPCDISRQLRVSHGCVSKILGRYYETGSIKPGVIGGSKPKVATPKVVDKIAEYKRQNPTMFAWEIRDRLLAEGICDNDTVPSVSSINRIIRTKVQQPFHPTPDGAGTGVTAPGHTIVPSTASPPVSSASNDPVGSYSINGILGIPRSNGEKRKRDEDVSEGSVPNGDSQSGVDSLRKHLRADTFTQQQLEALDRVFERPSYPDVFQASEHIKSEQGNEYSLPALTPGLDEVKSSLSASTNPELGSNVSGTQTYPVVTGRDMASTTLPGYPPHVPPTGQGSYPTSTLAGMVPEAAVGPSSSLMSKPGRKLAEVPPCVQPTGASSPATRTATPSTRPTTRLGDSATPPY

SEQ ID NO: 32923 - protein, 393 aa, Homo sapiens
  ENSP00000355069
MDMHCKADPFSAMHRHGGVNQLGGVFVNGRPLPDVVRQRIVELAHQGVRPCDISRQLRVSHGCVSKILGRYYETGSIKPGVIGGSKPKVATPKVVDKIAEYKRQNPTMFAWEIRDRLLAEGICDNDTVPSVSSINRIIRTKVQQPFHPTPDGAGTGVTAPGHTIVPSTASPPVSSASNDPVGSYSINGILGIPRSNGEKRKRDEDVSEGSVPNGDSQSGVDSLRKHLRADTFTQQQLEALDRVFERPSYPDVFQASEHIKSEQGNEYSLPALTPGLDEVKSSLSASTNPELGSNVSGTQTYPVVTGRDMASTTLPGYPPHVPPTGQGSYPTSTLAGMVPGSEFSGNPYSHPQYTAYNEAWRFSNPALLSSPYYYSAAPRGSAPAAAAAAYDRH

SEQ ID NO: 32924 - protein, 214 aa, Homo sapiens
  ENSP00000398652
MDMHCKADPFSAMHPGHGGVNQLGGVFVNGRPLPDVVRQRIVELAHQGVRPCDISRQLRVSHGCVSKILGRYYETGSIKPGVIGGSKPKVATPKVVDKIAEYKRQNPTMFAWEIRDRLLAEGICDNDTVPSVSSINRIIRTKVQQPFHPTPDGAGTGVTAPGHTIVPSTASPPVSSASNDPVGSYSINGILGIPRSNGEKRKRDEVEVYTDPAH

SEQ ID NO: 32925 - protein, 304 aa, Homo sapiens
  ENSP00000452489
MAGPCCVWGVVFFSCLSPAGHGGVNQLGGVFVNGRPLPDVVRQRIVELAHQGVRPCDISRQLRVSHGCVSKILGRYYETGSIKPGVIGGSKPKVATPKVVDKIAEYKRQNPTMFAWEIRDRLLAEGICDNDTVPSVSSINRIIRTKVQQPFHPTPDGAGTGVTAPGHTIVPSTASPPVSSASNDPVGSYSINGILGIPRSNDVSEGSVPNGDSQSGVDSLRKHLRADTFTQQQLEALDRVFERPSYPDVFQASEHIKSEQGNEYSLPALTPGLDEVKSSLSASTNPELGSNVSGTQTYPVVTGR

SEQ ID NO: 32926 - protein, 417 aa, Homo sapiens
  ENSP00000396259
MDMHCKADPFSAMHPGHGGVNQLGGVFVNGRPLPDVVRQRIVELAHQGVRPCDISRQLRVSHGCVSKILGRYYETGSIKPGVIGGSKPKVATPKVVDKIAEYKRQNPTMFAWEIRDRLLAEGICDNDTVPSVSSINRIIRTKVQQPFHPTPDGAGTGVTAPGHTIVPSTASPPVSSASNDPVGSYSINGILGIPRSNGEKRKRDEVEVYTDPAHIRGGGGLHLVWTLRDVSEGSVPNGDSQSGVDSLRKHLRADTFTQQQLEALDRVFERPSYPDVFQASEHIKSEQGNEYSLPALTPGLDEVKSSLSASTNPELGSNVSGTQTYPVVTGRDMASTTLPGYPPHVPPTGQGSYPTSTLAGMVPGSEFSGNPYSHPQYTAYNEAWRFSNPALLSSPYYYSAAPRGSAPAAAAAAYDRH

SEQ ID NO: 32927 - protein, 505 aa, Homo sapiens
  ENSP00000375921
MTTLAGAVPRMMRPGPGQNYPRSGFPLEVSTPLGQGRVNQLGGVFINGRPLPNHIRHKIVEMAHHGIRPCVISRQLRVSHGCVSKILCRYQETGSIRPGAIGGSKPKQVTTPDVEKKIEEYKRENPGMFSWEIRDKLLKDAVCDRNTVPSVSSISRILRSKFGKGEEEEADLERKEAEESEKKAKHSIDGILSERASAPQSDEGSDIDSEPDLPLKRKQRRSRTTFTAEQLEELERAFERTHYPDIYTREELAQRAKLTEARVQVWFSNRRARWRKQAGANQLMAFNHLIPGGFPPTAMPTLPTYQLSETSYQPTSIPQAVSDPSSTVHRPQPLPPSTVHQSTIPSNPDSSSAYCLPSTRHGFSSYTDSFVPPSGPSNPMNPTIGNGLSPQVMGLLTNHGGVPHQPQTDYALSPLTGGLEPTTTVSASCSQRLDHMKSLDSLPTSQSYCPPTYSTTGYSMDPVTGYQYGQYGQSAFHYLKPDIAWFQILLNTFDKSSGEEEDLEQ

SEQ ID NO: 32928 - protein, 403 aa, Homo sapiens
  ENSP00000342092
MTTLAGAVPRMMRPGPGQNYPRSGFPLEVSTPLGQGRVNQLGGVFINGRPLPNHIRHKIVEMAHHGIRPCVISRQLRVSHGCVSKILCRYQETGSIRPGAIGGSKPKQVTTPDVEKKIEEYKRENPGMFSWEIRDKLLKDAVCDRNTVPSVSSISRILRSKFGKGEEEEADLERKEAEESEKKAKHSIDGILSERASAPQSDEGSDIDSEPDLPLKRKQRRSRTTFTAEQLEELERAFERTHYPDIYTREELAQRAKLTEARVQVWFSNRRARWRKQAGANQLMAFNHLIPGGFPPTAMPTLPTYQLSETSYQPTSIPQAVSDPSSTVHRPQPLPPSTVHQSTIPSNPDSSSAYCLPSTRHGFSSYTDSFVPPSGPSNPMNPTIGNGLSPQVPFIISSQISRK

SEQ ID NO: 32929 - protein, 479 aa, Homo sapiens
  ENSP00000343052
MTTLAGAVPRMMRPGPGQNYPRSGFPLEVSTPLGQGRVNQLGGVFINGRPLPNHIRHKIVEMAHHGIRPCVISRQLRVSHGCVSKILCRYQETGSIRPGAIGGSKPKQVTTPDVEKKIEEYKRENPGMFSWEIRDKLLKDAVCDRNTVPSVSSISRILRSKFGKGEEEEADLERKEAEESEKKAKHSIDGILSERASAPQSDEGSDIDSEPDLPLKRKQRRSRTTFTAEQLEELERAFERTHYPDIYTREELAQRAKLTEARVQVWFSNRRARWRKQAGANQLMAFNHLIPGGFPPTAMPTLPTYQLSETSYQPTSIPQAVSDPSSTVHRPQPLPPSTVHQSTIPSNPDSSSAYCLPSTRHGFSSYTDSFVPPSGPSNPMNPTIGNGLSPQVMGLLTNHGGVPHQPQTDYALSPLTGGLEPTTTVSASCSQRLDHMKSLDSLPTSQSYCPPTYSTTGYSMDPVTGYQYGQYGQSKPWTF

SEQ ID NO: 32930 - protein, 407 aa, Homo sapiens
  ENSP00000338767
MTTLAGAVPRMMRPGPGQNYPRSGFPLEVSTPLGQGRVNQLGGVFINGRPLPNHIRHKIVEMAHHGIRPCVISRQLRVSHGCVSKILCRYQETGSIRPGAIGGSKPKQVTTPDVEKKIEEYKRENPGMFSWEIRDKLLKDAVCDRNTVPSVSSISRILRSKFGKGEEEEADLERKEAEESEKKAKHSIDGILSERASAPQSDEGSDIDSEPDLPLKRKQRRSRTTFTAEQLEELERAFERTHYPDIYTREELAQRAKLTEARVQVWFSNRRARWRKQAGANQLMAFNHLIPGGFPPTAMPTLPTYQLSETSYQPTSIPQAVSDPSSTVHRPQPLPPSTVHQSTIPSNPDSSSAYCLPSTRHGFSSYTDSFVPPSGPSNPMNPTIGNGLSPQVPFIISSQISLGFKSF

SEQ ID NO: 32931 - protein, 484 aa, Homo sapiens
  ENSP00000375922
MTTLAGAVPRMMRPGPGQNYPRSGFPLEVSTPLGQGRVNQLGGVFINGRPLPNHIRHKIVEMAHHGIRPCVISRQLRVSHGCVSKILCRYQETGSIRPGAIGGSKPKQVTTPDVEKKIEEYKRENPGMFSWEIRDKLLKDAVCDRNTVPSVSSISRILRSKFGKGEEEEADLERKEAEESEKKAKHSIDGILSERASAPQSDEGSDIDSEPDLPLKRKQRRSRTTFTAEQLEELERAFERTHYPDIYTREELAQRAKLTEARVQVWFSNRRARWRKQAGANQLMAFNHLIPGGFPPTAMPTLPTYQLSETSYQPTSIPQAVSDPSSTVHRPQPLPPSTVHQSTIPSNPDSSSAYCLPSTRHGFSSYTDSFVPPSGPSNPMNPTIGNGLSPQVMGLLTNHGGVPHQPQTDYALSPLTGGLEPTTTVSASCSQRLDHMKSLDSLPTSQSYCPPTYSTTGYSMDPVTGYQYGQYGQSAFHYLKPDIA

SEQ ID NO: 32932 - protein, 483 aa, Homo sapiens
  ENSP00000386750
MTTLAGAVPRMMRPGPGQNYPRSGFPLEVSTPLGQGRVNQLGGVFINGRPLPNHIRHKIVEMAHHGIRPCVISRQLRVSHGCVSKILCRYQETGSIRPGAIGGSKPKVTTPDVEKKIEEYKRENPGMFSWEIRDKLLKDAVCDRNTVPSVSSISRILRSKFGKGEEEEADLERKEAEESEKKAKHSIDGILSERASAPQSDEGSDIDSEPDLPLKRKQRRSRTTFTAEQLEELERAFERTHYPDIYTREELAQRAKLTEARVQVWFSNRRARWRKQAGANQLMAFNHLIPGGFPPTAMPTLPTYQLSETSYQPTSIPQAVSDPSSTVHRPQPLPPSTVHQSTIPSNPDSSSAYCLPSTRHGFSSYTDSFVPPSGPSNPMNPTIGNGLSPQVMGLLTNHGGVPHQPQTDYALSPLTGGLEPTTTVSASCSQRLDHMKSLDSLPTSQSYCPPTYSTTGYSMDPVTGYQYGQYGQSAFHYLKPDIA

SEQ ID NO: 32933 - protein, 215 aa, Homo sapiens
  ENSP00000386817
MTTLAGAVPRMMRPGPGQNYPRSGFPLEVSTPLGQGRVNQLGGVFINGRPLPNHIRHKIVEMAHHGIRPCVISRQLRVSHGCVSKILCRYQETGSIRPGAIGGSKPKQVTTPDVEKKIEEYKRENPGMFSWEIRDKLLKDAVCDRNTVPSVSSISRILRSKFGKGEEEEADLERKEAEESEKKAKHSIDGILSERGKRWRLGRRTCWVTWRASAS

SEQ ID NO: 32934 - protein, 206 aa, Homo sapiens
  ENSP00000258387
MTTLAGAVPRMMRPGPGQNYPRSGFPLEVSTPLGQGRVNQLGGVFINGRPLPNHIRHKIVEMAHHGIRPCVISRQLRVSHGCVSKILCRYQETGSIRPGAIGGSKPKQVTTPDVEKKIEEYKRENPGMFSWEIRDKLLKDAVCDRNTVPSVSSISRILRSKFGKGEEEEADLERKEAEESEKKAKHSIDGILSERGKALVSGVSSH

SEQ ID NO: 32935 - protein, 436 aa, Homo sapiens
  ENSP00000480026
MQNSHSGVNQLGGVFVNGRPLPDSTRQKIVELAHSGARPCDISRILQTHADAKVQVLDNQNVSNGCVSKILGRYYETGSIRPRAIGGSKPRVATPEVVSKIAQYKRECPSIFAWEIRDRLLSEGVCTNDNIPSVSSINRVLRNLASEKQQMGADGMYDKLRMLNGQTGSWGTRPGWYPGTSVPGQPTQDGCQQQEGGGENTNSISSNGEDSDEAQMRLQLKRKLQRNRTSFTQEQIEALEKEFERTHYPDVFARERLAAKIDLPEARIQVWFSNRRAKWRREEKLRNQRRQASNTPSHIPISSSFSTSVYQPIPQPTTPVSSFTSGSMLGRTDTALTNTYSALPPMPSFTMANNLPMQPPVPSQTSSYSCMLPTSPSVNGRSYDTYTPPHMQTHMNSQPMGTSGTTSTGLISPGVSVPVQVPGSEPDMSQYWPRLQ

SEQ ID NO: 32936 - protein, 436 aa, Homo sapiens; identical to SEQ ID NO: 32935
  ENSP00000492024

SEQ ID NO: 32937 - protein, 422 aa, Homo sapiens [sequence omitted]

SEQ ID NO: 32938 - protein, 436 aa, Homo sapiens; identical to SEQ ID NO: 32935
  ENSP00000404100

SEQ ID NO: 32939 - protein, 422 aa, Homo sapiens [sequence omitted]

SEQ ID NO: 32940 - protein, 422 aa, Homo sapiens [sequence omitted]

SEQ ID NO: 32941 - protein, 422 aa, Homo sapiens [sequence omitted]

SEQ ID NO: 32942 - protein, 436 aa, Homo sapiens; identical to SEQ ID NO: 32935
  ENSP00000368424

SEQ ID NO: 32943 - protein, 422 aa, Homo sapiens [sequence omitted]

SEQ ID NO: 32944 - protein, 302 aa, Homo sapiens
  ENSP00000492316
MQNNGCQQQEGGGENTNSISSNGEDSDEAQMRLQLKRKLQRNRTSFTQEQIEALEKEFERTHYPDVFARERLAAKIDLPEARIQVWFSNRRAKWRREEKLRNQRRQASNTPSHIPISSSFSTSVYQPIPQPTTPVSSFTSGSMLGRTDTALTNTYSALPPMPSFTMANNLPMQDSFPLVCQFQFKFPEVNLICLNTGQDYSKKKKKKKKERKYCVNSVSDYGDTTVELSGKKEKWLLEPLQFYNCVLYCTTGEGMDLKQGPLYTEGTISVGTNLHFGIQTFIHFGVLFVNGHLYVIMKKRTM

SEQ ID NO: 32945 - protein, 436 aa, Homo sapiens; identical to SEQ ID NO: 32935
  ENSP00000368401

SEQ ID NO: 32946 - protein, 436 aa, Homo sapiens; identical to SEQ ID NO: 32935
  ENSP00000492296

SEQ ID NO: 32947 - protein, 436 aa, Homo sapiens; identical to SEQ ID NO: 32935
  ENSP00000492476

SEQ ID NO: 32948 - protein, 436 aa, Homo sapiens; identical to SEQ ID NO: 32935
  ENSP00000491872

SEQ ID NO: 32949 - protein, 473 aa, Homo sapiens
  ENSP00000491948
MQNSHSGVNQLGGVFVNGRPLPDSTRQKIVELAHSGARPCDISRILQVSNGCVSKILGRYYETGSIRPRAIGGSKPRVATPEVVSKIAQYKRECPSIFAWEIRDRLLSEGVCTNDNIPSVSSINRVLRNLASEKQQMGADGMYDKLRMLNGQTGSWGTRPGWYPGTSVPGQPTQDGCQQQEGGGENTNSISSNGEDSDEAQMRLQLKRKLQRNRTSFTQEQIEALEKEFERTHYPDVFARERLAAKIDLPEARIQVWFSNRRAKWRREEKLRNQRRQASNTPSHIPISSSFSTSVYQPIPQPTTPVSSFTSGSMLGRTDTALTNTYSALPPMPSFTMANNLPMQDSFPLVCQFQFKFPEVNLICLNTGQDYSKKKKKKKKERKYCVNSVSDYGDTTVELSGKKEKWLLEPLQFYNCVLYCTTGEGMDLKQGPLYTEGTISVGTNLHFGIQTFIHFGVLFVNGHLYVIMKKRTM

SEQ ID NO: 32950 - protein, 221 aa, Homo sapiens
  ENSP00000492769
MRLQLKRKLQRNRTSFTQEQIEALEKEFERTHYPDVFARERLAAKIDLPEARIQVWFSNRRAKWRREEKLRNQRRQASNTPSHIPISSSFSTSVYQPIPQPTTPVSSFTSGSMLGRTDTALTNTYSALPPMPSFTMANNLPMQPPVPSQTSSYSCMLPTSPSVNGRSYDTYTPPHMQTHMNSQPMGTSGTTSTGLISPGVSVPVQVPGSEPDMSQYWPRLQ

SEQ ID NO: 32951 - protein, 422 aa, Homo sapiens [sequence omitted]

SEQ ID NO: 32952 - protein, 286 aa, Homo sapiens
  ENSP00000490971
MGADGMYDKLRMLNGQTGSWGTRPGWYPGTSVPGQPTQDGCQQQEGGGENTNSISSNGEDSDEAQMRLQLKRKLQRNRTSFTQEQIEALEKEFERTHYPDVFARERLAAKIDLPEARIQVWFSNRRAKWRREEKLRNQRRQASNTPSHIPISSSFSTSVYQPIPQPTTPVSSFTSGSMLGRTDTALTNTYSALPPMPSFTMANNLPMQPPVPSQTSSYSCMLPTSPSVNGRSYDTYTPPHMQTHMNSQPMGTSGTTSTGLISPGVSVPVQVPGSEPDMSQYWPRLQ

SEQ ID NO: 32953 - protein, 286 aa, Homo sapiens; identical to SEQ ID NO: 32952
  ENSP00000491944

SEQ ID NO: 32954 - protein, 286 aa, Homo sapiens; identical to SEQ ID NO: 32952
  ENSP00000492166

SEQ ID NO: 32955 - protein, 286 aa, Homo sapiens; identical to SEQ ID NO: 32952
  ENSP00000492205

SEQ ID NO: 32956 - protein, 286 aa, Homo sapiens; identical to SEQ ID NO: 32952
  ENSP00000492658

SEQ ID NO: 32957 - protein, 400 aa, Homo sapiens
  ENSP00000492756
MQNSHSGVNQLGGVFVNGRPLPDSTRQKIVELAHSGARPCDISRILQTHADAKVQVLDNQNVSNGCVSKILGRYYETGSIRPRAIGGSKPRVATPEVVSSINRVLRNLASEKQQMGADGMYDKLRMLNGQTGSWGTRPGWYPGTSVPGQPTQDGCQQQEGGGENTNSISSNGEDSDEAQMRLQLKRKLQRNRTSFTQEQIEALEKEFERTHYPDVFARERLAAKIDLPEARIQVWFSNRRAKWRREEKLRNQRRQASNTPSHIPISSSFSTSVYQPIPQPTTPVSSFTSGSMLGRTDTALTNTYSALPPMPSFTMANNLPMQPPVPSQTSSYSCMLPTSPSVNGRSYDTYTPPHMQTHMNSQPMGTSGTTSTGLISPGVSVPVQVPGSEPDMSQYWPRLQ

SEQ ID NO: 32958 - protein, 386 aa, Homo sapiens
  ENSP00000492181
MQNSHSGVNQLGGVFVNGRPLPDSTRQKIVELAHSGARPCDISRILQVSNGCVSKILGRYYETGSIRPRAIGGSKPRVATPEVVSSINRVLRNLASEKQQMGADGMYDKLRMLNGQTGSWGTRPGWYPGTSVPGQPTQDGCQQQEGGGENTNSISSNGEDSDEAQMRLQLKRKLQRNRTSFTQEQIEALEKEFERTHYPDVFARERLAAKIDLPEARIQVWFSNRRAKWRREEKLRNQRRQASNTPSHIPISSSFSTSVYQPIPQPTTPVSSFTSGSMLGRTDTALTNTYSALPPMPSFTMANNLPMQPPVPSQTSSYSCMLPTSPSVNGRSYDTYTPPHMQTHMNSQPMGTSGTTSTGLISPGVSVPVQVPGSEPDMSQYWPRLQ

SEQ ID NO: 32959 - protein, 422 aa, Homo sapiens [sequence omitted]

SEQ ID NO: 32960 - protein, 368 aa, Homo sapiens
  ENSP00000492587
MQNSHSGVNQLGGVFVNGRPLPDSTRQKIVELAHSGARPCDISRILQTHADAKVQVLDNQNVSNGCVSSINRVLRNLASEKQQMGADGMYDKLRMLNGQTGSWGTRPGWYPGTSVPGQPTQDGCQQQEGGGENTNSISSNGEDSDEAQMRLQLKRKLQRNRTSFTQEQIEALEKEFERTHYPDVFARERLAAKIDLPEARIQVWFSNRRAKWRREEKLRNQRRQASNTPSHIPISSSFSTSVYQPIPQPTTPVSSFTSGSMLGRTDTALTNTYSALPPMPSFTMANNLPMQPPVPSQTSSYSCMLPTSPSVNGRSYDTYTPPHMQTHMNSQPMGTSGTTSTGLISPGVSVPVQVPGSEPDMSQYWPRL

SEQ ID NO: 32961 - protein, 367 aa, Homo sapiens
  ENSP00000388132
MQNSHSGVNQLGGVFVNGRPLPDSTRQKIVELAHSGARPCDISRILQTHADAKVQVLDNQNVSNGCVSSINRVLRNLASEKQQMGADGMYDKLRMLNGQTGSWGTRPGWYPGTSVPGQPTQDGCQQQEGGGENTNSISSNGEDSDEAQMRLQLKRKLQRNRTSFTQEQIEALEKEFERTHYPDVFARERLAAKIDLPEARIQVWFSNRRAKWRREEKLRNQRRQASNTPSHIPISSSFSTSVYQPIPQPTTPVSSFTSGSMLGRTDTALTNTYSALPPMPSFTMANNLPMQPPVPSQTSSYSCMLPTSPSVNGRSYDTYTPPHMQTHMNSQPMGTSGTTSTGLISPGVSVPVQVPGSEPDMSQYWPR

SEQ ID NO: 32962 - protein, 283 aa, Homo sapiens
  ENSP00000491324
MGADGMYDKLRMLNGQTGSWGTRPGWYPGTSVPGQPTQDGCQQQEGGGENTNSISSNGEDSDEAQMRLQLKRKLQRNRTSFTQEQIEALEKEFERTHYPDVFARERLAAKIDLPEARIQVWFSNRRAKWRREEKLRNQRRQASNTPSHIPISSSFSTSVYQPIPQPTTPVSSFTSGSMLGRTDTALTNTYSALPPMPSFTMANNLPMQPPVPSQTSSYSCMLPTSPSVNGRSYDTYTPPHMQTHMNSQPMGTSGTTSTGLISPGVSVPVQVPGSEPDMSQYWP

SEQ ID NO: 32963 - protein, 283 aa, Homo sapiens; identical to SEQ ID NO: 32962
  ENSP00000491214

SEQ ID NO: 32964 - protein, 382 aa, Homo sapiens
  ENSP00000492397
MQNSHSGVNQLGGVFVNGRPLPDSTRQKIVELAHSGARPCDISRILQTHADAKVQVLDNQNVSNGCVSKILGRYYETGSIRPRAIGGSKPRVATPEVVSKIAQYKRECPSIFAWEIRDRLLSEGVCTNDNIPSVSSINRVLRNLASEKQQMGADGMYDKLRMLNGQTGSWGTRPGWYPGTSVPGQPTQDGCQQQEGGGENTNSISSNGEDSDEAQMRLQLKRKLQRNRTSFTQEQIEALEKEFERTHYPDVFARERLAAKIDLPEARIQVWFSNRRAKWRREEKLRNQRRQASNTPSHIPISSSFSTSVYQPIPQPTTPVSSFTSGSMLGRTDTALTNTYSALPPMPSFTMANNLPMQDSFPLVCQFQFKFPEVNLICLNTG

SEQ ID NO: 32965 - protein, 419 aa, Homo sapiens
  ENSP00000368406
MQNSHSGVNQLGGVFVNGRPLPDSTRQKIVELAHSGARPCDISRILQVSNGCVSKILGRYYETGSIRPRAIGGSKPRVATPEVVSKIAQYKRECPSIFAWEIRDRLLSEGVCTNDNIPSVSSINRVLRNLASEKQQMGADGMYDKLRMLNGQTGSWGTRPGWYPGTSVPGQPTQDGCQQQEGGGENTNSISSNGEDSDEAQMRLQLKRKLQRNRTSFTQEQIEALEKEFERTHYPDVFARERLAAKIDLPEARIQVWFSNRRAKWRREEKLRNQRRQASNTPSHIPISSSFSTSVYQPIPQPTTPVSSFTSGSMLGRTDTALTNTYSALPPMPSFTMANNLPMQPPVPSQTSSYSCMLPTSPSVNGRSYDTYTPPHMQTHMNSQPMGTSGTTSTGLISPGVSVPVQVPGSEPDMSQYWP

SEQ ID NO: 32966 - protein, 419 aa, Homo sapiens; identical to SEQ ID NO: 32965
  ENSP00000491862

SEQ ID NO: 32967 - protein, 282 aa, Homo sapiens
  ENSP00000491365
MGADGMYDKLRMLNGQTGSWGTRPGWYPGTSVPGQPTQDGCQQQEGGGENTNSISSNGEDSDEAQMRLQLKRKLQRNRTSFTQEQIEALEKEFERTHYPDVFARERLAAKIDLPEARIQVWFSNRRAKWRREEKLRNQRRQASNTPSHIPISSSFSTSVYQPIPQPTTPVSSFTSGSMLGRTDTALTNTYSALPPMPSFTMANNLPMQPPVPSQTSSYSCMLPTSPSVNGRSYDTYTPPHMQTHMNSQPMGTSGTTSTGLISPGVSVPVQVPGSEPDMSQYW

SEQ ID NO: 32968 - protein, 282 aa, Homo sapiens; identical to SEQ ID NO: 32967
  ENSP00000368418

SEQ ID NO: 32969 - protein, 417 aa, Homo sapiens
  ENSP00000431585
MQNSHSGVNQLGGVFVNGRPLPDSTRQKIVELAHSGARPCDISRILQVSNGCVSKILGRYYETGSIRPRAIGGSKPRVATPEVVSKIAQYKRECPSIFAWEIRDRLLSEGVCTNDNIPSVSSINRVLRNLASEKQQMGADGMYDKLRMLNGQTGSWGTRPGWYPGTSVPGQPTQDGCQQQEGGGENTNSISSNGEDSDEAQMRLQLKRKLQRNRTSFTQEQIEALEKEFERTHYPDVFARERLAAKIDLPEARIQVWFSNRRAKWRREEKLRNQRRQASNTPSHIPISSSFSTSVYQPIPQPTTPVSSFTSGSMLGRTDTALTNTYSALPPMPSFTMANNLPMQPPVPSQTSSYSCMLPTSPSVNGRSYDTYTPPHMQTHMNSQPMGTSGTTSTGLISPGVSVPVQVPGSEPDMSQY

SEQ ID NO: 32970 - protein, 281 aa, Homo sapiens
  ENSP00000491065
MGADGMYDKLRMLNGQTGSWGTRPGWYPGTSVPGQPTQDGCQQQEGGGENTNSISSNGEDSDEAQMRLQLKRKLQRNRTSFTQEQIEALEKEFERTHYPDVFARERLAAKIDLPEARIQVWFSNRRAKWRREEKLRNQRRQASNTPSHIPISSSFSTSVYQPIPQPTTPVSSFTSGSMLGRTDTALTNTYSALPPMPSFTMANNLPMQPPVPSQTSSYSCMLPTSPSVNGRSYDTYTPPHMQTHMNSQPMGTSGTTSTGLISPGVSVPVQVPGSEPDMSQY

SEQ ID NO: 32971 - protein, 163 aa, Homo sapiens
  ENSP00000492177
MQNSHSGVNQLGGVFVNGRPLPDSTRQKIVELAHSGARPCDISRILQTHADAKVQVLDNQNVSNGCVSKILGRYYETGSIRPRAIGGSKPRVATPEVVSKIAQYKRECPSIFAWEIRDRLLSEGVCTNDNIPSVSSLRTSALPALSPMLSPLYLLPPSLSTVS

SEQ ID NO: 32972 - protein, 277 aa, Homo sapiens
  ENSP00000491904
MGADGMYDKLRMLNGQTGSWGTRPGWYPGTSVPGQPTQDGCQQQEGGGENTNSISSNGEDSDEAQMRLQLKRKLQRNRTSFTQEQIEALEKEFERTHYPDVFARERLAAKIDLPEARIQVWFSNRRAKWRREEKLRNQRRQASNTPSHIPISSSFSTSVYQPIPQPTTPVSSFTSGSMLGRTDTALTNTYSALPPMPSFTMANNLPMQPPVPSQTSSYSCMLPTSPSVNGRSYDTYTPPHMQTHMNSQPMGTSGTTSTGLISPGVSVPVQVPGSEPD

SEQ ID NO: 32973 - protein, 277 aa, Homo sapiens; identical to SEQ ID NO: 32972
  ENSP00000491280

SEQ ID NO: 32974 - protein, 413 aa, Homo sapiens
  ENSP00000492802
MQNSHSGVNQLGGVFVNGRPLPDSTRQKIVELAHSGARPCDISRILQVSNGCVSKILGRYYETGSIRPRAIGGSKPRVATPEVVSKIAQYKRECPSIFAWEIRDRLLSEGVCTNDNIPSVSSINRVLRNLASEKQQMGADGMYDKLRMLNGQTGSWGTRPGWYPGTSVPGQPTQDGCQQQEGGGENTNSISSNGEDSDEAQMRLQLKRKLQRNRTSFTQEQIEALEKEFERTHYPDVFARERLAAKIDLPEARIQVWFSNRRAKWRREEKLRNQRRQASNTPSHIPISSSFSTSVYQPIPQPTTPVSSFTSGSMLGRTDTALTNTYSALPPMPSFTMANNLPMQPPVPSQTSSYSCMLPTSPSVNGRSYDTYTPPHMQTHMNSQPMGTSGTTSTGLISPGVSVPVQVPGSEPD

SEQ ID NO: 32975 - protein, 263 aa, Homo sapiens
  ENSP00000492437
MGADGMYDKLRMLNGQTGSWGTRPGWYPGTSVPGQPTQDGCQQQEGGGENTNSISSNGEDSDEAQMRLQLKRKLQRNRTSFTQEQIEALEKEFERTHYPDVFARERLAAKIDLPEARIQVWFSNRRAKWRREEKLRNQRRQASNTPSHIPISSSFSTSVYQPIPQPTTPVSSFTSGSMLGRTDTALTNTYSALPPMPSFTMANNLPMQPPVPSQTSSYSCMLPTSPSVNGRSYDTYTPPHMQTHMNSQPMGTSGTTSTGLISP

SEQ ID NO: 32976 - protein, 260 aa, Homo sapiens
  ENSP00000491267
MGADGMYDKLRMLNGQTGSWGTRPGWYPGTSVPGQPTQDGCQQQEGGGENTNSISSNGEDSDEAQMRLQLKRKLQRNRTSFTQEQIEALEKEFERTHYPDVFARERLAAKIDLPEARIQVWFSNRRAKWRREEKLRNQRRQASNTPSHIPISSSFSTSVYQPIPQPTTPVSSFTSGSMLGRTDTALTNTYSALPPMPSFTMANNLPMQPPVPSQTSSYSCMLPTSPSVNGRSYDTYTPPHMQTHMNSQPMGTSGTTSTGL

SEQ ID NO: 32977 - protein, 335 aa, Homo sapiens
  ENSP00000368410
MQNSHSGVNQLGGVFVNGRPLPDSTRQKIVELAHSGARPCDISRILQTHADAKVQVLDNQNVSNGCVSSINRVLRNLASEKQQMGADGMYDKLRMLNGQTGSWGTRPGWYPGTSVPGQPTQDGCQQQEGGGENTNSISSNGEDSDEAQMRLQLKRKLQRNRTSFTQEQIEALEKEFERTHYPDVFARERLAAKIDLPEARIQVWFSNRRAKWRREEKLRNQRRQASNTPSHIPISSSFSTSVYQPIPQPTTPVSSFTSGSMLGRTDTALTNTYSALPPMPSFTMANNLPMQPPVPSQTSSYSCMLPTSPSVNGRSYDTYTPPHMQTHMNSQPMGT

SEQ ID NO: 32978 - protein, 249 aa, Homo sapiens
  ENSP00000491210
MGADGMYDKLRMLNGQTGSWGTRPGWYPGTSVPGQPTQDGCQQQEGGGENTNSISSNGEDSDEAQMRLQLKRKLQRNRTSFTQEQIEALEKEFERTHYPDVFARERLAAKIDLPEARIQVWFSNRRAKWRREEKLRNQRRQASNTPSHIPISSSFSTSVYQPIPQPTTPVSSFTSGSMLGRTDTALTNTYSALPPMPSFTMANNLPMQPPVPSQTSSYSCMLPTSPSVNGRSYDTYTPPHMQTHMNSQP

SEQ ID NO: 32979 - protein, 205 aa, Homo sapiens
  ENSP00000492808
MQNNGCQQQEGGGENTNSISSNGEDSDEAQMRLQLKRKLQRNRTSFTQEQIEALEKEFERTHYPDVFARERLAAKIDLPEARIQVWFSNRRAKWRREEKLRNQRRQASNTPSHIPISSSFSTSVYQPIPQPTTPVSSFTSGSMLGRTDTALTNTYSALPPMPSFTMANNLPMQPPVPSQTSSYSCMLPTSPSVNGRSYDTYTPPH

SEQ ID NO: 32980 - protein, 238 aa, Homo sapiens
  ENSP00000491517
MGADGMYDKLRMLNGQTGSWGTRPGWYPGTSVPGQPTQDGCQQQEGGGENTNSISSNGEDSDEAQMRLQLKRKLQRNRTSFTQEQIEALEKEFERTHYPDVFARERLAAKIDLPEARIQVWFSNRRAKWRREEKLRNQRRQASNTPSHIPISSSFSTSVYQPIPQPTTPVSSFTSGSMLGRTDTALTNTYSALPPMPSFTMANNLPMQPPVPSQTSSYSCMLPTSPSVNGRSYDTYTP

SEQ ID NO: 32981 - protein, 320 aa, Homo sapiens
  ENSP00000404356
MQNSHSGVNQLGGVFVNGRPLPDSTRQKIVELAHSGARPCDISRILQTHADAKVQVLDNQNVSNGCVSSINRVLRNLASEKQQMGADGMYDKLRMLNGQTGSWGTRPGWYPGTSVPGQPTQDGCQQQEGGGENTNSISSNGEDSDEAQMRLQLKRKLQRNRTSFTQEQIEALEKEFERTHYPDVFARERLAAKIDLPEARIQVWFSNRRAKWRREEKLRNQRRQASNTPSHIPISSSFSTSVYQPIPQPTTPVSSFTSGSMLGRTDTALTNTYSALPPMPSFTMANNLPMQPPVPSQTSSYSCMLPTSPSVNGRSYDTYT

SEQ ID NO: 32982 - protein, 231 aa, Homo sapiens
  ENSP00000492081
MGADGMYDKLRMLNGQTGSWGTRPGWYPGTSVPGQPTQDGCQQQEGGGENTNSISSNGEDSDEAQMRLQLKRKLQRNRTSFTQEQIEALEKEFERTHYPDVFARERLAAKIDLPEARIQVWFSNRRAKWRREEKLRNQRRQASNTPSHIPISSSFSTSVYQPIPQPTTPVSSFTSGSMLGRTDTALTNTYSALPPMPSFTMANNLPMQPPVPSQTSSYSCMLPTSPSVNGR

SEQ ID NO: 32983 - protein, 314 aa, Homo sapiens
  ENSP00000491229
MQNSHSGVNQLGGVFVNGRPLPDSTRQKIVELAHSGARPCDISRILQTHADAKVQVLDNQNVSNGCVSSINRVLRNLASEKQQMGADGMYDKLRMLNGQTGSWGTRPGWYPGTSVPGQPTQDGCQQQEGGGENTNSISSNGEDSDEAQMRLQLKRKLQRNRTSFTQEQIEALEKEFERTHYPDVFARERLAAKIDLPEARIQVWFSNRRAKWRREEKLRNQRRQASNTPSHIPISSSFSTSVYQPIPQPTTPVSSFTSGSMLGRTDTALTNTYSALPPMPSFTMANNLPMQPPVPSQTSSYSCMLPTSPSVNGR

SEQ ID NO: 32984 - protein, 370 aa, Homo sapiens
  ENSP00000491779
MQNSHSGVNQLGGVFVNGRPLPDSTRQKIVELAHSGARPCDISRILQTHADAKVQVLDNQNVSNGCVSKILGRYYETGSIRPRAIGGSKPRVATPEVVSKIAQYKRECPSIFAWEIRDRLLSEGVCTNDNIPSVSSINRVLRNLASEKQQMGADGMYDKLRMLNGQTGSWGTRPGWYPGTSVPGQPTQDGCQQQEGGGENTNSISSNGEDSDEAQMRLQLKRKLQRNRTSFTQEQIEALEKEFERTHYPDVFARERLAAKIDLPEARIQVWFSNRRAKWRREEKLRNQRRQASNTPSHIPISSSFSTSVYQPIPQPTTPVSSFTSGSMLGRTDTALTNTYSALPPMPSFTMANNLPMQPPVPSQTSSYSC

SEQ ID NO: 32985 - protein, 401 aa, Homo sapiens
  ENSP00000491679
MQNSHSGVNQLGGVFVNGRPLPDSTRQKIVELAHSGARPCDISRILQVSNGCVSKILGRYYETGSIRPRAIGGSKPRVATPEVVSKIAQYKRECPSIFAWEIRDRLLSEGVCTNDNIPSVSSINRVLRNLASEKQQMGADGMYDKLRMLNGQTGSWGTRPGWYPGTSVPGQPTQDGCQQQEGGGENTNSISSNGEDSDEAQMRLQLKRKLQRNRTSFTQEQIEALEKEFERTHYPDVFARERLAAKIDLPEARIQVWFSNRRAKWRREEKLRNQRRQASNTPSHIPISSSFSTSVYQPIPQPTTPVSSFTSGSMLGRTDTALTNTYSALPPMPSFTMANNLPMQVSAAGGGLHNPGPREVRSGSGPADLIGCVCTLESFSHYSDWLDQSSRRQSIPSLLSD

SEQ ID NO: 32986 - protein, 415 aa, Homo sapiens
  ENSP00000491492
MQNSHSGVNQLGGVFVNGRPLPDSTRQKIVELAHSGARPCDISRILQTHADAKVQVLDNQNVSNGCVSKILGRYYETGSIRPRAIGGSKPRVATPEVVSKIAQYKRECPSIFAWEIRDRLLSEGVCTNDNIPSVSSINRVLRNLASEKQQMGADGMYDKLRMLNGQTGSWGTRPGWYPGTSVPGQPTQDGCQQQEGGGENTNSISSNGEDSDEAQMRLQLKRKLQRNRTSFTQEQIEALEKEFERTHYPDVFARERLAAKIDLPEARIQVWFSNRRAKWRREEKLRNQRRQASNTPSHIPISSSFSTSVYQPIPQPTTPVSSFTSGSMLGRTDTALTNTYSALPPMPSFTMANNLPMQVSAAGGGLHNPGPREVRSGSGPADLIGCVCTLESFSHYSDWLDQSSRRQSIPSLLSD

SEQ ID NO: 32987 - protein, 263 aa, Homo sapiens
  ENSP00000492129
MGADGMYDKLRMLNGQTGSWGTRPGWYPGTSVPGQPTQDGCQQQEGGGENTNSISSNGEDSDEAQMRLQLKRKLQRNRTSFTQEQIEALEKEFERTHYPDVFARERLAAKIDLPEARIQVWFSNRRAKWRREEKLRNQRRQASNTPSHIPISSSFSTSVYQPIPQPTTPVSSFTSGSMLGRTDTALTNTYSALPPMPSFTMANNLPMQVSAAGGGLHNPGPREVRSGSGPADLIGCVCTLESFSHYSDWLDQSSRRQSIPSLL

SEQ ID NO: 32988 - protein, 341 aa, Homo sapiens
  ENSP00000492409
MPHKGHSGVNQLGGVFVNGRPLPDSTRQKIVELAHSGARPCDISRILQVSNGCVSKILGRYYETGSIRPRAIGGSKPRVATPEVVSKIAQYKRECPSIFAWEIRDRLLSEGVCTNDNIPSVSSINRVLRNLASEKQQMGADGMYDKLRMLNGQTGSWGTRPGWYPGTSVPGQPTQDGCQQQEGGGENTNSISSNGEDSDEAQMRLQLKRKLQRNRTSFTQEQIEALEKEFERTHYPDVFARERLAAKIDLPEARIQVWFSNRRAKWRREEKLRNQRRQASNTPSHIPISSSFSTSVYQPIPQPTTPVSSFTSGSMLGRTDTALTNTYSALPPMPSFTMANN

SEQ ID NO: 32989 - protein, 241 aa, Homo sapiens
  ENSP00000397384
MQNSHSGVNQLGGVFVNGRPLPDSTRQKIVELAHSGARPCDISRILQTHADAKVQVLDNQNVSNGCVSKILGRYYETGSIRPRAIGGSKPRVATPEVVSKIAQYKRECPSIFAWEIRDRLLSEGVCTNDNIPSVSSINRVLRNLASEKQQMGADGMYDKLRMLNGQTGSWGTRPGWYPGTSVPGQPTQDGCQQQEGGGENTNSISSNGEDSDEAQMRLQLKRKLQRNRTSFTQEQIEALEK

SEQ ID NO: 32990 - protein, 72 aa, Homo sapiens
  ENSP00000492111
MQNSHSGVNQLGGVFVNGRPLPDSTRQKIVELAHSGARPCDISRILQTHADAKVQVLDNQNVSNGCVSKILG

SEQ ID NO: 32991 - protein, 3 aa, Homo sapiens
  ENSP00000436365
MQN

SEQ ID NO: 32992 - protein, 917 aa, Homo sapiens
  ENSP00000328992
MFRKARRVNVRKRNDSEEEERERDEEQEPPPLLPPPGTGEEAGPGGGDRAPGGESLLGPGPSPPSALTPGLGAEAGGGFPGGAEPGNGLKPRKRPRENKEVPRASLLSFQDEEEENEEVFKVKKSSYSKKIVKLLKKEYKEDLEKSKIKTELNSSAESEQPLDKTGHVKDTNQEDGVIISEHGEDEMDMESEKEEEKPKTGGAFSNALSSLNVLRPGEIPDAAFIHAARKKRQMARELGDFTPHDNEPGKGRLVREDENDASDDEDDDEKRRIVFSVKEKSQRQKIAEEIGIEGSDDDALVTGEQDEELSRWEQEQIRKGINIPQVQASQPAEVNMYYQNTYQTMPYGSSYGIPYSYTAYGSSDAKSQKTDNTVPFKTPSNEMTPVTIDLVKKQLKDRLDSMKELHKTNRQQHEKHLQSRVDSTRAIERLEGSSGGIGERYKFLQEMRGYVQDLLECFSEKVPLINELESAIHQLYKQRASRLVQRRQDDIKDESSEFSSHSNKALMAPNLDSFGRDRALYQEHAKRRIAEREARRTRRRQAREQTGKMADHLEGLSSDDEETSTDITNFNLEKDRISKESGKVFEDVLESFYSIDCIKSQFEAWRSKYYTSYKDAYIGLCLPKLFNPLIRLQLLTWTPLEAKCRDFENMLWFESLLFYGCEEREQEKDDVDVALLPTIVEKVILPKLTVIAENMWDPFSTTQTSRMVGITLKLINGYPSVVNAENKNTQVYLKALLLRMRRTLDDDVFMPLYPKNVLENKNSGPYLFFQRQFWSSVKLLGNFLQWYGIFSNKTLQELSIDGLLNRYILMAFQNSEYGDDSIKKAQNVINCFPKQWFMNLKGERTISQLENFCRYLVHLADTIYRNSIGCSDVEKRNARENIKQIVKLLASVRALDHAMSVASDHNVKEFKSLIEGK

SEQ ID NO: 32993 - protein, 511 aa, Homo sapiens
  ENSP00000393038
MFRKARRVNVRKRNDSEEEERERDEEQEPPPLLPPPGTGEEAGPGGGDRAPGGESLLGPGPSPPSALTPGLGAEAGGGFPGGAEPGNGLKPRKRPRENKEVPRASLLSFQDEEEENEEVFKVKKSSYSKKIVKLLKKEYKEDLEKSKIKTELNSSAESEQPLDKTGHVKDTNQEDGVIISEHGEDEMDMESEKEEEKPKTGGAFSNALSSLNVLRPGEIPDAAFIHAARKKRQMARELGDFTPHDNEPGKGRLVREDENDASDDEDDDEKRRIVFSVKEKSQRQKIAEEIGIEGSDDDALVTGEQDEELSRWEQEQIRKGINIPQVQASQPAEVNMYYQNTYQTMPYGSSYGIPYSYTAYGSSDAKSQKTDNTVPFKTPSNEMTPVTIDLVKKQLKDRLDSMKELHKTNRQQHEKHLQSRVDSTRAIERLEGSSGGIGERYKFLQEMRGYVQDLLECFSEKVPLINELESAIHQLYKQRASRLVQRRQDDIKDESSEFSSHSSQSILKTKL

SEQ ID NO: 32994 - protein, 815 aa, Homo sapiens
  ENSP00000290178
MFRKARRVNVRKRNDSEEEERERDEEQEPPPLLPPPGTGEEAGPGGGDRAPGGESLLGPGPSPPSALTPGLGAEAGGGFPGGAEPGNGLKPRKRPRENKEVPRASLLSFQDEEEENEEVFKVKKSSYSKKIVKLLKKEYKEDLEKSKIKTELNSSAESEQPLDKTGHVKDTNQEDGVIISEHGEDEMDMESEKEEEKPKTGGAFSNALSSLNVLRPGEIPDAAFIHAARKKRQMARELGDFTPHDNEPGKGRLVREDENDASDDEDDDEKRRIVFSVKEKSQRQKIAEEIGIEGSDDDALVTGEQDEELSRWEQEQIRKGINIPQVQASQPAEVNMYYQNTYQTMPYGSSYGIPYSYTAYGSSDAKSQKTDNTVPFKTPSNEMTPVTIDLVKKQLKDRLDSMKELHKTNRQQHEKHLQSRVDSTRAIERLEGSSGGIGERYKFLQEMRGYVQDLLECFSEKVPLINELESAIHQLYKQRASRLVQRRQDDIKDESSEFSSHSNKALMAPNLDSFGRDRALYQEHAKRRIAEREARRTRRRQAREQTGKMADHLEGLSSDDEETSTDITNFNLEKDRISKESGKVFEDVLESFYSIDCIKSQFEAWRSKYYTSYKDAYIGLCLPKLFNPLIRLQLLTWTPLEAKCRDFENMLWFESLLFYGCEEREQEKDDVDVALLPTIVEKVILPKLTVIAENMWDPFSTTQTSRMVGITLKLINGYPSVVNAENKNTQVYLKALLLRMRRTLDDDVFMPLYPKNVLENKNSGPYLFFQRQFWSSVKVIKPPFQRGSCPIPRRKECCSERPRRIWTDRPCVVFS

SEQ ID NO: 32995 - protein, 25 aa, Homo sapiens
  ENSP00000408048
QFWSSVKEKVISEFQSKVHRTQRNA

SEQ ID NO: 32996 - protein, 36 aa, Homo sapiens
  ENSP00000388973
YKQRASRLVQRRQDDIKDESSEFSSHSSQSILKTKL

SEQ ID NO: 32997 - protein, 157 aa, Homo sapiens
  ENSP00000458892
MFRKARRVNVRKRNDSEEEERERDEEQEPPPLLPPPGTGEEAGPGGGDRAPGGESLLGPGPSPPSALTPGLGAEAGGGFPGGAEPGNGLKPRKRPRENKEVPRASLLSFQDEEEENEEVFKVKKSSYSKKIVKLLKKEYKEDLEKSKIKTELNSSAE

SEQ ID NO: 32998 - protein, 157 aa, Homo sapiens; identical to SEQ ID NO: 32997
  ENSP00000458262

SEQ ID NO: 32999 - protein, 176 aa, Homo sapiens
  ENSP00000397903
  MOD_RES (1)..(1): Any amino acid
XCFLENKSGAITCLSIRGAQEEDPPDPQLMRLDNMLLAEGVSGPEKGGGSAAAAAAAAASGGSSDNSIEHSDYRAKLTQIRQIYHTELEKYEQACNEFTTHVMNLLREQSRTRPISPKEIERMVGIIHRKFSSIQMQLKQSTCEAVMILRSRFLDARRKRRNFSKQATEILNEYFY

SEQ ID NO: 33000 - protein, 359 aa, Homo sapiens
  ENSP00000387456
MKPALFSVLCEIKEKTGLSIRGAQEEDPPDPQLMRLDNMLLAEGVSGPEKGGGSAAAAAAAAASGGSSDNSIEHSDYRAKLTQIRQIYHTELEKYEQACNEFTTHVMNLLREQSRTRPISPKEIERMVGIIHRKFSSIQMQLKQSTCEAVMILRSRFLDARRKRRNFSKQATEILNEYFYSHLSNPYPSEEAKEELAKKCSITVSQVSNWFGNKRIRYKKNIGKFQEEANLYAAKTAVTAAHAVAAAVQNNQTNSPTTPNSGSSGSFNLPNSGDMFMNMQSLNGDSYQGSQVGANVQSQVDTLRHVINQTGGYSDGLGGNSLYSPHNLNANGGWQDATTPSSVTSPTEGPGSVHSDTSN

SEQ ID NO: 33001 - protein, 160 aa, Homo sapiens
  ENSP00000475679
MKPALFSVLCEIKEKTGLSIRGAQEEDPPDPQLMRLDNMLLAEGVSGPEKGGGSAAAAAAAAASGGSSDNSIEHSDYRAKLTQIRQIYHTELEKYEQACNEFTTHVMNLLREQSRTRPISPKEIERMVGIIHRKFSSIQMQLKQSTCEAVMILRSRFLDA

SEQ ID NO: 33002 - protein, 93 aa, Homo sapiens
  ENSP00000362581
MDDQSRMLQTLAGVNLAGHSVQGGMALPPPPHGHEGADGDGRKQDIGDILHQIMTITDQSLDEAQAKKHALNCHRMKPALFSVLCEIKEKTGM

SEQ ID NO: 33003 - protein, 93 aa, Homo sapiens; identical to SEQ ID NO: 33002
  ENSP00000362591

SEQ ID NO: 33004 - protein, 434 aa, Homo sapiens
  ENSP00000362588
MDDQSRMLQTLAGVNLAGHSVQGGMALPPPPHGHEGADGDGRKQDIGDILHQIMTITDQSLDEAQAKKHALNCHRMKPALFSVLCEIKEKTGLSIRGAQEEDPPDPQLMRLDNMLLAEGVSGPEKGGGSAAAAAAAAASGGSSDNSIEHSDYRAKLTQIRQIYHTELEKYEQACNEFTTHVMNLLREQSRTRPISPKEIERMVGIIHRKFSSIQMQLKQSTCEAVMILRSRFLDARRKRRNFSKQATEILNEYFYSHLSNPYPSEEAKEELAKKCSITVSQVSNWFGNKRIRYKKNIGKFQEEANLYAAKTAVTAAHAVAAAVQNNQTNSPTTPNSGSSGSFNLPNSGDMFMNMQSLNGDSYQGSQVGANVQSQVDTLRHVINQTGGYSDGLGGNSLYSPHNLNANGGWQDATTPSSVTSPTEGPGSVHSDTSN

SEQ ID NO: 33005 - protein, 455 aa, Homo sapiens
  ENSP00000362586
MDDQSRMLQTLAGVNLAGHSVQGGMALPPPPHGHEGADGDGRKQDIGDILHQIMTITDQSLDEAQAKKHALNCHRMKPALFSVLCEIKEKTGLSIRGAQEEDPPDPQLMRLDNMLLAEGVSGPEKGGGSAAAAAAAAASGGSSDNSIEHSDYRAKLTQIRQIYHTELEKYEQACNEFTTHVMNLLREQSRTRPISPKEIERMVGIIHRKFSSIQMQLKQSTCEAVMILRSRFLDARRKRRNFSKQATEILNEYFYSHLSNPYPSEEAKEELAKKCSITVSQSLVKDPKERGSKGSDIQPTSVVSNWFGNKRIRYKKNIGKFQEEANLYAAKTAVTAAHAVAAAVQNNQTNSPTTPNSGSSGSFNLPNSGDMFMNMQSLNGDSYQGSQVGANVQSQVDTLRHVINQTGGYSDGLGGNSLYSPHNLNANGGWQDATTPSSVTSPTEGPGSVHSDTSN

SEQ ID NO: 33006 - protein, 351 aa, Homo sapiens
  ENSP00000341990
MDDQSRMLQTLAGVNLAGHSVQGGMALPPPPHGHEGADGDGRKQDIGDILHQIMTITDQSLDEAQAKKHALNCHRMKPALFSVLCEIKEKTGLSIRGAQEEDPPDPQLMRLDNMLLAEGVSGPEKGGGSAAAAAAAAASGGSSDNSIEHSDYRAKLTQIRQIYHTELEKYEQACNEFTTHVMNLLREQSRTRPISPKEIERMVGIIHRKFSSIQMQLKQSTCEAVMILRSRFLDARRKRRNFSKQATEILNEYFYSHLSNPYPSEEAKEELAKKCSITVSQVSNWFGNKRIRYKKNIGKFQEEANLYAAKTAVTAAHAVAAAVQNNQTNSPTTPNSGGYPPSCYQSDGRLQ

SEQ ID NO: 33007 - protein, 702 aa, Homo sapiens
  ENSP00000357450
MDPESERALQAPHSPSKTDGKELAGTMDGEGTLFQTESPQSGSILTEETEVKGTLEGDVCGVEPPGPGDTVVQGDLQETTVVTGLGPDTQDLEGQSPPQSLPSTPKAAWIREEGRCSSSDDDTDVDMEGLRRRRGREAGPPQPMVPLAVENQAGGEGAGGELGISLNMCLLGALVLLGLGVLLFSGGLSESETGPMEEVERQVLPDPEVLEAVGDRQDGLREQLQAPVPPDSVPSLQNMGLLLDKLAKENQDIRLLQAQLQAQKEELQSLMHQPKGLEEENAQLRGALQQGEAFQRALESELQQLRARLQGLEADCVRGPDGVCLSGGRGPQGDKAIREQGPREQEPELSFLKQKEQLEAEAQALRQELERQRRLLGSVQQDLERSLQDASRGDPAHAGLAELGHRLAQKLQGLENWGQDPGVSANASKAWHQKSHFQNSREWSGKEKWWDGQRDRKAEHWKHKKEESGRERKKNWGGQEDREPAGRWKEGRPRVEESGSKKEGKRQGPKEPPRKSGSFHSSGEKQKQPRWREGTKDSHDPLPSWAELLRPKYRAPQGCSGVDECARQEGLTFFGTELAPVRQQELASLLRTYLARLPWAGQLTKELPLSPAFFGEDGIFRHDRLRFRDFVDALEDSLEEVAVQQTGDDDEVDDFEDFIFSHFFGDKALKKRSGKKDKHSQSPRAAGPREGHSHSHHHHHRG

SEQ ID NO: 33008 - protein, 731 aa, Homo sapiens
  ENSP00000357448
MASCPDSDNSWVLAGSESLPVETLGPASRMDPESERALQAPHSPSKTDGKELAGTMDGEGTLFQTESPQSGSILTEETEVKGTLEGDVCGVEPPGPGDTVVQGDLQETTVVTGLGPDTQDLEGQSPPQSLPSTPKAAWIREEGRCSSSDDDTDVDMEGLRRRRGREAGPPQPMVPLAVENQAGGEGAGGELGISLNMCLLGALVLLGLGVLLFSGGLSESETGPMEEVERQVLPDPEVLEAVGDRQDGLREQLQAPVPPDSVPSLQNMGLLLDKLAKENQDIRLLQAQLQAQKEELQSLMHQPKGLEEENAQLRGALQQGEAFQRALESELQQLRARLQGLEADCVRGPDGVCLSGGRGPQGDKAIREQGPREQEPELSFLKQKEQLEAEAQALRQELERQRRLLGSVQQDLERSLQDASRGDPAHAGLAELGHRLAQKLQGLENWGQDPGVSANASKAWHQKSHFQNSREWSGKEKWWDGQRDRKAEHWKHKKEESGRERKKNWGGQEDREPAGRWKEGRPRVEESGSKKEGKRQGPKEPPRKSGSFHSSGEKQKQPRWREGTKDSHDPLPSWAELLRPKYRAPQGCSGVDECARQEGLTFFGTELAPVRQQELASLLRTYLARLPWAGQLTKELPLSPAFFGEDGIFRHDRLRFRDFVDALEDSLEEVAVQQTGDDDEVDDFEDFIFSHFFGDKALKKRSGKKDKHSQSPRAAGPREGHSHSHHHHHRG

SEQ ID NO: 33009 - protein, 315 aa, Homo sapiens
  ENSP00000357445
MASCPDSDNSWVLAGSESLPVETLGPASRMDPESERALQAPHSPSKTDGKELAGTMDGEGTLFQTESPQSGSILTEETEVKGTLEGDVCGVEPPGPGDTVVQGDLQETTVVTGLGPDTQDLEGQSPPQSLPSTPKAAWIREEGRCSSSDDDTDVDMEGLRRRRGREAGPPQPMVPLAVENQAGGGLSESETGPMEEVERQVLPDPEVLEAVGDRQDGLREQLQAPVPPDSVPSLQNMGLLLDKLAKENQDIRLLQAQLQVGTGRRGWARVTHLGQASVLASSPKRNVSYLPTHPDPPLSHYSQGVFPVLGSHPLC

SEQ ID NO: 33010 - protein, 147 aa, Homo sapiens
  ENSP00000432543
MASCPDSDNSWVLAGSESLPVETLGPASRMDPESERALQAPHSPSKTDGKELAGTMDGEGTLFQTESPQSGSILTEETEVKGTLEGDVCGVEPPGPGDTVVQGDLQETTVVTGLGPDTQDLEGQSPPQSLPSTPKAVTSLPCPCPFP

SEQ ID NO: 33011 - protein, 298 aa, Homo sapiens [sequence omitted]

SEQ ID NO: 33012 - protein, 1178 aa, Homo sapiens
  ENSP00000377527
MLKFRTVHGGLRLLGIRRTSTAPAASPNVRRLEYKPIKKVMVANRGEIAIRVFRACTELGIRTVAIYSEQDTGQMHRQKADEAYLIGRGLAPVQAYLHIPDIIKVAKENNVDAVHPGYGFLSERADFAQACQDAGVRFIGPSPEVVRKMGDKVEARAIAIAAGVPVVPGTDAPITSLHEAHEFSNTYGFPIIFKAAYGGGGRGMRVVHSYEELEENYTRAYSEALAAFGNGALFVEKFIEKPRHIEVQILGDQYGNILHLYERDCSIQRRHQKVVEIAPAAHLDPQLRTRLTSDSVKLAKQVGYENAGTVEFLVDRHGKHYFIEVNSRLQVEHTVTEEITDVDLVHAQIHVAEGRSLPDLGLRQENIRINGCAIQCRVTTEDPARSFQPDTGRIEVFRSGEGMGIRLDNASAFQGAVISPHYDSLLVKVIAHGKDHPTAATKMSRALAEFRVRGVKTNIAFLQNVLNNQQFLAGTVDTQFIDENPELFQLRPAQNRAQKLLHYLGHVMVNGPTTPIPVKASPSPTDPVVPAVPIGPPPAGFRDILLREGPEGFARAVRNHPGLLLMDTTFRDAHQSLLATRVRTHDLKKIAPYVAHNFSKLFSMENWGGATFDVAMRFLYECPWRRLQELRELIPNIPFQMLLRGANAVGYTNYPDNVVFKFCEVAKENGMDVFRVFDSLNYLPNMLLGMEAAGSAGGVVEAAISYTGDVADPSRTKYSLQYYMGLAEELVRAGTHILCIKDMAGLLKPTACTMLVSSLRDRFPDLPLHIHTHDTSGAGVAAMLACAQAGADVVDVAADSMSGMTSQPSMGALVACTRGTPLDTEVPMERVFDYSEYWEGARGLYAAFDCTATMKSGNSDVYENEIPGGQYTNLHFQAHSMGLGSKFKEVKKAYVEANQMLGDLIKVTPSSKIVGDLAQFMVQNGLSRAEAEAQAEELSFPRSVVEFLQGYIGVPHGGFPEPFRSKVLKDLPRVEGRPGASLPPLDLQALEKELVDRHGEEVTPEDVLSAAMYPDVFAHFKDFTATFGPLDSLNTRLFLQGPKIAEEFEVELERGKTLHIKALAVSDLNRAGQRQVFFELNGQLRSILVKDTQAMKEMHFHPKALKDVKGQIGAPMPGKVIDIKVVAGAKVAKGQPLCVLSAMKMETVVTSPMEGTVRKVHVTKDMTLEGDDLILEIE

SEQ ID NO: 33013 - protein, 1178 aa, Homo sapiens; identical to SEQ ID NO: 33012
  ENSP00000377530

SEQ ID NO: 33014 - protein, 489 aa, Homo sapiens
  ENSP00000434192
MVANRGEIAIRVFRACTELGIRTVAIYSEQDTGQMHRQKADEAYLIGRGLAPVQAYLHIPDIIKVAKENNVDAVHPGYGFLSERADFAQACQDAGVRFIGPSPEVVRKMGDKVEARAIAIAAGVPVVPGTDAPITSLHEAHEFSNTYGFPIIFKAAYGGGGRGMRVVHSYEELEENYTRAYSEALAAFGNGALFVEKFIEKPRHIEVQILGDQYGNILHLYERDCSIQRRHQKVVEIAPAAHLDPQLRTRLTSDSVKLAKQVGYENAGTVEFLVDRHGKHYFIEVNSRLQVEHTVTEEITDVDLVHAQIHVAEGRSLPDLGLRQENIRINGCAIQCRVTTEDPARSFQPDTGRIEVFRSGEGMGIRLDNASAFQGAVISPHYDSLLVKVIAHGKDHPTAATKMSRALAEFRVRGVKVRRHQAQPLAAALGRPCGQEARRPQAAVTAPTGPGSPTLVRVPPAARVLSSRLGGPSQTTPETSTEVSPTILL

SEQ ID NO: 33015 - protein, 1178 aa, Homo sapiens; identical to SEQ ID NO: 33012
  ENSP00000377532

SEQ ID NO: 33016 - protein, 489 aa, Homo sapiens; identical to SEQ ID NO: 33014
  ENSP00000486373

SEQ ID NO: 33017 - protein, 298 aa, Homo sapiens [sequence omitted]

SEQ ID NO: 33018 - protein, 1178 aa, Homo sapiens; identical to SEQ ID NO: 33012
  ENSP00000377527

SEQ ID NO: 33019 - protein, 1178 aa, Homo sapiens; identical to SEQ ID NO: 33012
  ENSP00000377530

SEQ ID NO: 33020 - protein, 489 aa, Homo sapiens; identical to SEQ ID NO: 33014
  ENSP00000434192

SEQ ID NO: 33021 - protein, 1178 aa, Homo sapiens; identical to SEQ ID NO: 33012
  ENSP00000377532

SEQ ID NO: 33022 - protein, 489 aa, Homo sapiens; identical to SEQ ID NO: 33014
  ENSP00000486373

SEQ ID NO: 33023 - protein, 4303 aa, Homo sapiens
  ENSP00000262304
MPPAAPARLALALGLGLWLGALAGGPGRGCGPCEPPCLCGPAPGAACRVNCSGRGLRTLGPALRIPADATALDVSHNLLRALDVGLLANLSALAELDISNNKISTLEEGIFANLFNLSEINLSGNPFECDCGLAWLPRWAEEQQVRVVQPEAATCAGPGSLAGQPLLGIPLLDSGCGEEYVACLPDNSSGTVAAVSFSAAHEGLLQPEACSAFCFSTGQGLAALSEQGWCLCGAAQPSSASFACLSLCSGPPPPPAPTCRGPTLLQHVFPASPGATLVGPHGPLASGQLAAFHIAAPLPVTATRWDFGDGSAEVDAAGPAASHRYVLPGRYHVTAVLALGAGSALLGTDVQVEAAPAALELVCPSSVQSDESLDLSIQNRGGSGLEAAYSIVALGEEPARAVHPLCPSDTEIFPGNGHCYRLVVEKAAWLQAQEQCQAWAGAALAMVDSPAVQRFLVSRVTRSLDVWIGFSTVQGVEVGPAPQGEAFSLESCQNWLPGEPHPATAEHCVRLGPTGWCNTDLCSAPHSYVCELQPGGPVQDAENLLVGAPSGDLQGPLTPLAQQDGLSAPHEPVEVMVFPGLRLSREAFLTTAEFGTQELRRPAQLRLQVYRLLSTAGTPENGSEPESRSPDNRTQLAPACMPGGRWCPGANICLPLDASCHPQACANGCTSGPGLPGAPYALWREFLFSVPAGPPAQYSVTLHGQDVLMLPGDLVGLQHDAGPGALLHCSPAPGHPGPRAPYLSANASSWLPHLPAQLEGTWACPACALRLLAATEQLTVLLGLRPNPGLRLPGRYEVRAEVGNGVSRHNLSCSFDVVSPVAGLRVIYPAPRDGRLYVPTNGSALVLQVDSGANATATARWPGGSVSARFENVCPALVATFVPGCPWETNDTLFSVVALPWLSEGEHVVDVVVENSASRANLSLRVTAEEPICGLRATPSPEARVLQGVLVRYSPVVEAGSDMVFRWTINDKQSLTFQNVVFNVIYQSAAVFKLSLTASNHVSNVTVNYNVTVERMNRMQGLQVSTVPAVLSPNATLALTAGVLVDSAVEVAFLWTFGDGEQALHQFQPPYNESFPVPDPSVAQVLVEHNVMHTYAAPGEYLLTVLASNAFENLTQQVPVSVRASLPSVAVGVSDGVLVAGRPVTFYPHPLPSPGGVLYTWDFGDGSPVLTQSQPAANHTYASRGTYHVRLEVNNTVSGAAAQADVRVFEELRGLSVDMSLAVEQGAPVVVSAAVQTGDNITWTFDMGDGTVLSGPEATVEHVYLRAQNCTVTVGAASPAGHLARSLHVLVFVLEVLRVEPAACIPTQPDARLTAYVTGNPAHYLFDWTFGDGSSNTTVRGCPTVTHNFTRSGTFPLALVLSSRVNRAHYFTSICVEPEVGNVTLQPERQFVQLGDEAWLVACAWPPFPYRYTWDFGTEEAAPTRARGPEVTFIYRDPGSYLVTVTASNNISAANDSALVEVQEPVLVTSIKVNGSLGLELQQPYLFSAVGRGRPASYLWDLGDGGWLEGPEVTHAYNSTGDFTVRVAGWNEVSRSEAWLNVTVKRRVRGLVVNASRTVVPLNGSVSFSTSLEAGSDVRYSWVLCDRCTPIPGGPTISYTFRSVGTFNIIVTAENEVGSAQDSIFVYVLQLIEGLQVVGGGRYFPTNHTVQLQAVVRDGTNVSYSWTAWRDRGPALAGSGKGFSLTVLEAGTYHVQLRATNMLGSAWADCTMDFVEPVGWLMVAASPNPAAVNTSVTLSAELAGGSGVVYTWSLEEGLSWETSEPFTTHSFPTPGLHLVTMTAGNPLGSANATVEVDVQVPVSGLSIRASEPGGSFVAAGSSVPFWGQLATGTNVSWCWAVPGGSSKRGPHVTMVFPDAGTFSIRLNASNAVSWVSATYNLTAEEPIVGLVLWASSKVVAPGQLVHFQILLAAGSAVTFRLQVGGANPEVLPGPRFSHSFPRVGDHVVSVRGKNHVSWAQAQVRIVVLEAVSGLQVPNCCEPGIATGTERNFTARVQRGSRVAYAWYFSLQKVQGDSLVILSGRDVTYTPVAAGLLEIQVRAFNALGSENRTLVLEVQDAVQYVALQSGPCFTNRSAQFEAATSPSPRRVAYHWDFGDGSPGQDTDEPRAEHSYLRPGDYRVQVNASNLVSFFVAQATVTVQVLACREPEVDVVLPLQVLMRRSQRNYLEAHVDLRDCVTYQTEYRWEVYRTASCQRPGRPARVALPGVDVSRPRLVLPRLALPVGHYCFVFVVSFGDTPLTQSIQANVTVAPERLVPIIEGGSYRVWSDTRDLVLDGSESYDPNLEDGDQTPLSFHWACVASTQREAGGCALNFGPRGSSTVTIPRERLAAGVEYTFSLTVWKAGRKEEATNQTVLIRSGRVPIVSLECVSCKAQAVYEVSRSSYVYLEGRCLNCSSGSKRGRWAARTFSNKTLVLDETTTSTGSAGMRLVLRRGVLRDGEGYTFTLTVLGRSGEEEGCASIRLSPNRPPLGGSCRLFPLGAVHALTTKVHFECTGWHDAEDAGAPLVYALLLRRCRQGHCEEFCVYKGSLSSYGAVLPPGFRPHFEVGLAVVVQDQLGAAVVALNRSLAITLPEPNGSATGLTVWLHGLTASVLPGLLRQADPQHVIEYSLALVTVLNEYERALDVAAEPKHERQHRAQIRKNITETLVSLRVHTVDDIQQIAAALAQCMGPSRELVCRSCLKQTLHKLEAMMLILQAETTAGTVTPTAIGDSILNITGDLIHLASSDVRAPQPSELGAESPSRMVASQAYNLTSALMRILMRSRVLNEEPLTLAGEEIVAQGKRSDPRSLLCYGGAPGPGCHFSIPEAFSGALANLSDVVQLIFLVDSNPFPFGYISNYTVSTKVASMAFQTQAGAQIPIERLASERAITVKVPNNSDWAARGHRSSANSANSVVVQPQASVGAVVTLDSSNPAAGLHLQLNYTLLDGHYLSEEPEPYLAVYLHSEPRPNEHNCSASRRIRPESLQGADHRPYTFFISPGSRDPAGSYHLNLSSHFRWSALQVSVGLYTSLCQYFSEEDMVWRTEGLLPLEETSPRQAVCLTRHLTAFGASLFVPPSHVRFVFPEPTADVNYIVMLTCAVCLVTYMVMAAILHKLDQLDASRGRAIPFCGQRGRFKYEILVKTGWGRGSGTTAHVGIMLYGVDSRSGHRHLDGDRAFHRNSLDIFRIATPHSLGSVWKIRVWHDNKGLSPAWFLQHVIVRDLQTARSAFFLVNDWLSVETEANGGLVEKEVLAASDAALLRFRRLLVAELQRGFFDKHIWLSIWDRPPRSRFTRIQRATCCVLLICLFLGANAVWYGAVGDSAYSTGHVSRLSPLSVDTVAVGLVSSVVVYPVYLAILFLFRMSRSKVAGSPSPTPAGQQVLDIDSCLDSSVLDSSFLTFSGLHAEQAFVGQMKSDLFLDDSKSLVCWPSGEGTLSWPDLLSDPSIVGSNLRQLARGQAGHGLGPEEDGFSLASPYSPAKSFSASDEDLIQQVLAEGVSSPAPTQDTHMETDLLSSLSSTPGEKTETLALQRLGELGPPSPGLNWEQPQAARLSRTGLVEGLRKRLLPAWCASLAHGLSLLLVAVAVAVSGWVGASFPPGVSVAWLLSSSASFLASFLGWEPLKVLLEALYFSLVAKRLHPDEDDTLVESPAVTPVSARVPRVRPPHGFALFLAKEEARKVKRLHGMLRSLLVYMLFLLVTLLASYGDASCHGHAYRLQSAIKQELHSRAFLAITRSEELWPWMAHVLLPYVHGNQSSPELGPPRLRQVRLQEALYPDPPGPRVHTCSAAGGFSTSDYDVGWESPHNGSGTWAYSAPDLLGAWSWGSCAVYDSGGYVQELGLSLEESRDRLRFLQLHNWLDNRSRAVFLELTRYSPAVGLHAAVTLRLEFPAAGRALAALSVRPFALRRLSAGLSLPLLTSVCLLLFAVHFAVAEARTWHREGRWRVLRLGAWARWLLVALTAATALVRLAQLGAADRQWTRFVRGRPRRFTSFDQVAQLSSAARGLAASLLFLLLVKAAQQLRFVRQWSVFGKTLCRALPELLGVTLGLVVLGVAYAQLAILLVSSCVDSLWSVAQALLVLCPGTGLSTLCPAESWHLSPLLCVGLWALRLWGALRLGAVILRWRYHALRGELYRPAWEPQDYEMVELFLRRLRLWMGLSKVKEFRHKVRFEGMEPLPSRSSRGSKVSPDVPPPSAGSDASHPSTSSSQLDGLSVSLGRLGTRCEPEPSRLQAVFEALLTQFDRLNQATEDVYQLEQQLHSLQGRRSSRAPAGSSRGPSPGLRPALPSRLARASRGVDLATGPSRTPLRAKNKVHPSST

SEQ ID NO: 33024 - protein, 4302 aa, Homo sapiens
  ENSP00000399501
MPPAAPARLALALGLGLWLGALAGGPGRGCGPCEPPCLCGPAPGAACRVNCSGRGLRTLGPALRIPADATALDVSHNLLRALDVGLLANLSALAELDISNNKISTLEEGIFANLFNLSEINLSGNPFECDCGLAWLPRWAEEQQVRVVQPEAATCAGPGSLAGQPLLGIPLLDSGCGEEYVACLPDNSSGTVAAVSFSAAHEGLLQPEACSAFCFSTGQGLAALSEQGWCLCGAAQPSSASFACLSLCSGPPPPPAPTCRGPTLLQHVFPASPGATLVGPHGPLASGQLAAFHIAAPLPVTATRWDFGDGSAEVDAAGPAASHRYVLPGRYHVTAVLALGAGSALLGTDVQVEAAPAALELVCPSSVQSDESLDLSIQNRGGSGLEAAYSIVALGEEPARAVHPLCPSDTEIFPGNGHCYRLVVEKAAWLQAQEQCQAWAGAALAMVDSPAVQRFLVSRVTRSLDVWIGFSTVQGVEVGPAPQGEAFSLESCQNWLPGEPHPATAEHCVRLGPTGWCNTDLCSAPHSYVCELQPGGPVQDAENLLVGAPSGDLQGPLTPLAQQDGLSAPHEPVEVMVFPGLRLSREAFLTTAEFGTQELRRPAQLRLQVYRLLSTAGTPENGSEPESRSPDNRTQLAPACMPGGRWCPGANICLPLDASCHPQACANGCTSGPGLPGAPYALWREFLFSVPAGPPAQYSVTLHGQDVLMLPGDLVGLQHDAGPGALLHCSPAPGHPGPRAPYLSANASSWLPHLPAQLEGTWACPACALRLLAATEQLTVLLGLRPNPGLRLPGRYEVRAEVGNGVSRHNLSCSFDVVSPVAGLRVIYPAPRDGRLYVPTNGSALVLQVDSGANATATARWPGGSVSARFENVCPALVATFVPGCPWETNDTLFSVVALPWLSEGEHVVDVVVENSASRANLSLRVTAEEPICGLRATPSPEARVLQGVLVRYSPVVEAGSDMVFRWTINDKQSLTFQNVVFNVIYQSAAVFKLSLTASNHVSNVTVNYNVTVERMNRMQGLQVSTVPAVLSPNATLALTAGVLVDSAVEVAFLWTFGDGEQALHQFQPPYNESFPVPDPSVAQVLVEHNVMHTYAAPGEYLLTVLASNAFENLTQQVPVSVRASLPSVAVGVSDGVLVAGRPVTFYPHPLPSPGGVLYTWDFGDGSPVLTQSQPAANHTYASRGTYHVRLEVNNTVSGAAAQADVRVFEELRGLSVDMSLAVEQGAPVVVSAAVQTGDNITWTFDMGDGTVLSGPEATVEHVYLRAQNCTVTVGAASPAGHLARSLHVLVFVLEVLRVEPAACIPTQPDARLTAYVTGNPAHYLFDWTFGDGSSNTTVRGCPTVTHNFTRSGTFPLALVLSSRVNRAHYFTSICVEPEVGNVTLQPERQFVQLGDEAWLVACAWPPFPYRYTWDFGTEEAAPTRARGPEVTFIYRDPGSYLVTVTASNNISAANDSALVEVQEPVLVTSIKVNGSLGLELQQPYLFSAVGRGRPASYLWDLGDGGWLEGPEVTHAYNSTGDFTVRVAGWNEVSRSEAWLNVTVKRRVRGLVVNASRTVVPLNGSVSFSTSLEAGSDVRYSWVLCDRCTPIPGGPTISYTFRSVGTFNIIVTAENEVGSAQDSIFVYVLQLIEGLQVVGGGRYFPTNHTVQLQAVVRDGTNVSYSWTAWRDRGPALAGSGKGFSLTVLEAGTYHVQLRATNMLGSAWADCTMDFVEPVGWLMVAASPNPAAVNTSVTLSAELAGGSGVVYTWSLEEGLSWETSEPFTTHSFPTPGLHLVTMTAGNPLGSANATVEVDVQVPVSGLSIRASEPGGSFVAAGSSVPFWGQLATGTNVSWCWAVPGGSSKRGPHVTMVFPDAGTFSIRLNASNAVSWVSATYNLTAEEPIVGLVLWASSKVVAPGQLVHFQILLAAGSAVTFRLQVGGANPEVLPGPRFSHSFPRVGDHVVSVRGKNHVSWAQAQVRIVVLEAVSGLQVPNCCEPGIATGTERNFTARVQRGSRVAYAWYFSLQKVQGDSLVILSGRDVTYTPVAAGLLEIQVRAFNALGSENRTLVLEVQDAVQYVALQSGPCFTNRSAQFEAATSPSPRRVAYHWDFGDGSPGQDTDEPRAEHSYLRPGDYRVQVNASNLVSFFVAQATVTVQVLACREPEVDVVLPLQVLMRRSQRNYLEAHVDLRDCVTYQTEYRWEVYRTASCQRPGRPARVALPGVDVSRPRLVLPRLALPVGHYCFVFVVSFGDTPLTQSIQANVTVAPERLVPIIEGGSYRVWSDTRDLVLDGSESYDPNLEDGDQTPLSFHWACVASTQREAGGCALNFGPRGSSTVTIPRERLAAGVEYTFSLTVWKAGRKEEATNQTVLIRSGRVPIVSLECVSCKAQAVYEVSRSSYVYLEGRCLNCSSGSKRGRWAARTFSNKTLVLDETTTSTGSAGMRLVLRRGVLRDGEGYTFTLTVLGRSGEEEGCASIRLSPNRPPLGGSCRLFPLGAVHALTTKVHFECTGWHDAEDAGAPLVYALLLRRCRQGHCEEFCVYKGSLSSYGAVLPPGFRPHFEVGLAVVVQDQLGAAVVALNRSLAITLPEPNGSATGLTVWLHGLTASVLPGLLRQADPQHVIEYSLALVTVLNEYERALDVAAEPKHERQHRAQIRKNITETLVSLRVHTVDDIQQIAAALAQCMGPSRELVCRSCLKQTLHKLEAMMLILQAETTAGTVTPTAIGDSILNITGDLIHLASSDVRAPQPSELGAESPSRMVASQAYNLTSALMRILMRSRVLNEEPLTLAGEEIVAQGKRSDPRSLLCYGGAPGPGCHFSIPEAFSGALANLSDVVQLIFLVDSNPFPFGYISNYTVSTKVASMAFQTQAGAQIPIERLASERAITVKVPNNSDWAARGHRSSANSANSVVVQPQASVGAVVTLDSSNPAAGLHLQLNYTLLDGHYLSEEPEPYLAVYLHSEPRPNEHNCSASRRIRPESLQGADHRPYTFFISPGSRDPAGSYHLNLSSHFRWSALQVSVGLYTSLCQYFSEEDMVWRTEGLLPLEETSPRQAVCLTRHLTAFGASLFVPPSHVRFVFPEPTADVNYIVMLTCAVCLVTYMVMAAILHKLDQLDASRGRAIPFCGQRGRFKYEILVKTGWGRGSGTTAHVGIMLYGVDSRSGHRHLDGDRAFHRNSLDIFRIATPHSLGSVWKIRVWHDNKGLSPAWFLQHVIVRDLQTARSAFFLVNDWLSVETEANGGLVEKEVLAASDAALLRFRRLLVAELQRGFFDKHIWLSIWDRPPRSRFTRIQRATCCVLLICLFLGANAVWYGAVGDSAYSTGHVSRLSPLSVDTVAVGLVSSVVVYPVYLAILFLFRMSRSKVAGSPSPTPAGQQVLDIDSCLDSSVLDSSFLTFSGLHAEAFVGQMKSDLFLDDSKSLVCWPSGEGTLSWPDLLSDPSIVGSNLRQLARGQAGHGLGPEEDGFSLASPYSPAKSFSASDEDLIQQVLAEGVSSPAPTQDTHMETDLLSSLSSTPGEKTETLALQRLGELGPPSPGLNWEQPQAARLSRTGLVEGLRKRLLPAWCASLAHGLSLLLVAVAVAVSGWVGASFPPGVSVAWLLSSSASFLASFLGWEPLKVLLEALYFSLVAKRLHPDEDDTLVESPAVTPVSARVPRVRPPHGFALFLAKEEARKVKRLHGMLRSLLVYMLFLLVTLLASYGDASCHGHAYRLQSAIKQELHSRAFLAITRSEELWPWMAHVLLPYVHGNQSSPELGPPRLRQVRLQEALYPDPPGPRVHTCSAAGGFSTSDYDVGWESPHNGSGTWAYSAPDLLGAWSWGSCAVYDSGGYVQELGLSLEESRDRLRFLQLHNWLDNRSRAVFLELTRYSPAVGLHAAVTLRLEFPAAGRALAALSVRPFALRRLSAGLSLPLLTSVCLLLFAVHFAVAEARTWHREGRWRVLRLGAWARWLLVALTAATALVRLAQLGAADRQWTRFVRGRPRRFTSFDQVAQLSSAARGLAASLLFLLLVKAAQQLRFVRQWSVFGKTLCRALPELLGVTLGLVVLGVAYAQLAILLVSSCVDSLWSVAQALLVLCPGTGLSTLCPAESWHLSPLLCVGLWALRLWGALRLGAVILRWRYHALRGELYRPAWEPQDYEMVELFLRRLRLWMGLSKVKEFRHKVRFEGMEPLPSRSSRGSKVSPDVPPPSAGSDASHPSTSSSQLDGLSVSLGRLGTRCEPEPSRLQAVFEALLTQFDRLNQATEDVYQLEQQLHSLQGRRSSRAPAGSSRGPSPGLRPALPSRLARASRGVDLATGPSRTPLRAKNKVHPSST

SEQ ID NO: 33025 - protein, 45 aa, Homo sapiens
  ENSP00000461391
  MOD_RES (1)..(1): Any amino acid
XGPRVHTCSAAGGFSTSDYDVGWESPHNGSGTWAYSAPDLLGSWA

SEQ ID NO: 33026 - protein, 1122 aa, Homo sapiens
  ENSP00000457132
PTPGLHLVTMTAGNPLGSANATVEVDVQVPVSGLSIRASEPGGSFVAAGSSVPFWGQLATGTNVSWCWAVPGGSSKRGPHVTMVFPDAGTFSIRLNASNAVSWVSATYNLTAEEPIVGLVLWASSKVVAPGQLVHFQILLAAGSAVTFRLQVGGANPEVLPGPRFSHSFPRVGDHVVSVRGKNHVSWAQAQVRIVVLEAVSGLQVPNCCEPGIATGTERNFTARVQRGSRVAYAWYFSLQKVQGDSLVILSGRDVTYTPVAAGLLEIQVRAFNALGSENRTLVLEVQDAVQYVALQSGPCFTNRSAQFEAATSPSPRRVAYHWDFGDGSPGQDTDEPRAEHSYLRPGDYRVQVNASNLVSFFVAQATVTVQVLACREPEVDVVLPLQVLMRRSQRNYLEAHVDLRDCVTYQTEYRWEVYRTASCQRPGRPARVALPGVDVSRPRLVLPRLALPVGHYCFVFVVSFGDTPLTQSIQANVTVAPERLVPIIEGGSYRVWSDTRDLVLDGSESYDPNLEDGDQTPLSFHWACVASTQREAGGCALNFGPRGSSTVTIPRERLAAGVEYTFSLTVWKAGRKEEATNQTVLIRSGRVPIVSLECVSCKAQAVYEVSRSSYVYLEGRCLNCSSGSKRGRWAARTFSNKTLVLDETTTSTGSAGMRLVLRRGVLRDGEGYTFTLTVLGRSGEEEGCASIRLSPNRPPLGGSCRLFPLGAVHALTTKVHFECTGWHDAEDAGAPLVYALLLRRCRQGHCEEFCVYKGSLSSYGAVLPPGFRPHFEVGLAVVVQDQLGAAVVALNRSLAITLPEPNGSATGLTVWLHGLTASVLPGLLRQADPQHVIEYSLALVTVLNEYERALDVAAEPKHERQHRAQIRKNITETLVSLRVHTVDDIQQIAAALAQCMGPSRELVCRSCLKQTLHKLEAMMLILQAETTAGTVTPTAIGDSILNITGDLIHLASSDVRAPQPSELGAESPSRMVASQAYNLTSALMRILMRSRVLNEEPLTLAGEEIVAQGKRSDPRSLLCYGGAPGPGCHFSIPEAFSGALANLSDVVQLIFLVDSNPFPFGYISNYTVSTKLRQLRQLRCGPAPGLRRCCGHPGQQQPCGRAASAAQLYAAGRPLPV

SEQ ID NO: 33027 - protein, 91 aa, Homo sapiens
  ENSP00000455753
  MOD_RES (1)..(1): Any amino acid
XVSVAWLLSSSASFLASFLGWEPLKVLLEALYFSLVAKRLHPDEDDTLVESPAVTPVSARVPRVRPPHGFALFLAKEEARKVKRLHGMLRV

SEQ ID NO: 33028 - protein, 607 aa, Homo sapiens
  ENSP00000457984
  MOD_RES (1)..(1): Any amino acid
XETLVSLRVHTVDDIQQIAAALAQCMGPSRELVCRSCLKQTLHKLEAMMLILQAETTAGTVTPTAIGDSILNITGDLIHLASSDVRAPQPSELGAESPSRMVASQAYNLTSALMRILMRSRVLNEEPLTLAGHYLSEEPEPYLAVYLHSEPRPNEHNCSASRRIRPESLQGADHRPYTFFISPGSRDPAGSYHLNLSSHFRWSALQVSVGLYTSLCQYFSEEDMVWRTEGLLPLEETSPRQAVCLTRHLTAFGASLFVPPSHVRFVFPEPTADVNYIVMLTCAVCLVTYMVMAAILHKLDQLDASRGRAIPFCGQRGRFKYEILVKTGWGRGSGTTAHVGIMLYGVDSRSGHRHLDGDRAFHRNSLDIFRIATPHSLGSVWKIRVWHDNKGLSPAWFLQHVIVRDLQTARSAFFLVNDWLSVETEANGGLVEKEVLAASDAALLRFRRLLVAELQRGFFDKHIWLSIWDRPPRSRFTRIQRATCCVLLICLFLGANAVWYGAVGDSAYSTGHVSRLSPLSVDTVAVGLVSSVVVYPVYLAILFLFRMSRSKVAGSPSPTPAGQQVLDIDSCLDSSVLDSSFLTFSGLHAEQAFVGQMKSDLFLDDSK

SEQ ID NO: 33029 - protein, 200 aa, Homo sapiens
  ENSP00000457162
LLGTDVQVEAAPAALELVCPSSVQSDESLDLSIQNRGGSGLEAAYSIVALGEEPARAVHPLCPSDTEIFPGNGHCYRLVVEKAAWLQAQEQCQAWAGAALAMVDSPAVQRFLVSRVTRGWRWAQRRRARPSAWRAARTGCPGSHTQPQPSTASGSGPPGGVTPTCAQRRTATSASCSPEAQCRMPRTSSWERPVGTCRDP

SEQ ID NO: 33030 - protein, 155 aa, Homo sapiens
  ENSP00000456670
  MOD_RES (1)..(1): Any amino acid
XAGVLVDSAVEVAFLWTFGDGEQALHQFQPPYNESFPVPDPSVAQVLVEHNVMHTYAAPGEYLLTVLASNAFENLTQQVLIRSGRVPIVSLECVSCKAQAVYEVSRSSYVYLEGRCLNCSSGSKRGRWAARTFSNKTLVLDETTTSTGSAGMRLV

SEQ ID NO: 33031 - protein, 246 aa, Homo sapiens
  ENSP00000456672
  MOD_RES (1)..(1): Any amino acid
XDFGDGSAEVDAAGPAASHRYVLPGRYHVTAVLALGAGSALLGTDVQVEAAPAALELVCPSSVQSDESLDLSIQNRGGSGLEAAYSIVALGEEPARAVHPLCPSDTEIFPGNGHCYRLVVEKAAWLQAQEQCQAWAGAALAMVDSPAVQRFLVSRVTRHTGPGAGWERVLRPQPGGRRPDAAQFPLGLCGFDTEGGWRVCAELWAPREQHGHHSTGAAGGWRGVHLQPDRVEGRPQGGGHQPDGAD

SEQ ID NO: 33032 - protein, 968 aa, Homo sapiens
  ENSP00000237596
MVNSSRVQPQQPGDAKRPPAPRAPDPGRLMAGCAAVGASLAAPGGLCEQRGLEIEMQRIRQAAARDPPAGAAASPSPPLSSCSRQAWSRDNPGFEAEEEEEEVEGEEGGMVVEMDVEWRPGSRRSAASSAVSSVGARSRGLGGYHGAGHPSGRRRRREDQGPPCPSPVGGGDPLHRHLPLEGQPPRVAWAERLVRGLRGLWGTRLMEESSTNREKYLKSVLRELVTYLLFLIVLCILTYGMMSSNVYYYTRMMSQLFLDTPVSKTEKTNFKTLSSMEDFWKFTEGSLLDGLYWKMQPSNQTEADNRSFIFYENLLLGVPRIRQLRVRNGSCSIPQDLRDEIKECYDVYSVSSEDRAPFGPRNGTAWIYTSEKDLNGSSHWGIIATYSGAGYYLDLSRTREETAAQVASLKKNVWLDRGTRATFIDFSVYNANINLFCVVRLLVEFPATGGVIPSWQFQPLKLIRYVTTFDFFLAACEIIFCFFIFYYVVEEILEIRIHKLHYFRSFWNCLDVVIVVLSVVAIGINIYRTSNVEVLLQFLEDQNTFPNFEHLAYWQIQFNNIAAVTVFFVWIKLFKFINFNRTMSQLSTTMSRCAKDLFGFAIMFFIIFLAYAQLAYLVFGTQVDDFSTFQECIFTQFRIILGDINFAEIEEANRVLGPIYFTTFVFFMFFILLNMFLAIINDTYSEVKSDLAQQKAEMELSDLIRKGYHKALVKLKLKKNTVDDISESLRQGGGKLNFDELRQDLKGKGHTDAEIEAIFTKYDQDGDQELTEHEHQQMRDDLEKEREDLDLDHSSLPRPMSSRSFPRSLDDSEEDDDEDSGHSSRRRGSISSGVSYEEFQVLVRRVDRMEHSIGSIVSKIDAVIVKLEIMERAKLKRREVLGRLLDGVAEDERLGRDSEIHREQMERLVREELERWESDDAASQISHGLGTPVGLNGQPRPRSSRPSSSQSTEGMEGAGGNGSSNVHV

SEQ ID NO: 33033 - protein, 386 aa, Homo sapiens
  ENSP00000427131
MSQLSTTMSRCAKDLFGFAIMFFIIFLAYAQLAYLVFGTQVDDFSTFQECIFTQFRIILGDINFAEIEEANRVLGPIYFTTFVFFMFFILLNMFLAIINDTYSEVKSDLAQQKAEMELSDLIRKGYHKALVKLKLKKNTVDDISESLRQGGGKLNFDELRQDLKGKGHTDAEIEAIFTKYDQDGDQELTEHEHQQMRDDLEKEREDLDLDHSSLPRPMSSRSFPRSLDDSEEDDDEDSGHSSRRRGSISSGVSYEEFQVLVRRVDRMEHSIGSIVSKIDAVIVKLEIMERAKLKRREVLGRLLDGVAEDERLGRDSEIHREQMERLVREELERWESDDAASQISHGLGTPVGLNGQPRPRSSRPSSSQSTEGMEGAGGNGSSNVHV

SEQ ID NO: 33034 - protein, 386 aa, Homo sapiens; identical to SEQ ID NO: 33033
  ENSP00000425289

SEQ ID NO: 33035 - protein, 690 aa, Homo sapiens
  ENSP00000365958
MGWGSRCCCPGRLDLLCVLALLGGCLLPVCRTRVYTNHWAVKIAGGFPEANRIASKYGFINIGQIGALKDYYHFYHSRTIKRSVISSRGTHSFISMEPKVEWIQQQVVKKRTKRDYDFSRAQSTYFNDPKWPSMWYMHCSDNTHPCQSDMNIEGAWKRGYTGKNIVVTILDDGIERTHPDLMQNYDALASCDVNGNDLDPMPRYDASNENKHGTRCAGEVAAAANNSHCTVGIAFNAKIGGVRMLDGDVTDMVEAKSVSFNPQHVHIYSASWGPDDDGKTVDGPAPLTRQAFENGVRMGRRGLGSVFVWASGNGGRSKDHCSCDGYTNSIYTISISSTAESGKKPWYLEECSSTLATTYSSGESYDKKIITTDLRQRCTDNHTGTSASAPMAAGIIALALEANPFLTWRDVQHVIVRTSRAGHLNANDWKTNAAGFKVSHLYGFGLMDAEAMVMEAEKWTTVPRQHVCVESTDRQIKTIRPNSAVRSIYKASGCSDNPNRHVNYLEHVVVRITITHPRRGDLAIYLTSPSGTRSQLLANRLFDHSMEGFKNWEFMTIHCWGERAAGDWVLEVYDTPSQLRNFKTPGKLKEWSLVLYGTSVQPYSPTNEFPKVERFRYSRVEDPTDDYGTEDYAGELASSGTQAKKRQLMHHPTTWENRMEWNGMKWNGMKWNGMEWNGMEWNRIESNRIE

SEQ ID NO: 33036 - protein, 913 aa, Homo sapiens
  ENSP00000365943
MGWGSRCCCPGRLDLLCVLALLGGCLLPVCRTRVYTNHWAVKIAGGFPEANRIASKYGFINIGQIGALKDYYHFYHSRTIKRSVISSRGTHSFISMEPKVEWIQQQVVKKRTKRDYDFSRAQSTYFNDPKWPSMWYMHCSDNTHPCQSDMNIEGAWKRGYTGKNIVVTILDDGIERTHPDLMQNYDALASCDVNGNDLDPMPRYDASNENKHGTRCAGEVAAAANNSHCTVGIAFNAKIGGVRMLDGDVTDMVEAKSVSFNPQHVHIYSASWGPDDDGKTVDGPAPLTRQAFENGVRMGRRGLGSVFVWASGNGGRSKDHCSCDGYTNSIYTISISSTAESGKKPWYLEECSSTLATTYSSGESYDKKIITTDLRQRCTDNHTGTSASAPMAAGIIALALEANPFLTWRDVQHVIVRTSRAGHLNANDWKTNAAGFKVSHLYGFGLMDAEAMVMEAEKWTTVPRQHVCVESTDRQIKTIRPNSAVRSIYKASGCSDNPNRHVNYLEHVVVRITITHPRRGDLAIYLTSPSGTRSQLLANRLFDHSMEGFKNWEFMTIHCWGERAAGDWVLEVYDTPSQLRNFKTPGKLKEWSLVLYGTSVQPYSPTNEFPKVERFRYSRVEDPTDDYGTEDYAGPCDPECSEVGCDGPGPDHCNDCLHYYYKLKNNTRICVSSCPPGHYHADKKRCRKCAPNCESCFGSHGDQCMSCKYGYFLNEETNSCVTHCPDGSYQDTKKNLCRKCSENCKTCTEFHNCTECRDGLSLQGSRCSVSCEDGRYFNGQDCQPCHRFCATCAGAGADGCINCTEGYFMEDGRCVQSCSISYYFDHSSENGYKSCKKCDISCLTCNGPGFKNCTSCPSGYLLDLGMCQMGAICKDATEESWAEGGFCMLVKKNNLCQRKVLQQLCCKTCTFQG

SEQ ID NO: 33037 - protein, 1560 aa, Homo sapiens
  ENSP00000411654
NSIYTISISSTAESGKKPWYLEECSSTLATTYSSGESYDKKIITTDLRQRCTDNHTGTSASAPMAAGIIALALEANPFLTWRDVQHVIVRTSRAGHLNANDWKTNAAGFKVSHLYGFGLMDAEAMVMEAEKWTTVPRQHVCVESTDRQIKTIRPNSAVRSIYKASGCSDNPNRHVNYLEHVVVRITITHPRRGDLAIYLTSPSGTRSQLLANRLFDHSMEGFKNWEFMTIHCWGERAAGDWVLEVYDTPSQLRNFKTPGKLKEWSLVLYGTSVQPYSPTNEFPKVERFRYSRVEDPTDDYGTEDYAGPCDPECSEVGCDGPGPDHCNDCLHYYYKLKNNTRICVSSCPPGHYHADKKRCRKCAPNCESCFGSHGDQCMSCKYGYFLNEETNSCVTHCPDGSYQDTKKNLCRKCSENCKTCTEFHNCTECRDGLSLQGSRCSVSCEDGRYFNGQDCQPCHRFCATCAGAGADGCINCTEGYFMEDGRCVQSCSISYYFDHSSENGYKSCKKCDISCLTCNGPGFKNCTSCPSGYLLDLGMCQMGAICKDGEYVDEHGHCQTCEASCAKCQGPTQEDCTTCPMTRIFDDGRCVSNCPSWKFEFENQCHPCHHTCQRCQGSGPTHCTSCGADNYGREHFLYQGECGDSCPEGHYATEGNTCLPCPDNCELCHSVHVCTRCMKGYFIAPTNHTCQKLECGQGEVQDPDYEECVPCEEGCLGCSLDDPGTCTSCAMGYYRFDHHCYKTCPEKTYSEEVECKACDSNCGSCDQNGCYWCEEGFFLLGGSCVRKCGPGFYGDQEMGECESCHRACETCTGPGHDECSSCQEGLQLLRGMCVHATKTQEEGKFWNEAVSTANLSVVKSLLQERRRWKVQIKRDILRKLQPCHSSCKTCNGSATLCTSCPKGAYLLAQACVSSCPQGTWPSVRSGSCENCTEACAICSGADLCKKCQMQPGHPLFLHEGRCYSKCPEGSYAEDGICERCSSPCRTCEGNATNCHSCEGGHVLHHGVCQENCPERHVAVKGVCKHCPEMCQDCIHEKTCKECTPEFFLHDDMCHQSCPRGFYADSRHCVPCHKDCLECSGPKADDCELCLESSWVLYDGLCLEECPAGTYYEKETKECRDCHKSCLTCSSSGTCTTCQKGLIMNPRGSCMANEKCSPSEYWDEDAPGCKPCHVKCFHCMGPAEDQCQTCPMNSLLLNTTCVKDCPEGYYADEDSNRCAHCHSSCRTCEGRHSRQCHSCRPGWFQLGKECLLQCREGYYADNSTGRCERCNRSCKGCQGPRPTDCLSCDRFFFLLRSKGECHRSCPDHYYVEQSTQTCERCHPTCDQCKGKGALNCLSCVWSYHLMGGICTSDCLVGEYRVGEGEKFNCEKCHESCMECKGPGAKNCTLCPANLVLHMDDSHCLHCCNTSDPPSAQECCDCQDTTDECILRTSKVRPATEHFKTALFITSSMMLVLLLGAAVVVWKKSRGRVQPAAKAGYEKLADPNKSYSSYKSSYRESTSFEEDQVIEYRDRDYDEDDDDDIVYMGQDGTVYRKFKYGLLDDDDIDELEYDDESYSYYQ

SEQ ID NO: 33038 - protein, 101 aa, Homo sapiens
  ENSP00000407239
CQPCHRFCATCAGAGADGCINCTEGYFMEDGRCVQSCSISYYFDHSSENGYKSCKKCDISCLTCNGPGFKNCTSCPSGYLLDLGMCQMGAICKDVSLFRGA

SEQ ID NO: 33039 - protein, 1860 aa, Homo sapiens
  ENSP00000446280
MGWGSRCCCPGRLDLLCVLALLGGCLLPVCRTRVYTNHWAVKIAGGFPEANRIASKYGFINIGQIGALKDYYHFYHSRTIKRSVISSRGTHSFISMEPKVEWIQQQVVKKRTKRDYDFSRAQSTYFNDPKWPSMWYMHCSDNTHPCQSDMNIEGAWKRGYTGKNIVVTILDDGIERTHPDLMQNYDALASCDVNGNDLDPMPRYDASNENKHGTRCAGEVAAAANNSHCTVGIAFNAKIGGVRMLDGDVTDMVEAKSVSFNPQHVHIYSASWGPDDDGKTVDGPAPLTRQAFENGVRMGRRGLGSVFVWASGNGGRSKDHCSCDGYTNSIYTISISSTAESGKKPWYLEECSSTLATTYSSGESYDKKIITTDLRQRCTDNHTGTSASAPMAAGIIALALEANPFLTWRDVQHVIVRTSRAGHLNANDWKTNAAGFKVSHLYGFGLMDAEAMVMEAEKWTTVPRQHVCVESTDRQIKTIRPNSAVRSIYKASGCSDNPNRHVNYLEHVVVRITITHPRRGDLAIYLTSPSGTRSQLLANRLFDHSMEGFKNWEFMTIHCWGERAAGDWVLEVYDTPSQLRNFKTPGKLKEWSLVLYGTSVQPYSPTNEFPKVERFRYSRVEDPTDDYGTEDYAGPCDPECSEVGCDGPGPDHCNDCLHYYYKLKNNTRICVSSCPPGHYHADKKRCRKCAPNCESCFGSHGDQCMSCKYGYFLNEETNSCVTHCPDGSYQDTKKNLCRKCSENCKTCTEFHNCTECRDGLSLQGSRCSVSCEDGRYFNGQDCQPCHRFCATCAGAGADGCINCTEGYFMEDGRCVQSCSISYYFDHSSENGYKSCKKCDISCLTCNGPGFKNCTSCPSGYLLDLGMCQMGAICKDGEYVDEHGHCQTCEASCAKCQGPTQEDCTTCPMTRIFDDGRCVSNCPSWKFEFENQCHPCHHTCQRCQGSGPTHCTSCGADNYGREHFLYQGECGDSCPEGHYATEGNTCLPCPDNCELCHSVHVCTRCMKGYFIAPTNHTCQKLECGQGEVQDPDYEECVPCEEGCLGCSLDDPGTCTSCAMGYYRFDHHCYKTCPEKTYSEEVECKACDSNCGSCDQNGCYWCEEGFFLLGGSCVRKCGPGFYGDQEMGECESCHRACETCTGPGHDECSSCQEGLQLLRGMCVHATKTQEEGKFWNDILRKLQPCHSSCKTCNGSATLCTSCPKGAYLLAQACVSSCPQGTWPSVRSGSCENCTEACAICSGADLCKKCQMQPGHPLFLHEGRCYSKCPEGSYAEDGICERCSSPCRTCEGNATNCHSCEGGHVLHHGVCQENCPERHVAVKGVCKHCPEMCQDCIHEKTCKECTPEFFLHDDMCHQSCPRGFYADSRHCVPCHKDCLECSGPKADDCELCLESSWVLYDGLCLEECPAGTYYEKETKECRDCHKSCLTCSSSGTCTTCQKGLIMNPRGSCMANEKCSPSEYWDEDAPGCKPCHVKCFHCMGPAEDQCQTCPMNSLLLNTTCVKDCPEGYYADEDSNRCAHCHSSCRTCEGRHSRQCHSCRPGWFQLGKECLLQCREGYYADNSTGRCERCNRSCKGCQGPRPTDCLSCDRFFFLLRSKGECHRSCPDHYYVEQSTQTCERCHPTCDQCKGKGALNCLSCVWSYHLMGGICTSDCLVGEYRVGEGEKFNCEKCHESCMECKGPGAKNCTLCPANLVLHMDDSHCLHCCNTSDPPSAQECCDCQDTTDECILRTSKVRPATEHFKTALFITSSMMLVLLLGAAVVVWKKSRGRVQPAAKAGYEKLADPNKSYSSYKSSYRESTSFEEDQVIEYRDRDYDEDDDDDIVYMGQDGTVYRKFKYGLLDDDDIDELEYDDESYSYYQ

SEQ ID NO: 33040 - protein, 690 aa, Homo sapiens; identical to SEQ ID NO: 33035
  ENSP00000365958

SEQ ID NO: 33041 - protein, 913 aa, Homo sapiens; identical to SEQ ID NO: 33036
  ENSP00000365943

SEQ ID NO: 33042 - protein, 1560 aa, Homo sapiens; identical to SEQ ID NO: 33037
  ENSP00000411654

SEQ ID NO: 33043 - protein, 101 aa, Homo sapiens; identical to SEQ ID NO: 33038
  ENSP00000407239

SEQ ID NO: 33044 - protein, 1860 aa, Homo sapiens; identical to SEQ ID NO: 33039
  ENSP00000446280

SEQ ID NO: 33045 - protein, 785 aa, Homo sapiens
  ENSP00000325917
MPKGRQKVPHLDAPLGLPTCLWLELAGLFLLVPWVMGLAGTGGPDGQGTGGPSWAVHLESLEGDGEEETLEQQADALAQAAGLVNAGRIGELQGHYLFVQPAGHRPALEVEAIRQQVEAVLAGHEAVRWHSEQRLLRRAKRSVHFNDPKYPQQWHLNNRRSPGRDINVTGVWERNVTGRGVTVVVVDDGVEHTIQDIAPNYSPEGSYDLNSNDPDPMPHPDVENGNHHGTRCAGEIAAVPNNSFCAVGVAYGSRIAGIRVLDGPLTDSMEAVAFNKHYQINDIYSCSWGPDDDGKTVDGPHQLGKAALQHGVIAGRQGFGSIFVVASGNGGQHNDNCNYDGYANSIYTVTIGAVDEEGRMPFYAEECASMLAVTFSGGDKMLRSIVTTDWDLQKGTGCTEGHTGTSAAAPLAAGMIALMLQVRPCLTWRDVQHIIVFTATRYEDRRAEWVTNEAGFSHSHQHGFGLLNAWRLVNAAKIWTSVPYLASYVSPVLKENKAIPQSPRSLEVLWNVSRMDLEMSGLKTLEHVAVTVSITHPRRGSLELKLFCPSGMMSLIGAPRSMDSDPNGFNDWTFSTVRCWGERARGTYRLVIRDVGDESFQVGILRQWQLTLYGSVWSAVDIRDRQRLLESAMSGKYLHDDFALPCPPGLKIPEEDGYTITPNTLKTLVLVGCFTVFWTVYYMLEVYLSQRNVASNQVCRSGPCHWPHRSRKAKEEGTELESVPLCSSKDPDEVETESRGPPTTSDLLAPDLLEQGDWSLSQNKSALDCPHQHLDVPHGKEEQIC

SEQ ID NO: 33046 - protein, 305 aa, Homo sapiens
  ENSP00000431181
MPKGRQKVPHLDAPLGLPTCLWLELAGLFLLVPWVMGLAGTGGPDGQGTGGPSWAVHLESLEGDGEEETLEQQADALAQAAGLVNAGRIGELQGHYLFVQPAGHRPALEVEAIRQQVEAVLAGHEAVRWHSEQRLLRRAKRSVHFNDPKYPQQWHLNNRRSPGRDINVTGVWERNVTGRGVTVVVVDDGVEHTIQDIAPNYSPEGSYDLNSNDPDPMPHPDVENGNHHGTRCAGEIAAVPNNSFCAVGVAYGSRIAGIRVLDGPLTDSMEAVAFNKHYQINDIYSCSWGPDDDGKTVDGPHQLGK

SEQ ID NO: 33047 - protein, 113 aa, Homo sapiens
  ENSP00000433841
MPKGRQKVPHLDAPLGLPTCLWLELAGLFLLVPWVMGLAGTGGPDGQGTGGPSWAVHLESLEGDGEEETLEQQADALAQAAGLVNAGRIGELQGHYLFVQPAGHRPALEVEAI

SEQ ID NO: 33048 - protein, 92 aa, Homo sapiens
  ENSP00000436459
MPKGRQKVPHLDAPLGLPTCLWLELAGLFLLVPWVMGLAGTGGPDGQGTGGPSWAVHLESLEGDGEEETLEQQADALAQAAGLVNAGRIGEL

SEQ ID NO: 33049 - protein, 91 aa, Homo sapiens
  ENSP00000433252
MPKGRQKVPHLDAPLGLPTCLWLELAGLFLLVPWVMGLAGTGGPDGQGTGGPSWAVHLESLEGDGEEETLEQQADALAQAAGLVNAGRIGE

SEQ ID NO: 33050 - protein, 591 aa, Homo sapiens
  ENSP00000441944
MPKGRQKVPHLDAPLGLPTCLWLELAGLFLLVPWVMGLAGTGGPDGQGTGGPSWAVHLESLEGDGEEETLEQQADALAQAAGLVNAGRIGELQGHYLFVQPAGHRPALEVEAIRQQVEAVLAGHEAVRWHSEQRLLRRAKRSVHFNDPKYPQQWHLNNRRSPGRDINVTGVWERNVTGRGVTVVVVDDGVEHTIQDIAPNYSPEGSYDLNSNDPDPMPHPDVENGNHHGTRCAGEIAAVPNNSFCAVGVAYGSRIAGIRVLDGPLTDSMEAVAFNKHYQINDIYSCSWGPDDDGKTVDGPHQLGKAALQHGVIAGRQGFGSIFVVASGNGGQHNDNCNYDGYANSIYTVTIGAVDEEGRMPFYAEECASMLAVTFSGGDKMLRSIVTTDWDLQKGTGCTEGHTGTSAAAPLAAGMIALMLQVRPCLTWRDVQHIIVFTATRYEDRRAEWVTNEAGFSHSHQHGFGLLNAWRLVNAAKIWTSVPYLASYVSPVLKENKAIPQSPRSLEVLWNVSRMDLEMSGLKTLEHVAVTVSITHPRRGSLELKLFCPSGMMSLIGAPRSMDSWLCVECSRHQGQTKAVRECHEWKIPAR

SEQ ID NO: 33051 - protein, 356 aa, Homo sapiens
  ENSP00000305556
MDAGVTESGLNVTLTIRLLMHGKEVGSIIGKKGESVKRIREESGARINISEGNCPERIITLTGPTNAIFKAFAMIIDKLEEDINSSMTNSTAASRPPVTLRLVVPATQCGSLIGKGGCKIKEIRESTGAQVQVAGDMLPNSTERAITIAGVPQSVTECVKQICLVMLETLSQSPQGRVMTIPYQPMPASSPVICAGGQDRCSDAAGYPHATHDLEGPPLDAYSIQGQHTISPLDLAKLNQVARQQSHFAMMHGGTGFAGIDSSSPEVKGYWASLDASTQTTHELTIPNNLIGCIIGRQGANINEIRQMSGAQIKIANPVEGSSGRQVTITGSAASISLAQYLINARLSSEKGMGCS

SEQ ID NO: 33052 - protein, 1237 aa, Homo sapiens
  ENSP00000287008
MDSGAGGRRCPEAALLILGPPRMEHLRHSPGPGGQRLLLPSMLLALLLLLAPSPGHATRVVYKVPEEQPPNTLIGSLAADYGFPDVGHLYKLEVGAPYLRVDGKTGDIFTTETSIDREGLRECQNQLPGDPCILEFEVSITDLVQNGSPRLLEGQIEVQDINDNTPNFASPVITLAIPENTNIGSLFPIPLASDRDAGPNGVASYELQAGPEAQELFGLQVAEDQEEKQPQLIVMGNLDRERWDSYDLTIKVQDGGSPPRASSALLRVTVLDTNDNAPKFERPSYEAELSENSPIGHSVIQVKANDSDQGANAEIEYTFHQAPEVVRRLLRLDRNTGLITVQGPVDREDLSTLRFSVLAKDRGTNPKSARAQVVVTVKDMNDNAPTIEIRGIGLVTHQDGMANISEDVAEETAVALVQVSDRDEGENAAVTCVVAGDVPFQLRQASETGSDSKKKYFLQTTTPLDYEKVKDYTIEIVAVDSGNPPLSSTNSLKVQVVDVNDNAPVFTQSVTEVAFPENNKPGEVIAEITASDADSGSNAELVYSLEPEPAAKGLFTISPETGEIQVKTSLDREQRESYELKVVAADRGSPSLQGTATVLVNVLDCNDNDPKFMLSGYNFSVMENMPALSPVGMVTVIDGDKGENAQVQLSVEQDNGDFVIQNGTGTILSSLSFDREQQSTYTFQLKAVDGGVPPRSAYVGVTINVLDENDNAPYITAPSNTSHKLLTPQTRLGETVSQVAAEDFDSGVNAELIYSIAGGNPYGLFQIGSHSGAITLEKEIERRHHGLHRLVVKVSDRGKPPRYGTALVHLYVNETLANRTLLETLLGHSLDTPLDIDIAGDPEYERSKQRGNILFGVVAGVVAVALLIALAVLVRYCRQREAKSGYQAGKKETKDLYAPKPSGKASKGNKSKGKKSKSPKPVKPVEDEDEAGLQKSLKFNLMSDAPGDSPRIHLPLNYPPGSPDLGRHYRSNSPLPSIQLQPQSPSASKKHQVVQDLPPANTFVGTGDTTSTGSEQYSDYSYRTNPPKYPSKQLPHRRVTFSATSQAQELQDPSQHSYYDSGLEESETPSSKSSSGPRLGPLALPEDHYERTTPDGSIGEMEHPENDLRPLPDVAMTGTCTRECSEFGHSDTCWMPGQSSPSRRTKSSALKLSTFVPYQDRGGQEPAGAGSPSPPEDRNTKTAPVRLLPSYSAFSHSSHDSCKDSATLEEIPLTQTSDFPPAATPASAQTAKREIYL

SEQ ID NO: 33053 - protein, 382 aa, Homo sapiens
  ENSP00000424667
MDSGAGGRRCPEAALLILGPPRMEHLRHSPGPGGQRLLLPSMLLALLLLLAPSPGHATRVVYKVPEEQPPNTLIGSLAADYGFPDVGHLYKLEVGAPYLRVDGKTGDIFTTETSIDREGLRECQNQLPGDPCILEFEVSITDLVQNGSPRLLEGQIEVQDINDNTPNFASPVITLAIPENTNIGSLFPIPLASDRDAGPNGVASYELQAGPEAQELFGLQVAEDQEEKQPQLIVMGNLDRERWDSYDLTIKVQDGGSPPRASSALLRVTVLDTNDNAPKFERPSYEAELSENSPIGHSVIQLPHRRVTFSATSQAQELQDPSQHSYYDSGLEESETPSSKSSSGPRLGPLALPEDHYERTTPDGSIGEMEHPENEPAGRSRP

SEQ ID NO: 33054 - protein, 1060 aa, Homo sapiens
  ENSP00000378043
MDSGAGGRRCPEAALLILGPPRMEHLRHSPGPGGQRLLLPSMLLALLLLLAPSPGHATRVVYKVPEEQPPNTLIGSLAADYGFPDVGHLYKLEVGAPYLRVDGKTGDIFTTETSIDREGLRECQNQLPGDPCILEFEVSITDLVQNGSPRLLEGQIEVQDINDNTPNFASPVITLAIPENTNIGSLFPIPLASDRDAGPNGVASYELQAGPEAQELFGLQVAEDQEEKQPQLIVMGNLDRERWDSYDLTIKVQDGGSPPRASSALLRVTVLDTNDNAPKFERPSYEAELSENSPIGHSVIQVKANDSDQGANAEIEYTFHQAPEVVRRLLRLDRNTGLITVQGPVDREDLSTLRFSVLAKDRGTNPKSARAQVVVTVKDMNDNAPTIEIRGIGLVTHQDGMANISEDVAEETAVALVQVSDRDEGENAAVTCVVAGDVPFQLRQASETGSDSKKKYFLQTTTPLDYEKVKDYTIEIVAVDSGNPPLSSTNSLKVQVVDVNDNAPVFTQSVTEVAFPENNKPGEVIAEITASDADSGSNAELVYSLEPEPAAKGLFTISPETGEIQVKTSLDREQRESYELKVVAADRGSPSLQGTATVLVNVLDCNDNDPKFMLSGYNFSVMENMPALSPVGMVTVIDGDKGENAQVQLSVEQDNGDFVIQNGTGTILSSLSFDREQQSTYTFQLKAVDGGVPPRSAYVGVTINVLDENDNAPYITAPSNTSHKLLTPQTRLGETVSQVAAEDFDSGVNAELIYSIAGGNPYGLFQIGSHSGAITLEKEIERRHHGLHRLVVKVSDRGKPPRYGTALVHLYVNETLANRTLLETLLGHSLDTPLDIDIAGDPEYERSKQRGNILFGVVAGVVAVALLIALAVLVRYCRQREAKSGYQAGKKETKDLYAPKPSGKASKGNKSKGKKSKSPKPVKPVEDEDEAGLQKSLKFNLMSDAPGDSPRIHLPLNYPPGSPDLGRHYRSNSPLPSIQLQPQSPSASKKHQVVQDLPPANTFVGTGDTTSTGSEQYSDYSYRTNPPKYPSKQVGQPFQLSTPQPLPHPYHGAIWTEVWE

SEQ ID NO: 33055 - protein, 17 aa, Homo sapiens
  ENSP00000424204
  MOD_RES (1)..(1): Any amino acid
XIQVRGPLRITVRVTHH

SEQ ID NO: 33056 - protein, 126 aa, Homo sapiens
  ENSP00000424004
  MOD_RES (1)..(1): Any amino acid
XGPNGVASYELQAGPEAQELFGLQVAEDQEEKQPQLIVMGNLDRERWDSYDLTIKVQDGGSPPRASSALLRVTVLDTNDNAPKFERPSYEAELSENSPIGHSVIQSLVDWDLEKRLRKKRETDSRG

SEQ ID NO: 33057 - protein, 150 aa, Homo sapiens
  ENSP00000424163
MEHLRHSPGPGGQRLLLPSMLLALLLLLAPSPGHATRVVYKVPEEQPPNTLIGSLAADYGFPDVGHLYKLEVGAPYLRVDGKTGDIFTTETSIDREGLRECQNQLPGDPCILEFEVSITDLVQNGSPRLLEGQIEVQDINDNTPNFASPV

SEQ ID NO: 33058 - protein, 1677 aa, Homo sapiens
  ENSP00000363076
MFRQFYLWTCLASGIILGSLFEICLGQYDDDCKLARGGPPATIVAIDEESRNGTILVDNMLIKGTAGGPDPTIELSLKDNVDYWVLMDPVKQMLFLNSTGRVLDRDPPMNIHSIVVQVQCINKKVGTIIYHEVRIVVRDRNDNSPTFKHESYYATVNELTPVGTTIFTGFSGDNGATDIDDGPNGQIEYVIQYNPDDPTSNDTFEIPLMLTGNIVLRKRLNYEDKTRYFVIIQANDRAQNLNERRTTTTTLTVDVLDGDDLGPMFLPCVLVPNTRDCRPLTYQAAIPELRTPEELNPIIVTPPIQAIDQDRNIQPPSDRPGILYSILVGTPEDYPRFFHMHPRTAELSLLEPVNRDFHQKFDLVIKAEQDNGHPLPAFAGLHIEILDENNQSPYFTMPSYQGYILESAPVGATISDSLNLTSPLRIVALDKDIEDTKDPELHLFLNDYTSVFTVTQTGITRYLTLLQPVDREEQQTYTFSITAFDGVQESEPVIVNIQVMDANDNTPTFPEISYDVYVYTDMRPGDSVIQLTAVDADEGSNGEITYEILVGAQGDFIINKTTGLITIAPGVEMIVGRTYALTVQAADNAPPAERRNSICTVYIEVLPPNNQSPPRFPQLMYSLEISEAMRVGAVLLNLQATDREGDSITYAIENGDPQRVFNLSETTGILTLGKALDRESTDRYILIITASDGRPDGTSTATVNIVVTDVNDNAPVFDPYLPRNLSVVEEEANAFVGQVKATDPDAGINGQVHYSLGNFNNLFRITSNGSIYTAVKLNREVRDYYELVVVATDGAVHPRHSTLTLAIKVLDIDDNSPVFTNSTYTVLVEENLPAGTTILQIEAKDVDLGANVSYRIRSPEVKHFFALHPFTGELSLLRSLDYEAFPDQEASITFLVEAFDIYGTMPPGIATVTVIVKDMNDYPPVFSKRIYKGMVAPDAVKGTPITTVYAEDADPPGLPASRVRYRVDDVQFPYPASIFEVEEDSGRVITRVNLNEEPTTIFKLVVVAFDDGEPVMSSSATVKILVLHPGEIPRFTQEEYRPPPVSELATKGTMVGVISAAAINQSIVYSIVSGNEEDTFGINNITGVIYVNGPLDYETRTSYVLRVQADSLEVVLANLRVPSKSNTAKVYIEIQDENNHPPVFQKKFYIGGVSEDARMFTSVLRVKATDKDTGNYSVMAYRLIIPPIKEGKEGFVVETYTGLIKTAMLFHNMRRSYFKFQVIATDDYGKGLSGKADVLVSVVNQLDMQVIVSNVPPTLVEKKIEDLTEILDRYVQEQIPGAKVVVESIGARRHGDAFSLEDYTKCDLTVYAIDPQTNRAIDRNELFKFLDGKLLDINKDFQPYYGEGGRILEIRTPEAVTSIKKRGESLGYTEGALLALAFIIILCCIPAILVVLVSYRQFKVRQAECTKTARIQAALPAAKPAVPAPAPVAAPPPPPPPPPGAHLYEELGDSSMHKYEMPQYGSRRRLLPPAGQEEYGEVVGEAEEEYEEEEWARKRMIKLVVDREYETSSTGEDSAPECQRNRLHHPSIHSNINGNIYIAQNGSVVRTRRACLTDNLKVASPVRLGGPFKKLDKLAVTHEENVPLNTLSKGPFSTEKMNARPTLVTFAPCPVGTDNTAVKPLRNRLKSTVEQESMIDSKNIKEALEFHSDHTQSDDEELWMGPWNNLHIPMTKL

SEQ ID NO: 33059 - protein, 1675 aa, Homo sapiens
  ENSP00000483745
MFRQFYLWTCLASGIILGSLFEICLGQYDDDCKLARGGPPATIVAIDEESRNGTILVDNMLIKGTAGGPDPTIELSLKDNVDYWVLMDPVKQMLFLNSTGRVLDRDPPMNIHSIVVQVQCINKKVGTIIYHEVRIVVRDRNDNSPTFKHESYYATVNELTPVGTTIFTGFSGDNGATDIDDGPNGQIEYVIQYNPDDPTSNDTFEIPLMLTGNIVLRKRLNYEDKTRYFVIIQANDRAQNLNERRTTTTTLTVDVLDGDDLGPMFLPCVLVPNTRDCRPLTYQAAIPELRTPEELNPIIVTPPIQAIDQDRNIQPPSDRPGILYSILVGTPEDYPRFFHMHPRTAELSLLEPVNRDFHQKFDLVIKAEQDNGHPLPAFAGLHIEILDENNQSPYFTMPSYQGYILESAPVGATISDSLNLTSPLRIVALDKDIEDTKDPELHLFLNDYTSVFTVTQTGITRYLTLLQPVDREEQQTYTFSITAFDGVQESEPVIVNIQVMDANDNTPTFPEISYDVYVYTDMRPGDSVIQLTAVDADEGSNGEITYEILVGAQGDFIINKTTGLITIAPGVEMIVGRTYALTVQAADNAPPAERRNSICTVYIEVLPPNNQSPPRFPQLMYSLEISEAMRVGAVLLNLQATDREGDSITYAIENGDPQRVFNLSETTGILTLGKALDRESTDRYILIITASDGRPDGTSTATVNIVVTDVNDNAPVFDPYLPRNLSVVEEEANAFVGQVKATDPDAGINGQVHYSLGNFNNLFRITSNGSIYTAVKLNREVRDYYELVVVATDGAVHPRHSTLTLAIKVLDIDDNSPVFTNSTYTVLVEENLPAGTTILQIEAKDVDLGANVSYRIRSPEVKHFFALHPFTGELSLLRSLDYEAFPDQEASITFLVEAFDIYGTMPPGIATVTVIVKDMNDYPPVFSKRIYKGMVAPDAVKGTPITTVYAEDADPPGLPASRVRYRVDDVQFPYPASIFEVEEDSGRVITRVNLNEEPTTIFKLVVVAFDDGEPVMSSSATVKILVLHPGEIPRFTQEEYRPPPVSELATKGTMVGVISAAAINQSIVYSIVSGNEEDTFGINNITGVIYVNGPLDYETRTSYVLRVQADSLEVVLANLRVPSKSNTAKVYIEIQDENNHPPVFQKKFYIGGVSEDARMFTSVLRVKATDKDTGNYSVMAYRLIIPPIKEGKEGFVVETYTGLIKTAMLFHNMRRSYFKFQVIATDDYGKGLSGKADVLVSVVNQLDMQVIVSNVPPTLVEKKIEDLTEILDRYVQEQIPGAKVVVESIGARRHGDAFSLEDYTKCDLTVYAIDPQTNRAIDRNELFKFLDGKLLDINKDFQPYYGEGGRILEIRTPEAVTSIKKRGESLGYTEGALLALAFIIILCCIPAILVVLVSYRQFKVRQAECTKTARIQAALPAAKPAVPAPAPVAAPPPPPPPPPGAHLYEELGDSSMYEMPQYGSRRRLLPPAGQEEYGEVVGEAEEEYEEEEWARKRMIKLVVDREYETSSTGEDSAPECQRNRLHHPSIHSNINGNIYIAQNGSVVRTRRACLTDNLKVASPVRLGGPFKKLDKLAVTHEENVPLNTLSKGPFSTEKMNARPTLVTFAPCPVGTDNTAVKPLRNRLKSTVEQESMIDSKNIKEALEFHSDHTQSDDEELWMGPWNNLHIPMTKL

SEQ ID NO: 33060 - protein, 1682 aa, Homo sapiens
  ENSP00000484454
MFRQFYLWTCLASGIILGSLFEICLGQYDDDWQYEDCKLARGGPPATIVAIDEESRNGTILVDNMLIKGTAGGPDPTIELSLKDNVDYWVLMDPVKQMLFLNSTGRVLDRDPPMNIHSIVVQVQCINKKVGTIIYHEVRIVVRDRNDNSPTFKHESYYATVNELTPVGTTIFTGFSGDNGATDIDDGPNGQIEYVIQYNPDDPTSNDTFEIPLMLTGNIVLRKRLNYEDKTRYFVIIQANDRAQNLNERRTTTTTLTVDVLDGDDLGPMFLPCVLVPNTRDCRPLTYQAAIPELRTPEELNPIIVTPPIQAIDQDRNIQPPSDRPGILYSILVGTPEDYPRFFHMHPRTAELSLLEPVNRDFHQKFDLVIKAEQDNGHPLPAFAGLHIEILDENNQSPYFTMPSYQGYILESAPVGATISDSLNLTSPLRIVALDKDIEDTKDPELHLFLNDYTSVFTVTQTGITRYLTLLQPVDREEQQTYTFSITAFDGVQESEPVIVNIQVMDANDNTPTFPEISYDVYVYTDMRPGDSVIQLTAVDADEGSNGEITYEILVGAQGDFIINKTTGLITIAPGVEMIVGRTYALTVQAADNAPPAERRNSICTVYIEVLPPNNQSPPRFPQLMYSLEISEAMRVGAVLLNLQATDREGDSITYAIENGDPQRVFNLSETTGILTLGKALDRESTDRYILIITASDGRPDGTSTATVNIVVTDVNDNAPVFDPYLPRNLSVVEEEANAFVGQVKATDPDAGINGQVHYSLGNFNNLFRITSNGSIYTAVKLNREVRDYYELVVVATDGAVHPRHSTLTLAIKVLDIDDNSPVFTNSTYTVLVEENLPAGTTILQIEAKDVDLGANVSYRIRSPEVKHFFALHPFTGELSLLRSLDYEAFPDQEASITFLVEAFDIYGTMPPGIATVTVIVKDMNDYPPVFSKRIYKGMVAPDAVKGTPITTVYAEDADPPGLPASRVRYRVDDVQFPYPASIFEVEEDSGRVITRVNLNEEPTTIFKLVVVAFDDGEPVMSSSATVKILVLHPGEIPRFTQEEYRPPPVSELATKGTMVGVISAAAINQSIVYSIVSGNEEDTFGINNITGVIYVNGPLDYETRTSYVLRVQADSLEVVLANLRVPSKSNTAKVYIEIQDENNHPPVFQKKFYIGGVSEDARMFTSVLRVKATDKDTGNYSVMAYRLIIPPIKEGKEGFVVETYTGLIKTAMLFHNMRRSYFKFQVIATDDYGKGLSGKADVLVSVVNQLDMQVIVSNVPPTLVEKKIEDLTEILDRYVQEQIPGAKVVVESIGARRHGDAFSLEDYTKCDLTVYAIDPQTNRAIDRNELFKFLDGKLLDINKDFQPYYGEGGRILEIRTPEAVTSIKKRGESLGYTEGALLALAFIIILCCIPAILVVLVSYRQFKVRQAECTKTARIQAALPAAKPAVPAPAPVAAPPPPPPPPPGAHLYEELGDSSMHKYEMPQYGSRRRLLPPAGQEEYGEVVGEAEEEYEEEEWARKRMIKLVVDREYETSSTGEDSAPECQRNRLHHPSIHSNINGNIYIAQNGSVVRTRRACLTDNLKVASPVRLGGPFKKLDKLAVTHEENVPLNTLSKGPFSTEKMNARPTLVTFAPCPVGTDNTAVKPLRNRLKSTVEQESMIDSKNIKEALEFHSDHTQSDDEELWMGPWNNLHIPMTKL

SEQ ID NO: 33061 - protein, 416 aa, Homo sapiens
  ENSP00000480780
MQVIVSNVPPTLVEKKIEDLTEILDRYVQEQIPGAKVVVESIGARRHGDAFSLEDYTKCDLTVYAIDPQTNRAIDRNELFKFLDGKLLDINKDFQPYYGEGGRILEIRTPEAVTSIKKRGESLGYTEGALLALAFIIILCCIPAILVVLVSYRQRGYGSEQQQLLRPSLLKPEELSMESGIDPGQEYGQDYYSYEHGYEMPQYGSRRRLLPPAGQEEYGEVVGEAEEEYEEEEWARKRMIKLVVDREYETSSTGEDSAPECQRNRLHHPSIHSNINGNIYIAQNGSVVRTRRACLTDNLKVASPVRLGGPFKKLDKLAVTHEENVPLNTLSKGPFSTEKMNARPTLVTFAPCPVGTDNTAVKPLRNRLKSTVEQESMIDSKNIKEALEFHSDHTQSDDEELWMGPWNNLHIPMTKL

SEQ ID NO: 33062 - protein, 460 aa, Homo sapiens
  ENSP00000482780
LVEKKIEDLTEILDRYVQEQIPGAKVVVESIGARRHGDAFSLEDYTKCDLTVYAIDPQTNRAIDRNELFKFLDGKLLDINKDFQPYYGEGGRILEIRTPEAVTSIKKRGESLGYTEGALLALAFIIILCCIPAILVVLVSYRQFKVRQAECTKTARIQAALPAAKPAVPAPAPVAAPPPPPPPPPGAHLYEELGDSSMRGYGSEQQQLLRPSLLKPEELSMESGIDPGQEYGQDYYSYEHGYEMPQYGSRRRLLPPAGQEEYGEVVGEAEEEYEEEEWARKRMIKLVVDREYETSSTGEDSAPECQRNRLHHPSIHSNINGNIYIAQNGSVVRTRRACLTDNLKVASPVRLGGPFKKLDKLAVTHEENVPLNTLSKGPFSTEKMNARPTLVTFAPCPVGTDNTAVKPLRNRLKSTVEQESMIDSKNIKEALEFHSDHTQSDDEELWMGPWNNLHIPMTKL

SEQ ID NO: 33063 - protein, 650 aa, Homo sapiens
  ENSP00000378829
MFRQFYLWTCLASGIILGSLFEICLGQYDDDCKLARGGPPATIVAIDEESRNGTILVDNMLIKGTAGGPDPTIELSLKDNVDYWVLMDPVKQMLFLNSTGRVLDRDPPMNIHSIVVQVQCINKKVGTIIYHEVRIVVRDRNDNSPTFKHESYYATVNELTPVGTTIFTGFSGDNGATDIDDGPNGQIEYVIQYNPDDPTSNDTFEIPLMLTGNIVLRKRLNYEDKTRYFVIIQANDRAQNLNERRTTTTTLTVDVLDGDDLGPMFLPCVLVPNTRDCRPLTYQAAIPELRTPEELNPIIVTPPIQAIDQDRNIQPPSDRPGILYSILVGTPEDYPRFFHMHPRTAELSLLEPVNRDFHQKFDLVIKEEPKKIKKPKVEIREPSEEEEVVVTIEKPPAAEPTYTTWKRARIFPMIFKKVRGLADKRGIVDLEGEEWQRRLEEEDKDYLKLTLDQEEATESTVESEEESSSDYTEYSEEESEFSESETTEEESESETPSEEEESSTPESEESESTESEGEKARKNIVLARRRPMVEEVKEVKGRKEEPQEEQKEPKMEEEEHSEEEESGPAPVEESTDPEAQDIPEEGSAESASVEGGVESEEESESGSSSSSSESQSGGPWGYQVPAYDRSKNANQKKSPGANSEGYNTAL

SEQ ID NO: 33064 - protein, 719 aa, Homo sapiens
  ENSP00000378827
MFRQFYLWTCLASGIILGSLFEICLGQYDDDCKLARGGPPATIVAIDEESRNGTILVDNMLIKGTAGGPDPTIELSLKDNVDYWVLMDPVKQMLFLNSTGRVLDRDPPMNIHSIVVQVQCINKKVGTIIYHEVRIVVRDRNDNSPTFKHESYYATVNELTPVGTTIFTGFSGDNGATDIDDGPNGQIEYVIQYNPDDPTSNDTFEIPLMLTGNIVLRKRLNYEDKTRYFVIIQANDRAQNLNERRTTTTTLTVDVLDGDDLGPMFLPCVLVPNTRDCRPLTYQAAIPELRTPEELNPIIVTPPIQAIDQDRNIQPPSDRPGILYSILVGTPEDYPRFFHMHPRTAELSLLEPVNRDFHQKFDLVIKAEQDNGHPLPAFAGLHIEILDENNQSPYFTMPSYQGYILESAPVGATISDSLNLTSPLRIVALDKDIEDEEPKKIKKPKVEIREPSEEEEVVVTIEKPPAAEPTYTTWKRARIFPMIFKKVRGLADKRGIVDLEGEEWQRRLEEEDKDYLKLTLDQEEATESTVESEEESSSDYTEYSEEESEFSESETTEEESESETPSEEEESSTPESEESESTESEGEKARKNIVLARRRPMVEEVKEVKGRKEEPQEEQKEPKMEEEEHSEEEESGPAPVEESTDPEAQDIPEEGSAESASVEGGVESEEESESGSSSSSSESQSGGPWGYQVPAYDRSKNANQKKSPGANSEGYNTAL

SEQ ID NO: 33065 - protein, 1539 aa, Homo sapiens
  ENSP00000478076
MFRQFYLWTCLASGIILGSLFEICLGQYDDDCKLARGGPPATIVAIDEESRNGTILVDNMLIKGTAGGPDPTIELSLKDNVDYWVLMDPVKQMLFLNSTGRVLDRDPPMNIHSIVVQVQCINKKVGTIIYHEVRIVVRDRNDNSPTFKHESYYATVNELTPVGTTIFTGFSGDNGATDIDDGPNGQIEYVIQYNPDDPTSNDTFEIPLMLTGNIVLRKRLNYEDKTRYFVIIQANDRAQNLNERRTTTTTLTVDVLDGDDLGPMFLPCVLVPNTRDCRPLTYQAAIPELRTPEELNPIIVTPPIQAIDQDRNIQPPSDRPGILYSILVGTPEDYPRFFHMHPRTAELSLLEPVNRDFHQKFDLVIKAEQDNGHPLPAFAGLHIEILDENNQSPYFTMPSYQGYILESAPVGATISDSLNLTSPLRIVALDKDIEDTKDPELHLFLNDYTSVFTVTQTGITRYLTLLQPVDREEQQTYTFSITAFDGVQESEPVIVNIQVMDANDNTPTFPEISYDVYVYTDMRPGDSVIQLTAVDADEGSNGEITYEILVGAQGDFIINKTTGLITIAPGVEMIVGRTYALTVQAADNAPPAERRNSICTVYIEVLPPNNQSPPRFPQLMYSLEISEAMRVGAVLLNLQATDREGDSITYAIENGDPQRVFNLSETTGILTLGKALDRESTDRYILIITASDGRPDGTSTATVNIVVTDVNDNAPVFDPYLPRNLSVVEEEANAFVGQVKATDPDAGINGQVHYSLGNFNNLFRITSNGSIYTAVKLNREVRDYYELVVVATDGAVHPRHSTLTLAIKVLDIDDNSPVFTNSTYTVLVEENLPAGTTILQIEAKDVDLGANVSYRIRSPEVKHFFALHPFTGELSLLRSLDYEAFPDQEASITFLVEAFDIYGTMPPGIATVTVIVKDMNDYPPVFSKRIYKGMVAPDAVKGTPITTVYAEDADPPGLPASRVRYRVDDVQFPYPASIFEVEEDSGRVITRVNLNEEPTTIFKLVVVAFDDGEPVMSSSATVKILVLHPGEIPRFTQEEYRPPPVSELATKGTMVGVISAAAINQSIVYSIVSGNEEDTFGINNITGVIYVNGPLDYETRTSYVLRVQADSLEVVLANLRVPSKSNTAKVYIEIQDENNHPPVFQKKFYIGGVSEDARMFTSVLRVKATDKDTGNYSVMAYRLIIPPIKEGKEGFVVETYTGLIKTAMLFHNMRRSYFKFQVIATDDYGKGLSGKADVLVSVVNQLDMQVIVSNVPPTLVEKKIEDLTEILDRYVQEQIPGAKVVVESIGARRHGDAFSLEDYTKCDLTVYAIDPQTNRAIDRNELFKFLDGKLLDINKDFQPYYGEGGRILEIRTPEAVTSIKKRGESLGYTEGALLALAFIIILCCIPAILVVLVSYRQFKVRQAECTKTARIQAALPAAKPAVPAPAPVAAPPPPPPPPPGAHLYEELGDSSMHKNYPWSLELILARNMDKIITVMSMGMKCLNMGVAVDCYHQLDRRNMVRWLVKLRKNMRRKRKSQRKLKNQRLKLESLVRRKK

SEQ ID NO: 33066 - protein, 981 aa, Homo sapiens
  ENSP00000378833
MFRQFYLWTCLASGIILGSLFEICLGQYDDDCKLARGGPPATIVAIDEESRNGTILVDNMLIKGTAGGPDPTIELSLKDNVDYWVLMDPVKQMLFLNSTGRVLDRDPPMNIHSIVVQVQCINKKVGTIIYHEVRIVVRDRNDNSPTFKHESYYATVNELTPVGTTIFTGFSGDNGATDIDDGPNGQIEYVIQYNPDDPTSNDTFEIPLMLTGNIVLRKRLNYEDKTRYFVIIQANDRAQNLNERRTTTTTLTVDVLDGDDLGPMFLPCVLVPNTRDCRPLTYQAAIPELRTPEELNPIIVTPPIQAIDQDRNIQPPSDRPGILYSILVGTPEDYPRFFHMHPRTAELSLLEPVNRDFHQKFDLVIKAEQDNGHPLPAFAGLHIEILDENNQSPYFTMPSYQGYILESAPVGATISDSLNLTSPLRIVALDKDIEDTKDPELHLFLNDYTSVFTVTQTGITRYLTLLQPVDREEQQTYTFSITAFDGVQESEPVIVNIQVMDANDNTPTFPEISYDVYVYTDMRPGDSVIQLTAVDADEGSNGEITYEILVGAQGDFIINKTTGLITIAPGVEMIVGRTYALTVQAADNAPPAERRNSICTVYIEVLPPNNQSPPRFPQLMYSLEISEAMRVGAVLLNLQATDREGDSITYAIENGDPQRVFNLSETTGILTLGKALDRESTDRYILIITASDGRPDGEEPKKIKKPKVEIREPSEEEEVVVTIEKPPAAEPTYTTWKRARIFPMIFKKVRGLADKRGIVDLEGEEWQRRLEEEDKDYLKLTLDQEEATESTVESEEESSSDYTEYSEEESEFSESETTEEESESETPSEEEESSTPESEESESTESEGEKARKNIVLARRRPMVEEVKEVKGRKEEPQEEQKEPKMEEEEHSEEEESGPAPVEESTDPEAQDIPEEGSAESASVEGGVESEEESESGSSSSSSESQSGGPWGYQVPAYDRSKNANQKKSPGANSEGYNTAL

SEQ ID NO: 33067 - protein, 1150 aa, Homo sapiens
  ENSP00000386693
MPSYQGYILESAPVGATISDSLNLTSPLRIVALDKDIEDVPPSGVPTKDPELHLFLNDYTSVFTVTQTGITRYLTLLQPVDREEQQTYTFSITAFDGVQESEPVIVNIQVMDANDNTPTFPEISYDVYVYTDMRPGDSVIQLTAVDADEGSNGEITYEILVGAQGDFIINKTTGLITIAPGVEMIVGRTYALTVQAADNAPPAERRNSICTVYIEVLPPNNQSPPRFPQLMYSLEISEAMRVGAVLLNLQATDREGDSITYAIENGDPQRVFNLSETTGILTLGKALDRESTDRYILIITASDGRPDGTSTATVNIVVTDVNDNAPVFDPYLPRNLSVVEEEANAFVGQVKATDPDAGINGQVHYSLGNFNNLFRITSNGSIYTAVKLNREVRDYYELVVVATDGAVHPRHSTLTLAIKVLDIDDNSPVFTNSTYTVLVEENLPAGTTILQIEAKDVDLGANVSYRIRSPEVKHFFALHPFTGELSLLRSLDYEAFPDQEASITFLVEAFDIYGTMPPGIATVTVIVKDMNDYPPVFSKRIYKGMVAPDAVKGTPITTVYAEDADPPGLPASRVRYRVDDVQFPYPASIFEVEEDSGRVITRVNLNEEPTTIFKLVVVAFDDGEPVMSSSATVKILVLHPGEIPRFTQEEYRPPPVSELATKGTMVGVISAAAINQSIVYSIVSGNEEDTFGINNITGVIYVNGPLDYETRTSYVLRVQADSLEVVLANLRVPSKSNTAKVYIEIQDENNHPPVFQKKFYIGGVSEDARMFTSVLRVKATDKDTGNYSVMAYRLIIPPIKEGKEGFVVETYTGLIKTAMLFHNMRRSYFKFQVIATDDYGKGLSGKADVLVSVVNQLDMQVIVSNVPPTLVEKKIEDLTEILDRYVQEQIPGAKVVVESIGARRHGDAFSLEDYTKCDLTVYAIDPQTNRAIDRNELFKFLDGKLLDINKDFQPYYGEGGRILEIRTPEAVTSIKKRGESLGYTEGALLALAFIIILCCIPAILVVLVSYRQFKVRQAECTKTARIQAALPAAKPAVPAPAPVAAPPPPPPPPPGAHLYEELGDSSMHKNYPWSLELILARNMDKIITVMSMGMKCLNMGVAVDCYHQLDRRNMVRWLVKLRKNMRRKRKSQRKLKNQRLKLESLVRRKK

SEQ ID NO: 33068 - protein, 329 aa, Homo sapiens
  ENSP00000412531
MFRQFYLWTCLASGIILGSLFEICLGQYDDDCKLARGGPPATIVAIDEESRNGTILVDNMLIKGTAGGPDPTIELSLKDNVDYWVLMDPVKQMLFLNSTGRVLDRDPPMNIHSIVVQVQCINKKVGTIIYHEVRIVVRDRNDNSPTFKHESYYATVNELTPVGTTIFTGFSGDNGATDIDDGPNGQIEYVIQYNPDDPTSNDTFEIPLMLTGNIVLRKRLNYEDKTRYFVIIQANDRAQNLNERRTTTTTLTVDVLDGDDLGPMFLPCVLVPNTRDCRPLTYQAAIPELRTPDLGSLCSGTNSWCQGRSGVHWSSPAWRCLFPRRLHQM

SEQ ID NO: 33069 - protein, 1790 aa, Homo sapiens
  ENSP00000482794
MFRQFYLWTCLASGIILGSLFEICLGQYDDDWQYEDCKLARGGPPATIVAIDEESRNGTILVDNMLIKGTAGGPDPTIELSLKDNVDYWVLMDPVKQMLFLNSTGRVLDRDPPMNIHSIVVQVQCINKKVGTIIYHEVRIVVRDRNDNSPTFKHESYYATVNELTPVGTTIFTGFSGDNGATDIDDGPNGQIEYVIQYNPDDPTSNDTFEIPLMLTGNIVLRKRLNYEDKTRYFVIIQANDRAQNLNERRTTTTTLTVDVLDGDDLGPMFLPCVLVPNTRDCRPLTYQAAIPELRTPEELNPIIVTPPIQAIDQDRNIQPPSDRPGILYSILVGTPEDYPRFFHMHPRTAELSLLEPVNRDFHQKFDLVIKAEQDNGHPLPAFAGLHIEILDENNQSPYFTMPSYQGYILESAPVGATISDSLNLTSPLRIVALDKDIEDVPPSGVPTKDPELHLFLNDYTSVFTVTQTGITRYLTLLQPVDREEQQTYTFSITAFDGVQESEPVIVNIQVMDANDNTPTFPEISYDVYVYTDMRPGDSVIQLTAVDADEGSNGEITYEILVGAQGDFIINKTTGLITIAPGVEMIVGRTYALTVQAADNAPPAERRNSICTVYIEVLPPNNQSPPRFPQLMYSLEISEAMRVGAVLLNLQATDREGDSITYAIENGDPQRVFNLSETTGILTLGKALDRESTDRYILIITASDGRPDGTSTATVNIVVTDVNDNAPVFDPYLPRNLSVVEEEANAFVGQVKATDPDAGINGQVHYSLGNFNNLFRITSNGSIYTAVKLNREVRDYYELVVVATDGAVHPRHSTLTLAIKVLDIDDNSPVFTNSTYTVLVEENLPAGTTILQIEAKDVDLGANVSYRIRSPEVKHFFALHPFTGELSLLRSLDYEAFPDQEASITFLVEAFDIYGTMPPGIATVTVIVKDMNDYPPVFSKRIYKGMVAPDAVKGTPITTVYAEDADPPGLPASRVRYRVDDVQFPYPASIFEVEEDSGRVITRVNLNEEPTTIFKLVVVAFDDGEPVMSSSATVKILVLHPGEIPRFTQEEYRPPPVSELATKGTMVGVISAAAINQSIVYSIVSGNEEDTFGINNITGVIYVNGPLDYETRTSYVLRVQADSLEVVLANLRVPSKSNTAKVYIEIQDENNHPPVFQKKFYIGGVSEDARMFTSVLRVKATDKDTGNYSVMAYRLIIPPIKEGKEGFVVETYTGLIKTAMLFHNMRRSYFKFQVIATDDYGKGLSGKADVLVSVVNQLDMQVIVSNVPPTLVEKKIEDLTEILDRYVQEQIPGAKVVVESIGARRHGDAFSLEDYTKCDLTVYAIDPQTNRAIDRNELFKFLDGKLLDINKDFQPYYGEGGRILEIRTPEAVTSIKKRGESLGYTEGALLALAFIIILCCIPAILVVLVSYRQFKVRQAECTKTARIQAALPAAKPAVPAPAPVAAPPPPPPPPPGAHLYEELGDSSMHKYEMPQYGSRRRLLPPAGQEEYGEVVGEAEEEYEEEEEEPKKIKKPKVEIREPSEEEEVVVTIEKPPAAEPTYTTWKRARIFPMIFKKVRGLADKRGIVDLEGEEWQRRLEEEDKDYLKLTLDQEEATESTVESEEESSSDYTEYSEEESEFSESETTEEESESETPSEEEESSTPESEESESTESEGEKARKNIVLARRRPMVEEVKEVKGRKEEPQEEQKEPKMEEEEHSEEEESGPAPVEESTDPEAQDIPEEGSAESASVEGGVESEEESESGSSSSSSESQSGGPWGYQVPAYDRSKNANQKKSPGANSEGYNTAL

SEQ ID NO: 33070 - protein, 37 aa, Homo sapiens
  ENSP00000478551
  MOD_RES (1)..(1): Any amino acid
XMKCLNMGVAVDCYHQLDRRNMVRWLVKLRKNMRRKR

SEQ ID NO: 33071 - protein, 1783 aa, Homo sapiens
  ENSP00000378832
MFRQFYLWTCLASGIILGSLFEICLGQYDDDCKLARGGPPATIVAIDEESRNGTILVDNMLIKGTAGGPDPTIELSLKDNVDYWVLMDPVKQMLFLNSTGRVLDRDPPMNIHSIVVQVQCINKKVGTIIYHEVRIVVRDRNDNSPTFKHESYYATVNELTPVGTTIFTGFSGDNGATDIDDGPNGQIEYVIQYNPDDPTSNDTFEIPLMLTGNIVLRKRLNYEDKTRYFVIIQANDRAQNLNERRTTTTTLTVDVLDGDDLGPMFLPCVLVPNTRDCRPLTYQAAIPELRTPEELNPIIVTPPIQAIDQDRNIQPPSDRPGILYSILVGTPEDYPRFFHMHPRTAELSLLEPVNRDFHQKFDLVIKAEQDNGHPLPAFAGLHIEILDENNQSPYFTMPSYQGYILESAPVGATISDSLNLTSPLRIVALDKDIEDVPPSGVPTKDPELHLFLNDYTSVFTVTQTGITRYLTLLQPVDREEQQTYTFSITAFDGVQESEPVIVNIQVMDANDNTPTFPEISYDVYVYTDMRPGDSVIQLTAVDADEGSNGEITYEILVGAQGDFIINKTTGLITIAPGVEMIVGRTYALTVQAADNAPPAERRNSICTVYIEVLPPNNQSPPRFPQLMYSLEISEAMRVGAVLLNLQATDREGDSITYAIENGDPQRVFNLSETTGILTLGKALDRESTDRYILIITASDGRPDGTSTATVNIVVTDVNDNAPVFDPYLPRNLSVVEEEANAFVGQVKATDPDAGINGQVHYSLGNFNNLFRITSNGSIYTAVKLNREVRDYYELVVVATDGAVHPRHSTLTLAIKVLDIDDNSPVFTNSTYTVLVEENLPAGTTILQIEAKDVDLGANVSYRIRSPEVKHFFALHPFTGELSLLRSLDYEAFPDQEASITFLVEAFDIYGTMPPGIATVTVIVKDMNDYPPVFSKRIYKGMVAPDAVKGTPITTVYAEDADPPGLPASRVRYRVDDVQFPYPASIFEVEEDSGRVITRVNLNEEPTTIFKLVVVAFDDGEPVMSSSATVKILVLHPGEIPRFTQEEYRPPPVSELATKGTMVGVISAAAINQSIVYSIVSGNEEDTFGINNITGVIYVNGPLDYETRTSYVLRVQADSLEVVLANLRVPSKSNTAKVYIEIQDENNHPPVFQKKFYIGGVSEDARMFTSVLRVKATDKDTGNYSVMAYRLIIPPIKEGKEGFVVETYTGLIKTAMLFHNMRRSYFKFQVIATDDYGKGLSGKADVLVSVVNQLDMQVIVSNVPPTLVEKKIEDLTEILDRYVQEQIPGAKVVVESIGARRHGDAFSLEDYTKCDLTVYAIDPQTNRAIDRNELFKFLDGKLLDINKDFQPYYGEGGRILEIRTPEAVTSIKKRGESLGYTEGALLALAFIIILCCIPAILVVLVSYRQFKVRQAECTKTARIQAALPAAKPAVPAPAPVAAPPPPPPPPPGAHLYEELGDSSMYEMPQYGSRRRLLPPAGQEEYGEVVGEAEEEYEEEEEEPKKIKKPKVEIREPSEEEEVVVTIEKPPAAEPTYTTWKRARIFPMIFKKVRGLADKRGIVDLEGEEWQRRLEEEDKDYLKLTLDQEEATESTVESEEESSSDYTEYSEEESEFSESETTEEESESETPSEEEESSTPESEESESTESEGEKARKNIVLARRRPMVEEVKEVKGRKEEPQEEQKEPKMEEEEHSEEEESGPAPVEESTDPEAQDIPEEGSAESASVEGGVESEEESESGSSSSSSESQSGGPWGYQVPAYDRSKNANQKKSPGANSEGYNTAL

SEQ ID NO: 33072 - protein, 1957 aa, Homo sapiens
  ENSP00000354950
MFRQFYLWTCLASGIILGSLFEICLGQYDDDCKLARGGPPATIVAIDEESRNGTILVDNMLIKGTAGGPDPTIELSLKDNVDYWVLMDPVKQMLFLNSTGRVLDRDPPMNIHSIVVQVQCINKKVGTIIYHEVRIVVRDRNDNSPTFKHESYYATVNELTPVGTTIFTGFSGDNGATDIDDGPNGQIEYVIQYNPDDPTSNDTFEIPLMLTGNIVLRKRLNYEDKTRYFVIIQANDRAQNLNERRTTTTTLTVDVLDGDDLGPMFLPCVLVPNTRDCRPLTYQAAIPELRTPEELNPIIVTPPIQAIDQDRNIQPPSDRPGILYSILVGTPEDYPRFFHMHPRTAELSLLEPVNRDFHQKFDLVIKAEQDNGHPLPAFAGLHIEILDENNQSPYFTMPSYQGYILESAPVGATISDSLNLTSPLRIVALDKDIEDTKDPELHLFLNDYTSVFTVTQTGITRYLTLLQPVDREEQQTYTFSITAFDGVQESEPVIVNIQVMDANDNTPTFPEISYDVYVYTDMRPGDSVIQLTAVDADEGSNGEITYEILVGAQGDFIINKTTGLITIAPGVEMIVGRTYALTVQAADNAPPAERRNSICTVYIEVLPPNNQSPPRFPQLMYSLEISEAMRVGAVLLNLQATDREGDSITYAIENGDPQRVFNLSETTGILTLGKALDRESTDRYILIITASDGRPDGTSTATVNIVVTDVNDNAPVFDPYLPRNLSVVEEEANAFVGQVKATDPDAGINGQVHYSLGNFNNLFRITSNGSIYTAVKLNREVRDYYELVVVATDGAVHPRHSTLTLAIKVLDIDDNSPVFTNSTYTVLVEENLPAGTTILQIEAKDVDLGANVSYRIRSPEVKHFFALHPFTGELSLLRSLDYEAFPDQEASITFLVEAFDIYGTMPPGIATVTVIVKDMNDYPPVFSKRIYKGMVAPDAVKGTPITTVYAEDADPPGLPASRVRYRVDDVQFPYPASIFEVEEDSGRVITRVNLNEEPTTIFKLVVVAFDDGEPVMSSSATVKILVLHPGEIPRFTQEEYRPPPVSELATKGTMVGVISAAAINQSIVYSIVSGNEEDTFGINNITGVIYVNGPLDYETRTSYVLRVQADSLEVVLANLRVPSKSNTAKVYIEIQDENNHPPVFQKKFYIGGVSEDARMFTSVLRVKATDKDTGNYSVMAYRLIIPPIKEGKEGFVVETYTGLIKTAMLFHNMRRSYFKFQVIATDDYGKGLSGKADVLVSVVNQLDMQVIVSNVPPTLVEKKIEDLTEILDRYVQEQIPGAKVVVESIGARRHGDAFSLEDYTKCDLTVYAIDPQTNRAIDRNELFKFLDGKLLDINKDFQPYYGEGGRILEIRTPEAVTSIKKRGESLGYTEGALLALAFIIILCCIPAILVVLVSYRQFKVRQAECTKTARIQAALPAAKPAVPAPAPVAAPPPPPPPPPGAHLYEELGDSSMHNLFLLYHFQQSRGNNSVSEDRKHQQVVMPFSSNTIEAHKSAHVDGSLKSNKLKSARKFTFLSDEDDLSAHNPLYKENISQVSTNSDISQRTDFVDPFSPKIQAKSKSLRGPREKIQRLWSQSVSLPRRLMRKVPNRPEIIDLQQWQGTRQKAENENTGICTNKRGSSNPLLTTEEANLTEKEEIRQGETLMIEGTEQLKSLSSDSSFCFPRPHFSFSTLPTVSRTVELKSEPNVISSPAECSLELSPSRPCVLHSSLSRRETPICMLPIETERNIFENFAHPPNISPSACPLPPPPPISPPSPPPAPAPLAPPPDISPFSLFCPPPSPPSIPLPLPPPTFFPLSVSTSGPPTPPLLPPFPTPLPPPPPSIPCPPPPSASFLSTECVCITGVKCTTNLMPAEKIKSSMTQLSTTTVCKTDPQREPKGILRHVKNLAELEKSVANMYSQIEKNYLRTNVSELQTMCPSEVTNMEITSEQNKGSLNNIVEGTEKQSHSQSTSL

SEQ ID NO: 33073 - protein, 1952 aa, Homo sapiens
  ENSP00000378818
MFRQFYLWTCLASGIILGSLFEICLGQYDDDCKLARGGPPATIVAIDEESRNGTILVDNMLIKGTAGGPDPTIELSLKDNVDYWVLMDPVKQMLFLNSTGRVLDRDPPMNIHSIVVQVQCINKKVGTIIYHEVRIVVRDRNDNSPTFKHESYYATVNELTPVGTTIFTGFSGDNGATDIDDGPNGQIEYVIQYNPDDPTSNDTFEIPLMLTGNIVLRKRLNYEDKTRYFVIIQANDRAQNLNERRTTTTTLTVDVLDGDDLGPMFLPCVLVPNTRDCRPLTYQAAIPELRTPEELNPIIVTPPIQAIDQDRNIQPPSDRPGILYSILVGTPEDYPRFFHMHPRTAELSLLEPVNRDFHQKFDLVIKAEQDNGHPLPAFAGLHIEILDENNQSPYFTMPSYQGYILESAPVGATISDSLNLTSPLRIVALDKDIEDTKDPELHLFLNDYTSVFTVTQTGITRYLTLLQPVDREEQQTYTFSITAFDGVQESEPVIVNIQVMDANDNTPTFPEISYDVYVYTDMRPGDSVIQLTAVDADEGSNGEITYEILVGAQGDFIINKTTGLITIAPGVEMIVGRTYALTVQAADNAPPAERRNSICTVYIEVLPPNNQSPPRFPQLMYSLEISEAMRVGAVLLNLQATDREGDSITYAIENGDPQRVFNLSETTGILTLGKALDRESTDRYILIITASDGRPDGTSTATVNIVVTDVNDNAPVFDPYLPRNLSVVEEEANAFVGQVKATDPDAGINGQVHYSLGNFNNLFRITSNGSIYTAVKLNREVRDYYELVVVATDGAVHPRHSTLTLAIKVLDIDDNSPVFTNSTYTVLVEENLPAGTTILQIEAKDVDLGANVSYRIRSPEVKHFFALHPFTGELSLLRSLDYEAFPDQEASITFLVEAFDIYGTMPPGIATVTVIVKDMNDYPPVFSKRIYKGMVAPDAVKGTPITTVYAEDADPPGLPASRVRYRVDDVQFPYPASIFEVEEDSGRVITRVNLNEEPTTIFKLVVVAFDDGEPVMSSSATVKILVLHPGEIPRFTQEEYRPPPVSELATKGTMVGVISAAAINQSIVYSIVSGNEEDTFGINNITGVIYVNGPLDYETRTSYVLRVQADSLEVVLANLRVPSKSNTAKVYIEIQDENNHPPVFQKKFYIGGVSEDARMFTSVLRVKATDKDTGNYSVMAYRLIIPPIKEGKEGFVVETYTGLIKTAMLFHNMRRSYFKFQVIATDDYGKGLSGKADVLVSVVNQLDMQVIVSNVPPTLVEKKIEDLTEILDRYVQEQIPGAKVVVESIGARRHGDAFSLEDYTKCDLTVYAIDPQTNRAIDRNELFKFLDGKLLDINKDFQPYYGEGGRILEIRTPEAVTSIKKRGESLGYTEGALLALAFIIILCCIPAILVVLVSYRQRQAECTKTARIQAALPAAKPAVPAPAPVAAPPPPPPPPPGAHLYEELGDSSILFLLYHFQQSRGNNSVSEDRKHQQVVMPFSSNTIEAHKSAHVDGSLKSNKLKSARKFTFLSDEDDLSAHNPLYKENISQVSTNSDISQRTDFVDPFSPKIQAKSKSLRGPREKIQRLWSQSVSLPRRLMRKVPNRPEIIDLQQWQGTRQKAENENTGICTNKRGSSNPLLTTEEANLTEKEEIRQGETLMIEGTEQLKSLSSDSSFCFPRPHFSFSTLPTVSRTVELKSEPNVISSPAECSLELSPSRPCVLHSSLSRRETPICMLPIETERNIFENFAHPPNISPSACPLPPPPPISPPSPPPAPAPLAPPPDISPFSLFCPPPSPPSIPLPLPPPTFFPLSVSTSGPPTPPLLPPFPTPLPPPPPSIPCPPPPSASFLSTECVCITGVKCTTNLMPAEKIKSSMTQLSTTTVCKTDPQREPKGILRHVKNLAELEKSVANMYSQIEKNYLRTNVSELQTMCPSEVTNMEITSEQNKGSLNNIVEGTEKQSHSQSTSL

SEQ ID NO: 33074 - protein, 1932 aa, Homo sapiens
  ENSP00000378821
MFRQFYLWTCLASGIILGSLFEICLGQYDDGTILVDNMLIKGTAGGPDPTIELSLKDNVDYWVLMDPVKQMLFLNSTGRVLDRDPPMNIHSIVVQVQCINKKVGTIIYHEVRIVVRDRNDNSPTFKHESYYATVNELTPVGTTIFTGFSGDNGATDIDDGPNGQIEYVIQYNPDDPTSNDTFEIPLMLTGNIVLRKRLNYEDKTRYFVIIQANDRAQNLNERRTTTTTLTVDVLDGDDLGPMFLPCVLVPNTRDCRPLTYQAAIPELRTPEELNPIIVTPPIQAIDQDRNIQPPSDRPGILYSILVGTPEDYPRFFHMHPRTAELSLLEPVNRDFHQKFDLVIKAEQDNGHPLPAFAGLHIEILDENNQSPYFTMPSYQGYILESAPVGATISDSLNLTSPLRIVALDKDIEDTKDPELHLFLNDYTSVFTVTQTGITRYLTLLQPVDREEQQTYTFSITAFDGVQESEPVIVNIQVMDANDNTPTFPEISYDVYVYTDMRPGDSVIQLTAVDADEGSNGEITYEILVGAQGDFIINKTTGLITIAPGVEMIVGRTYALTVQAADNAPPAERRNSICTVYIEVLPPNNQSPPRFPQLMYSLEISEAMRVGAVLLNLQATDREGDSITYAIENGDPQRVFNLSETTGILTLGKALDRESTDRYILIITASDGRPDGTSTATVNIVVTDVNDNAPVFDPYLPRNLSVVEEEANAFVGQVKATDPDAGINGQVHYSLGNFNNLFRITSNGSIYTAVKLNREVRDYYELVVVATDGAVHPRHSTLTLAIKVLDIDDNSPVFTNSTYTVLVEENLPAGTTILQIEAKDVDLGANVSYRIRSPEVKHFFALHPFTGELSLLRSLDYEAFPDQEASITFLVEAFDIYGTMPPGIATVTVIVKDMNDYPPVFSKRIYKGMVAPDAVKGTPITTVYAEDADPPGLPASRVRYRVDDVQFPYPASIFEVEEDSGRVITRVNLNEEPTTIFKLVVVAFDDGEPVMSSSATVKILVLHPGEIPRFTQEEYRPPPVSELATKGTMVGVISAAAINQSIVYSIVSGNEEDTFGINNITGVIYVNGPLDYETRTSYVLRVQADSLEVVLANLRVPSKSNTAKVYIEIQDENNHPPVFQKKFYIGGVSEDARMFTSVLRVKATDKDTGNYSVMAYRLIIPPIKEGKEGFVVETYTGLIKTAMLFHNMRRSYFKFQVIATDDYGKGLSGKADVLVSVVNQLDMQVIVSNVPPTLVEKKIEDLTEILDRYVQEQIPGAKVVVESIGARRHGDAFSLEDYTKCDLTVYAIDPQTNRAIDRNELFKFLDGKLLDINKDFQPYYGEGGRILEIRTPEAVTSIKKRGESLGYTEGALLALAFIIILCCIPAILVVLVSYRQRQAECTKTARIQAALPAAKPAVPAPAPVAAPPPPPPPPPGAHLYEELGDSSMHNLFLLYHFQQSRGNNSVSEDRKHQQVVMPFSSNTIEAHKSAHVDGSLKSNKLKSARKFTFLSDEDDLSAHNPLYKENISQVSTNSDISQRTDFVDPFSPKIQAKSKSLRGPREKIQRLWSQSVSLPRRLMRKVPNRPEIIDLQQWQGTRQKAENENTGICTNKRGSSNPLLTTEEANLTEKEEIRQGETLMIEGTEQLKSLSSDSSFCFPRPHFSFSTLPTVSRTVELKSEPNVISSPAECSLELSPSRPCVLHSSLSRRETPICMLPIETERNIFENFAHPPNISPSACPLPPPPPISPPSPPPAPAPLAPPPDISPFSLFCPPPSPPSIPLPLPPPTFFPLSVSTSGPPTPPLLPPFPTPLPPPPPSIPCPPPPSASFLSTECVCITGVKCTTNLMPAEKIKSSMTQLSTTTVCKTDPQREPKGILRHVKNLAELEKSVANMYSQIEKNYLRTNVSELQTMCPSEVTNMEITSEQNKGSLNNIVEGTEKQSHSQSTSL

SEQ ID NO: 33075 - protein, 654 aa, Homo sapiens
  ENSP00000363067
MFRQFYLWTCLASGIILGSLFEICLGQYDDDCKLARGGPPATIVAIDEESRNGTILVDNMLIKGTAGGPDPTIELSLKDNVDYWVLMDPVKQMLFLNSTGRVLDRDPPMNIHSIVVQVQCINKKVGTIIYHEVRIVVRDRNDNSPTFKHESYYATVNELTPVGTTIFTGFSGDNGATDIDDGPNGQIEYVIQYNPDDPTSNDTFEIPLMLTGNIVLRKRLNYEDKTRYFVIIQANDRAQNLNERRTTTTTLTVDVLDGDDLGPMFLPCVLVPNTRDCRPLTYQAAIPELRTPEELNPIIVTPPIQAIDQDRNIQPPSDRPGILYSILVGTPEDYPRFFHMHPRTAELSLLEPVNRDFHQKFDLVIKAEQDNGHPLPAFAGLHIEILDENNQSPYFTMPSYQGYILESAPVGATISDSLNLTSPLRIVALDKDIEDTKDPELHLFLNDYTSVFTVTQTGITRYLTLLQPVDREEQQTYTFSITAFDGVQESEPVIVNIQVMDANDNTPTFPEISYDVYVYTDMRPGDSVIQLTAVDADEGSNGEITYEILVGAQGDFIINKTTGLITIAPGVEMIVGRTYALTVQAADNAPPAERRNSICTVYIEVLPPNNQSPPRFPQLMYSLEISEAMRVGAVLLNLQHGDSNLRESTGQGKH

SEQ ID NO: 33076 - protein, 1962 aa, Homo sapiens
  ENSP00000363068
MFRQFYLWTCLASGIILGSLFEICLGQYDDDWQYEDCKLARGGPPATIVAIDEESRNGTILVDNMLIKGTAGGPDPTIELSLKDNVDYWVLMDPVKQMLFLNSTGRVLDRDPPMNIHSIVVQVQCINKKVGTIIYHEVRIVVRDRNDNSPTFKHESYYATVNELTPVGTTIFTGFSGDNGATDIDDGPNGQIEYVIQYNPDDPTSNDTFEIPLMLTGNIVLRKRLNYEDKTRYFVIIQANDRAQNLNERRTTTTTLTVDVLDGDDLGPMFLPCVLVPNTRDCRPLTYQAAIPELRTPEELNPIIVTPPIQAIDQDRNIQPPSDRPGILYSILVGTPEDYPRFFHMHPRTAELSLLEPVNRDFHQKFDLVIKAEQDNGHPLPAFAGLHIEILDENNQSPYFTMPSYQGYILESAPVGATISDSLNLTSPLRIVALDKDIEDTKDPELHLFLNDYTSVFTVTQTGITRYLTLLQPVDREEQQTYTFSITAFDGVQESEPVIVNIQVMDANDNTPTFPEISYDVYVYTDMRPGDSVIQLTAVDADEGSNGEITYEILVGAQGDFIINKTTGLITIAPGVEMIVGRTYALTVQAADNAPPAERRNSICTVYIEVLPPNNQSPPRFPQLMYSLEISEAMRVGAVLLNLQATDREGDSITYAIENGDPQRVFNLSETTGILTLGKALDRESTDRYILIITASDGRPDGTSTATVNIVVTDVNDNAPVFDPYLPRNLSVVEEEANAFVGQVKATDPDAGINGQVHYSLGNFNNLFRITSNGSIYTAVKLNREVRDYYELVVVATDGAVHPRHSTLTLAIKVLDIDDNSPVFTNSTYTVLVEENLPAGTTILQIEAKDVDLGANVSYRIRSPEVKHFFALHPFTGELSLLRSLDYEAFPDQEASITFLVEAFDIYGTMPPGIATVTVIVKDMNDYPPVFSKRIYKGMVAPDAVKGTPITTVYAEDADPPGLPASRVRYRVDDVQFPYPASIFEVEEDSGRVITRVNLNEEPTTIFKLVVVAFDDGEPVMSSSATVKILVLHPGEIPRFTQEEYRPPPVSELATKGTMVGVISAAAINQSIVYSIVSGNEEDTFGINNITGVIYVNGPLDYETRTSYVLRVQADSLEVVLANLRVPSKSNTAKVYIEIQDENNHPPVFQKKFYIGGVSEDARMFTSVLRVKATDKDTGNYSVMAYRLIIPPIKEGKEGFVVETYTGLIKTAMLFHNMRRSYFKFQVIATDDYGKGLSGKADVLVSVVNQLDMQVIVSNVPPTLVEKKIEDLTEILDRYVQEQIPGAKVVVESIGARRHGDAFSLEDYTKCDLTVYAIDPQTNRAIDRNELFKFLDGKLLDINKDFQPYYGEGGRILEIRTPEAVTSIKKRGESLGYTEGALLALAFIIILCCIPAILVVLVSYRQFKVRQAECTKTARIQAALPAAKPAVPAPAPVAAPPPPPPPPPGAHLYEELGDSSMHNLFLLYHFQQSRGNNSVSEDRKHQQVVMPFSSNTIEAHKSAHVDGSLKSNKLKSARKFTFLSDEDDLSAHNPLYKENISQVSTNSDISQRTDFVDPFSPKIQAKSKSLRGPREKIQRLWSQSVSLPRRLMRKVPNRPEIIDLQQWQGTRQKAENENTGICTNKRGSSNPLLTTEEANLTEKEEIRQGETLMIEGTEQLKSLSSDSSFCFPRPHFSFSTLPTVSRTVELKSEPNVISSPAECSLELSPSRPCVLHSSLSRRETPICMLPIETERNIFENFAHPPNISPSACPLPPPPPISPPSPPPAPAPLAPPPDISPFSLFCPPPSPPSIPLPLPPPTFFPLSVSTSGPPTPPLLPPFPTPLPPPPPSIPCPPPPSASFLSTECVCITGVKCTTNLMPAEKIKSSMTQLSTTTVCKTDPQREPKGILRHVKNLAELEKSVANMYSQIEKNYLRTNVSELQTMCPSEVTNMEITSEQNKGSLNNIVEGTEKQSHSQSTSL

SEQ ID NO: 33077 - protein, 654 aa, Homo sapiens; identical to SEQ ID NO: 33075
  ENSP00000412320

SEQ ID NO: 33078 - protein, 1886 aa, Homo sapiens
  ENSP00000412628
MFRQFYLWTCLASGIILGSLFEICLGQYDDDCKLARGGPPATIVAIDEESRNGTILVDNMLIKGTAGGPDPTIELSLKDNVDYWVLMDPVKQMLFLNSTGRVLDRDPPMNIHSIVVQVQCINKKVGTIIYHEVRIVVRDRNDNSPTFKHESYYATVNELTPVGTTIFTGFSGDNGATDIDDGPNGQIEYVIQYNPDDPTSNDTFEIPLMLTGNIVLRKRLNYEDKTRYFVIIQANDRAQNLNERRTTTTTLTVDVLDGDDLGPMFLPCVLVPNTRDCRPLTYQAAIPELRTPEELNPIIVTPPIQAIDQDRNIQPPSDRPGILYSILVGTPEDYPRFFHMHPRTAELSLLEPVNRDFHQKFDLVIKAEQDNGHPLPAFAGLHIEILDENNQSPYFTMPSYQGYILESAPVGATISDSLNLTSPLRIVALDKDIEDTKDPELHLFLNDYTSVFTVTQTGITRYLTLLQPVDREEQQTYTFSITAFDGVQESEPVIVNIQVMDANDNTPTFPEISYDVYVYTDMRPGDSVIQLTAVDADEGSNGEITYEILVGAQGDFIINKTTGLITIAPGVEMIVGRTYALTVQAADNAPPAERSTGILTLGKALDRESTDRYILIITASDGRPDGTSTATVNIVVTDVNDNAPVFDPYLPRNLSVVEEEANAFVGQVKATDPDAGINGQVHYSLGNFNNLFRITSNGSIYTAVKLNREVRDYYELVVVATDGAVHPRHSTLTLAIKVLDIDDNSPVFTNSTYTVLVEENLPAGTTILQIEAKDVDLGANVSYRIRSPEVKHFFALHPFTGELSLLRSLDYEAFPDQEASITFLVEAFDIYGTMPPGIATVTVIVKDMNDYPPVFSKRIYKGMVAPDAVKGTPITTVYAEDADPPGLPASRVRYRVDDVQFPYPASIFEVEEDSGRVITRVNLNEEPTTIFKLVVVAFDDGEPVMSSSATVKILVLHPGEIPRFTQEEYRPPPVSELATKGTMVGVISAAAINQSIVYSIVSGNEEDTFGINNITGVIYVNGPLDYETRTSYVLRVQADSLEVVLANLRVPSKSNTAKVYIEIQDENNHPPVFQKKFYIGGVSEDARMFTSVLRVKATDKDTGNYSVMAYRLIIPPIKEGKEGFVVETYTGLIKTAMLFHNMRRSYFKFQVIATDDYGKGLSGKADVLVSVVNQLDMQVIVSNVPPTLVEKKIEDLTEILDRYVQEQIPGAKVVVESIGARRHGDAFSLEDYTKCDLTVYAIDPQTNRAIDRNELFKFLDGKLLDINKDFQPYYGEGGRILEIRTPEAVTSIKKRGESLGYTEGALLALAFIIILCCIPAILVVLVSYRQFKVRQAECTKTARIQAALPAAKPAVPAPAPVAAPPPPPPPPPGAHLYEELGDSSMHNLFLLYHFQQSRGNNSVSEDRKHQQVVMPFSSNTIEAHKSAHVDGSLKSNKLKSARKFTFLSDEDDLSAHNPLYKENISQVSTNSDISQRTDFVDPFSPKIQAKSKSLRGPREKIQRLWSQSVSLPRRLMRKVPNRPEIIDLQQWQGTRQKAENENTGICTNKRGSSNPLLTTEEANLTEKEEIRQGETLMIEGTEQLKSLSSDSSFCFPRPHFSFSTLPTVSRTVELKSEPNVISSPAECSLELSPSRPCVLHSSLSRRETPICMLPIETERNIFENFAHPPNISPSACPLPPPPPISPPSPPPAPAPLAPPPDISPFSLFCPPPSPPSIPLPLPPPTFFPLSVSTSGPPTPPLLPPFPTPLPPPPPSIPCPPPPSASFLSTECVCITGVKCTTNLMPAEKIKSSMTQLSTTTVCKTDPQREPKGILRHVKNLAELEKSVANMYSQIEKNYLRTNVSELQTMCPSEVTNMEITSEQNKGSLNNIVEGTEKQSHSQSTSL

SEQ ID NO: 33079 - protein, 1955 aa, Homo sapiens
  ENSP00000322604
MFRQFYLWTCLASGIILGSLFEICLGQYDDDCKLARGGPPATIVAIDEESRNGTILVDNMLIKGTAGGPDPTIELSLKDNVDYWVLMDPVKQMLFLNSTGRVLDRDPPMNIHSIVVQVQCINKKVGTIIYHEVRIVVRDRNDNSPTFKHESYYATVNELTPVGTTIFTGFSGDNGATDIDDGPNGQIEYVIQYNPDDPTSNDTFEIPLMLTGNIVLRKRLNYEDKTRYFVIIQANDRAQNLNERRTTTTTLTVDVLDGDDLGPMFLPCVLVPNTRDCRPLTYQAAIPELRTPEELNPIIVTPPIQAIDQDRNIQPPSDRPGILYSILVGTPEDYPRFFHMHPRTAELSLLEPVNRDFHQKFDLVIKAEQDNGHPLPAFAGLHIEILDENNQSPYFTMPSYQGYILESAPVGATISDSLNLTSPLRIVALDKDIEDTKDPELHLFLNDYTSVFTVTQTGITRYLTLLQPVDREEQQTYTFSITAFDGVQESEPVIVNIQVMDANDNTPTFPEISYDVYVYTDMRPGDSVIQLTAVDADEGSNGEITYEILVGAQGDFIINKTTGLITIAPGVEMIVGRTYALTVQAADNAPPAERRNSICTVYIEVLPPNNQSPPRFPQLMYSLEISEAMRVGAVLLNLQATDREGDSITYAIENGDPQRVFNLSETTGILTLGKALDRESTDRYILIITASDGRPDGTSTATVNIVVTDVNDNAPVFDPYLPRNLSVVEEEANAFVGQVKATDPDAGINGQVHYSLGNFNNLFRITSNGSIYTAVKLNREVRDYYELVVVATDGAVHPRHSTLTLAIKVLDIDDNSPVFTNSTYTVLVEENLPAGTTILQIEAKDVDLGANVSYRIRSPEVKHFFALHPFTGELSLLRSLDYEAFPDQEASITFLVEAFDIYGTMPPGIATVTVIVKDMNDYPPVFSKRIYKGMVAPDAVKGTPITTVYAEDADPPGLPASRVRYRVDDVQFPYPASIFEVEEDSGRVITRVNLNEEPTTIFKLVVVAFDDGEPVMSSSATVKILVLHPGEIPRFTQEEYRPPPVSELATKGTMVGVISAAAINQSIVYSIVSGNEEDTFGINNITGVIYVNGPLDYETRTSYVLRVQADSLEVVLANLRVPSKSNTAKVYIEIQDENNHPPVFQKKFYIGGVSEDARMFTSVLRVKATDKDTGNYSVMAYRLIIPPIKEGKEGFVVETYTGLIKTAMLFHNMRRSYFKFQVIATDDYGKGLSGKADVLVSVVNQLDMQVIVSNVPPTLVEKKIEDLTEILDRYVQEQIPGAKVVVESIGARRHGDAFSLEDYTKCDLTVYAIDPQTNRAIDRNELFKFLDGKLLDINKDFQPYYGEGGRILEIRTPEAVTSIKKRGESLGYTEGALLALAFIIILCCIPAILVVLVSYRQFKVRQAECTKTARIQAALPAAKPAVPAPAPVAAPPPPPPPPPGAHLYEELGDSSILFLLYHFQQSRGNNSVSEDRKHQQVVMPFSSNTIEAHKSAHVDGSLKSNKLKSARKFTFLSDEDDLSAHNPLYKENISQVSTNSDISQRTDFVDPFSPKIQAKSKSLRGPREKIQRLWSQSVSLPRRLMRKVPNRPEIIDLQQWQGTRQKAENENTGICTNKRGSSNPLLTTEEANLTEKEEIRQGETLMIEGTEQLKSLSSDSSFCFPRPHFSFSTLPTVSRTVELKSEPNVISSPAECSLELSPSRPCVLHSSLSRRETPICMLPIETERNIFENFAHPPNISPSACPLPPPPPISPPSPPPAPAPLAPPPDISPFSLFCPPPSPPSIPLPLPPPTFFPLSVSTSGPPTPPLLPPFPTPLPPPPPSIPCPPPPSASFLSTECVCITGVKCTTNLMPAEKIKSSMTQLSTTTVCKTDPQREPKGILRHVKNLAELEKSVANMYSQIEKNYLRTNVSELQTMCPSEVTNMEITSEQNKGSLNNIVEGTEKQSHSQSTSL

SEQ ID NO: 33080 - protein, 961 aa, Homo sapiens
  ENSP00000363066
MFRQFYLWTCLASGIILGSLFEICLGQYDDDCKLARGGPPATIVAIDEESRNGTILVDNMLIKGTAGGPDPTIELSLKDNVDYWVLMDPVKQMLFLNSTGRVLDRDPPMNIHSIVVQVQCINKKVGTIIYHEVRIVVRDRNDNSPTFKHESYYATVNELTPVGTTIFTGFSGDNGATDIDDGPNGQIEYVIQYNPDDPTSNDTFEIPLMLTGNIVLRKRLNYEDKTRYFVIIQANDRAQNLNERRTTTTTLTVDVLDGDDLGPMFLPCVLVPNTRDCRPLTYQAAIPELRTPEELNPIIVTPPIQAIDQDRNIQPPSDRPGILYSILVGTPEDYPRFFHMHPRTAELSLLEPVNRDFHQKFDLVIKAEQDNGHPLPAFAGLHIEILDENNQSPYFTMPSYQGYILESAPVGATISDSLNLTSPLRIVALDKDIEDTKDPELHLFLNDYTSVFTVTQTGITRYLTLLQPVDREEQQTYTFSITAFDGVQESEPVIVNIQVMDANDNTPTFPEISYDVYVYTDMRPGDSVIQLTAVDADEGSNGEITYEILVGAQGDFIINKTTGLITIAPGVEMIVGRTYALTVQAADNAPPAERRNSICTVYIEVLPPNNQSPPRFPQLMYSLEISEAMRVGAVLLNLQATDREGDSITYAIENGDPQRVFNLSETTGILTLGKALDRESTDRYILIITASDGRPDGTSTATVNIVVTDVNDNAPVFDPYLPRNLSVVEEEANAFVGQVKATDPDAGINGQVHYSLGNFNNLFRITSNGSIYTAVKLNREVRDYYELVVVATDGAVHPRHSTLTLAIKVLDIDDNSPVFTNSTYTVLVEENLPAGTTILQIEAKDVDLGANVSYRIRSPEVKHFFALHPFTGELSLLRSLDYEAFPDQEASITFLVEAFDIYGTMPPGIATVTVIVKDMNDYPPVFSKRIYKGMVAPDAVKGTPITTVYAEDADPPVSRRH

SEQ ID NO: 33081 - protein, 72 aa, Homo sapiens
  ENSP00000481211
MFRQFYLWTCLASGIILGSLFEICLGQYDDGTILVDNMLIKGTAGGPDPTIELSLKDNVDYWVLMDPVKQML

SEQ ID NO: 33082 - protein, 92 aa, Homo sapiens
  ENSP00000394465
MFRQFYLWTCLASGIILGSLFEICLGQYDDDCKLARGGPPATIVAIDEESRNGTILVDNMLIKGTAGGPDPTIELSLKDNVDYWVLMDPVKQ

SEQ ID NO: 33083 - protein, 1915 aa, Homo sapiens
  ENSP00000378820
MFRQFYLWTCLASGIILGSLFEICLGQYDDDCKLARGGPPATIVAIDEESRNGTILVDNMLIKGTAGGPDPTIELSLKDNVDYWVLMDPVKQMLFLNSTGRVLDRDPPMNIHSIVVQVQCINKKVGTIIYHEVRIVVRDRNDNSPTFKHESYYATVNELTPVGTTIFTGFSGDNGATDIDDGPNGQIEYVIQYNPDDPDRAQNLNERRTTTTTLTVDVLDGDDLGPMFLPCVLVPNTRDCRPLTYQAAIPELRTPEELNPIIVTPPIQAIDQDRNIQPPSDRPGILYSILVGTPEDYPRFFHMHPRTAELSLLEPVNRDFHQKFDLVIKAEQDNGHPLPAFAGLHIEILDENNQSPYFTMPSYQGYILESAPVGATISDSLNLTSPLRIVALDKDIEDTKDPELHLFLNDYTSVFTVTQTGITRYLTLLQPVDREEQQTYTFSITAFDGVQESEPVIVNIQVMDANDNTPTFPEISYDVYVYTDMRPGDSVIQLTAVDADEGSNGEITYEILVGAQGDFIINKTTGLITIAPGVEMIVGRTYALTVQAADNAPPAERRNSICTVYIEVLPPNNQSPPRFPQLMYSLEISEAMRVGAVLLNLQATDREGDSITYAIENGDPQRVFNLSETTGILTLGKALDRESTDRYILIITASDGRPDGTSTATVNIVVTDVNDNAPVFDPYLPRNLSVVEEEANAFVGQVKATDPDAGINGQVHYSLGNFNNLFRITSNGSIYTAVKLNREVRDYYELVVVATDGAVHPRHSTLTLAIKVLDIDDNSPVFTNSTYTVLVEENLPAGTTILQIEAKDVDLGANVSYRIRSPEVKHFFALHPFTGELSLLRSLDYEAFPDQEASITFLVEAFDIYGTMPPGIATVTVIVKDMNDYPPVFSKRIYKGMVAPDAVKGTPITTVYAEDADPPGLPASRVRYRVDDVQFPYPASIFEVEEDSGRVITRVNLNEEPTTIFKLVVVAFDDGEPVMSSSATVKILVLHPGEIPRFTQEEYRPPPVSELATKGTMVGVISAAAINQSIVYSIVSGNEEDTFGINNITGVIYVNGPLDYETRTSYVLRVQADSLEVVLANLRVPSKSNTAKVYIEIQDENNHPPVFQKKFYIGGVSEDARMFTSVLRVKATDKDTGNYSVMAYRLIIPPIKEGKEGFVVETYTGLIKTAMLFHNMRRSYFKFQVIATDDYGKGLSGKADVLVSVVNQLDMQVIVSNVPPTLVEKKIEDLTEILDRYVQEQIPGAKVVVESIGARRHGDAFSLEDYTKCDLTVYAIDPQTNRAIDRNELFKFLDGKLLDINKDFQPYYGEGGRILEIRTPEAVTSIKKRGESLGYTEGALLALAFIIILCCIPAILVVLVSYRQRQAECTKTARIQAALPAAKPAVPAPAPVAAPPPPPPPPPGAHLYEELGDSSILFLLYHFQQSRGNNSVSEDRKHQQVVMPFSSNTIEAHKSAHVDGSLKSNKLKSARKFTFLSDEDDLSAHNPLYKENISQVSTNSDISQRTDFVDPFSPKIQAKSKSLRGPREKIQRLWSQSVSLPRRLMRKVPNRPEIIDLQQWQGTRQKAENENTGICTNKRGSSNPLLTTEEANLTEKEEIRQGETLMIEGTEQLKSLSSDSSFCFPRPHFSFSTLPTVSRTVELKSEPNVISSPAECSLELSPSRPCVLHSSLSRRETPICMLPIETERNIFENFAHPPNISPSACPLPPPPPISPPSPPPAPAPLAPPPDISPFSLFCPPPSPPSIPLPLPPPTFFPLSVSTSGPPTPPLLPPFPTPLPPPPPSIPCPPPPSASFLSTECVCITGVKCTTNLMPAEKIKSSMTQLSTTTVCKTDPQREPKGILRHVKNLAELEKSVANMYSQIEKNYLRTNVSELQTMCPSEVTNMEITSEQNKGSLNNIVEGTEKQSHSQSTSL

SEQ ID NO: 33084 - protein, 1964 aa, Homo sapiens
  ENSP00000484703
MFRQFYLWTCLASGIILGSLFEICLGQYDDDWQYEDCKLARGGPPATIVAIDEESRNGTILVDNMLIKGTAGGPDPTIELSLKDNVDYWVLMDPVKQMLFLNSTGRVLDRDPPMNIHSIVVQVQCINKKVGTIIYHEVRIVVRDRNDNSPTFKHESYYATVNELTPVGTTIFTGFSGDNGATDIDDGPNGQIEYVIQYNPDDPTSNDTFEIPLMLTGNIVLRKRLNYEDKTRYFVIIQANDRAQNLNERRTTTTTLTVDVLDGDDLGPMFLPCVLVPNTRDCRPLTYQAAIPELRTPEELNPIIVTPPIQAIDQDRNIQPPSDRPGILYSILVGTPEDYPRFFHMHPRTAELSLLEPVNRDFHQKFDLVIKAEQDNGHPLPAFAGLHIEILDENNQSPYFTMPSYQGYILESAPVGATISDSLNLTSPLRIVALDKDIEDTKDPELHLFLNDYTSVFTVTQTGITRYLTLLQPVDREEQQTYTFSITAFDGVQESEPVIVNIQVMDANDNTPTFPEISYDVYVYTDMRPGDSVIQLTAVDADEGSNGEITYEILVGAQGDFIINKTTGLITIAPGVEMIVGRTYALTVQAADNAPPAERRNSICTVYIEVLPPNNQSPPRFPQLMYSLEISEAMRVGAVLLNLQATDREGDSITYAIENGDPQRVFNLSETTGILTLGKALDRESTDRYILIITASDGRPDGTSTATVNIVVTDVNDNAPVFDPYLPRNLSVVEEEANAFVGQVKATDPDAGINGQVHYSLGNFNNLFRITSNGSIYTAVKLNREVRDYYELVVVATDGAVHPRHSTLTLAIKVLDIDDNSPVFTNSTYTVLVEENLPAGTTILQIEAKDVDLGANVSYRIRSPEVKHFFALHPFTGELSLLRSLDYEAFPDQEASITFLVEAFDIYGTMPPGIATVTVIVKDMNDYPPVFSKRIYKGMVAPDAVKGTPITTVYAEDADPPGLPASRVRYRVDDVQFPYPASIFEVEEDSGRVITRVNLNEEPTTIFKLVVVAFDDGEPVMSSSATVKILVLHPGEIPRFTQEEYRPPPVSELATKGTMVGVISAAAINQSIVYSIVSGNEEDTFGINNITGVIYVNGPLDYETRTSYVLRVQADSLEVVLANLRVPSKSNTAKVYIEIQDENNHPPVFQKKFYIGGVSEDARMFTSVLRVKATDKDTGNYSVMAYRLIIPPIKEGKEGFVVETYTGLIKTAMLFHNMRRSYFKFQVIATDDYGKGLSGKADVLVSVVNQLDMQVIVSNVPPTLVEKKIEDLTEILDRYVQEQIPGAKVVVESIGARRHGDAFSLEDYTKCDLTVYAIDPQTNRAIDRNELFKFLDGKLLDINKDFQPYYGEGGRILEIRTPEAVTSIKKRGESLGYTEGALLALAFIIILCCIPAILVVLVSYRQVFKGRQAECTKTARIQAALPAAKPAVPAPAPVAAPPPPPPPPPGAHLYEELGDSSILSSLFLLYHFQQSRGNNSVSEDRKHQQVVMPFSSNTIEAHKSAHVDGSLKSNKLKSARKFTFLSDEDDLSAHNPLYKENISQVSTNSDISQRTDFVDPFSPKIQAKSKSLRGPREKIQRLWSQSVSLPRRLMRKVPNRPEIIDLQQWQGTRQKAENENTGICTNKRGSSNPLLTTEEANLTEKEEIRQGETLMIEGTEQLKSLSSDSSFCFPRPHFSFSTLPTVSRTVELKSEPNVISSPAECSLELSPSRPCVLHSSLSRRETPICMLPIETERNIFENFAHPPNISPSACPLPPPPPISPPSPPPAPAPLAPPPDISPFSLFCPPPSPPSIPLPLPPPTFFPLSVSTSGPPTPPLLPPFPTPLPPPPPSIPCPPPPSASFLSTECVCITGVKCTTNLMPAEKIKSSMTQLSTTTVCKTDPQREPKGILRHVKNLAELEKSVANMYSQIEKNYLRTNVSELQTMCPSEVTNMEITSEQNKGSLNNIVEGTEKQSHSQSTSL

SEQ ID NO: 33085 - protein, 1681 aa, Homo sapiens
  ENSP00000478512
MFRQFYLWTCLASGIILGSLFEICLGQYDDDWQYEDCKLARGGPPATIVAIDEESRNGTILVDNMLIKGTAGGPDPTIELSLKDNVDYWVLMDPVKQMLFLNSTGRVLDRDPPMNIHSIVVQVQCINKKVGTIIYHEVRIVVRDRNDNSPTFKHESYYATVNELTPVGTTIFTGFSGDNGATDIDDGPNGQIEYVIQYNPDDPTSNDTFEIPLMLTGNIVLRKRLNYEDKTRYFVIIQANDRAQNLNERRTTTTTLTVDVLDGDDLGPMFLPCVLVPNTRDCRPLTYQAAIPELRTPEELNPIIVTPPIQAIDQDRNIQPPSDRPGILYSILVGTPEDYPRFFHMHPRTAELSLLEPVNRDFHQKFDLVIKAEQDNGHPLPAFAGLHIEILDENNQSPYFTMPSYQGYILESAPVGATISDSLNLTSPLRIVALDKDIEDTKDPELHLFLNDYTSVFTVTQTGITRYLTLLQPVDREEQQTYTFSITAFDGVQESEPVIVNIQVMDANDNTPTFPEISYDVYVYTDMRPGDSVIQLTAVDADEGSNGEITYEILVGAQGDFIINKTTGLITIAPGVEMIVGRTYALTVQAADNAPPAERRNSICTVYIEVLPPNNQSPPRFPQLMYSLEISEAMRVGAVLLNLQATDREGDSITYAIENGDPQRVFNLSETTGILTLGKALDRESTDRYILIITASDGRPDGTSTATVNIVVTDVNDNAPVFDPYLPRNLSVVEEEANAFVGQVKATDPDAGINGQVHYSLGNFNNLFRITSNGSIYTAVKLNREVRDYYELVVVATDGAVHPRHSTLTLAIKVLDIDDNSPVFTNSTYTVLVEENLPAGTTILQIEAKDVDLGANVSYRIRSPEVKHFFALHPFTGELSLLRSLDYEAFPDQEASITFLVEAFDIYGTMPPGIATVTVIVKDMNDYPPVFSKRIYKGMVAPDAVKGTPITTVYAEDADPPGLPASRVRYRVDDVQFPYPASIFEVEEDSGRVITRVNLNEEPTTIFKLVVVAFDDGEPVMSSSATVKILVLHPGEIPRFTQEEYRPPPVSELATKGTMVGVISAAAINQSIVYSIVSGNEEDTFGINNITGVIYVNGPLDYETRTSYVLRVQADSLEVVLANLRVPSKSNTAKVYIEIQDENNHPPVFQKKFYIGGVSEDARMFTSVLRVKATDKDTGNYSVMAYRLIIPPIKEGKEGFVVETYTGLIKTAMLFHNMRRSYFKFQVIATDDYGKGLSGKADVLVSVVNQLDMQVIVSNVPPTLVEKKIEDLTEILDRYVQEQIPGAKVVVESIGARRHGDAFSLEDYTKCDLTVYAIDPQTNRAIDRNELFKFLDGKLLDINKDFQPYYGEGGRILEIRTPEAVTSIKKRGESLGYTEGALLALAFIIILCCIPAILVVLVSYRQVFKGRQAECTKTARIQAALPAAKPAVPAPAPVAAPPPPPPPPPGAHLYEELGDSSMYEMPQYGSRRRLLPPAGQEEYGEVVGEAEEEYEEEEWARKRMIKLVVDREYETSSTGEDSAPECQRNRLHHPSIHSNINGNIYIAQNGSVVRTRRACLTDNLKVASPVRLGGPFKKLDKLAVTHEENVPLNTLSKGPFSTEKMNARPTLVTFAPCPVGTDNTAVKPLRNRLKSTVEQESMIDSKNIKEALEFHSDHTQSDDEELWMGPWNNLHIPMTKL

SEQ ID NO: 33086 - protein, 1888 aa, Homo sapiens
  ENSP00000482329
MFRQFYLWTCLASGIILGSLFEICLGQYDDDCKLARGGPPATIVAIDEESRNGTILVDNMLIKGTAGGPDPTIELSLKDNVDYWVLMDPVKQMLFLNSTGRVLDRDPPMNIHSIVVQVQCINKKVGTIIYHEVRIVVRDRNDNSPTFKHESYYATVNELTPVGTTIFTGFSGDNGATDIDDGPNGQIEYVIQYNPDDPTSNDTFEIPLMLTGNIVLRKRLNYEDKTRYFVIIQANDRAQNLNERRTTTTTLTVDVLDGDDLGPMFLPCVLVPNTRDCRPLTYQAAIPELRTPEELNPIIVTPPIQAIDQDRNIQPPSDRPGILYSILVGTPEDYPRFFHMHPRTAELSLLEPVNRDFHQKFDLVIKAEQDNGHPLPAFAGLHIEILDENNQSPYFTMPSYQGYILESAPVGATISDSLNLTSPLRIVALDKDIEDTKDPELHLFLNDYTSVFTVTQTGITRYLTLLQPVDREEQQTYTFSITAFDGVQESEPVIVNIQVMDANDNTPTFPEISYDVYVYTDMRPGDSVIQLTAVDADEGSNGEITYEILVGAQGDFIINKTTGLITIAPGVEMIVGRTYALTVQAADNAPPAERSTGILTLGKALDRESTDRYILIITASDGRPDGTSTATVNIVVTDVNDNAPVFDPYLPRNLSVVEEEANAFVGQVKATDPDAGINGQVHYSLGNFNNLFRITSNGSIYTAVKLNREVRDYYELVVVATDGAVHPRHSTLTLAIKVLDIDDNSPVFTNSTYTVLVEENLPAGTTILQIEAKDVDLGANVSYRIRSPEVKHFFALHPFTGELSLLRSLDYEAFPDQEASITFLVEAFDIYGTMPPGIATVTVIVKDMNDYPPVFSKRIYKGMVAPDAVKGTPITTVYAEDADPPGLPASRVRYRVDDVQFPYPASIFEVEEDSGRVITRVNLNEEPTTIFKLVVVAFDDGEPVMSSSATVKILVLHPGEIPRFTQEEYRPPPVSELATKGTMVGVISAAAINQSIVYSIVSGNEEDTFGINNITGVIYVNGPLDYETRTSYVLRVQADSLEVVLANLRVPSKSNTAKVYIEIQDENNHPPVFQKKFYIGGVSEDARMFTSVLRVKATDKDTGNYSVMAYRLIIPPIKEGKEGFVVETYTGLIKTAMLFHNMRRSYFKFQVIATDDYGKGLSGKADVLVSVVNQLDMQVIVSNVPPTLVEKKIEDLTEILDRYVQEQIPGAKVVVESIGARRHGDAFSLEDYTKCDLTVYAIDPQTNRAIDRNELFKFLDGKLLDINKDFQPYYGEGGRILEIRTPEAVTSIKKRGESLGYTEGALLALAFIIILCCIPAILVVLVSYRQVFKGRQAECTKTARIQAALPAAKPAVPAPAPVAAPPPPPPPPPGAHLYEELGDSSILSSLFLLYHFQQSRGNNSVSEDRKHQQVVMPFSSNTIEAHKSAHVDGSLKSNKLKSARKFTFLSDEDDLSAHNPLYKENISQVSTNSDISQRTDFVDPFSPKIQAKSKSLRGPREKIQRLWSQSVSLPRRLMRKVPNRPEIIDLQQWQGTRQKAENENTGICTNKRGSSNPLLTTEEANLTEKEEIRQGETLMIEGTEQLKSLSSDSSFCFPRPHFSFSTLPTVSRTVELKSEPNVISSPAECSLELSPSRPCVLHSSLSRRETPICMLPIETERNIFENFAHPPNISPSACPLPPPPPISPPSPPPAPAPLAPPPDISPFSLFCPPPSPPSIPLPLPPPTFFPLSVSTSGPPTPPLLPPFPTPLPPPPPSIPCPPPPSASFLSTECVCITGVKCTTNLMPAEKIKSSMTQLSTTTVCKTDPQREPKGILRHVKNLAELEKSVANMYSQIEKNYLRTNVSELQTMCPSEVTNMEITSEQNKGSLNNIVEGTEKQSHSQSTSL

SEQ ID NO: 33087 - protein, 1676 aa, Homo sapiens
  ENSP00000410304
MFRQFYLWTCLASGIILGSLFEICLGQYDDDCKLARGGPPATIVAIDEESRNGTILVDNMLIKGTAGGPDPTIELSLKDNVDYWVLMDPVKQMLFLNSTGRVLDRDPPMNIHSIVVQVQCINKKVGTIIYHEVRIVVRDRNDNSPTFKHESYYATVNELTPVGTTIFTGFSGDNGATDIDDGPNGQIEYVIQYNPDDPTSNDTFEIPLMLTGNIVLRKRLNYEDKTRYFVIIQANDRAQNLNERRTTTTTLTVDVLDGDDLGPMFLPCVLVPNTRDCRPLTYQAAIPELRTPEELNPIIVTPPIQAIDQDRNIQPPSDRPGILYSILVGTPEDYPRFFHMHPRTAELSLLEPVNRDFHQKFDLVIKAEQDNGHPLPAFAGLHIEILDENNQSPYFTMPSYQGYILESAPVGATISDSLNLTSPLRIVALDKDIEDTKDPELHLFLNDYTSVFTVTQTGITRYLTLLQPVDREEQQTYTFSITAFDGVQESEPVIVNIQVMDANDNTPTFPEISYDVYVYTDMRPGDSVIQLTAVDADEGSNGEITYEILVGAQGDFIINKTTGLITIAPGVEMIVGRTYALTVQAADNAPPAERRNSICTVYIEVLPPNNQSPPRFPQLMYSLEISEAMRVGAVLLNLQATDREGDSITYAIENGDPQRVFNLSETTGILTLGKALDRESTDRYILIITASDGRPDGTSTATVNIVVTDVNDNAPVFDPYLPRNLSVVEEEANAFVGQVKATDPDAGINGQVHYSLGNFNNLFRITSNGSIYTAVKLNREVRDYYELVVVATDGAVHPRHSTLTLAIKVLDIDDNSPVFTNSTYTVLVEENLPAGTTILQIEAKDVDLGANVSYRIRSPEVKHFFALHPFTGELSLLRSLDYEAFPDQEASITFLVEAFDIYGTMPPGIATVTVIVKDMNDYPPVFSKRIYKGMVAPDAVKGTPITTVYAEDADPPGLPASRVRYRVDDVQFPYPASIFEVEEDSGRVITRVNLNEEPTTIFKLVVVAFDDGEPVMSSSATVKILVLHPGEIPRFTQEEYRPPPVSELATKGTMVGVISAAAINQSIVYSIVSGNEEDTFGINNITGVIYVNGPLDYETRTSYVLRVQADSLEVVLANLRVPSKSNTAKVYIEIQDENNHPPVFQKKFYIGGVSEDARMFTSVLRVKATDKDTGNYSVMAYRLIIPPIKEGKEGFVVETYTGLIKTAMLFHNMRRSYFKFQVIATDDYGKGLSGKADVLVSVVNQLDMQVIVSNVPPTLVEKKIEDLTEILDRYVQEQIPGAKVVVESIGARRHGDAFSLEDYTKCDLTVYAIDPQTNRAIDRNELFKFLDGKLLDINKDFQPYYGEGGRILEIRTPEAVTSIKKRGESLGYTEGALLALAFIIILCCIPAILVVLVSYRQVFKGRQAECTKTARIQAALPAAKPAVPAPAPVAAPPPPPPPPPGAHLYEELGDSSMYEMPQYGSRRRLLPPAGQEEYGEVVGEAEEEYEEEEWARKRMIKLVVDREYETSSTGEDSAPECQRNRLHHPSIHSNINGNIYIAQNGSVVRTRRACLTDNLKVASPVRLGGPFKKLDKLAVTHEENVPLNTLSKGPFSTEKMNARPTLVTFAPCPVGTDNTAVKPLRNRLKSTVEQESMIDSKNIKEALEFHSDHTQSDDEELWMGPWNNLHIPMTKL

SEQ ID NO: 33088 - protein, 1540 aa, Homo sapiens
  ENSP00000378826
MFRQFYLWTCLASGIILGSLFEICLGQYDDDCKLARGGPPATIVAIDEESRNGTILVDNMLIKGTAGGPDPTIELSLKDNVDYWVLMDPVKQMLFLNSTGRVLDRDPPMNIHSIVVQVQCINKKVGTIIYHEVRIVVRDRNDNSPTFKHESYYATVNELTPVGTTIFTGFSGDNGATDIDDGPNGQIEYVIQYNPDDPTSNDTFEIPLMLTGNIVLRKRLNYEDKTRYFVIIQANDRAQNLNERRTTTTTLTVDVLDGDDLGPMFLPCVLVPNTRDCRPLTYQAAIPELRTPEELNPIIVTPPIQAIDQDRNIQPPSDRPGILYSILVGTPEDYPRFFHMHPRTAELSLLEPVNRDFHQKFDLVIKAEQDNGHPLPAFAGLHIEILDENNQSPYFTMPSYQGYILESAPVGATISDSLNLTSPLRIVALDKDIEDTKDPELHLFLNDYTSVFTVTQTGITRYLTLLQPVDREEQQTYTFSITAFDGVQESEPVIVNIQVMDANDNTPTFPEISYDVYVYTDMRPGDSVIQLTAVDADEGSNGEITYEILVGAQGDFIINKTTGLITIAPGVEMIVGRTYALTVQAADNAPPAERRNSICTVYIEVLPPNNQSPPRFPQLMYSLEISEAMRVGAVLLNLQATDREGDSITYAIENGDPQRVFNLSETTGILTLGKALDRESTDRYILIITASDGRPDGTSTATVNIVVTDVNDNAPVFDPYLPRNLSVVEEEANAFVGQVKATDPDAGINGQVHYSLGNFNNLFRITSNGSIYTAVKLNREVRDYYELVVVATDGAVHPRHSTLTLAIKVLDIDDNSPVFTNSTYTVLVEENLPAGTTILQIEAKDVDLGANVSYRIRSPEVKHFFALHPFTGELSLLRSLDYEAFPDQEASITFLVEAFDIYGTMPPGIATVTVIVKDMNDYPPVFSKRIYKGMVAPDAVKGTPITTVYAEDADPPGLPASRVRYRVDDVQFPYPASIFEVEEDSGRVITRVNLNEEPTTIFKLVVVAFDDGEPVMSSSATVKILVLHPGEIPRFTQEEYRPPPVSELATKGTMVGVISAAAINQSIVYSIVSGNEEDTFGINNITGVIYVNGPLDYETRTSYVLRVQADSLEVVLANLRVPSKSNTAKVYIEIQDENNHPPVFQKKFYIGGVSEDARMFTSVLRVKATDKDTGNYSVMAYRLIIPPIKEGKEGFVVETYTGLIKTAMLFHNMRRSYFKFQVIATDDYGKGLSGKADVLVSVVNQLDMQVIVSNVPPTLVEKKIEDLTEILDRYVQEQIPGAKVVVESIGARRHGDAFSLEDYTKCDLTVYAIDPQTNRAIDRNELFKFLDGKLLDINKDFQPYYGEGGRILEIRTPEAVTSIKKRGESLGYTEGALLALAFIIILCCIPAILVVLVSYRQVFKGRQAECTKTARIQAALPAAKPAVPAPAPVAAPPPPPPPPPGAHLYEELGDSSMNRNYPWSLELILARNMDKIITVMSMGMKCLNMGVAVDCYHQLDRRNMVRWLVKLRKNMRRKRKSQRKLKNQRLKLESLVRRKK

SEQ ID NO: 33089 - protein, 1789 aa, Homo sapiens
  ENSP00000482921
MFRQFYLWTCLASGIILGSLFEICLGQYDDDWQYEDCKLARGGPPATIVAIDEESRNGTILVDNMLIKGTAGGPDPTIELSLKDNVDYWVLMDPVKQMLFLNSTGRVLDRDPPMNIHSIVVQVQCINKKVGTIIYHEVRIVVRDRNDNSPTFKHESYYATVNELTPVGTTIFTGFSGDNGATDIDDGPNGQIEYVIQYNPDDPTSNDTFEIPLMLTGNIVLRKRLNYEDKTRYFVIIQANDRAQNLNERRTTTTTLTVDVLDGDDLGPMFLPCVLVPNTRDCRPLTYQAAIPELRTPEELNPIIVTPPIQAIDQDRNIQPPSDRPGILYSILVGTPEDYPRFFHMHPRTAELSLLEPVNRDFHQKFDLVIKAEQDNGHPLPAFAGLHIEILDENNQSPYFTMPSYQGYILESAPVGATISDSLNLTSPLRIVALDKDIEDVPPSGVPTKDPELHLFLNDYTSVFTVTQTGITRYLTLLQPVDREEQQTYTFSITAFDGVQESEPVIVNIQVMDANDNTPTFPEISYDVYVYTDMRPGDSVIQLTAVDADEGSNGEITYEILVGAQGDFIINKTTGLITIAPGVEMIVGRTYALTVQAADNAPPAERRNSICTVYIEVLPPNNQSPPRFPQLMYSLEISEAMRVGAVLLNLQATDREGDSITYAIENGDPQRVFNLSETTGILTLGKALDRESTDRYILIITASDGRPDGTSTATVNIVVTDVNDNAPVFDPYLPRNLSVVEEEANAFVGQVKATDPDAGINGQVHYSLGNFNNLFRITSNGSIYTAVKLNREVRDYYELVVVATDGAVHPRHSTLTLAIKVLDIDDNSPVFTNSTYTVLVEENLPAGTTILQIEAKDVDLGANVSYRIRSPEVKHFFALHPFTGELSLLRSLDYEAFPDQEASITFLVEAFDIYGTMPPGIATVTVIVKDMNDYPPVFSKRIYKGMVAPDAVKGTPITTVYAEDADPPGLPASRVRYRVDDVQFPYPASIFEVEEDSGRVITRVNLNEEPTTIFKLVVVAFDDGEPVMSSSATVKILVLHPGEIPRFTQEEYRPPPVSELATKGTMVGVISAAAINQSIVYSIVSGNEEDTFGINNITGVIYVNGPLDYETRTSYVLRVQADSLEVVLANLRVPSKSNTAKVYIEIQDENNHPPVFQKKFYIGGVSEDARMFTSVLRVKATDKDTGNYSVMAYRLIIPPIKEGKEGFVVETYTGLIKTAMLFHNMRRSYFKFQVIATDDYGKGLSGKADVLVSVVNQLDMQVIVSNVPPTLVEKKIEDLTEILDRYVQEQIPGAKVVVESIGARRHGDAFSLEDYTKCDLTVYAIDPQTNRAIDRNELFKFLDGKLLDINKDFQPYYGEGGRILEIRTPEAVTSIKKRGESLGYTEGALLALAFIIILCCIPAILVVLVSYRQVFKGRQAECTKTARIQAALPAAKPAVPAPAPVAAPPPPPPPPPGAHLYEELGDSSMYEMPQYGSRRRLLPPAGQEEYGEVVGEAEEEYEEEEEEPKKIKKPKVEIREPSEEEEVVVTIEKPPAAEPTYTTWKRARIFPMIFKKVRGLADKRGIVDLEGEEWQRRLEEEDKDYLKLTLDQEEATESTVESEEESSSDYTEYSEEESEFSESETTEEESESETPSEEEESSTPESEESESTESEGEKARKNIVLARRRPMVEEVKEVKGRKEEPQEEQKEPKMEEEEHSEEEESGPAPVEESTDPEAQDIPEEGSAESASVEGGVESEEESESGSSSSSSESQSGGPWGYQVPAYDRSKNANQKKSPGANSEGYNTAL

SEQ ID NO: 33090 - protein, 889 aa, Homo sapiens
  ENSP00000432899
MYLSICCCFLLWAPALTLKNLNYSVPEEQGAGTVIGNIGRDARLQPGLPPAERGGGGRSKSGSYRVLENSAPHLLDVDADSGLLYTKQRIDRESLCRHNAKCQLSLEVFANDKEICMIKVEIQDINDNAPSFSSDQIEMDISENAAPGTRFPLTSAHDPDAGENGLRTYLLTRDDHGLFGLDVKSRGDGTKFPELVIQKALDREQQNHHTLVLTALDGGEPPRSATVQINVKVIDSNDNSPVFEAPSYLVELPENAPLGTVVIDLNATDADEGPNGEVLYSFSSYVPDRVRELFSIDPKTGLIRVKGNLDYEENGMLEIDVQARDLGPNPIPAHCKVTVKLIDRNDNAPSIGFVSVRQGALSEAAPPGTVIALVRVTDRDSGKNGQLQCRVLGGGGTGGGGGLGGPGGSVPFKLEENYDNFYTVVTDRPLDRETQDEYNVTIVARDGGSPPLNSTKSFAIKILDENDNPPRFTKGLYVLQVHENNIPGEYLGSVLAQDPDLGQNGTVSYSILPSHIGDVSIYTYVSVNPTNGAIYALRSFNFEQTKAFEFKVLAKDSGAPAHLESNATVRVTVLDVNDNAPVIVLPTLQNDTAELQVPRNAGLGYLVSTVRALDSDFGESGRLTYEIVDGNDDHLFEIDPSSGEIRTLHPFWEDVTPVVELVVKVTDHGKPTLSAVAKLIIRSVSGSLPEGVPRVNGEQHHWDMSLPLIVTLSTISIILLAAMITIAVKCKRENKEIRTYNCRIAEYSHPQLGGGKGKKKKINKNDIMLVQSEVEERNAMNVMNVVSSPSLATSPMYFDYQTRLPLSSPRSEVMYLKPASNNLTVPQGHAGCHTSFTGQGTNASETPATRMSIIQTDNFPAEPNYMGSRQQFVQSISVAPRLRTQKEPA

SEQ ID NO: 33091 - protein, 1159 aa, Homo sapiens
  ENSP00000367151
MYLSICCCFLLWAPALTLKNLNYSVPEEQGAGTVIGNIGRDARLQPGLPPAERGGGGRSKSGSYRVLENSAPHLLDVDADSGLLYTKQRIDRESLCRHNAKCQLSLEVFANDKEICMIKVEIQDINDNAPSFSSDQIEMDISENAAPGTRFPLTSAHDPDAGENGLRTYLLTRDDHGLFGLDVKSRGDGTKFPELVIQKALDREQQNHHTLVLTALDGGEPPRSATVQINVKVIDSNDNSPVFEAPSYLVELPENAPLGTVVIDLNATDADEGPNGEVLYSFSSYVPDRVRELFSIDPKTGLIRVKGNLDYEENGMLEIDVQARDLGPNPIPAHCKVTVKLIDRNDNAPSIGFVSVRQGALSEAAPPGTVIALVRVTDRDSGKNGQLQCRVLGGGGTGGGGGLGGPGGSVPFKLEENYDNFYTVVTDRPLDRETQDEYNVTIVARDGGSPPLNSTKSFAIKILDENDNPPRFTKGLYVLQVHENNIPGEYLGSVLAQDPDLGQNGTVSYSILPSHIGDVSIYTYVSVNPTNGAIYALRSFNFEQTKAFEFKVLAKDSGAPAHLESNATVRVTVLDVNDNAPVIVLPTLQNDTAELQVPRNAGLGYLVSTVRALDSDFGESGRLTYEIVDGNDDHLFEIDPSSGEIRTLHPFWEDVTPVVELVVKVTDHGKPTLSAVAKLIIRSVSGSLPEGVPRVNGEQHHWDMSLPLIVTLSTISIILLAAMITIAVKCKRENKEIRTYNCRIAEYSHPQLGGGKGKKKKINKNDIMLVQSEVEERNAMNVMNVVSSPSLATSPMYFDYQTRLPLSSPRSEVMYLKPASNNLTVPQGHAGCHTSFTGQGTNASETPATRMSIIQTDNFPAEPNYMGSRQQFVQSSSTFKDPERASLRDSGHGDSDQADSDQDTNKGSCCDMSVREALKMKTTSTKSQPLEQEPEECVNCTDECRVLGHSDRCWMPQFPAANQAENADYRTNLFVPTVEANVETETYETVNPTGKKTFCTFGKDKREHTILIANVKPYLKAKRALSPLLQEVPSASSSPTKACIEPCTSTKGSLDGCEAKPGALAEASSQYLPTDSQYLSPSKQPRDPPFMASDQMARVFADVHSRASRDSSEMGAVLEQLDHPNRDLGRESVDAEEVVREIDKLLQDCRGNDPVAVRK

SEQ ID NO: 33092 - protein, 546 aa, Homo sapiens
  ENSP00000481329
LDSDFGESGRLTYEIVDGNDDHLFEIDPSSGEIRTLHPFWEDVTPVVELVVKVTDHGKPTLSAVAKLIIRSVSGSLPEGVPRVNGEQHHWDMSLPLIVTLSTISIILLAAMITIAVKCKRENKEIRTYNCRIAEYSHPQLGGGKGKKKKINKNDIMLVQSEVEERNAMNVMNVVSSPSLATSPMYFDYQTRLPLSSPRSEVMYLKPASNNLTVPQGHAGCHTSFTGQGTNASETPATRMSIIQTDNFPAEPNYMGSRQQFVQSSTFKDPERASLRDSGHGDSDQADSDQDTNKGSCCDMSVREALKMKTTSTKSQPLEQEPEECVNCTDECRVLGHSDRCWMPQFPAANQAENADYRTNLFVPTVEANVETETYETVNPTGKKTFCTFGKDKREHTILIANVKPYLKAKRALSPLLQEVPSASSSPTKACIEPCTSTKGSLDGCEAKPGALAEASSQYLPTDSQYLSPSKQPRDPPFMASDQMARVFADVHSRASRDSSEMGAVLEQLDHPNRDLGRESVDAEEVVREIDKLLQDCRGNDPVAVRK

SEQ ID NO: 33093 - protein, 184 aa, Homo sapiens
  ENSP00000483215
LTVPQGHAGCHTSFTGQGTNASETPATRMSIIQTDNFPAEPNYMGSRQQFVQSSSTFKDPERASLRDSGHGDSDQADSDQDTNKGSCCDMSVREALKMKTTSTKSQPLEQAFPTLLSFAILTLHTITSRLQSVDLLPPEPEECVNCTDECRVLGHSDRCWMPQFPAANQAENADYRTNLFVPTV

SEQ ID NO: 33094 - protein, 1237 aa, Homo sapiens
  ENSP00000367096
MDLRDFYLLAALIACLRLDSAIAQELIYTIREELPENVPIGNIPKDLNISHINAATGTSASLVYRLVSKAGDAPLVKVSSSTGEIFTTSNRIDREKLCAGASYAEENECFFELEVVILPNDFFRLIKIKIIVKDTNDNAPMFPSPVINISIPENTLINSRFPIPSATDPDTGFNGVQHYELLNGQSVFGLDIVETPEGEKWPQLIVQQNLDREQKDTYVMKIKVEDGGTPQKSSTAILQVTVSDVNDNRPVFKEGQVEVHIPENAPVGTSVIQLHATDADIGSNAEIRYIFGAQVAPATKRLFALNNTTGLITVQRSLDREETAIHKVTVLASDGSSTPARATVTINVTDVNDNPPNIDLRYIISPINGTVYLSEKDPVNTKIALITVSDKDTDVNGKVICFIEREVPFHLKAVYDNQYLLETSSLLDYEGTKEFSFKIVASDSGKPSLNQTALVRVKLEDENDNPPIFNQPVIELSVSENNRRGLYLTTISATDEDSGKNADIVYQLGPNASFFDLDRKTGVLTASRVFDREEQERFIFTVTARDNGTPPLQSQAAVIVTVLDENDNSPKFTHNHFQFFVSENLPKYSTVGVITVTDADAGENKAVTLSILNDNDNFVLDPYSGVIKSNVSFDREQQSSYTFDVKATDGGQPPRSSTAKVTINVMDVNDNSPVVISPPSNTSFKLVPLSAIPGSVVAEVFAVDVDTGMNAELKYTIVSGNNKGLFRIDPVTGNITLEEKPAPTDVGLHRLVVNISDLGYPKSLHTLVLVFLYVNDTAGNASYIYDLIRRTMETPLDRNIGDSSQPYQNEDYLTIMIAIIAGAMVVIVVIFVTVLVRCRHASRFKAAQRSKQGAEWMSPNQENKQNKKKKRKKRKSPKSSLLNFVTIEESKPDDAVHEPINGTISLPAELEEQSIGRFDWGPAPPTTFKPNSPDLAKHYKSASPQPAFHLKPDTPVSVKKHHVIQELPLDNTFVGGCDTLSKRSSTSSDHFSASECSSQGGFKTKGPLHTRQCNSHSKSDNIPVTPQKCPSSTGFHIQENEESHYESQRRVTFHLPDGSQESCSDSGLGDHEPVGSGTLISHPLPLVQPQDEFYDQASPDKRTEADGNSDPNSDGPLGPRGLAEATEMCTQECLVLGHSDNCWMPPGLGPYQHPKSPLSTFAPQKEWVKKDKLVNGHTLTRAWKEDSNRNQFNDRKQYGSNEGHFNNGSHMTDIPLANLKSYKQAGGATESPKEHQL

SEQ ID NO: 33095 - protein, 1203 aa, Homo sapiens
  ENSP00000442186
MDLRDFYLLAALIACLRLDSAIAQELIYTIREELPENVPIGNIPKDLNISHINAATGTSASLVYRLVSKAGDAPLVKVSSSTGEIFTTSNRIDREKLCAGASYAEENECFFELEVVILPNDFFRLIKIKIIVKDTNDNAPMFPSPVINISIPENTLINSRFPIPSATDPDTGFNGVQHYELLNGQSVFGLDIVETPEGEKWPQLIVQQNLDREQKDTYVMKIKVEDGGTPQKSSTAILQVTVSDVNDNRPVFKEGQVEVHIPENAPVGTSVIQLHATDADIGSNAEIRYIFGAQVAPATKRLFALNNTTGLITVQRSLDREETAIHKVTVLASDGSSTPARATVTINVTDVNDNPPNIDLRYIISPINGTVYLSEKDPVNTKIALITVSDKDTDVNGKVICFIEREVPFHLKAVYDNQYLLETSSLLDYEGTKEFSFKIVASDSGKPSLNQTALVRVKLEDENDNPPIFNQPVIELSVSENNRRGLYLTTISATDEDSGKNADIVYQLGPNASFFDLDRKTGVLTASRVFDREEQERFIFTVTARDNGTPPLQSQAAVIVTVLDENDNSPKFTHNHFQFFVSENLPKYSTVGVITVTDADAGENKAVTLSILNDNDNFVLDPYSGVIKSNVSFDREQQSSYTFDVKATDGGQPPRSSTAKVTINVMDVNDNSPVVISPPSNTSFKLVPLSAIPGSVVAEVFAVDVDTGMNAELKYTIVSGNNKGLFRIDPVTGNITLEEKPAPTDVGLHRLVVNISDLGYPKSLHTLVLVFLYVNDTAGNASYIYDLIRRTMETPLDRNIGDSSQPYQNEDYLTIMIAIIAGAMVVIVVIFVTVLVRCRHASRFKAAQRSKQGAEWMSPNQENKQNKKKKRKKRKSPKSSLLNFVTIEESKPDDAVHEPINGTISLPAELEEQSIGRFDWGPAPPTTFKPNSPDLAKHYKSASPQPAFHLKPDTPVSVKKHHVIQELPLDNTFVGGCDTLSKRSSTSSDHFSASECSSQGGFKTKGPLHTRQSQRRVTFHLPDGSQESCSDSGLGDHEPVGSGTLISHPLPLVQPQDEFYDQASPDKRTEADGNSDPNSDGPLGPRGLAEATEMCTQECLVLGHSDNCWMPPGLGPYQHPKSPLSTFAPQKEWVKKDKLVNGHTLTRAWKEDSNRNQFNDRKQYGSNEGHFNNGSHMTDIPLANLKSYKQAGGATESPKEHQL

SEQ ID NO: 33096 - protein, 1195 aa, Homo sapiens
  ENSP00000401699
MDLRDFYLLAALIACLRLDSAIAQELIYTIREELPENVPIGNIPKDLNISHINAATGTSASLVYRLVSKAGDAPLVKVSSSTGEIFTTSNRIDREKLCAGASYAEENECFFELEVVILPNDFFRLIKIKIIVKDTNDNAPMFPSPVINISIPENTLINSRFPIPSATDPDTGFNGVQHYELLNGQSVFGLDIVETPEGEKWPQLIVQQNLDREQKDTYVMKIKVEDGGTPQKSSTAILQVTVSDVNDNRPVFKEGQVEVHIPENAPVGTSVIQLHATDADIGSNAEIRYIFGAQVAPATKRLFALNNTTGLITVQRSLDREETAIHKVTVLASDGSSTPARATVTINVTDVNDNPPNIDLRYIISPINGTVYLSEKDPVNTKIALITVSDKDTDVNGKVICFIEREVPFHLKAVYDNQYLLETSSLLDYEGTKEFSFKIVASDSGKPSLNQTALVRVKLEDENDNPPIFNQPVIELSVSENNRRGLYLTTISATDEDSGKNADIVYQLGPNASFFDLDRKTGVLTASRVFDREEQERFIFTVTARDNGTPPLQSQAAVIVTVLDENDNSPKFTHNHFQFFVSENLPKYSTVGVITVTDADAGENKAVTLSILNDNDNFVLDPYSGVIKSNVSFDREQQSSYTFDVKATDGGQPPRSSTAKVTINVMDVNDNSPVVISPPSNTSFKLVPLSAIPGSVVAEVFAVDVDTGMNAELKYTIVSGNNKGLFRIDPVTGNITLEEKPAPTDVGLHRLVVNISDLGYPKSLHTLVLVFLYVNDTAGNASYIYDLIRRTMETPLDRNIGDSSQPYQNEDYLTIMIAIIAGAMVVIVVIFVTVLVRCRHASRFKAAQRSKQGAEWMSPNQENKQNKKKKRKKRKSPKSSLLNFVTIEESKPDDAVHEPINGTISLPAELEEQSIGRFDWGPAPPTTFKPNSPDLAKHYKSASPQPAFHLKPDTPVSVKKHHVIQELPLDNTFVGGCDTLSKRSSTSSDHFSASECSSQGGFKTKGPLHTRQCNSHSKSDNIPVTPQKCPSSTGFHIQENEESHYEPQDEFYDQASPDKRTEADGNSDPNSDGPLGPRGLAEATEMCTQECLVLGHSDNCWMPPGLGPYQHPKSPLSTFAPQKEWVKKDKLVNGHTLTRAWKEDSNRNQFNDRKQYGSNEGHFNNGSHMTDIPLANLKSYKQAGGATESPKEHQL

SEQ ID NO: 33097 - protein, 44 aa, Homo sapiens
  ENSP00000482917
CNSHSKSDNIPVTPQKCPSSTGFHIQENEESHYEGTLPYLRYSL

SEQ ID NO: 33098 - protein, 1032 aa, Homo sapiens
  ENSP00000367092
MDLRDFYLLAALIACLRLDSAIAQELIYTIREELPENVPIGNIPKDLNISHINAATGTSASLVYRLVSKAGDAPLVKVSSSTGEIFTTSNRIDREKLCAGASYAEENECFFELEVVILPNDFFRLIKIKIIVKDTNDNAPMFPSPVINISIPENTLINSRFPIPSATDPDTGFNGVQHYELLNGQSVFGLDIVETPEGEKWPQLIVQQNLDREQKDTYVMKIKVEDGGTPQKSSTAILQVTVSDVNDNRPVFKEGQVEVHIPENAPVGTSVIQLHATDADIGSNAEIRYIFGAQVAPATKRLFALNNTTGLITVQRSLDREETAIHKVTVLASDGSSTPARATVTINVTDVNDNPPNIDLRYIISPINGTVYLSEKDPVNTKIALITVSDKDTDVNGKVICFIEREVPFHLKAVYDNQYLLETSSLLDYEGTKEFSFKIVASDSGKPSLNQTALVRVKLEDENDNPPIFNQPVIELSVSENNRRGLYLTTISATDEDSGKNADIVYQLGPNASFFDLDRKTGVLTASRVFDREEQERFIFTVTARDNGTPPLQSQAAVIVTVLDENDNSPKFTHNHFQFFVSENLPKYSTVGVITVTDADAGENKAVTLSILNDNDNFVLDPYSGVIKSNVSFDREQQSSYTFDVKATDGGQPPRSSTAKVTINVMDVNDNSPVVISPPSNTSFKLVPLSAIPGSVVAEVFAVDVDTGMNAELKYTIVSGNNKGLFRIDPVTGNITLEEKPAPTDVGLHRLVVNISDLGYPKSLHTLVLVFLYVNDTAGNASYIYDLIRRTMETPLDRNIGDSSQPYQNEDYLTIMIAIIAGAMVVIVVIFVTVLVRCRHASRFKAAQRSKQGAEWMSPNQENKQNKKKKRKKRKSPKSSLLNFVTIEESKPDDAVHEPINGTISLPAELEEQSIGRFDWGPAPPTTFKPNSPDLAKHYKSASPQPAFHLKPDTPVSVKKHHVIQELPLDNTFVGGCDTLSKRSSTSSDHFSASECSSQGGFKTKGPLHTRQVNEHFYWSISTAYKCPVNQY

SEQ ID NO: 33099 - protein, 807 aa, Homo sapiens
  ENSP00000367373
MVFSRRGGLGARDLLLWLLLLAAWEVGSGQLHYSIPEEAKHGTFVGRVAQDLGLELAELVPRLFRVASKTHRDLLEVNLQNGILFVNSRIDREELCQWSAECSIHLELIADRPLQVFHVEVKVKDINDNPPVFRGREQIIFIPESRLLNSRFPIEGAADADIGANALLTYTLSPSDYFSLDVEASDELSKSLWLELRKYLDREETPELHLLLTATDGGKPELQGTVELLITVLDVNDNAPLFDQAVYRVHLLETTANGTLVTTLNASDADEGVNGEVVFSFDSGISRDIQEKFKVDSSSGEIRLIDKLDYEETKSYEIQVKAVDKGSPPMSNHCKVLVKVLDVNDNAPELAVTSLYLPIREDAPLSTVIALITVSDRDSGANGQVTCSLMPHVPFKLVSTFKNYYSLVLDSALDRESLSVYELVVTARDGGSPSLWATARVSVEVADVNDNAPAFAQPEYTVFVKENNPPGCHIFTVSARDADAQENALVSYSLVERRVGERALSNYVSVHAESGKVYALQPLDHEELELLQFQVSARDAGVPPLGSNVTLQVFVLDENDNAPALLAPRVGGTIGAVSELVPRLVGAGHVVAKVRAVDADSGYNAWLSYELQPAAGGARIPFRVGLYTGEISTTRVLDEADLSRYRLLVLVKDHGEPALTATATVLVSLVESGQAPKASSRASVGVAGPEAALVDVNVYLIIAICAVSSLLVLTLLLYTALRCSVPPTEGAYVPGKPTLVCSSALGSWSNSQQRRQRVCSSEGPPKTDLMAFSPGLSPSLNTSERNEQPEANLDLSGNVSPTFEFWL

SEQ ID NO: 33100 - protein, 686 aa, Homo sapiens
  ENSP00000378129
MVFSRRGGLGARDLLLWLLLLAAWEVGSGQLHYSIPEEAKHGTFVGRVAQDLGLELAELVPRLFRVASKTHRDLLEVNLQNGILFVNSRIDREELCQWSAECSIHLELIADRPLQVFHVEVKVKDINDNPPVFRGREQIIFIPESRLLNSRFPIEGAADADIGANALLTYTLSPSDYFSLDVEASDELSKSLWLELRKYLDREETPELHLLLTATDGGKPELQGTVELLITVLDVNDNAPLFDQAVYRVHLLETTANGTLVTTLNASDADEGVNGEVVFSFDSGISRDIQEKFKVDSSSGEIRLIDKLDYEETKSYEIQVKAVDKGSPPMSNHCKVLVKVLDVNDNAPELAVTSLYLPIREDAPLSTVIALITVSDRDSGANGQVTCSLMPHVPFKLVSTFKNYYSLVLDSALDRESLSVYELVVTARDGGSPSLWATARVSVEVADVNDNAPAFAQPEYTVFVKENNPPGCHIFTVSARDADAQENALVSYSLVERRVGERALSNYVSVHAESGKVYALQPLDHEELELLQFQPRQPNPDWRYSASLRAGMHSSVHLEEAGILRAGPGGPDQQWPTVSSATPEPEAGEVSPPVGAGVNSNSWTFKYGPGNPKQSGPGELPDKFIIPGSPAIISIRQEPTNSQIDKSDFITFGKKEETKKKKKKKKGNKTQEKKEKGNSTTDNSDQ

SEQ ID NO: 33101 - protein, 950 aa, Homo sapiens
  ENSP00000420840
MVFSRRGGLGARDLLLWLLLLAAWEVGSGQLHYSIPEEAKHGTFVGRVAQDLGLELAELVPRLFRVASKTHRDLLEVNLQNGILFVNSRIDREELCQWSAECSIHLELIADRPLQVFHVEVKVKDINDNPPVFRGREQIIFIPESRLLNSRFPIEGAADADIGANALLTYTLSPSDYFSLDVEASDELSKSLWLELRKYLDREETPELHLLLTATDGGKPELQGTVELLITVLDVNDNAPLFDQAVYRVHLLETTANGTLVTTLNASDADEGVNGEVVFSFDSGISRDIQEKFKVDSSSGEIRLIDKLDYEETKSYEIQVKAVDKGSPPMSNHCKVLVKVLDVNDNAPELAVTSLYLPIREDAPLSTVIALITVSDRDSGANGQVTCSLMPHVPFKLVSTFKNYYSLVLDSALDRESLSVYELVVTARDGGSPSLWATARVSVEVADVNDNAPAFAQPEYTVFVKENNPPGCHIFTVSARDADAQENALVSYSLVERRVGERALSNYVSVHAESGKVYALQPLDHEELELLQFQVSARDAGVPPLGSNVTLQVFVLDENDNAPALLAPRVGGTIGAVSELVPRLVGAGHVVAKVRAVDADSGYNAWLSYELQPAAGGARIPFRVGLYTGEISTTRVLDEADLSRYRLLVLVKDHGEPALTATATVLVSLVESGQAPKASSRASVGVAGPEAALVDVNVYLIIAICAVSSLLVLTLLLYTALRCSVPPTEGAYVPGKPTLVCSSALGSWSNSQQRRQRVCSSEGPPKTDLMAFSPGLSPSLNTSERNEQPEANLDLSGNPRQPNPDWRYSASLRAGMHSSVHLEEAGILRAGPGGPDQQWPTVSSATPEPEAGEVSPPVGAGVNSNSWTFKYGPGNPKQSGPGELPDKFIIPGSPAIISIRQEPTNSQIDKSDFITFGKKEETKKKKKKKKGNKTQEKKEKGNSTTDNSDQ

SEQ ID NO: 33102 - protein, 950 aa, Homo sapiens
  ENSP00000429808
MLFSWREDPGAQCLLLSLLLLAASEVGSGQLHYSVSEEAKHGTFVGRIAQDLGLELAELVPRLFRVASKRHGDLLEVNLQNGILFVNSRIDREELCGRSAECSIHLEVIVDRPLQVFHVEVEVKDINDNAPVFPMAVKNLFISESRQPGSRFSLEGASDADIGTNSLLTYSLDSTEYFTLDVKRNDEEIKSLGLVLKKNLNREDTPKHYLLITAIDGGKPELTGTTQLKITVLDVNDNAPAFERTIYKVRLLENAPNGTLVVTVNATDLDEGVNKDIAYSFNTDMSADILSKFHLDPVNGQISVKGNIDFEESKSYEIQVEATDKGNPPMSDHCTVLLEIVDINDNVPELVIQSLSLPVLEDSPLSTVIALISVSDRDSGVNGQVTCSLTPHVPFKLVSTFKNYYSLVLDSPLDRESVSAYELVVTARDGGSPSLWATASVSVEVADVNDNAPAFSQSEYTVFVKENNPPGCHIFTVSARDADAQENALVSYSLVERRVGERALSSYVSVHAESGKVYALQPLDHEELELLQFQVSARDAGVPPLGSNVTLQVFVLDENDNAPALLMPRVGGIGGAVSELVPRSVGAGHVVAKVRAVDADSGYNAWLSYELQPGTGGARIPFRVGLYTGEISTTRALDEVDAPRHRLLVLVKDHGEPSLTATATVLVSLVESGQAPKASSQASAGATGPEAALVDVNVYLIVAICAVSSLLVLTLLLYTALRCSAPPTEGDCGPGKPTLVCSSAVGSWSYSQQRQQRVCSGEGLPKTDLMAFSPSLPPCPISRDREEKQDVDVDLSAKPRQPNPDWRYSASLRAGMHSSVHLEEAGILRAGPGGPDQQWPTVSSATPEPEAGEVSPPVGAGVNSNSWTFKYGPGNPKQSGPGELPDKFIIPGSPAIISIRQEPTNSQIDKSDFITFGKKEETKKKKKKKKGNKTQEKKEKGNSTTDNSDQ

SEQ ID NO: 33103 - protein, 824 aa, Homo sapiens
  ENSP00000434086
MLFSWREDPGAQCLLLSLLLLAASEVGSGQLHYSVSEEAKHGTFVGRIAQDLGLELAELVPRLFRVASKRHGDLLEVNLQNGILFVNSRIDREELCGRSAECSIHLEVIVDRPLQVFHVEVEVKDINDNAPVFPMAVKNLFISESRQPGSRFSLEGASDADIGTNSLLTYSLDSTEYFTLDVKRNDEEIKSLGLVLKKNLNREDTPKHYLLITAIDGGKPELTGTTQLKITVLDVNDNAPAFERTIYKVRLLENAPNGTLVVTVNATDLDEGVNKDIAYSFNTDMSADILSKFHLDPVNGQISVKGNIDFEESKSYEIQVEATDKGNPPMSDHCTVLLEIVDINDNVPELVIQSLSLPVLEDSPLSTVIALISVSDRDSGVNGQVTCSLTPHVPFKLVSTFKNYYSLVLDSPLDRESVSAYELVVTARDGGSPSLWATASVSVEVADVNDNAPAFSQSEYTVFVKENNPPGCHIFTVSARDADAQENALVSYSLVERRVGERALSSYVSVHAESGKVYALQPLDHEELELLQFQVSARDAGVPPLGSNVTLQVFVLDENDNAPALLMPRVGGIGGAVSELVPRSVGAGHVVAKVRAVDADSGYNAWLSYELQPGTGGARIPFRVGLYTGEISTTRALDEVDAPRHRLLVLVKDHGEPSLTATATVLVSLVESGQAPKASSQASAGATGPEAALVDVNVYLIVAICAVSSLLVLTLLLYTALRCSAPPTEGDCGPGKPTLVCSSAVGSWSYSQQRQQRVCSGEGLPKTDLMAFSPSLPPCPISRDREEKQDVDVDLSAKVSNFYLFFPKCLCFSFLNVSTPLEIH

SEQ ID NO: 33104 - protein, 256 aa, Homo sapiens
  ENSP00000337500
MATQRKHLVKDFNPYITCYICKGYLIKPTTVTECLHTFCKTCIVQHFEDSNDCPRCGNQVHETNPLEMLRLDNTLEEIIFKLVPGLREQELERESEFWKKNKPQENGQDDTSKADKPKVDEEGDENEDDKDYHRSDPQIAICLDCLRNNGQSGDNVVKGLMKKFIRCSTRVTVGTIKKFLSLKLKLPSSYELDVLCNGEIMGKDHTMEFIYMTRWRLRGENFRCLNCSASQVCSQDGPLYQSYPMVLQYRPRIDFG

SEQ ID NO: 33105 - protein, 256 aa, Homo sapiens; identical to SEQ ID NO: 33104
  ENSP00000445704

SEQ ID NO: 33106 - protein, 256 aa, Homo sapiens; identical to SEQ ID NO: 33104
  ENSP00000479492

SEQ ID NO: 33107 - protein, 622 aa, Homo sapiens
  ENSP00000319814
MPPQLQNGLNLSAKVVQGSLDSLPQAVREFLENNAELCQPDHIHICDGSEEENGRLLGQMEEEGILRRLKKYDNCWLALTDPRDVARIESKTVIVTQEQRDTVPIPKTGLSQLGRWMSEEDFEKAFNARFPGCMKGRTMYVIPFSMGPLGSPLSKIGIELTDSPYVVASMRIMTRMGTPVLEAVGDGEFVKCLHSVGCPLPLQKPLVNNWPCNPELTLIAHLPDRREIISFGSGYGGNSLLGKKCFALRMASRLAKEEGWLAEHMLILGITNPEGEKKYLAAAFPSACGKTNLAMMNPSLPGWKVECVGDDIAWMKFDAQGHLRAINPENGFFGVAPGTSVKTNPNAIKTIQKNTIFTNVAETSDGGVYWEGIDEPLASGVTITSWKNKEWSSEDGEPCAHPNSRFCTPASQCPIIDAAWESPEGVPIEGIIFGGRRPAGVPLVYEALSWQHGVFVGAAMRSEATAAAEHKGKIIMHDPFAMRPFFGYNFGKYLAHWLSMAQHPAAKLPKIFHVNWFRKDKEGKFLWPGFGENSRVLEWMFNRIDGKASTKLTPIGYIPKEDALNLKGLGHINMMELFSISKEFWEKEVEDIEKYLEDQVNADLPCEIEREILALKQRISQM

SEQ ID NO: 33108 - protein, 120 aa, Homo sapiens
  ENSP00000472761
MAGSPDQEGFFNLLSHVQGDRMEGQRCSLQAGPGQTTKSQSDPTPEMDSLMDMLASTQGRRMDDQRVTVSSLPGFQPVGSKDGAQKRAGTLSPQPLLTPQDPTALGFRRNSSPQPPTQAP

SEQ ID NO: 33109 - protein, 136 aa, Homo sapiens
  ENSP00000310585
MMDQEEKTEEGSGPCAEAGSPDQEGFFNLLSHVQGDRMEGQRCSLQAGPGQTTKSQSDPTPEMDSLMDMLASTQGRRMDDQRVTVSSLPGFQPVGSKDGAQKRAGTLSPQPLLTPQDPTALGFRRNSSPQPPTQAP

SEQ ID NO: 33110 - protein, 62 aa, Homo sapiens
  ENSP00000329403
MSERQGAGATNGKDKTSGENDGQKKVQEEFDIDMDAPETERAAVAIQSQFRKFQKKKAGSQS

SEQ ID NO: 33111 - protein, 31 aa, Homo sapiens
  ENSP00000433172
MSERQGAGATNGKDKTSGENVGCPILFLTHS

SEQ ID NO: 33112 - protein, 77 aa, Homo sapiens
  ENSP00000452839
  MOD_RES (1)..(1): Any amino acid
XGLPHKVCRRCDENCLSCAGSSRNCSRCKTGFTQLGTSCITNHTCSNGDIWQRLETFWVVTTGRMYSHPVGGGQECC

SEQ ID NO: 33113 - protein, 125 aa, Homo sapiens
  ENSP00000453771
AEGQWTLEIQDLPSQVRNPEKQGKLKEWSLILYGTAEHPYHTFSAHQSRSRMLELSAPELEPPKAALSPSQVEVPEDEEDYTAQSTPGSANILQTRDIWQRLETFWVVTTGRMYSHPVGGGQECC

SEQ ID NO: 33114 - protein, 969 aa, Homo sapiens
  ENSP00000482760
MPPRAPPAPGPRPPPRAAAATDTAAGAGGAGGAGGAGGPGFRPLAPRPWRWLLLLALPAACSAPPPRPVYTNHWAVQVLGGPAEADRVAAAHGYLNLGQIGNLEDYYHFYHSKTFKRSTLSSRGPHTFLRMDPQVKWLQQQEVKRRVKRQVRSDPQALYFNDPIWSNMWYLHCGDKNSRCRSEMNVQAAWKRGYTGKNVVVTILDDGIERNHPDLAPNYDSYASYDVNGNDYDPSPRYDASNENKHGTRCAGEVAASANNSYCIVGIAYNAKIGGIRMLDGDVTDVVEAKSLGIRPNYIDIYSASWGPDDDGKTVDGPGRLAKQAFEYGIKKGRQGLGSIFVWASGNGGREGDYCSCDGYTNSIYTISVSSATENGYKPWYLEECASTLATTYSSGAFYERKIVTTDLRQRCTDGHTGTSVSAPMVAGIIALALEANSQLTWRDVQHLLVKTSRPAHLKASDWKVNGAGHKVSHFYGFGLVDAEALVVEAKKWTAVPSQHMCVAASDKRPRSIPLVQVLRTTALTSACAEHSDQRVVYLEHVVVRTSISHPRRGDLQIYLVSPSGTKSQLLAKRLLDLSNEGFTNWEFMTVHCWGEKAEGQWTLEIQDLPSQVRNPEKQGKLKEWSLILYGTAEHPYHTFSAHQSRSRMLELSAPELEPPKAALSPSQVEVPEDEEDYTAQSTPGSANILQTSVCHPECGDKGCDGPNADQCLNCVHFSLGSVKTSRKCVSVCPLGYFGDTAARRCRRCHKGCETCSSRAATQCLSCRRGFYHHQEMNTCVTLCPAGFYADESQKNCLKCHPSCKKCVDEPEKCTVCKEGFSLARGSCIPDCEPGTYFDSELIRCGECHHTCGTCVGPGREECIHCAKNFHFHDWKCVPACGEGFYPEEMPGLPHKVCRRCDENCLSCAGSSRNCSRCKTGFTQLGTSCITNHTCSNADETFCEMVKSNRLCERKLFIQFCCRTCLLAG

SEQ ID NO: 33115 - protein, 797 aa, Homo sapiens
  ENSP00000381246
QIGNLEDYYHFYHSKTFKRSTLSSRGPHTFLRMDPQVKWLQQQEVKRRVKRQVRSDPQALYFNDPIWSNMWYLHCGDKNSRCRSEMNVQAAWKRGYTGKNVVVTILDDGIERNHPDLAPNYDSYASYDVNGNDYDPSPRYDASNENKHGTRCAGEVAASANNSYCIVGIAYNAKIGGIRMLDGDVTDVVEAKSLGIRPNYIDIYSASWGPDDDGKTVDGPGRLAKQAFEYGIKKGRQGLGSIFVWASGNGGREGDYCSCDGYTNSIYTISVSSATENGYKPWYLEECASTLATTYSSGAFYERKIVTTDLRQRCTDGHTGTSVSAPMVAGIIALALEAKSIPLVQVLRTTALTSACAEHSDQRVVYLEHVVVRTSISHPRRGDLQIYLVSPSGTKSQLLAKRLLDLSNEGFTNWEFMTVHCWGEKAEGQWTLEIQDLPSQVRNPEKQGKLKEWSLILYGTAEHPYHTFSAHQSRSRMLELSAPELEPPKAALSPSQVEVPEDEEDYTAQSTPGSANILQTSVCHPECGDKGCDGPNADQCLNCVHFSLGSVKTSRKCVSVCPLGYFGDTAARRCRRCHKGCETCSSRAATQCLSCRRGFYHHQEMNTCVTLCPAGFYADESQKNCLKCHPSCKKCVDEPEKCTVCKEGFSLARGSCIPDCEPGTYFDSELIRCGECHHTCGTCVGPGREECIHCAKNFHFHDWKCVPACGEGFYPEEMPGLPHKVCRRCDENCLSCAGSSRNCSRCKTGFTQLGTSCITNHTCSNADETFCEMVKSNRLCERKLFIQFCCRTCLLAG

SEQ ID NO: 33116 - protein, 956 aa, Homo sapiens
  ENSP00000479496
MPPRAPPAPGPRPPPRAAAATDTAAGAGGAGGAGGAGGPGFRPLAPRPWRWLLLLALPAACSAPPPRPVYTNHWAVQVLGGPAEADRVAAAHGYLNLGQIGNLEDYYHFYHSKTFKRSTLSSRGPHTFLRMDPQVKWLQQQEVKRRVKRQVRSDPQALYFNDPIWSNMWYLHCGDKNSRCRSEMNVQAAWKRGYTGKNVVVTILDDGIERNHPDLAPNYDSYASYDVNGNDYDPSPRYDASNENKHGTRCAGEVAASANNSYCIVGIAYNAKIGGIRMLDGDVTDVVEAKSLGIRPNYIDIYSASWGPDDDGKTVDGPGRLAKQAFEYGIKKGRQGLGSIFVWASGNGGREGDYCSCDGYTNSIYTISVSSATENGYKPWYLEECASTLATTYSSGAFYERKIVTTDLRQRCTDGHTGTSVSAPMVAGIIALALEANSQLTWRDVQHLLVKTSRPAHLKASDWKVNGAGHKVSHFYGFGLVDAEALVVEAKKWTAVPSQHMCVAASDKRPRSIPLVQVLRTTALTSACAEHSDQRVVYLEHVVVRTSISHPRRGDLQIYLVSPSGTKSQLLAKRLLDLSNEGFTNWEFMTVHCWGEKAEGQWTLEIQDLPSQVRNPEKQGKLKEWSLILYGTAEHPYHTFSAHQSRSRMLELSAPELEPPKAALSPSQVEVPEDEEDYTGVCHPECGDKGCDGPNADQCLNCVHFSLGSVKTSRKCVSVCPLGYFGDTAARRCRRCHKGCETCSSRAATQCLSCRRGFYHHQEMNTCVTLCPAGFYADESQKNCLKCHPSCKKCVDEPEKCTVCKEGFSLARGSCIPDCEPGTYFDSELIRCGECHHTCGTCVGPGREECIHCAKNFHFHDWKCVPACGEGFYPEEMPGLPHKVCRRCDENCLSCAGSSRNCSRCKTGFTQLGTSCITNHTCSNADETFCEMVKSNRLCERKLFIQFCCRTCLLAG

SEQ ID NO: 33117 - protein, 308 aa, Homo sapiens
  ENSP00000487813
MLELSAPELEPPKAALSPSQVEVPEDEEDYTGVCHPECGDKGCDGPNADQCLNCVHFSLGSVKTSRKCVSVCPLGYFGDTAARRCRRCHKGCETCSSRAATQCLSCRRGFYHHQEMNTCVTLCPAGFYADESQKNCLKCHPSCKKCVDEPEKCTVCKEGFSLARGSCIPDCEPGTYFDSELIRCGECHHTCGTCVGPGREECIHCAKNFHFHDWKCVPACGEGFYPEEMPGLPHKVCRRCDENCLSCAGSSRNCSRCKTGFTQLGTSCITNHTCSNADETFCEMVKSNRLCERKLFIQFCCRTCLLAG

SEQ ID NO: 33118 - protein, 975 aa, Homo sapiens
  ENSP00000481556
MPPRAPPAPGPRPPPRAAAATDTAAGAGGAGGAGGAGGPGFRPLAPRPWRWLLLLALPAACSAPPPRPVYTNHWAVQVLGGPAEADRVAAAHGYLNLGQIGNLEDYYHFYHSKTFKRSTLSSRGPHTFLRMDPQVKWLQQQEVKRRVKRQVRSDPQALYFNDPIWSNMWYLHCGDKNSRCRSEMNVQAAWKRGYTGKNVVVTILDDGIERNHPDLAPNYDSYASYDVNGNDYDPSPRYDASNENKHGTRCAGEVAASANNSYCIVGIAYNAKIGGIRMLDGDVTDVVEAKSLGIRPNYIDIYSASWGPDDDGKTVDGPGRLAKQAFEYGIKKGRQGLGSIFVWASGNGGREGDYCSCDGYTNSIYTISVSSATENGYKPWYLEECASTLATTYSSGAFYERKIVTTDLRQRCTDGHTGTSVSAPMVAGIIALALEANSQLTWRDVQHLLVKTSRPAHLKASDWKVNGAGHKVSHFYGFGLVDAEALVVEAKKWTAVPSQHMCVAASDKRPRSIPLVQVLRTTALTSACAEHSDQRVVYLEHVVVRTSISHPRRGDLQIYLVSPSGTKSQLLAKRLLDLSNEGFTNWEFMTVHCWGEKAEGQWTLEIQDLPSQVRNPEKQGKLKEWSLILYGTAEHPYHTFSAHQSRSRMLELSAPELEPPKAALSPSQVEVPEDEEDYTAQSTPGSANILQTSVCHPECGDKGCDGPNADQCLNCVHFSLGSVKTSRKCVSVCPLGYFGDTAARRCRRCHKGCETCSSRAATQCLSCRRGFYHHQEMNTCVTLCPAGFYADESQKNCLKCHPSCKKCVDEPEKCTVCKEGFSLARGSCIPDCEPGTYFDSELIRCGECHHTCGTCVGPGREECIHCAKNFHFHDWKCVPACGEGFYPEEMPGLPHKVCRRYGPPGGERQAAVSSKGVPGGQSLAASSPGAGEGMLHHPTVDRSPFTELLRGLRPFVHWMHICWVPAVGRHRAAAG

SEQ ID NO: 33119 - protein, 962 aa, Homo sapiens
  ENSP00000482831
MPPRAPPAPGPRPPPRAAAATDTAAGAGGAGGAGGAGGPGFRPLAPRPWRWLLLLALPAACSAPPPRPVYTNHWAVQVLGGPAEADRVAAAHGYLNLGQIGNLEDYYHFYHSKTFKRSTLSSRGPHTFLRMDPQVKWLQQQEVKRRVKRQVRSDPQALYFNDPIWSNMWYLHCGDKNSRCRSEMNVQAAWKRGYTGKNVVVTILDDGIERNHPDLAPNYDSYASYDVNGNDYDPSPRYDASNENKHGTRCAGEVAASANNSYCIVGIAYNAKIGGIRMLDGDVTDVVEAKSLGIRPNYIDIYSASWGPDDDGKTVDGPGRLAKQAFEYGIKKGRQGLGSIFVWASGNGGREGDYCSCDGYTNSIYTISVSSATENGYKPWYLEECASTLATTYSSGAFYERKIVTTDLRQRCTDGHTGTSVSAPMVAGIIALALEANSQLTWRDVQHLLVKTSRPAHLKASDWKVNGAGHKVSHFYGFGLVDAEALVVEAKKWTAVPSQHMCVAASDKRPRSIPLVQVLRTTALTSACAEHSDQRVVYLEHVVVRTSISHPRRGDLQIYLVSPSGTKSQLLAKRLLDLSNEGFTNWEFMTVHCWGEKAEGQWTLEIQDLPSQVRNPEKQGKLKEWSLILYGTAEHPYHTFSAHQSRSRMLELSAPELEPPKAALSPSQVEVPEDEEDYTGVCHPECGDKGCDGPNADQCLNCVHFSLGSVKTSRKCVSVCPLGYFGDTAARRCRRCHKGCETCSSRAATQCLSCRRGFYHHQEMNTCVTLCPAGFYADESQKNCLKCHPSCKKCVDEPEKCTVCKEGFSLARGSCIPDCEPGTYFDSELIRCGECHHTCGTCVGPGREECIHCAKNFHFHDWKCVPACGEGFYPEEMPGLPHKVCRRYGPPGGERQAAVSSKGVPGGQSLAASSPGAGEGMLHHPTVDRSPFTELLRGLRPFVHWMHICWVPAVGRHRAAAG

SEQ ID NO: 33120 - protein, 126 aa, Homo sapiens
  ENSP00000453155
  MOD_RES (1)..(1): Any amino acid
XALGPAGGLLGARGGSHLHLTPTPRRPPDLPGFSLGNQVSTSGKEVEVPEDEEDYTGVCHPECGDKGCDGPNADQCLNCVHFSLGSVKTSRKCVSVCPLGYFGDTAARRCRRCHKGCETCSSRAAT

SEQ ID NO: 33121 - protein, 652 aa, Homo sapiens
  ENSP00000477768
MPPRAPPAPGPRPPPRAAAATDTAAGAGGAGGAGGAGGPGFRPLAPRPWRWLLLLALPAACSAPPPRPVYTNHWAVQVLGGPAEADRVAAAHGYLNLGQIGNLEDYYHFYHSKTFKRSTLSSRGPHTFLRMDPQVKWLQQQEVKRRVKRQVRSDPQALYFNDPIWSNMWYLHCGDKNSRCRSEMNVQAAWKRGYTGKNVVVTILDDGIERNHPDLAPNYDSYASYDVNGNDYDPSPRYDASNENKHGTRCAGEVAASANNSYCIVGIAYNAKIGGIRMLDGDVTDVVEAKSLGIRPNYIDIYSASWGPDDDGKTVDGPGRLAKQAFEYGIKKGRQGLGSIFVWASGNGGREGDYCSCDGYTNSIYTISVSSATENGYKPWYLEECASTLATTYSSGAFYERKIVTTDLRQRCTDGHTGTSVSAPMVAGIIALALEANSQLTWRDVQHLLVKTSRPAHLKASDWKVNGAGHKVSHFYGFGLVDAEALVVEAKKWTAVPSQHMCVAASDKRPRSIPLVQVLRTTALTSACAEHSDQRVVYLEHVVVRTSISHPRRGDLQIYLVSPSGTKSQLLAKRLLDLSNEGFTNWEFMTVHCWGEKAEGQWTLEIQDLPSQVRNPEKQGDLETPVANQLTTEEREPGLKHVFRWQIEQELW

SEQ ID NO: 33122 - protein, 623 aa, Homo sapiens
  ENSP00000478081
MPPRAPPAPGPRPPPRAAAATDTAAGAGGAGGAGGAGGPGFRPLAPRPWRWLLLLALPAACSAPPPRPVYTNHWAVQVLGGPAEADRVAAAHGYLNLGQIGNLEDYYHFYHSKTFKRSTLSSRGPHTFLRMDPQVKWLQQQEVKRRVKRQVRSDPQALYFNDPIWSNMWYLHCGDKNSRCRSEMNVQAAWKRGYTGKNVVVTILDDGIERNHPDLAPNYDSYASYDVNGNDYDPSPRYDASNENKHGTRCAGEVAASANNSYCIVGIAYNAKIGGIRMLDGDVTDVVEAKSLGIRPNYIDIYSASWGPDDDGKTVDGPGRLAKQAFEYGIKKGRQGLGSIFVWASGNGGREGDYCSCDGYTNSIYTISVSSATENGYKPWYLEECASTLATTYSSGAFYERKIVTTDLRQRCTDGHTGTSVSAPMVAGIIALALEANSQLTWRDVQHLLVKTSRPAHLKASDWKVNGAGHKVSHFYGFGLVDAEALVVEAKKWTAVPSQHMCVAASDKRPRSIPLVQVLRTTALTSACAEHSDQRVVYLEHVVVRTSISHPRRGDLQIYLVSPSGTKSQLLAKRLLDLSNEGFTNWEFMTVHCWGEKAEGQWTLEIQDLPSQVRNPEKQGNLD

SEQ ID NO: 33123 - protein, 142 aa, Homo sapiens
  ENSP00000483048
  MOD_RES (1)..(1): Any amino acid
XLTSACAEHSDQRVVYLEHVVVRTSISHPRRGDLQIYLVSPSGTKSQLLAKRLLDLSNEGFTNWEFMTVHCWGEKAEGQWTLEIQDLPSQVRNPEKQGDLETPVANQLTTEERFVSTLSILFHWSVYLSWSQYHIVLITVAL

SEQ ID NO: 33124 - protein, 345 aa, Homo sapiens
  ENSP00000452997
  MOD_RES (1)..(1): Any amino acid
XGGPAEADRVAAAHGYLNLGQIGNLEDYYHFYHSKTFKRSTLSSRGPHTFLRMDPQVKWLQQQEVKRRVKRQVRSDPQALYFNDPIWSNMWYLDSYASYDVNGNDYDPSPRYDASNENKHGTRCAGEVAASANNSYCIVGIAYNAKIGGIRMLDGDVTDVVEAKSLGIRPNYIDIYSASWGPDDDGKTVDGPGRLAKQAFEYGIKKGRQGLGSIFVWASGNGGREGDYCSCDGYTNSIYTISVSSATENGYKPWYLEECASTLATTYSSGAFYERKIVTTDLRQRCTDGHTGTSVSAPMVAGIIALALEANSQLTWRDVQHLLVKTSRPAHLKASDWKVNGAGHK

SEQ ID NO: 33125 - protein, 664 aa, Homo sapiens
  ENSP00000332052
MPPRAPPAPGPRPPPRAAAATDTAAGAGGAGGAGGAGGPGFRPLAPRPWRWLLLLALPAACSAPPPRPVYTNHWAVQVLGGPAEADRVAAAHGYLNLGQIGNLEDYYHFYHSKTFKRSTLSSRGPHTFLRMDPQVKWLQQQEVKRRVKRQVRSDPQALYFNDPIWSNMWYLHCGDKNSRCRSEMNVQAAWKRGYTGKNVVVTILDDGIERNHPDLAPNYDSYASYDVNGNDYDPSPRYDASNENKHGTRCAGEVAASANNSYCIVGIAYNAKIGGIRMLDGDVTDVVEAKSLGIRPNYIDIYSASWGPDDDGKTVDGPGRLAKQAFEYGIKKGRQGLGSIFVWASGNGGREGDYCSCDGYTNSIYTISVSSATENGYKPWYLEECASTLATTYSSGAFYERKIVTTDLRQRCTDGHTGTSVSAPMVAGIIALALEANSQLTWRDVQHLLVKTSRPAHLKASDWKVNGAGHKVSHFYGFGLVDAEALVVEAKKWTAVPSQHMCVAASDKRPRSIPLVQVLRTTALTSACAEHSDQRVVYLEHVVVRTSISHPRRGDLQIYLVSPSGTKSQLLAKRLLDLSNEGFTNWEFMTVHCWGEKAEGQWTLEIQDLPSQVRNPEKQGDLETPVANQLTTEERFVSTLSILFHWSVYLSWSQYHIVLITVAL

SEQ ID NO: 33126 - protein, 351 aa, Homo sapiens
  ENSP00000368440
MVGHQECIMEEDNRAPQLWRKTLTAPAPFADETNCQCQAPHEKLTIAQARLGTPADRPVRVYADGIFDLFHSGHARALMQAKTLFPNSYLLVGVCSDDLTHKFKGFTVMNEAERYEALRHCRYVDEVIRDAPWTLTPEFLEKHKIDFVAHDDIPYSSAGSDDVYKHIKEAGMFVPTQRTEGISTSDIITRIVRDYDVYARRNLQRGYTAKELNVSFINEKRYRFQNQVDKMKEKVKNVEERSKEFVNRVEEKSHDLIQKWEEKSREFIGNFLELFGPDGAWKQMFQERSSRMLQALSPKQSPVSSPTRSRSPSRSPSPTFSWLPLKTSPPSSPKAASASISSMSEGDEDEK

SEQ ID NO: 33127 - protein, 330 aa, Homo sapiens
  ENSP00000349211
MPVVTTDAESETGIPKSLSNEPPSETMEEIEHTCPQPRLTLTAPAPFADETNCQCQAPHEKLTIAQARLGTPADRPVRVYADGIFDLFHSGHARALMQAKTLFPNSYLLVGVCSDDLTHKFKGFTVMNEAERYEALRHCRYVDEVIRDAPWTLTPEFLEKHKIDFVAHDDIPYSSAGSDDVYKHIKEAGMFVPTQRTEGISTSDIITRIVRDYDVYARRNLQRGYTAKELNVSFINEKRYRFQNQVDKMKEKVKNVEERSKEFVNRVEEKSHDLIQKWEEKSREFIGNFLELFGPDGAWKQMFQERSSRMLQALSPKQSPLKSWARCRDF

SEQ ID NO: 33128 - protein, 369 aa, Homo sapiens
  ENSP00000368439
MPVVTTDAESETGIPKSLSNEPPSETMEEIEHTCPQPRLTLTAPAPFADETNCQCQAPHEKLTIAQARLGTPADRPVRVYADGIFDLFHSGHARALMQAKTLFPNSYLLVGVCSDDLTHKFKGFTVMNEAERYEALRHCRYVDEVIRDAPWTLTPEFLEKHKIDFVAHDDIPYSSAGSDDVYKHIKEAGMFVPTQRTEGISTSDIITRIVRDYDVYARRNLQRGYTAKELNVSFINEKRYRFQNQVDKMKEKVKNVEERSKEFVNRVEEKSHDLIQKWEEKSREFIGNFLELFGPDGAWKQMFQERSSRMLQALSPKQSPVSSPTRSRSPSRSPSPTFSWLPLKTSPPSSPKAASASISSMSEGDEDEK

SEQ ID NO: 33129 - protein, 177 aa, Homo sapiens
  ENSP00000436562
MEEIEHTCPQPRLTLTAPAPFADETNCQCQAPHEKLTIAQARLGTPADRPVRVYADGIFDLFHSGHARALMQAKTLFPNSYLLVGVCSDDLTHKFKGFTVMNEAERYEALRHCRYVDEVIRDAPWTLTPEFLEKHKGCSFQRREQKASQHRTSLPELFVTMMFMPDVTSREGIQPRN

SEQ ID NO: 33130 - protein, 246 aa, Homo sapiens
  ENSP00000375855
MEEAKSQSLEEDFEGQATHTGPKGVINDWRKFKLESQDSDSIPPSKKEILRQMSSPQSRNGKDSKERVSRKMSIQEYELIHKEKEDENCLRKYRRQCMQDMHQKLSFGPRYGFVYELETGKQFLETIEKELKITTIVVHIYEDGIKGCDALNSSLTCLAAEYPIVKFCKIKASNTGAGDRFSLDVLPTLLIYKGGELISNFISVAEQFAEEFFAGDVESFLNEYGLLPEREVHVLEHTKIEEEDVE

SEQ ID NO: 33131 - protein, 194 aa, Homo sapiens
  ENSP00000422775
MSSPQSRNGKDSKERVSRKMSIQEYELIHKEKEDENCLRKYRRQCMQDMHQKLSFGPRYGFVYELETGKQFLETIEKELKITTIVVHIYEDGIKGCDALNSSLTCLAAEYPIVKFCKIKASNTGAGDRFSLDVLPTLLIYKGGELISNFISVAEQFAEEFFAGDVESFLNEYGLLPEREVHVLEHTKIEEEDVE

SEQ ID NO: 33132 - protein, 545 aa, Homo sapiens
  ENSP00000410309
MGSSATEIEELENTTFKYLTGEQTEKMWQRLKGILRCLVKQLERGDVNVVDLKKNIEYAASVLEAVYIDETRRLLDTEDELSDIQTDSVPSEVRDWLASTFTRKMGMTKKKPEEKPKFRSIVHAVQAGIFVERMYRKTYHMVGLAYPAAVIVTLKDVDKWSFDVFALNEASGEHSLKFMIYELFTRYDLINRFKIPVSCLITFAEALEVGYSKYKNPYHNLIHAADVTQTVHYIMLHTGIMHWLTELEILAMVFAAAIHDYEHTGTTNNFHIQTRSDVAILYNDRSVLENHHVSAAYRLMQEEEMNILINLSKDDWRDLRNLVIEMVLSTDMSGHFQQIKNIRNSLQQPEGIDRAKTMSLILHAADISHPAKSWKLHYRWTMALMEEFFLQGDKEAELGLPFSPLCDRKSTMVAQSQIGFIDFIVEPTFSLLTDSTEKIVIPLIEEASKAETSSYVASSSTTIVGLHIADALRRSNTKGSMSDGSYSPDYSLAAVDLKSFKNNLVDIIQQNKERWKELAAQGESDLHKNSEDLVNAEEKHDETHS

SEQ ID NO: 33133 - protein, 529 aa, Homo sapiens
  ENSP00000386767
MDDHVTIRKKHLQRPIFRLRCLVKQLERGDVNVVDLKKNIEYAASVLEAVYIDETRRLLDTEDELSDIQTDSVPSEVRDWLASTFTRKMGMTKKKPEEKPKFRSIVHAVQAGIFVERMYRKTYHMVGLAYPAAVIVTLKDVDKWSFDVFALNEASGEHSLKFMIYELFTRYDLINRFKIPVSCLITFAEALEVGYSKYKNPYHNLIHAADVTQTVHYIMLHTGIMHWLTELEILAMVFAAAIHDYEHTGTTNNFHIQTRSDVAILYNDRSVLENHHVSAAYRLMQEEEMNILINLSKDDWRDLRNLVIEMVLSTDMSGHFQQIKNIRNSLQQPEGIDRAKTMSLILHAADISHPAKSWKLHYRWTMALMEEFFLQGDKEAELGLPFSPLCDRKSTMVAQSQIGFIDFIVEPTFSLLTDSTEKIVIPLIEEASKAETSSYVASSSTTIVGLHIADALRRSNTKGSMSDGSYSPDYSLAAVDLKSFKNNLVDIIQQNKERWKELAAQGESDLHKNSEDLVNAEEKHDETHS

SEQ ID NO: 33134 - protein, 535 aa, Homo sapiens
  ENSP00000387037
MGSSATEIEELENTTFKYLTGEQTEKMWQRLKGILRCLVKQLERGDVNVVDLKKNIEYAASVLEAVYIDETRRLLDTEDELSDIQTDSVPSEVRDWLASTFTRKMGMTKKKPEEKPKFRSIVHAVQAGIFVERMYRKTYHMVGLAYPAAVIVTLKDVDKWSFDVFALNEASGEHSLKFMIYELFTRYDLINRFKIPVSCLITFAEALEVGYSKYKNPYHNLIHAADVTQTVHYIMLHTGIMHWLTELEILAMVFAAAIHDYEHTGTTNNFHIQTRSDVAILYNDRSVLENHHVSAAYRLMQEEEMNILINLSKDDWRDLRNLVIEMVLSTDMSGHFQQIKNIRNSLQQPEGIDRAKTMSLILHAADISHPAKSWKLHYRWTMALMEEFFLQGDKEAELGLPFSPLCDRKSTMVAQSQIGFIDFIVEPTFSLLTDSTEKIVIPLIEEASKAETSSYVASSSTTIVGLHIADALRRSNTKGSMSDGSYSPDYSLAAVDLKSFKNNLVDIIQQNKERWKELAAQEARTSSQKCEFIHQ

SEQ ID NO: 33135 - protein, 519 aa, Homo sapiens
  ENSP00000309269
MDDHVTIRKKHLQRPIFRLRCLVKQLERGDVNVVDLKKNIEYAASVLEAVYIDETRRLLDTEDELSDIQTDSVPSEVRDWLASTFTRKMGMTKKKPEEKPKFRSIVHAVQAGIFVERMYRKTYHMVGLAYPAAVIVTLKDVDKWSFDVFALNEASGEHSLKFMIYELFTRYDLINRFKIPVSCLITFAEALEVGYSKYKNPYHNLIHAADVTQTVHYIMLHTGIMHWLTELEILAMVFAAAIHDYEHTGTTNNFHIQTRSDVAILYNDRSVLENHHVSAAYRLMQEEEMNILINLSKDDWRDLRNLVIEMVLSTDMSGHFQQIKNIRNSLQQPEGIDRAKTMSLILHAADISHPAKSWKLHYRWTMALMEEFFLQGDKEAELGLPFSPLCDRKSTMVAQSQIGFIDFIVEPTFSLLTDSTEKIVIPLIEEASKAETSSYVASSSTTIVGLHIADALRRSNTKGSMSDGSYSPDYSLAAVDLKSFKNNLVDIIQQNKERWKELAAQEARTSSQKCEFIHQ

SEQ ID NO: 33136 - protein, 501 aa, Homo sapiens
  ENSP00000350858
MGKKINKLFCFNFLVQCFRGKSKPSKCQIRKKVKNHIERLLDTEDELSDIQTDSVPSEVRDWLASTFTRKMGMTKKKPEEKPKFRSIVHAVQAGIFVERMYRKTYHMVGLAYPAAVIVTLKDVDKWSFDVFALNEASGEHSLKFMIYELFTRYDLINRFKIPVSCLITFAEALEVGYSKYKNPYHNLIHAADVTQTVHYIMLHTGIMHWLTELEILAMVFAAAIHDYEHTGTTNNFHIQTRSDVAILYNDRSVLENHHVSAAYRLMQEEEMNILINLSKDDWRDLRNLVIEMVLSTDMSGHFQQIKNIRNSLQQPEGIDRAKTMSLILHAADISHPAKSWKLHYRWTMALMEEFFLQGDKEAELGLPFSPLCDRKSTMVAQSQIGFIDFIVEPTFSLLTDSTEKIVIPLIEEASKAETSSYVASSSTTIVGLHIADALRRSNTKGSMSDGSYSPDYSLAAVDLKSFKNNLVDIIQQNKERWKELAAQEARTSSQKCEFIHQ

SEQ ID NO: 33137 - protein, 545 aa, Homo sapiens; identical to SEQ ID NO: 33132
  ENSP00000410309

SEQ ID NO: 33138 - protein, 529 aa, Homo sapiens; identical to SEQ ID NO: 33133
  ENSP00000386767

SEQ ID NO: 33139 - protein, 535 aa, Homo sapiens; identical to SEQ ID NO: 33134
  ENSP00000387037

SEQ ID NO: 33140 - protein, 519 aa, Homo sapiens; identical to SEQ ID NO: 33135
  ENSP00000309269

SEQ ID NO: 33141 - protein, 501 aa, Homo sapiens; identical to SEQ ID NO: 33136
  ENSP00000350858

SEQ ID NO: 33142 - protein, 536 aa, Homo sapiens
  ENSP00000243052
MELSPRSPPEMLEESDCPSPLELKSAPSKKMWIKLRSLLRYMVKQLENGEINIEELKKNLEYTASLLEAVYIDETRQILDTEDELQELRSDAVPSEVRDWLASTFTQQARAKGRRAEEKPKFRSIVHAVQAGIFVERMFRRTYTSVGPTYSTAVLNCLKNLDLWCFDVFSLNQAADDHALRTIVFELLTRHNLISRFKIPTVFLMSFLDALETGYGKYKNPYHNQIHAADVTQTVHCFLLRTGMVHCLSEIELLAIIFAAAIHDYEHTGTTNSFHIQTKSECAIVYNDRSVLENHHISSVFRLMQDDEMNIFINLTKDEFVELRALVIEMVLATDMSCHFQQVKTMKTALQQLERIDKPKALSLLLHAADISHPTKQWLVHSRWTKALMEEFFRQGDKEAELGLPFSPLCDRTSTLVAQSQIGFIDFIVEPTFSVLTDVAEKSVQPLADEDSKSKNQPSFQWRQPSLDVEVGDPNPDVVSFRSTWVKRIQENKQKWKERAASGITNQMSIDELSPCEEEAPPSPAEDEHNQNGNLD

SEQ ID NO: 33143 - protein, 50 aa, Homo sapiens
  ENSP00000478185
MELSPRSPPEMLEESDCPSPLELKSAPSKKMWIKLRSLPHGVIFYGSYQF

SEQ ID NO: 33144 - protein, 191 aa, Homo sapiens
  ENSP00000447354
MELSPRSPPEMLEESDCPSPLELKSAPSKKMWIKLRSLLRYMVKQLENGEINIEELKKNLEYTASLLEAVYIDETRVSRLWKHLLSFLCDSPSGVSGKSWTRRTSCRSCGQMPCLRRCGTGWPPPSPSRPGPKAAEQRRSPSSEALCTLCRLGSSWNGCSGEHTPLWAPLTLLRFSTVSRTWISGALMSFP

SEQ ID NO: 33145 - protein, 495 aa, Homo sapiens
  ENSP00000442559
MVKQLENGEINIEELKKNLEYTASLLEAVYIDETRQILDTEDELQELRSDAVPSEVRDWLASTFTQQARAKGRRAEEKPKFRSIVHAVQAGIFVERMFRRTYTSVGPTYSTAVLNCLKNLDLWCFDVFSLNQAADDHALRTIVFELLTRHNLISRFKIPTVFLMSFLDALETGYGKYKNPYHNQIHAADVTQTVHCFLLRTGMVHCLSEIELLAIIFAAAIHDYEHTGTTNSFHIQTKSECAIVYNDRSVLENHHISSVFRLMQDDEMNIFINLTKDEFVELRALVIEMVLATDMSCHFQQVKTMKTALQQLERIDKPKALSLLLHAADISHPTKQWLVHSRWTKALMEEFFRQGDKEAELGLPFSPLCDRTSTLVAQSQIGFIDFIVEPTFSVLTDVAEKSVQPLADEDSKSKNQPSFQWRQPSLDVEVGDPNPDVVSFRSTWVKRIQENKQKWKERAASGITNQMSIDELSPCEEEAPPSPAEDEHNQNGNLD

SEQ ID NO: 33146 - protein, 516 aa, Homo sapiens
  ENSP00000448519
MANPVPVQRSHLQGPILRLRYMVKQLENGEINIEELKKNLEYTASLLEAVYIDETRQILDTEDELQELRSDAVPSEVRDWLASTFTQQARAKGRRAEEKPKFRSIVHAVQAGIFVERMFRRTYTSVGPTYSTAVLNCLKNLDLWCFDVFSLNQAADDHALRTIVFELLTRHNLISRFKIPTVFLMSFLDALETGYGKYKNPYHNQIHAADVTQTVHCFLLRTGMVHCLSEIELLAIIFAAAIHDYEHTGTTNSFHIQTKSECAIVYNDRSVLENHHISSVFRLMQDDEMNIFINLTKDEFVELRALVIEMVLATDMSCHFQQVKTMKTALQQLERIDKPKALSLLLHAADISHPTKQWLVHSRWTKALMEEFFRQGDKEAELGLPFSPLCDRTSTLVAQSQIGFIDFIVEPTFSVLTDVAEKSVQPLADEDSKSKNQPSFQWRQPSLDVEVGDPNPDVVSFRSTWVKRIQENKQKWKERAASGITNQMSIDELSPCEEEAPPSPAEDEHNQNGNLD

SEQ ID NO: 33147 - protein, 769 aa, Homo sapiens
  ENSP00000379496
MTDAGNRKEGFKKCRSATFSIDGYSFTIVANEAGDKNARPLARFSRSKSQNCLWNSLIDGLTGNVKEKPRPTIVHDPRPPEEILADELPQLDSPEVLVKTSFRLRSLVKQLERGEASVVDLKKNLEYAATVLESVYIDETRRLLDTEDELSDIQSDAVPSEVRDWLASTFTRQMGMMLRRSDEKPRFKSIVHAVQAGIFVERMYRRTSNMVGLSYPPAVIEALKDVDKWSFDVFSLNEASGDHALKFIFYELLTRYDLISRFKIPISALVSFVEALEVGYSKHKNPYHNLMHAADVTQTVHYLLYKTGVANWLTELEIFAIIFSAAIHDYEHTGTTNNFHIQTRSDPAILYNDRSVLENHHLSAAYRLLQDDEEMNILINLSKDDWREFRTLVIEMVMATDMSCHFQQIKAMKTALQQPEAIEKPKALSLMLHTADISHPAKAWDLHHRWTMSLLEEFFRQGDREAELGLPFSPLCDRKSTMVAQSQVGFIDFIVEPTFTVLTDMTEKIVSPLIDETSQTGGTGQRRSSLNSISSSDAKRSGVKTSGSEGSAPINNSVISVDYKSFKATWTEVVHINRERWRAKVPKEEKAKKEAEEKARLAAEEQQKEMEAKSQAEEGASGKAEKKTSGETKNQVNGTRANKSDNPRGKNSKAEKSSGEQQQNGDFKDGKNKTDKKDHSNIGNDSKKTDGTKQRSHGSPAPSTSSTCRLTLPVIKPPLRHFKRPAYASSSYAPSVSKKTDEHPARYKMLDQRIKMKKIQNISHNWNRK

SEQ ID NO: 33148 - protein, 709 aa, Homo sapiens
  ENSP00000379494
MESPTKEIEEFESNSLKYLQPEQIEKIWLRLRGLRKYKKTSQRLRSLVKQLERGEASVVDLKKNLEYAATVLESVYIDETRRLLDTEDELSDIQSDAVPSEVRDWLASTFTRQMGMMLRRSDEKPRFKSIVHAVQAGIFVERMYRRTSNMVGLSYPPAVIEALKDVDKWSFDVFSLNEASGDHALKFIFYELLTRYDLISRFKIPISALVSFVEALEVGYSKHKNPYHNLMHAADVTQTVHYLLYKTGVANWLTELEIFAIIFSAAIHDYEHTGTTNNFHIQTRSDPAILYNDRSVLENHHLSAAYRLLQDDEEMNILINLSKDDWREFRTLVIEMVMATDMSCHFQQIKAMKTALQQPEAIEKPKALSLMLHTADISHPAKAWDLHHRWTMSLLEEFFRQGDREAELGLPFSPLCDRKSTMVAQSQVGFIDFIVEPTFTVLTDMTEKIVSPLIDETSQTGGTGQRRSSLNSISSSDAKRSGVKTSGSEGSAPINNSVISVDYKSFKATWTEVVHINRERWRAKVPKEEKAKKEAEEKARLAAEEQQKEMEAKSQAEEGASGKAEKKTSGETKNQVNGTRANKSDNPRGKNSKAEKSSGEQQQNGDFKDGKNKTDKKDHSNIGNDSKKTDGTKQRSHGSPAPSTSSTCRLTLPVIKPPLRHFKRPAYASSSYAPSVSKKTDEHPARYKMLDQRIKMKKIQNISHNWNRK

SEQ ID NO: 33149 - protein, 709 aa, Homo sapiens; identical to SEQ ID NO: 33148
  ENSP00000318105

SEQ ID NO: 33150 - protein, 634 aa, Homo sapiens
  ENSP00000379487
MESPTKEIEEFESNSLKYLQPEQIEKIWLRLRGLRKYKKTSQRLRSLVKQLERGEASVVDLKKNLEYAATVLESVYIDETRRLLDTEDELSDIQSDAVPSEVRDWLASTFTRQMGMMLRRSDEKPRFKSIVHAVQAGIFVERMYRRTSNMVGLSYPPAVIEALKDVDKWSFDVFSLNEASGDHALKFIFYELLTRYDLISRFKIPISALVSFVEALEVGYSKHKNPYHNLMHAADVTQTVHYLLYKTGVANWLTELEIFAIIFSAAIHDYEHTGTTNNFHIQTRSDPAILYNDRSVLENHHLSAAYRLLQDDEEMNILINLSKDDWREFRTLVIEMVMATDMSCHFQQIKAMKTALQQPEAIEKPKALSLMLHTADISHPAKAWDLHHRWTMSLLEEFFRQGDREAELGLPFSPLCDRKSTMVAQSQVGFIDFIVEPTFTVLTDMTEKIVSPLIDETSQTGGTGQRRSSLNSISSSDAKRSGVKTSGSEGSAPINNSVISVDYKSFKATWTEVVHINRERWRAKVPKEEKAKKEAEEKARLAAEEQQKEMEAKSQAEEGASGKAEKKTSGETKNQVNGTRANKSDNPRGKNSKAEKSSGEQQQNGDFKDGKNKTDKKDHSNIGNDSKKTDDSQE

SEQ ID NO: 33151 - protein, 634 aa, Homo sapiens; identical to SEQ ID NO: 33150
  ENSP00000379485

SEQ ID NO: 33152 - protein, 46 aa, Homo sapiens
  ENSP00000379492
MESPTKEIEEFESNSLKYLQPEQIEKIWLRLRGLRKYKKTSQRLRS

SEQ ID NO: 33153 - protein, 1141 aa, Homo sapiens
  ENSP00000351957
MAVPGDAARVRDKPVHSGVSQAPTAGRDCHHRADPASPRDSGCRGCWGDLVLQPLRSSRKLSSALCAGSLSFLLALLVRLVRGEVGCDLEQCKEAAAAEEEEAAPGAEGGVFPGPRGGAPGGGARLSPWLQPSALLFSLLCAFFWMGLYLLRAGVRLPLAVALLAACCGGEALVQIGLGVGEDHLLSLPAAGVVLSCLAAATWLVLRLRLGVLMIALTSAVRTVSLISLERFKVAWRPYLAYLAGVLGILLARYVEQILPQSAEAAPREHLGSQLIAGTKEDIPVFKRRRRSSSVVSAEMSGCSSKSHRRTSLPCIPREQLMGHSEWDHKRGPRGSQSSGTSITVDIAVMGEAHGLITDLLADPSLPPNVCTSLRAVSNLLSTQLTFQAIHKPRVNPVTSLSENYTCSDSEESSEKDKLAIPKRLRRSLPPGLLRRVSSTWTTTTSATGLPTLEPAPVRRDRSTSIKLQEAPSSSPDSWNNPVMMTLTKSRSFTSSYAISAANHVKAKKQSRPGALAKISPLSSPCSSPLQGTPASSLVSKISAVQFPESADTTAKQSLGSHRALTYTQSAPDLSPQILTPPVICSSCGRPYSQGNPADEPLERSGVATRTPSRTDDTAQVTSDYETNNNSDSSDIVQNEDETECLREPLRKASACSTYAPETMMFLDKPILAPEPLVMDNLDSIMEQLNTWNFPIFDLVENIGRKCGRILSQVSYRLFEDMGLFEAFKIPIREFMNYFHALEIGYRDIPYHNRIHATDVLHAVWYLTTQPIPGLSTVINDHGSTSDSDSDSGFTHGHMGYVFSKTYNVTDDKYGCLSGNIPALELMALYVAAAMHDYDHPGRTNAFLVATSAPQAVLYNDRSVLENHHAAAAWNLFMSRPEYNFLINLDHVEFKHFRFLVIEAILATDLKKHFDFVAKFNGKVNDDVGIDWTNENDRLLVCQMCIKLADINGPAKCKELHLQWTDGIVNEFYEQGDEEASLGLPISPFMDRSAPQLANLQESFISHIVGPLCNSYDSAGLMPGKWVEDSDESGDTDDPEEEEEEAPAPNEEETCENNESPKKKTFKRRKIYCQITQHLLQNHKMWKKVIEEEQRLAGIENQSLDQTPQSHSSEQIQAIKEEEEEKGKPRGEEIPTQKPDQ

SEQ ID NO: 33154 - protein, 1112 aa, Homo sapiens
  ENSP00000282096
MRRDERDAKAMRSLQPPDGAGSPPESLRNGYVKSCVSPLRQDPPRGFFFHLCRFCNVELRPPPASPQQPRRCSPFCRARLSLGALAAFVLALLLGAEPESWAAGAAWLRTLLSVCSHSLSPLFSIACAFFFLTCFLTRTKRGPGPGRSCGSWWLLALPACCYLGDFLVWQWWSWPWGDGDAGSAAPHTPPEAAAGRLLLVLSCVGLLLTLAHPLRLRHCVLVLLLASFVWWVSFTSLGSLPSALRPLLSGLVGGAGCLLALGLDHFFQIREAPLHPRLSSAAEEKVPVIRPRRRSSCVSLGETAASYYGSCKIFRRPSLPCISREQMILWDWDLKQWYKPHYQNSGGGNGVDLSVLNEARNMVSDLLTDPSLPPQVISSLRSISSLMGAFSGSCRPKINPLTPFPGFYPCSEIEDPAEKGDRKLNKGLNRNSLPTPQLRRSSGTSGLLPVEQSSRWDRNNGKRPHQEFGISSQGCYLNGPFNSNLLTIPKQRSSSVSLTHHVGLRRAGVLSSLSPVNSSNHGPVSTGSLTNRSPIEFPDTADFLNKPSVILQRSLGNAPNTPDFYQQLRNSDSNLCNSCGHQMLKYVSTSESDGTDCCSGKSGEEENIFSKESFKLMETQQEEETEKKDSRKLFQEGDKWLTEEAQSEQQTNIEQEVSLDLILVEEYDSLIEKMSNWNFPIFELVEKMGEKSGRILSQVMYTLFQDTGLLEIFKIPTQQFMNYFRALENGYRDIPYHNRIHATDVLHAVWYLTTRPVPGLQQIHNGCGTGNETDSDGRINHGRIAYISSKSCSNPDESYGCLSSNIPALELMALYVAAAMHDYDHPGRTNAFLVATNAPQAVLYNDRSVLENHHAASAWNLYLSRPEYNFLLHLDHVEFKRFRFLVIEAILATDLKKHFDFLAEFNAKANDVNSNGIEWSNENDRLLVCQVCIKLADINGPAKVRDLHLKWTEGIVNEFYEQGDEEANLGLPISPFMDRSSPQLAKLQESFITHIVGPLCNSYDAAGLLPGQWLEAEEDNDTESGDDEDGEELDTEDEEMENNLNPKPPRRKSRRRIFCQLMHHLTENHKIWKEIVEEEEKCKADGNKLQVENSSLPQADEIQVIEEADEEE

SEQ ID NO: 33155 - protein, 1061 aa, Homo sapiens
  ENSP00000388644
MRRDERDAKAMRSLQPPDGAGSPPESLRNGYVKSCVSPLRQDPPRGFFFHLCRFCNVELRPPPASPQQPRRCSPFCRARLSLGALAAFVLALLLGAEPESWAAGAAWLRTLLSVCSHSLSPLFSIACAFFFLTCFLTRTKRGPGPGRSCGSWWLLALPACCYLGDFLVWQWWSWPWGDGDAGSAAPHTPPEAAAGRLLLVLSCVGLLLTLAHPLRLRHCVLVLLLASFVWWVSFTSLGSLPSALRPLLSGLVGGAGCLLALGLDHFFQIREAPLHPRLSSAAEEKVPVIRPRRRSSCVSLGETAASYYGSCKIFRRPSLPCISREQMILWDWDLKQWYKPHYQNSGGGNGVDLSVLNEARNMVSDLLTDPSLPPQGLNRNSLPTPQLRRSSGTSGLLPVEQSSRWDRNNGKRPHQEFGISSQGCYLNGPFNSNLLTIPKQRSSSVSLTHHVGLRRAGVLSSLSPVNSSNHGPVSTGSLTNRSPIEFPDTADFLNKPSVILQRSLGNAPNTPDFYQQLRNSDSNLCNSCGHQMLKYVSTSESDGTDCCSGKSGEEENIFSKESFKLMETQQEEETEKKDSRKLFQEGDKWLTEEAQSEQQTNIEQEVSLDLILVEEYDSLIEKMSNWNFPIFELVEKMGEKSGRILSQVMYTLFQDTGLLEIFKIPTQQFMNYFRALENGYRDIPYHNRIHATDVLHAVWYLTTRPVPGLQQIHNGCGTGNETDSDGRINHGRIAYISSKSCSNPDESYGCLSSNIPALELMALYVAAAMHDYDHPGRTNAFLVATNAPQAVLYNDRSVLENHHAASAWNLYLSRPEYNFLLHLDHVEFKRFRFLVIEAILATDLKKHFDFLAEFNAKANDVNSNGIEWSNENDRLLVCQVCIKLADINGPAKVRDLHLKWTEGIVNEFYEQGDEEANLGLPISPFMDRSSPQLAKLQESFITHIVGPLCNSYDAAGLLPGQWLEAEEDNDTESGDDEDGEELDTEDEEMENNLNPKPPRRKSRRRIFCQLMHHLTENHKIWKEIVEEEEKCKADGNKLQVENSSLPQADEIQVIEEADEEE

SEQ ID NO: 33156 - protein, 809 aa, Homo sapiens
  ENSP00000345502
MEAEGSSAPARAGSGEGSDSAGGATLKAPKHLWRHEQHHQYPLRQPQFRLLHPHHHLPPPPPPSPQPQPQCPLQPPPPPPLPPPPPPPGAARGRYASSGATGRVRHRGYSDTERYLYCRAMDRTSYAVETGHRPGLKKSRMSWPSSFQGLRRFDVDNGTSAGRSPLDPMTSPGSGLILQANFVHSQRRESFLYRSDSDYDLSPKSMSRNSSIASDIHGDDLIVTPFAQVLASLRTVRNNFAALTNLQDRAPSKRSPMCNQPSINKATITEEAYQKLASETLEELDWCLDQLETLQTRHSVSEMASNKFKRMLNRELTHLSEMSRSGNQVSEFISNTFLDKQHEVEIPSPTQKEKEKKKRPMSQISGVKKLMHSSSLTNSSIPRFGVKTEQEDVLAKELEDVNKWGLHVFRIAELSGNRPLTVIMHTIFQERDLLKTFKIPVDTLITYLMTLEDHYHADVAYHNNIHAADVVQSTHVLLSTPALEAVFTDLEILAAIFASAIHDVDHPGVSNQFLINTNSELALMYNDSSVLENHHLAVGFKLLQEENCDIFQNLTKKQRQSLRKMVIDIVLATDMSKHMNLLADLKTMVETKKVTSSGVLLLDNYSDRIQVLQNMVHCADLSNPTKPLQLYRQWTDRIMEEFFRQGDRERERGMEISPMCDKHNASVEKSQVGFIDYIVHPLWETWADLVHPDAQDILDTLEDNREWYQSTIPQSPSPAPDDPEEGRQGQTEKFQFELTLEEDGESDTEKDSGSQVEEDTSCSDSKTLCTQDSESTEIPLDEQVEEEAVGEEEESQPEACVIDDRSPDT

SEQ ID NO: 33157 - protein, 699 aa, Homo sapiens
  ENSP00000490821
MSLPSSCEYLTLGKVARFRSAYVHGSPYAINMPIDIKPQRRRFDVDNGTSAGRSPLDPMTSPGSGLILQANFVHSQRRESFLYRSDSDYDLSPKSMSRNSSIASDIHGDDLIVTPFAQVLASLRTVRNNFAALTNLQDRAPSKRSPMCNQPSINKATITEEAYQKLASETLEELDWCLDQLETLQTRHSVSEMASNKFKRMLNRELTHLSEMSRSGNQVSEFISNTFLDKQHEVEIPSPTQKEKEKKKRPMSQISGVKKLMHSSSLTNSSIPRFGVKTEQEDVLAKELEDVNKWGLHVFRIAELSGNRPLTVIMHTIFQERDLLKTFKIPVDTLITYLMTLEDHYHADVAYHNNIHAADVVQSTHVLLSTPALEAVFTDLEILAAIFASAIHDVDHPGVSNQFLINTNSELALMYNDSSVLENHHLAVGFKLLQEENCDIFQNLTKKQRQSLRKMVIDIVLATDMSKHMNLLADLKTMVETKKVTSSGVLLLDNYSDRIQVLQNMVHCADLSNPTKPLQLYRQWTDRIMEEFFRQGDRERERGMEISPMCDKHNASVEKSQVGFIDYIVHPLWETWADLVHPDAQDILDTLEDNREWYQSTIPQSPSPAPDDPEEGRQGQTEKFQFELTLEEDGESDTEKDSGSQVEEDTSCSDSKTLCTQDSESTEIPLDEQVEEEAVGEEEESQPEACVIDDRSPDT

SEQ ID NO: 33158 - protein, 673 aa, Homo sapiens
  ENSP00000353152
MMHVNNFPFRRHSWICFDVDNGTSAGRSPLDPMTSPGSGLILQANFVHSQRRESFLYRSDSDYDLSPKSMSRNSSIASDIHGDDLIVTPFAQVLASLRTVRNNFAALTNLQDRAPSKRSPMCNQPSINKATITEEAYQKLASETLEELDWCLDQLETLQTRHSVSEMASNKFKRMLNRELTHLSEMSRSGNQVSEFISNTFLDKQHEVEIPSPTQKEKEKKKRPMSQISGVKKLMHSSSLTNSSIPRFGVKTEQEDVLAKELEDVNKWGLHVFRIAELSGNRPLTVIMHTIFQERDLLKTFKIPVDTLITYLMTLEDHYHADVAYHNNIHAADVVQSTHVLLSTPALEAVFTDLEILAAIFASAIHDVDHPGVSNQFLINTNSELALMYNDSSVLENHHLAVGFKLLQEENCDIFQNLTKKQRQSLRKMVIDIVLATDMSKHMNLLADLKTMVETKKVTSSGVLLLDNYSDRIQVLQNMVHCADLSNPTKPLQLYRQWTDRIMEEFFRQGDRERERGMEISPMCDKHNASVEKSQVGFIDYIVHPLWETWADLVHPDAQDILDTLEDNREWYQSTIPQSPSPAPDDPEEGRQGQTEKFQFELTLEEDGESDTEKDSGSQVEEDTSCSDSKTLCTQDSESTEIPLDEQVEEEAVGEEEESQPEACVIDDRSPDT

SEQ ID NO: 33159 - protein, 745 aa, Homo sapiens
  ENSP00000424852
MAQQTSPDTLTVPEVDNPHCPNPWLNEDLVKSLRENLLQHEKSKTARKSVSPKLSPVISPRNSPRLLRRMLLSSNIPKQRRFTVAHTCFDVDNGTSAGRSPLDPMTSPGSGLILQANFVHSQRRESFLYRSDSDYDLSPKSMSRNSSIASDIHGDDLIVTPFAQVLASLRTVRNNFAALTNLQDRAPSKRSPMCNQPSINKATITEEAYQKLASETLEELDWCLDQLETLQTRHSVSEMASNKFKRMLNRELTHLSEMSRSGNQVSEFISNTFLDKQHEVEIPSPTQKEKEKKKRPMSQISGVKKLMHSSSLTNSSIPRFGVKTEQEDVLAKELEDVNKWGLHVFRIAELSGNRPLTVIMHTIFQERDLLKTFKIPVDTLITYLMTLEDHYHADVAYHNNIHAADVVQSTHVLLSTPALEAVFTDLEILAAIFASAIHDVDHPGVSNQFLINTNSELALMYNDSSVLENHHLAVGFKLLQEENCDIFQNLTKKQRQSLRKMVIDIVLATDMSKHMNLLADLKTMVETKKVTSSGVLLLDNYSDRIQVLQNMVHCADLSNPTKPLQLYRQWTDRIMEEFFRQGDRERERGMEISPMCDKHNASVEKSQVGFIDYIVHPLWETWADLVHPDAQDILDTLEDNREWYQSTIPQSPSPAPDDPEEGRQGQTEKFQFELTLEEDGESDTEKDSGSQVEEDTSCSDSKTLCTQDSESTEIPLDEQVEEEAVGEEEESQPEACVIDDRSPDT

SEQ ID NO: 33160 - protein, 507 aa, Homo sapiens
  ENSP00000351800
MASNKFKRMLNRELTHLSEMSRSGNQVSEFISNTFLDKQHEVEIPSPTQKEKEKKKRPMSQISGVKKLMHSSSLTNSSIPRFGVKTEQEDVLAKELEDVNKWGLHVFRIAELSGNRPLTVIMHTIFQERDLLKTFKIPVDTLITYLMTLEDHYHADVAYHNNIHAADVVQSTHVLLSTPALEAVFTDLEILAAIFASAIHDVDHPGVSNQFLINTNSELALMYNDSSVLENHHLAVGFKLLQEENCDIFQNLTKKQRQSLRKMVIDIVLATDMSKHMNLLADLKTMVETKKVTSSGVLLLDNYSDRIQVLQNMVHCADLSNPTKPLQLYRQWTDRIMEEFFRQGDRERERGMEISPMCDKHNASVEKSQVGFIDYIVHPLWETWADLVHPDAQDILDTLEDNREWYQSTIPQSPSPAPDDPEEGRQGQTEKFQFELTLEEDGESDTEKDSGSQVEEDTSCSDSKTLCTQDSESTEIPLDEQVEEEAVGEEEESQPEACVIDDRSPDT

SEQ ID NO: 33161 - protein, 518 aa, Homo sapiens
  ENSP00000321739
MPEANYLLSVSWGYIKFKRMLNRELTHLSEMSRSGNQVSEFISNTFLDKQHEVEIPSPTQKEKEKKKRPMSQISGVKKLMHSSSLTNSSIPRFGVKTEQEDVLAKELEDVNKWGLHVFRIAELSGNRPLTVIMHTIFQERDLLKTFKIPVDTLITYLMTLEDHYHADVAYHNNIHAADVVQSTHVLLSTPALEAVFTDLEILAAIFASAIHDVDHPGVSNQFLINTNSELALMYNDSSVLENHHLAVGFKLLQEENCDIFQNLTKKQRQSLRKMVIDIVLATDMSKHMNLLADLKTMVETKKVTSSGVLLLDNYSDRIQVLQNMVHCADLSNPTKPLQLYRQWTDRIMEEFFRQGDRERERGMEISPMCDKHNASVEKSQVGFIDYIVHPLWETWADLVHPDAQDILDTLEDNREWYQSTIPQSPSPAPDDPEEGRQGQTEKFQFELTLEEDGESDTEKDSGSQVEEDTSCSDSKTLCTQDSESTEIPLDEQVEEEAVGEEEESQPEACVIDDRSPDT

SEQ ID NO: 33162 - protein, 679 aa, Homo sapiens
  ENSP00000425605
MSIIMKPRSRSTSSLRTAEAVCFDVDNGTSAGRSPLDPMTSPGSGLILQANFVHSQRRESFLYRSDSDYDLSPKSMSRNSSIASDIHGDDLIVTPFAQVLASLRTVRNNFAALTNLQDRAPSKRSPMCNQPSINKATITEEAYQKLASETLEELDWCLDQLETLQTRHSVSEMASNKFKRMLNRELTHLSEMSRSGNQVSEFISNTFLDKQHEVEIPSPTQKEKEKKKRPMSQISGVKKLMHSSSLTNSSIPRFGVKTEQEDVLAKELEDVNKWGLHVFRIAELSGNRPLTVIMHTIFQERDLLKTFKIPVDTLITYLMTLEDHYHADVAYHNNIHAADVVQSTHVLLSTPALEAVFTDLEILAAIFASAIHDVDHPGVSNQFLINTNSELALMYNDSSVLENHHLAVGFKLLQEENCDIFQNLTKKQRQSLRKMVIDIVLATDMSKHMNLLADLKTMVETKKVTSSGVLLLDNYSDRIQVLQNMVHCADLSNPTKPLQLYRQWTDRIMEEFFRQGDRERERGMEISPMCDKHNASVEKSQVGFIDYIVHPLWETWADLVHPDAQDILDTLEDNREWYQSTIPQSPSPAPDDPEEGRQGQTEKFQFELTLEEDGESDTEKDSGSQVEEDTSCSDSKTLCTQDSESTEIPLDEQVEEEAVGEEEESQPEACVIDDRSPDT

SEQ ID NO: 33163 - protein, 687 aa, Homo sapiens
  ENSP00000384806
MAFVWDPLGATVPGPSTRAKSRLRFSKSYSFDVDNGTSAGRSPLDPMTSPGSGLILQANFVHSQRRESFLYRSDSDYDLSPKSMSRNSSIASDIHGDDLIVTPFAQVLASLRTVRNNFAALTNLQDRAPSKRSPMCNQPSINKATITEEAYQKLASETLEELDWCLDQLETLQTRHSVSEMASNKFKRMLNRELTHLSEMSRSGNQVSEFISNTFLDKQHEVEIPSPTQKEKEKKKRPMSQISGVKKLMHSSSLTNSSIPRFGVKTEQEDVLAKELEDVNKWGLHVFRIAELSGNRPLTVIMHTIFQERDLLKTFKIPVDTLITYLMTLEDHYHADVAYHNNIHAADVVQSTHVLLSTPALEAVFTDLEILAAIFASAIHDVDHPGVSNQFLINTNSELALMYNDSSVLENHHLAVGFKLLQEENCDIFQNLTKKQRQSLRKMVIDIVLATDMSKHMNLLADLKTMVETKKVTSSGVLLLDNYSDRIQVLQNMVHCADLSNPTKPLQLYRQWTDRIMEEFFRQGDRERERGMEISPMCDKHNASVEKSQVGFIDYIVHPLWETWADLVHPDAQDILDTLEDNREWYQSTIPQSPSPAPDDPEEGRQGQTEKFQFELTLEEDGESDTEKDSGSQVEEDTSCSDSKTLCTQDSESTEIPLDEQVEEEAVGEEEESQPEACVIDDRSPDT

SEQ ID NO: 33164 - protein, 748 aa, Homo sapiens
  ENSP00000423094
MKRNTCDLLSRSKSASEETLHSSNEEEDPFRGMEPYLVRRLSCRNIQLPPLAFRQLEQADLKSESENIQRPTSLPLKILPLIAITSAESSGFDVDNGTSAGRSPLDPMTSPGSGLILQANFVHSQRRESFLYRSDSDYDLSPKSMSRNSSIASDIHGDDLIVTPFAQVLASLRTVRNNFAALTNLQDRAPSKRSPMCNQPSINKATITEEAYQKLASETLEELDWCLDQLETLQTRHSVSEMASNKFKRMLNRELTHLSEMSRSGNQVSEFISNTFLDKQHEVEIPSPTQKEKEKKKRPMSQISGVKKLMHSSSLTNSSIPRFGVKTEQEDVLAKELEDVNKWGLHVFRIAELSGNRPLTVIMHTIFQERDLLKTFKIPVDTLITYLMTLEDHYHADVAYHNNIHAADVVQSTHVLLSTPALEAVFTDLEILAAIFASAIHDVDHPGVSNQFLINTNSELALMYNDSSVLENHHLAVGFKLLQEENCDIFQNLTKKQRQSLRKMVIDIVLATDMSKHMNLLADLKTMVETKKVTSSGVLLLDNYSDRIQVLQNMVHCADLSNPTKPLQLYRQWTDRIMEEFFRQGDRERERGMEISPMCDKHNASVEKSQVGFIDYIVHPLWETWADLVHPDAQDILDTLEDNREWYQSTIPQSPSPAPDDPEEGRQGQTEKFQFELTLEEDGESDTEKDSGSQVEEDTSCSDSKTLCTQDSESTEIPLDEQVEEEAVGEEEESQPEACVIDDRSPDT

SEQ ID NO: 33165 - protein, 422 aa, Homo sapiens
  ENSP00000421013
MASNKFKRMLNRELTHLSEMSRSGNQVSEFISNTFLDKQHEVEIPSPTQKEKEKKKRPMSQISGVKKLMHSSSLTNSSIPRFGVKTEQEDVLAKELEDVNKWGLHVFRIAELSGNRPLTVIMHTIFQERDLLKTFKIPVDTLITYLMTLEDHYHADVAYHNNIHAADVVQSTHVLLSTPALEAVFTDLEILAAIFASAIHDVDHPGVSNQFLINTNSELALMYNDSSVLENHHLAVGFKLLQEENCDIFQNLTKKQRQSLRKMVIDIVLATDMSKHMNLLADLKTMVETKKVTSSGVLLLDNYSDRIQVLQNMVHCADLSNPTKPLQLYRQWTDRIMEEFFRQGDRERERGMEISPMCDKHNASVEKSQVGFIDYIVHPLWETWADLVHPDAQDILDTLEDNREWYQSTIPQSPSPAPDDPE

SEQ ID NO: 33166 - protein, 215 aa, Homo sapiens
  ENSP00000308485
MAQQTSPDTLTVPEVDNPHCPNPWLNEDLVKSLRENLLQHEKSKTARKSVSPKLSPVISPRNSPRLLRRMLLSSNIPKQRRFTVAHTCFDVDNGTSAGRSPLDPMTSPGSGLILQANFVHSQRRESFLYRSDSDYDLSPKSMSRNSSIASDIHGDDLIVTPFAQVLASLRTVRNNFAALTNLQDRAPSKRSPMCNQPSINKATITGLYNGIIAFL

SEQ ID NO: 33167 - protein, 219 aa, Homo sapiens
  ENSP00000425917
MAQQTSPDTLTVPEVDNPHCPNPWLNEDLVKSLRENLLQHEKSKTARKSVSPKLSPVISPRNSPRLLRRMLLSSNIPKQRRFTVAHTCFDVDNGTSAGRSPLDPMTSPGSGLILQANFVHSQRRESFLYRSDSDYDLSPKSMSRNSSIASDIHGDDLIVTPFAQVLASLRTVRNNFAALTNLQDRAPSKRSPMCNQPSINKATITGSWMELNPYTLLDM

SEQ ID NO: 33168 - protein, 17 aa, Homo sapiens
  ENSP00000423555
MKRNTCDLLSRSKSDKK

SEQ ID NO: 33169 - protein, 81 aa, Homo sapiens
  ENSP00000425910
MKRNTCDLLSRSKSASEETLHSSNEEEDPFRGMEPYLVRRLSCRNIQLPPLAFRQLEQADLKSESENIQRPTSLPLKILPL

SEQ ID NO: 33170 - protein, 74 aa, Homo sapiens
  ENSP00000421829
MKRNTCDLLSRSKSASEETLHSSNEEEDPFRGMEPYLVRRLSCRNIQLPPLAFRQLEQADLKSESENIQRPTSL

SEQ ID NO: 33171 - protein, 29 aa, Homo sapiens
  ENSP00000424281
MKRNTCDLLSRSKSPAYCDLIFLLWPLKL

SEQ ID NO: 33172 - protein, 678 aa, Homo sapiens [sequence omitted]

SEQ ID NO: 33173 - protein, 125 aa, Homo sapiens [sequence omitted]

SEQ ID NO: 33174 - protein, 875 aa, Homo sapiens
  ENSP00000347046
MERAGPSFGQQRQQQQPQQQKQQQRDQDSVEAWLDDHWDFTFSYFVRKATREMVNAWFAERVHTIPVCKEGIRGHTESCSCPLQQSPRADNSAPGTPTRKISASEFDRPLRPIVVKDSEGTVSFLSDSEKKEQMPLTPPRFDHDEGDQCSRLLELVKDISSHLDVTALCHKIFLHIHGLISADRYSLFLVCEDSSNDKFLISRLFDVAEGSTLEEVSNNCIRLEWNKGIVGHVAALGEPLNIKDAYEDPRFNAEVDQITGYKTQSILCMPIKNHREEVVGVAQAINKKSGNGGTFTEKDEKDFAAYLAFCGIVLHNAQLYETSLLENKRNQVLLDLASLIFEEQQSLEVILKKIAATIISFMQVQKCTIFIVDEDCSDSFSSVFHMECEELEKSSDTLTREHDANKINYMYAQYVKNTMEPLNIPDVSKDKRFPWTTENTGNVNQQCIRSLLCTPIKNGKKNKVIGVCQLVNKMEENTGKVKPFNRNDEQFLEAFVIFCGLGIQNTQMYEAVERAMAKQMVTLEVLSYHASAAEEETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRRGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQEKMLINGESGQAKRN

SEQ ID NO: 33175 - protein, 833 aa, Homo sapiens
  ENSP00000264805
MLPFGDKTREMVNAWFAERVHTIPVCKEGIRGHTESCSCPLQQSPRADNSAPGTPTRKISASEFDRPLRPIVVKDSEGTVSFLSDSEKKEQMPLTPPRFDHDEGDQCSRLLELVKDISSHLDVTALCHKIFLHIHGLISADRYSLFLVCEDSSNDKFLISRLFDVAEGSTLEEVSNNCIRLEWNKGIVGHVAALGEPLNIKDAYEDPRFNAEVDQITGYKTQSILCMPIKNHREEVVGVAQAINKKSGNGGTFTEKDEKDFAAYLAFCGIVLHNAQLYETSLLENKRNQVLLDLASLIFEEQQSLEVILKKIAATIISFMQVQKCTIFIVDEDCSDSFSSVFHMECEELEKSSDTLTREHDANKINYMYAQYVKNTMEPLNIPDVSKDKRFPWTTENTGNVNQQCIRSLLCTPIKNGKKNKVIGVCQLVNKMEENTGKVKPFNRNDEQFLEAFVIFCGLGIQNTQMYEAVERAMAKQMVTLEVLSYHASAAEEETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRRGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQEKMLINGESGQAKRN

SEQ ID NO: 33176 - protein, 185 aa, Homo sapiens
  ENSP00000425810
  MOD_RES (1)..(1): Any amino acid
XALSHDLDHRGVNNSYIQRSEHPLAQLYCHSIMEHHHFDQCLMILNSPGNQILSGLSIEEYKTTLKIIKQAILATDLALYIKRRGEFFELIRKNQFNLEDPHQKELFLAMLMTACDLSAITKPWPIQQRIAELVATEFFDQGDRERKELNIEPTDLMNREKKNKIPSMQVGFIDAICLQLYEVFI

SEQ ID NO: 33177 - protein, 224 aa, Homo sapiens
  ENSP00000416309
MVNAWFAERVHTIPVCKEGIRGHTESCSCPLQQSPRADNSAPGTPTRKISASEFDRPLRPIVVKDSEGTVSFLSDSEKKEQMPLTPPRFDHDEGDQCSRLLELVKDISSHLDVTALCHKIFLHIHGLISADRYSLFLVCEDSSNDKFLISRLFDVAEGSTLEEVSNNCIRLEWNKGIVGHVAALGEPLNIKDAYEDPRFNAEVDQITGYKTQSILCMPIKNHRE

SEQ ID NO: 33178 - protein, 823 aa, Homo sapiens
  ENSP00000377957
MVNAWFAERVHTIPVCKEGIRGHTESCSCPLQQSPRADNSAPGTPTRKISASEFDRPLRPIVVKDSEGTVSFLSDSEKKEQMPLTPPRFDHDEGDQCSRLLELVKDISSHLDVTALCHKIFLHIHGLISADRYSLFLVCEDSSNDKFLISRLFDVAEGSTLEEVSNNCIRLEWNKGIVGHVAALGEPLNIKDAYEDPRFNAEVDQITGYKTQSILCMPIKNHREEVVGVAQAINKKSGNGGTFTEKDEKDFAAYLAFCGIVLHNAQLYETSLLENKRNQVLLDLASLIFEEQQSLEVILKKIAATIISFMQVQKCTIFIVDEDCSDSFSSVFHMECEELEKSSDTLTREHDANKINYMYAQYVKNTMEPLNIPDVSKDKRFPWTTENTGNVNQQCIRSLLCTPIKNGKKNKVIGVCQLVNKMEENTGKVKPFNRNDEQFLEAFVIFCGLGIQNTQMYEAVERAMAKQMVTLEVLSYHASAAEEETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRRGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQEKMLINGESGQAKRN

SEQ ID NO: 33179 - protein, 482 aa, Homo sapiens
  ENSP00000385632
MEVCYQLPVLPLDRPVPQHVLSRRGAISFSSSSALFGCPNPRQLSQRRGAISYDSSDQTALYIRMLGDVRVRSRAGFESERRGSHPYIDFRIFHSQSEIEVSVSARNIRRLLSFQRYLRSSRFFRGTAVSNSLNILDDDYNGQAKCMLEKVGNWNFDIFLFDRLTNGNSLVSLTFHLFSLHGLIEYFHLDMMKLRRFLVMIQEDYHSQNPYHNAVHAADVTQAMHCYLKEPKLANSVTPWDILLSLIAAATHDLDHPGVNQPFLIKTNHYLATLYKNTSVLENHHWRSAVGLLRESGLFSHLPLESRQQMETQIGALILATDISRQNEYLSLFRSHLDRGDLCLEDTRHRHLVLQMALKCADICNPCRTWELSKQWSEKVTEEFFHQGDIEKKYHLGVSPLCDRHTESIANIQIGFMTYLVEPLFTEWARFSNTRLSQTMLGHVGLNKASWKGLQREQSSSEDTDAAFELNSQLLPQENRLS

SEQ ID NO: 33180 - protein, 456 aa, Homo sapiens
  ENSP00000368730
MGITLIWCLALVLIKWITSKRRGAISYDSSDQTALYIRMLGDVRVRSRAGFESERRGSHPYIDFRIFHSQSEIEVSVSARNIRRLLSFQRYLRSSRFFRGTAVSNSLNILDDDYNGQAKCMLEKVGNWNFDIFLFDRLTNGNSLVSLTFHLFSLHGLIEYFHLDMMKLRRFLVMIQEDYHSQNPYHNAVHAADVTQAMHCYLKEPKLANSVTPWDILLSLIAAATHDLDHPGVNQPFLIKTNHYLATLYKNTSVLENHHWRSAVGLLRESGLFSHLPLESRQQMETQIGALILATDISRQNEYLSLFRSHLDRGDLCLEDTRHRHLVLQMALKCADICNPCRTWELSKQWSEKVTEEFFHQGDIEKKYHLGVSPLCDRHTESIANIQIGFMTYLVEPLFTEWARFSNTRLSQTMLGHVGLNKASWKGLQREQSSSEDTDAAFELNSQLLPQENRLS

SEQ ID NO: 33181 - protein, 424 aa, Homo sapiens
  ENSP00000379881
MEVCYQLPVLPLDRPVPQHVLSRRGAISFSSSSALFGCPNPRQLSQRRGAISYDSSDQTALYIRMLGDVRVRSRAGFESERRGSHPYIDFRIFHSQSEIEVSVSARNIRRLLSFQRYLRSSRFFRGTAVSNSLNILDDDYNGQAKCMLEKVGNWNFDIFLFDRLTNGNSLVSLTFHLFSLHGLIEYFHLDMMKLRRFLVMIQEDYHSQNPYHNAVHAADVTQAMHCYLKEPKLANSVTPWDILLSLIAAATHDLDHPGVNQPFLIKTNHYLATLYKNTSVLENHHWRSAVGLLRESGLFSHLPLESRQQMETQIGALILATDISRQNEYLSLFRSHLDRGDLCLEDTRHRHLVLQMALKCADICNPCRTWELSKQWSEKVTEEFFHQGDIEKKYHLGVSPLCDRHTESIANIQIGNYTYLDIAG

SEQ ID NO: 33182 - protein, 85 aa, Homo sapiens
  ENSP00000430262
MGITLIWCLALVLIKWITSKRRGAISYDSSDQTALYIRMLGDVRVRSRAGFESERRGSHPYIDFRIFHSQSEIEVSVSARNIRRL

SEQ ID NO: 33183 - protein, 450 aa, Homo sapiens
  ENSP00000310661
MSCLMVERCGEILFENPDQNAKCVCMLGDIRLRGQTGVRAERRGSYPFIDFRLLNSTTYSGEIGTKKKVKRLLSFQRYFHASRLLRGIIPQAPLHLLDEDYLGQARHMLSKVGMWDFDIFLFDRLTNGNSLVTLLCHLFNTHGLIHHFKLDMVTLHRFLVMVQEDYHSQNPYHNAVHAADVTQAMHCYLKEPKLASFLTPLDIMLGLLAAAAHDVDHPGVNQPFLIKTNHHLANLYQNMSVLENHHWRSTIGMLRESRLLAHLPKEMTQDIEQQLGSLILATDINRQNEFLTRLKAHLHNKDLRLEDAQDRHFMLQIALKCADICNPCRIWEMSKQWSERVCEEFYRQGELEQKFELEISPLCNQQKDSIPSIQIGFMSYIVEPLFREWAHFTGNSTLSENMLGHLAHNKAQWKSLLPRQHRSRGSSGSGPDHDHAGQGTESEEQEGDSP

SEQ ID NO: 33184 - protein, 200 aa, Homo sapiens
  ENSP00000403732
  MOD_RES (1)..(1): Any amino acid
XHMLSKVGMWDFDIFLFDRLTNGNSLVTLLCHLFNTHGLIHHFKLDMVTLHRFLVMVQEDYHSQNPYHNAVHAADVTQAMHCYLKEPKLASFLTPLDIMLGLLAAAAHDVDHPGVNQPFLIKTNHHLANLYQVREPNLEPATVWSIALGPVLKPESCPWRKPCFRVLEVQRRMKHNLCPQKFVQTQMLKMSKIQANLIPV

SEQ ID NO: 33185 - protein, 502 aa, Homo sapiens
  ENSP00000482117
MPVLERYFHPAELGRRWTGPEGVLPSSPGSRPGCQQGPLPWDLPEMIRMVKLVWKSKSELQATKQRGILDNEDALRSFPGDIRLRGQTGVRAERRGSYPFIDFRLLNSTTYSGEIGTKKKVKRLLSFQRYFHASRLLRGIIPQAPLHLLDEDYLGQARHMLSKVGMWDFDIFLFDRLTNGNSLVTLLCHLFNTHGLIHHFKLDMVTLHRFLVMVQEDYHSQNPYHNAVHAADVTQAMHCYLKEPKLASFLTPLDIMLGLLAAAAHDVDHPGVNQPFLIKTNHHLANLYQNMSVLENHHWRSTIGMLRESRLLAHLPKEMTQDIEQQLGSLILATDINRQNEFLTRLKAHLHNKDLRLEDAQDRHFMLQIALKCADICNPCRIWEMSKQWSERVCEEFYRQGELEQKFELEISPLCNQQKDSIPSIQIGFMSYIVEPLFREWAHFTGNSTLSENMLGHLAHNKAQWKSLLPRQHRSRGSSGSGPDHDHAGQGTESEEQEGDSP

SEQ ID NO: 33186 - protein, 829 aa, Homo sapiens
  ENSP00000311453
MGCAPSIHISERLVAEDAPSPAAPPLSSGGPRLPQGQKTAALPRTRGAGLLESELRDGSGKKVAVADVQFGPMRFHQDQLQVLLVFTKEDNQCNGFCRACEKAGFKCTVTKEAQAVLACFLDKHHDIIIIDHRNPRQLDAEALCRSIRSSKLSENTVIVGVVRRVDREELSVMPFISAGFTRRYVENPNIMACYNELLQLEFGEVRSQLKLRACNSVFTALENSEDAIEITSEDRFIQYANPAFETTMGYQSGELIGKELGEVPINEKKADLLDTINSCIRIGKEWQGIYYAKKKNGDNIQQNVKIIPVIGQGGKIRHYVSIIRVCNGNNKAEKISECVQSDTHTDNQTGKHKDRRKGSLDVKAVASRATEVSSQRRHSSMARIHSMTIEAPITKVINIINAAQESSPMPVTEALDRVLEILRTTELYSPQFGAKDDDPHANDLVGGLMSDGLRRLSGNEYVLSTKNTQMVSSNIITPISLDDVPPRIARAMENEEYWDFDIFELEAATHNRPLIYLGLKMFARFGICEFLHCSESTLRSWLQIIEANYHSSNPYHNSTHSADVLHATAYFLSKERIKETLDPIDEVAALIAATIHDVDHPGRTNSFLCNAGSELAILYNDTAVLESHHAALAFQLTTGDDKCNIFKNMERNDYRTLRQGIIDMVLATEMTKHFEHVNKFVNSINKPLATLEENGETDKNQEVINTMLRTPENRTLIKRMLIKCADVSNPCRPLQYCIEWAARISEEYFSQTDEEKQQGLPVVMPVFDRNTCSIPKSQISFIDYFITDMFDAWDAFVDLPDLMQHLDNNFKYWKGLDEMKLRNLRPPPE

SEQ ID NO: 33187 - protein, 757 aa, Homo sapiens
  ENSP00000453808
MRFHQDQLQVLLVFTKEDNQCNGFCRACEKAGFKCTVTKEAQAVLACFLDKHHDIIIIDHRNPRQLDAEALCRSIRSSKLSENTVIVGVVRRVDREELSVMPFISAGFTRRYVENPNIMACYNELLQLEFGEVRSQLKLRACNSVFTALENSEDAIEITSEDRFIQYANPAFETTMGYQSGELIGKELGEVPINEKKADLLDTINSCIRIGKEWQGIYYAKKKNGDNIQQNVKIIPVIGQGGKIRHYVSIIRVCNGNNKAEKISECVQSDTHTDNQTGKHKDRRKGSLDVKAVASRATEVSSQRRHSSMARIHSMTIEAPITKVINIINAAQESSPMPVTEALDRVLEILRTTELYSPQFGAKDDDPHANDLVGGLMSDGLRRLSGNEYVLSTKNTQMVSSNIITPISLDDVPPRIARAMENEEYWDFDIFELEAATHNRPLIYLGLKMFARFGICEFLHCSESTLRSWLQIIEANYHSSNPYHNSTHSADVLHATAYFLSKERIKETLDPIDEVAALIAATIHDVDHPGRTNSFLCNAGSELAILYNDTAVLESHHAALAFQLTTGDDKCNIFKNMERNDYRTLRQGIIDMVLATEMTKHFEHVNKFVNSINKPLATLEENGETDKNQEVINTMLRTPENRTLIKRMLIKCADVSNPCRPLQYCIEWAARISEEYFSQTDEEKQQGLPVVMPVFDRNTCSIPKSQISFIDYFITDMFDAWDAFVDLPDLMQHLDNNFKYWKGLDEMKLRNLRPPPE

SEQ ID NO: 33188 - protein, 783 aa, Homo sapiens
  ENSP00000340679
MGCAPSIHISERLVAEDAPSPAAPPLSSGGPRLPQGQKTAALPRTRGAGLLESELRDGSGKKVAVADVQFGPMRFHQDQLQVLLVFTKEDNQCNGFCRACEKAGFKCTVTKEAQAVLACFLDKHHDIIIIDHRNPRQLDAEALCRSIRSSKLSENTVIVGVVRRVDREELSVMPFISAGFTRRYVENPNIMACYNELLQLEFGEVRSQLKLRACNSVFTALENSEDAIEITSEDRFIQEWQGIYYAKKKNGDNIQQNVKIIPVIGQGGKIRHYVSIIRVCNGNNKAEKISECVQSDTHTDNQTGKHKDRRKGSLDVKAVASRATEVSSQRRHSSMARIHSMTIEAPITKVINIINAAQESSPMPVTEALDRVLEILRTTELYSPQFGAKDDDPHANDLVGGLMSDGLRRLSGNEYVLSTKNTQMVSSNIITPISLDDVPPRIARAMENEEYWDFDIFELEAATHNRPLIYLGLKMFARFGICEFLHCSESTLRSWLQIIEANYHSSNPYHNSTHSADVLHATAYFLSKERIKETLDPIDEVAALIAATIHDVDHPGRTNSFLCNAGSELAILYNDTAVLESHHAALAFQLTTGDDKCNIFKNMERNDYRTLRQGIIDMVLATEMTKHFEHVNKFVNSINKPLATLEENGETDKNQEVINTMLRTPENRTLIKRMLIKCADVSNPCRPLQYCIEWAARISEEYFSQTDEEKQQGLPVVMPVFDRNTCSIPKSQISFIDYFITDMFDAWDAFVDLPDLMQHLDNNFKYWKGLDEMKLRNLRPPPE

SEQ ID NO: 33189 - protein, 228 aa, Homo sapiens
  ENSP00000432309
MGCAPSIHISERLVAEDAPSPAAPPLSSGGPRLPQGQKTAALPRTRGAGLLESELRDGSGKKVAVADVQFGPMRFHQDQLQVLLVFTKEDNQCNGFCRACEKAGFKCTVTKEAQAVLACFLDKHHDIIIIDHRNPRQLDAEALCRSIRSSKLSENTVIVGVVRRVDREELSVMPFISAGFTRRYVENPNIMACYNELLQLEFGEVRSQLKLSMQILHLKQQWAISQVN

SEQ ID NO: 33190 - protein, 272 aa, Homo sapiens
  ENSP00000431976
MGCAPSIHISERLVAEDAPSPAAPPLSSGGPRLPQGQKTAALPRTRGAGLLESELRDGSGKKVAVADVQFGPMRFHQDQLQVLLVFTKEDNQCNGFCRACEKAGFKCTVTKEAQAVLACFLDKHHDIIIIDHRNPRQLDAEALCRSIRSSKLSENTVIVGVVRRVDREELSVMPFISAGFTRRYVENPNIMACYNELLQLEFGEVRSQLKLRACNSVFTALENSEDAIEITSEDRFIQPCCSSSWFGAVHIPSSAPVEVGVGLLPSWSLRRT

SEQ ID NO: 33191 - protein, 231 aa, Homo sapiens
  ENSP00000452907
MGCAPSIHISERLVAEDAPSPAAPPLSSGGPRLPQGQKTAALPRTRGAGLLESELRDGSGKKVAVADVQFGPMRFHQDQLQVLLVFTKEDNQCNGFCRACEKAGFKCTVTKEAQAVLACFLDKHHDIIIIDHRNPRQLDAEALCRSIRSSKLSENTVIVGVVRRVDREELSVMPFISAGFTRRYVENPNIMACYNELLQLEFGEVRSQLKLRSGKEFTMPKRKTEIIYNKM

SEQ ID NO: 33192 - protein, 126 aa, Homo sapiens
  ENSP00000454094
AAPPLSSGGPRLPQGQKTAALPRTRGAGLLESELRDGSGKKVAVADVQFGPMRFHQDQLQVLLVFTKEDNQCNGFCRACEKAGFKCTVTKEAQAVLACFLDKHHDIIIIDHRNPRQLDAEALCRGM

SEQ ID NO: 33193 - protein, 829 aa, Homo sapiens; identical to SEQ ID NO: 33186
  ENSP00000378056

SEQ ID NO: 33194 - protein, 116 aa, Homo sapiens
  ENSP00000425720
MRLTQDPIQVLLIFAKEDSQSDGFWWACDRAGYRCNIARTPESALECFLDKHHEIIVIDHRQTQNFDAEAVCRSIRATNPSEHTVILAVVSRVSDDHEEASVLPLLHAGFNRVCTR

SEQ ID NO: 33195 - protein, 838 aa, Homo sapiens
  ENSP00000345446
MGCAPSIHVSQSGVIYCRDSDESSSPRQTTSVSQGPAAPLPGLFVQTDAADAIPPSRASGPPSVARVRRARTELGSGSSAGSAAPAATTSRGRRRHCCSSAEAETQTCYTSVKQVSSAEVRIGPMRLTQDPIQVLLIFAKEDSQSDGFWWACDRAGYRCNIARTPESALECFLDKHHEIIVIDHRQTQNFDAEAVCRSIRATNPSEHTVILAVVSRVSDDHEEASVLPLLHAGFNRRFMENSSIIACYNELIQIEHGEVRSQFKLRACNSVFTALDHCHEAIEITSDDHVIQEWQGVYYARRKSGDSIQQHVKITPVIGQGGKIRHFVSLKKLCCTTDNNKQIHKIHRDSGDNSQTEPHSFRYKNRRKESIDVKSISSRGSDAPSLQNRRYPSMARIHSMTIEAPITKVINIINAAQENSPVTVAEALDRVLEILRTTELYSPQLGTKDEDPHTSDLVGGLMTDGLRRLSGNEYVFTKNVHQSHSHLAMPITINDVPPCISQLLDNEESWDFNIFELEAITHKRPLVYLGLKVFSRFGVCEFLNCSETTLRAWFQVIEANYHSSNAYHNSTHAADVLHATAFFLGKERVKGSLDQLDEVAALIAATVHDVDHPGRTNSFLCNAGSELAVLYNDTAVLESHHTALAFQLTVKDTKCNIFKNIDRNHYRTLRQAIIDMVLATEMTKHFEHVNKFVNSINKPMAAEIEGSDCECNPAGKNFPENQILIKRMMIKCADVANPCRPLDLCIEWAGRISEEYFAQTDEEKRQGLPVVMPVFDRNTCSIPKSQISFIDYFITDMFDAWDAFAHLPALMQHLADNYKHWKTLDDLKCKSLRLPSDS

SEQ ID NO: 33196 - protein, 788 aa, Homo sapiens
  ENSP00000330428
MGCAPSIHVSQSGVIYCRDSDESSSPRQTTSVSQGPAAPLPGLFVQTDAADAIPPSRASGPPSVARVRRARTELGSGSSAGSAAPAATTSRGRRRHCCSSAEAETQTCYTSVKQVSSAEVRIGPMRLTQDPIQVLLIFAKEDSQSDGFWWACDRAGYRCNIARTPESALECFLDKHHEIIVIDHRQTQNFDAEAVCRSIRATNPSEHTVILAVVSRVSDDHEEASVLPLLHAGFNRRFMENSSIIACYNELIQIEHGEVRSQFKLRACNSVFTALDHCHEAIEITSDDHVIQIHKIHRDSGDNSQTEPHSFRYKNRRKESIDVKSISSRGSDAPSLQNRRYPSMARIHSMTIEAPITKVINIINAAQENSPVTVAEALDRVLEILRTTELYSPQLGTKDEDPHTSDLVGGLMTDGLRRLSGNEYVFTKNVHQSHSHLAMPITINDVPPCISQLLDNEESWDFNIFELEAITHKRPLVYLGLKVFSRFGVCEFLNCSETTLRAWFQVIEANYHSSNAYHNSTHAADVLHATAFFLGKERVKGSLDQLDEVAALIAATVHDVDHPGRTNSFLCNAGSELAVLYNDTAVLESHHTALAFQLTVKDTKCNIFKNIDRNHYRTLRQAIIDMVLATEMTKHFEHVNKFVNSINKPMAAEIEGSDCECNPAGKNFPENQILIKRMMIKCADVANPCRPLDLCIEWAGRISEEYFAQTDEEKRQGLPVVMPVFDRNTCSIPKSQISFIDYFITDMFDAWDAFAHLPALMQHLADNYKHWKTLDDLKCKSLRLPSDS

SEQ ID NO: 33197 - protein, 885 aa, Homo sapiens
  ENSP00000264917
MGCAPSIHVSQSGVIYCRDSDESSSPRQTTSVSQGPAAPLPGLFVQTDAADAIPPSRASGPPSVARVRRARTELGSGSSAGSAAPAATTSRGRRRHCCSSAEAETQTCYTSVKQVSSAEVRIGPMRLTQDPIQVLLIFAKEDSQSDGFWWACDRAGYRCNIARTPESALECFLDKHHEIIVIDHRQTQNFDAEAVCRSIRATNPSEHTVILAVVSRVSDDHEEASVLPLLHAGFNRRFMENSSIIACYNELIQIEHGEVRSQFKLRACNSVFTALDHCHEAIEITSDDHVIQYVNPAFERMMGYHKGELLGKELADLPKSDKNRADLLDTINTCIKKGKEWQGVYYARRKSGDSIQQHVKITPVIGQGGKIRHFVSLKKLCCTTDNNKQIHKIHRDSGDNSQTEPHSFRYKNRRKESIDVKSISSRGSDAPSLQNRRYPSMARIHSMTIEAPITKVINIINAAQENSPVTVAEALDRVLEILRTTELYSPQLGTKDEDPHTSDLVGGLMTDGLRRLSGNEYVFTKNVHQSHSHLAMPITINDVPPCISQLLDNEESWDFNIFELEAITHKRPLVYLGLKVFSRFGVCEFLNCSETTLRAWFQVIEANYHSSNAYHNSTHAADVLHATAFFLGKERVKGSLDQLDEVAALIAATVHDVDHPGRTNSFLCNAGSELAVLYNDTAVLESHHTALAFQLTVKDTKCNIFKNIDRNHYRTLRQAIIDMVLATEMTKHFEHVNKFVNSINKPMAAEIEGSDCECNPAGKNFPENQILIKRMMIKCADVANPCRPLDLCIEWAGRISEEYFAQTDEEKRQGLPVVMPVFDRNTCSIPKSQISFIDYFITDMFDAWDAFAHLPALMQHLADNYKHWKTLDDLKCKSLRLPSDS

SEQ ID NO: 33198 - protein, 865 aa, Homo sapiens
  ENSP00000345646
MGCAPSIHVSQSGVIYCRDSDESSSPRQTTSVSQGPAAPLPGLFVQTDAADAIPPSRASGPPSVARVRRARTELGSGSSAGSAAPAATTSRGRRRHCCSSAEAETQTCYTSVKVLLIFAKEDSQSDGFWWACDRAGYRCNIARTPESALECFLDKHHEIIVIDHRQTQNFDAEAVCRSIRATNPSEHTVILAVVSRVSDDHEEASVLPLLHAGFNRRFMENSSIIACYNELIQIEHGEVRSQFKLRACNSVFTALDHCHEAIEITSDDHVIQYVNPAFERMMGYHKGELLGKELADLPKSDKNRADLLDTINTCIKKGKEWQGVYYARRKSGDSIQQHVKITPVIGQGGKIRHFVSLKKLCCTTDNNKQIHKIHRDSGDNSQTEPHSFRYKNRRKESIDVKSISSRGSDAPSLQNRRYPSMARIHSMTIEAPITKVINIINAAQENSPVTVAEALDRVLEILRTTELYSPQLGTKDEDPHTSDLVGGLMTDGLRRLSGNEYVFTKNVHQSHSHLAMPITINDVPPCISQLLDNEESWDFNIFELEAITHKRPLVYLGLKVFSRFGVCEFLNCSETTLRAWFQVIEANYHSSNAYHNSTHAADVLHATAFFLGKERVKGSLDQLDEVAALIAATVHDVDHPGRTNSFLCNAGSELAVLYNDTAVLESHHTALAFQLTVKDTKCNIFKNIDRNHYRTLRQAIIDMVLATEMTKHFEHVNKFVNSINKPMAAEIEGSDCECNPAGKNFPENQILIKRMMIKCADVANPCRPLDLCIEWAGRISEEYFAQTDEEKRQGLPVVMPVFDRNTCSIPKSQISFIDYFITDMFDAWDAFAHLPALMQHLADNYKHWKTLDDLKCKSLRLPSDS

SEQ ID NO: 33199 - protein, 830 aa, Homo sapiens
  ENSP00000331336
MGCAPSIHVSQSGVIYCRDSDESSSPRQTTSVSQGPAAPLPGLFVQTDAADAIPPSRASGPPSVARVRRARTELGSGSSAGSAAPAATTSRGRRRHCCSSAEAETQTCYTSVKQVSSAEVRIGPMRLTQDPIQVLLIFAKEDSQSDGFWWACDRAGYRCNIARTPESALECFLDKHHEIIVIDHRQTQNFDAEAVCRSIRATNPSEHTVILAVVSRVSDDHEEASVLPLLHAGFNRRFMENSSIIACYNELIQIEHGEVRSQFKLRACNSVFTALDHCHEAIEITSDDHVIQYVNPAFERMMGYHKGELLGKELADLPKSDKNRADLLDTINTCIKKGKEWQGVYYARRKSGDSIQQHVKITPVIGQGGKIRHFVSLKKLCCTTDNNKQIHKIHRDSGDNSQTEPHSFRYKNRRKESIDVKSISSRGSDAPSLQNRRYPSMARIHSMTIEAPITKDGLRRLSGNEYVFTKNVHQSHSHLAMPITINDVPPCISQLLDNEESWDFNIFELEAITHKRPLVYLGLKVFSRFGVCEFLNCSETTLRAWFQVIEANYHSSNAYHNSTHAADVLHATAFFLGKERVKGSLDQLDEVAALIAATVHDVDHPGRTNSFLCNAGSELAVLYNDTAVLESHHTALAFQLTVKDTKCNIFKNIDRNHYRTLRQAIIDMVLATEMTKHFEHVNKFVNSINKPMAAEIEGSDCECNPAGKNFPENQILIKRMMIKCADVANPCRPLDLCIEWAGRISEEYFAQTDEEKRQGLPVVMPVFDRNTCSIPKSQISFIDYFITDMFDAWDAFAHLPALMQHLADNYKHWKTLDDLKCKSLRLPSDS

SEQ ID NO: 33200 - protein, 112 aa, Homo sapiens
  ENSP00000426200
MRLTQDPIQVLLIFAKEDSQSDGFWWACDRAGYRCNIARTPESALECFLDKHHEIIVIDHRQTQNFDAEAVCRSIRATNPSEHTVILAVVSRVSDDHEEASVLPLLHAGFNR

SEQ ID NO: 33201 - protein, 119 aa, Homo sapiens
  ENSP00000422861
MENSSIIACYNELIQIEHGEVRSQFKLRACNSVFTALDHCHEAIEITSDDHVIQYVNPAFERMMGYHKGELLGKELADLPKSDKNRADLLDTINTCIKKGKEWQGVYYARRKSGDSIQQ

SEQ ID NO: 33202 - protein, 350 aa, Homo sapiens
  ENSP00000423461
MPITINDVPPCISQLLDNEESWDFNIFELEAITHKRPLVYLGLKVFSRFGVCEFLNCSETTLRAWFQVIEANYHSSNAYHNSTHAADVLHATAFFLGKERVKGSLDQLDEVAALIAATVHDVDHPGRTNSFLCNAGSELAVLYNDTAVLESHHTALAFQLTVKDTKCNIFKNIDRNHYRTLRQAIIDMVLATEMTKHFEHVNKFVNSINKPMAAEIEGSDCECNPAGKNFPENQILIKRMMIKCADVANPCRPLDLCIEWAGRISEEYFAQTDEEKRQGLPVVMPVFDRNTCSIPKSQISFIDYFITDMFDAWDAFAHLPALMQHLADNYKHWKTLDDLKCKSLRLPSDS

SEQ ID NO: 33203 - protein, 533 aa, Homo sapiens
  ENSP00000335242
MGSGSSSYRPKAIYLDIDGRIQKVIFSKYCNSSDIMDLFCIATGLPRNTTISLLTTDDAMVSIDPTMPANSERTPYKVRPVAIKQLSEREELIQSVLAQVAEQFSRAFKINELKAEVANHLAVLEKRVELEGLKVVEIEKCKSDIKKMREELAARSSRTNCPCKYSFLDNHKKLTPRRDVPTYPKYLLSPETIEALRKPTFDVWLWEPNEMLSCLEHMYHDLGLVRDFSINPVTLRRWLFCVHDNYRNNPFHNFRHCFCVAQMMYSMVWLCSLQEKFSQTDILILMTAAICHDLDHPGYNNTYQINARTELAVRYNDISPLENHHCAVAFQILAEPECNIFSNIPPDGFKQIRQGMITLILATDMARHAEIMDSFKEKMENFDYSNEEHMTLLKMILIKCCDISNEVRPMEVAEPWVDCLLEEYFMQSDREKSEGLPVAPFMDRDKVTKATAQIGFIKFVLIPMFETVTKLFPMVEEIMLQPLWESRDRYEELKRIDDAMKELQKKTDSLTSGATEKSRERSRDVKNSEGDCA

SEQ ID NO: 33204 - protein, 593 aa, Homo sapiens
  ENSP00000291539
MGSGSSSYRPKAIYLDIDGRIQKVIFSKYCNSSDIMDLFCIATGLPRNTTISLLTTDDAMVSIDPTMPANSERTPYKVRPVAIKQLSAGVEDKRTTSRGQSAERPLRDRRVVGLEQPRREGAFESGQVEPRPREPQGCYQEGQRIPPEREELIQSVLAQVAEQFSRAFKINELKAEVANHLAVLEKRVELEGLKVVEIEKCKSDIKKMREELAARSSRTNCPCKYSFLDNHKKLTPRRDVPTYPKYLLSPETIEALRKPTFDVWLWEPNEMLSCLEHMYHDLGLVRDFSINPVTLRRWLFCVHDNYRNNPFHNFRHCFCVAQMMYSMVWLCSLQEKFSQTDILILMTAAICHDLDHPGYNNTYQINARTELAVRYNDISPLENHHCAVAFQILAEPECNIFSNIPPDGFKQIRQGMITLILATDMARHAEIMDSFKEKMENFDYSNEEHMTLLKMILIKCCDISNEVRPMEVAEPWVDCLLEEYFMQSDREKSEGLPVAPFMDRDKVTKATAQIGFIKFVLIPMFETVTKLFPMVEEIMLQPLWESRDRYEELKRIDDAMKELQKKTDSLTSGATEKSRERSRDVKNSEGDCA

SEQ ID NO: 33205 - protein, 540 aa, Homo sapiens
  ENSP00000369685
MGSGSSSYRPKAIYLDIDGRIQKVIFSKYCNSSDIMDLFCIATGLPRNTTISLLTTDDAMVSIDPTMPANSERNELILYTSLRNLLFLPSKESWASHQHSVQSETCGHQATLRAFKINELKAEVANHLAVLEKRVELEGLKVVEIEKCKSDIKKMREELAARSSRTNCPCKYSFLDNHKKLTPRRDVPTYPKYLLSPETIEALRKPTFDVWLWEPNEMLSCLEHMYHDLGLVRDFSINPVTLRRWLFCVHDNYRNNPFHNFRHCFCVAQMMYSMVWLCSLQEKFSQTDILILMTAAICHDLDHPGYNNTYQINARTELAVRYNDISPLENHHCAVAFQILAEPECNIFSNIPPDGFKQIRQGMITLILATDMARHAEIMDSFKEKMENFDYSNEEHMTLLKMILIKCCDISNEVRPMEVAEPWVDCLLEEYFMQSDREKSEGLPVAPFMDRDKVTKATAQIGFIKFVLIPMFETVTKLFPMVEEIMLQPLWESRDRYEELKRIDDAMKELQKKTDSLTSGATEKSRERSRDVKNSEGDCA

SEQ ID NO: 33206 - protein, 526 aa, Homo sapiens
  ENSP00000381287
MDAFRSTPYKVRPVAIKQLSAGVEDKRTTSRGQSAERPLRDRRVVGLEQPRREGAFESGQVEPRPREPQGCYQEGQRIPPEREELIQSVLAQVAEQFSRAFKINELKAEVANHLAVLEKRVELEGLKVVEIEKCKSDIKKMREELAARSSRTNCPCKYSFLDNHKKLTPRRDVPTYPKYLLSPETIEALRKPTFDVWLWEPNEMLSCLEHMYHDLGLVRDFSINPVTLRRWLFCVHDNYRNNPFHNFRHCFCVAQMMYSMVWLCSLQEKFSQTDILILMTAAICHDLDHPGYNNTYQINARTELAVRYNDISPLENHHCAVAFQILAEPECNIFSNIPPDGFKQIRQGMITLILATDMARHAEIMDSFKEKMENFDYSNEEHMTLLKMILIKCCDISNEVRPMEVAEPWVDCLLEEYFMQSDREKSEGLPVAPFMDRDKVTKATAQIGFIKFVLIPMFETVTKLFPMVEEIMLQPLWESRDRYEELKRIDDAMKELQKKTDSLTSGATEKSRERSRDVKNSEGDCA

SEQ ID NO: 33207 - protein, 492 aa, Homo sapiens
  ENSP00000381289
MDAFRRNTTISLLTTDDAMVSIDPTMPANSERTPYKVRPVAIKQLSEREELIQSVLAQVAEQFSRAFKINELKAEVANHLAVLEKRVELEGLKVVEIEKCKSDIKKMREELAARSSRTNCPCKYSFLDNHKKLTPRRDVPTYPKYLLSPETIEALRKPTFDVWLWEPNEMLSCLEHMYHDLGLVRDFSINPVTLRRWLFCVHDNYRNNPFHNFRHCFCVAQMMYSMVWLCSLQEKFSQTDILILMTAAICHDLDHPGYNNTYQINARTELAVRYNDISPLENHHCAVAFQILAEPECNIFSNIPPDGFKQIRQGMITLILATDMARHAEIMDSFKEKMENFDYSNEEHMTLLKMILIKCCDISNEVRPMEVAEPWVDCLLEEYFMQSDREKSEGLPVAPFMDRDKVTKATAQIGFIKFVLIPMFETVTKLFPMVEEIMLQPLWESRDRYEELKRIDDAMKELQKKTDSLTSGATEKSRERSRDVKNSEGDCA

SEQ ID NO: 33208 - protein, 507 aa, Homo sapiens
  ENSP00000381291
MGSGSSSYRPKAIYLDIDGRIQKVIFSKYCNSSDIMDLFCIATGLPRTPYKVRPVAIKQLSEREELIQSVLAQVAEQFSRAFKINELKAEVANHLAVLEKRVELEGLKVVEIEKCKSDIKKMREELAARSSRTNCPCKYSFLDNHKKLTPRRDVPTYPKYLLSPETIEALRKPTFDVWLWEPNEMLSCLEHMYHDLGLVRDFSINPVTLRRWLFCVHDNYRNNPFHNFRHCFCVAQMMYSMVWLCSLQEKFSQTDILILMTAAICHDLDHPGYNNTYQINARTELAVRYNDISPLENHHCAVAFQILAEPECNIFSNIPPDGFKQIRQGMITLILATDMARHAEIMDSFKEKMENFDYSNEEHMTLLKMILIKCCDISNEVRPMEVAEPWVDCLLEEYFMQSDREKSEGLPVAPFMDRDKVTKATAQIGFIKFVLIPMFETVTKLFPMVEEIMLQPLWESRDRYEELKRIDDAMKELQKKTDSLTSGATEKSRERSRDVKNSEGDCA

SEQ ID NO: 33209 - protein, 567 aa, Homo sapiens
  ENSP00000328699
MGSGSSSYRPKAIYLDIDGRIQKVIFSKYCNSSDIMDLFCIATGLPRTPYKVRPVAIKQLSAGVEDKRTTSRGQSAERPLRDRRVVGLEQPRREGAFESGQVEPRPREPQGCYQEGQRIPPEREELIQSVLAQVAEQFSRAFKINELKAEVANHLAVLEKRVELEGLKVVEIEKCKSDIKKMREELAARSSRTNCPCKYSFLDNHKKLTPRRDVPTYPKYLLSPETIEALRKPTFDVWLWEPNEMLSCLEHMYHDLGLVRDFSINPVTLRRWLFCVHDNYRNNPFHNFRHCFCVAQMMYSMVWLCSLQEKFSQTDILILMTAAICHDLDHPGYNNTYQINARTELAVRYNDISPLENHHCAVAFQILAEPECNIFSNIPPDGFKQIRQGMITLILATDMARHAEIMDSFKEKMENFDYSNEEHMTLLKMILIKCCDISNEVRPMEVAEPWVDCLLEEYFMQSDREKSEGLPVAPFMDRDKVTKATAQIGFIKFVLIPMFETVTKLFPMVEEIMLQPLWESRDRYEELKRIDDAMKELQKKTDSLTSGATEKSRERSRDVKNSEGDCA

SEQ ID NO: 33210 - protein, 491 aa, Homo sapiens
  ENSP00000335365
MGSGSSSYRPKAIYLDIDGRIQKEHDHLPADHRRRHGLHRPHHAREFRTHSVQSETCGHQATLRAFKINELKAEVANHLAVLEKRVELEGLKVVEIEKCKSDIKKMREELAARSSRTNCPCKYSFLDNHKKLTPRRDVPTYPKYLLSPETIEALRKPTFDVWLWEPNEMLSCLEHMYHDLGLVRDFSINPVTLRRWLFCVHDNYRNNPFHNFRHCFCVAQMMYSMVWLCSLQEKFSQTDILILMTAAICHDLDHPGYNNTYQINARTELAVRYNDISPLENHHCAVAFQILAEPECNIFSNIPPDGFKQIRQGMITLILATDMARHAEIMDSFKEKMENFDYSNEEHMTLLKMILIKCCDISNEVRPMEVAEPWVDCLLEEYFMQSDREKSEGLPVAPFMDRDKVTKATAQIGFIKFVLIPMFETVTKLFPMVEEIMLQPLWESRDRYEELKRIDDAMKELQKKTDSLTSGATEKSRERSRDVKNSEGDCA

SEQ ID NO: 33211 - protein, 552 aa, Homo sapiens
  ENSP00000381281
MDAFRRNTTISLLTTDDAMVSIDPTMPANSERTPYKVRPVAIKQLSAGVEDKRTTSRGQSAERPLRDRRVVGLEQPRREGAFESGQVEPRPREPQGCYQEGQRIPPEREELIQSVLAQVAEQFSRAFKINELKAEVANHLAVLEKRVELEGLKVVEIEKCKSDIKKMREELAARSSRTNCPCKYSFLDNHKKLTPRRDVPTYPKYLLSPETIEALRKPTFDVWLWEPNEMLSCLEHMYHDLGLVRDFSINPVTLRRWLFCVHDNYRNNPFHNFRHCFCVAQMMYSMVWLCSLQEKFSQTDILILMTAAICHDLDHPGYNNTYQINARTELAVRYNDISPLENHHCAVAFQILAEPECNIFSNIPPDGFKQIRQGMITLILATDMARHAEIMDSFKEKMENFDYSNEEHMTLLKMILIKCCDISNEVRPMEVAEPWVDCLLEEYFMQSDREKSEGLPVAPFMDRDKVTKATAQIGFIKFVLIPMFETVTKLFPMVEEIMLQPLWESRDRYEELKRIDDAMKELQKKTDSLTSGATEKSRERSRDVKNSEGDCA

SEQ ID NO: 33212 - protein, 459 aa, Homo sapiens
  ENSP00000381285
MDAFRRNTTISLLTTDDAMVSIDPTMPANSERAFKINELKAEVANHLAVLEKRVELEGLKVVEIEKCKSDIKKMREELAARSSRTNCPCKYSFLDNHKKLTPRRDVPTYPKYLLSPETIEALRKPTFDVWLWEPNEMLSCLEHMYHDLGLVRDFSINPVTLRRWLFCVHDNYRNNPFHNFRHCFCVAQMMYSMVWLCSLQEKFSQTDILILMTAAICHDLDHPGYNNTYQINARTELAVRYNDISPLENHHCAVAFQILAEPECNIFSNIPPDGFKQIRQGMITLILATDMARHAEIMDSFKEKMENFDYSNEEHMTLLKMILIKCCDISNEVRPMEVAEPWVDCLLEEYFMQSDREKSEGLPVAPFMDRDKVTKATAQIGFIKFVLIPMFETVTKLFPMVEEIMLQPLWESRDRYEELKRIDDAMKELQKKTDSLTSGATEKSRERSRDVKNSEGDCA

SEQ ID NO: 33213 - protein, 433 aa, Homo sapiens
  ENSP00000381283
MDAFRRAFKINELKAEVANHLAVLEKRVELEGLKVVEIEKCKSDIKKMREELAARSSRTNCPCKYSFLDNHKKLTPRRDVPTYPKYLLSPETIEALRKPTFDVWLWEPNEMLSCLEHMYHDLGLVRDFSINPVTLRRWLFCVHDNYRNNPFHNFRHCFCVAQMMYSMVWLCSLQEKFSQTDILILMTAAICHDLDHPGYNNTYQINARTELAVRYNDISPLENHHCAVAFQILAEPECNIFSNIPPDGFKQIRQGMITLILATDMARHAEIMDSFKEKMENFDYSNEEHMTLLKMILIKCCDISNEVRPMEVAEPWVDCLLEEYFMQSDREKSEGLPVAPFMDRDKVTKATAQIGFIKFVLIPMFETVTKLFPMVEEIMLQPLWESRDRYEELKRIDDAMKELQKKTDSLTSGATEKSRERSRDVKNSEGDCA

SEQ ID NO: 33214 - protein, 465 aa, Homo sapiens
  ENSP00000344730
MGSGSSSYRPKAIYLDIDGRIQKHSVQSETCGHQATLRAFKINELKAEVANHLAVLEKRVELEGLKVVEIEKCKSDIKKMREELAARSSRTNCPCKYSFLDNHKKLTPRRDVPTYPKYLLSPETIEALRKPTFDVWLWEPNEMLSCLEHMYHDLGLVRDFSINPVTLRRWLFCVHDNYRNNPFHNFRHCFCVAQMMYSMVWLCSLQEKFSQTDILILMTAAICHDLDHPGYNNTYQINARTELAVRYNDISPLENHHCAVAFQILAEPECNIFSNIPPDGFKQIRQGMITLILATDMARHAEIMDSFKEKMENFDYSNEEHMTLLKMILIKCCDISNEVRPMEVAEPWVDCLLEEYFMQSDREKSEGLPVAPFMDRDKVTKATAQIGFIKFVLIPMFETVTKLFPMVEEIMLQPLWESRDRYEELKRIDDAMKELQKKTDSLTSGATEKSRERSRDVKNSEGDCA

SEQ ID NO: 33215 - protein, 466 aa, Homo sapiens
  ENSP00000381280
MDAFRSTPYKVRPVAIKQLSEREELIQSVLAQVAEQFSRAFKINELKAEVANHLAVLEKRVELEGLKVVEIEKCKSDIKKMREELAARSSRTNCPCKYSFLDNHKKLTPRRDVPTYPKYLLSPETIEALRKPTFDVWLWEPNEMLSCLEHMYHDLGLVRDFSINPVTLRRWLFCVHDNYRNNPFHNFRHCFCVAQMMYSMVWLCSLQEKFSQTDILILMTAAICHDLDHPGYNNTYQINARTELAVRYNDISPLENHHCAVAFQILAEPECNIFSNIPPDGFKQIRQGMITLILATDMARHAEIMDSFKEKMENFDYSNEEHMTLLKMILIKCCDISNEVRPMEVAEPWVDCLLEEYFMQSDREKSEGLPVAPFMDRDKVTKATAQIGFIKFVLIPMFETVTKLFPMVEEIMLQPLWESRDRYEELKRIDDAMKELQKKTDSLTSGATEKSRERSRDVKNSEGDCA

SEQ ID NO: 33216 - protein, 345 aa, Homo sapiens
  ENSP00000422464
MSLFGLLLLTSALAGQRQGTQAESNLSSKFQFSSNKEQNGVQDPQHERIITVSTNGSIHSPRFPHTYPRNTVLVWRLVAVEENVWIQLTFDERFGLEDPEDDICKYDFVEVEEPSDGTILGRWCGSGTVPGKQISKGNQIRIRFVSDEYFPSEPGFCIHYNIVMPQFTEAVSPSVLPPSALPLDLLNNAITAFSTLEDLIRYLEPERWQLDLEDLYRPTWQLLGKAFVFGRKSRVVDLNLLTEEVRLYSCTPRNFSVSIREELKRTDTIFWPGCLLVKRCGGNCACCLHNCNECQCVPSKVTKKYHEVLQLRPKTGVRGLHKSLTDVALEHHEECDCVCRGSTGG

SEQ ID NO: 33217 - protein, 50 aa, Homo sapiens
  ENSP00000274071
MSLFGLLLLTSALAGQRQGTQAESNLSSKFQFSSNKEQNGRNYIQASGLA

SEQ ID NO: 33218 - protein, 53 aa, Homo sapiens
  ENSP00000424600
  MOD_RES (1)..(1): Any amino acid
XTFDERFGLEDPEDDICKYDFVEVEEPSDGTILGRWCGSGFCIHYNIVMPNLP

SEQ ID NO: 33219 - protein, 282 aa, Homo sapiens
  ENSP00000410048
MSLFGLLLLTSALAGQRQGTQAESNLSSKFQFSSNKEQNGVQDPQHERIITVSTNGSIHSPRFPHTYPRNTVLVWRLVAVEENVWIQLTFDERFGLEDPEDDICKYDFVEVEEPSDGTILGRWCGSGTVPGKQISKGNQIRIRFVSDEYFPSEPGFCIHYNIVMPQFTEAVSPSVLPPSALPLDLLNNAITAFSTLEDLIRYLEPERWQLDLEDLYRPTWQLLGKAFVFGRKSRVVDLNLLTEEVLQLRPKTGVRGLHKSLTDVALEHHEECDCVCRGSTGG

SEQ ID NO: 33220 - protein, 206 aa, Homo sapiens
  ENSP00000432909
IFEAVGAQGTVVLDEESLHVDDLDLFDGDSGLRFAEDLEVSELKVGADLEREGDLGEVPPHAVHESNHLTDLYRRDETIQVKGNGYVQSPRFPNSYPRNLLLTWRLHSQENTRIQLVFDNQFGLEEAENDICRYDFVEVEDISETSTIIRGRWCGHKEVPPRIKSRTNQIKITFKSDDYFVAKPGFKIYYSLLEDFQPAAASETNW

SEQ ID NO: 33221 - protein, 364 aa, Homo sapiens
  ENSP00000302193
MHRLIFVYTLICANFCSCRDTSATPQSASIKALRNANLRRDDLYRRDETIQVKGNGYVQSPRFPNSYPRNLLLTWRLHSQENTRIQLVFDNQFGLEEAENDICRYDFVEVEDISETSTIIRGRWCGHKEVPPRIKSRTNQIKITFKSDDYFVAKPGFKIYYSLLEDFQPAAASETNWESVTSSISGVSYNSPSVTDPTLIADALDKKIAEFDTVEDLLKYFNPESWQEDLENMYLDTPRYRGRSYHDRKSKVDLDRLNDDAKRYSCTPRNYSVNIREELKLANVVFFPRCLLVQRCGGNCGCGTVNWRSCTCNSGKTVKKYHEVLQFEPGHIKRRGRAKTMALVDIQLDHHERCDCICSSRPPR

SEQ ID NO: 33222 - protein, 370 aa, Homo sapiens
  ENSP00000376865
MHRLIFVYTLICANFCSCRDTSATPQSASIKALRNANLRRDESNHLTDLYRRDETIQVKGNGYVQSPRFPNSYPRNLLLTWRLHSQENTRIQLVFDNQFGLEEAENDICRYDFVEVEDISETSTIIRGRWCGHKEVPPRIKSRTNQIKITFKSDDYFVAKPGFKIYYSLLEDFQPAAASETNWESVTSSISGVSYNSPSVTDPTLIADALDKKIAEFDTVEDLLKYFNPESWQEDLENMYLDTPRYRGRSYHDRKSKVDLDRLNDDAKRYSCTPRNYSVNIREELKLANVVFFPRCLLVQRCGGNCGCGTVNWRSCTCNSGKTVKKYHEVLQFEPGHIKRRGRAKTMALVDIQLDHHERCDCICSSRPPR

SEQ ID NO: 33223 - protein, 1089 aa, Homo sapiens
  ENSP00000257290
MGTSHPAFLVLGCLLTGLSLILCQLSLPSILPNENEKVVQLNSSFSLRCFGESEVSWQYPMSEEESSDVEIRNEENNSGLFVTVLEVSSASAAHTGLYTCYYNHTQTEENELEGRHIYIYVPDPDVAFVPLGMTDYLVIVEDDDSAIIPCRTTDPETPVTLHNSEGVVPASYDSRQGFNGTFTVGPYICEATVKGKKFQTIPFNVYALKATSELDLEMEALKTVYKSGETIVVTCAVFNNEVVDLQWTYPGEVKGKGITMLEEIKVPSIKLVYTLTVPEATVKDSGDYECAARQATREVKEMKKVTISVHEKGFIEIKPTFSQLEAVNLHEVKHFVVEVRAYPPPRISWLKNNLTLIENLTEITTDVEKIQEIRYRSKLKLIRAKEEDSGHYTIVAQNEDAVKSYTFELLTQVPSSILDLVDDHHGSTGGQTVRCTAEGTPLPDIEWMICKDIKKCNNETSWTILANNVSNIITEIHSRDRSTVEGRVTFAKVEETIAVRCLAKNLLGAENRELKLVAPTLRSELTVAAAVLVLLVIVIISLIVLVVIWKQKPRYEIRWRVIESISPDGHEYIYVDPMQLPYDSRWEFPRDGLVLGRVLGSGAFGKVVEGTAYGLSRSQPVMKVAVKMLKPTARSSEKQALMSELKIMTHLGPHLNIVNLLGACTKSGPIYIITEYCFYGDLVNYLHKNRDSFLSHHPEKPKKELDIFGLNPADESTRSYVILSFENNGDYMDMKQADTTQYVPMLERKEVSKYSDIQRSLYDRPASYKKKSMLDSEVKNLLSDDNSEGLTLLDLLSFTYQVARGMEFLASKNCVHRDLAARNVLLAQGKIVKICDFGLARDIMHDSNYVSKGSTFLPVKWMAPESIFDNLYTTLSDVWSYGILLWEIFSLGGTPYPGMMVDSTFYNKIKSGYRMAKPDHATSEVYEIMVKCWNSEPEKRPSFYHLSEIVENLLPGQYKKSYEKIHLDFLKSDHPAVARMRVDSDNAYIGVTYKNEEDKLKDWEGGLDEQRLSADSGYIIPLPDIDPVPEEEDLGKRNRHSSQTSEESAIETGSSSSTFIKREDETIEDIDMMDDIGIDSSDLVEDSFL

SEQ ID NO: 33224 - protein, 218 aa, Homo sapiens
  ENSP00000425648
MGTSHPAFLVLGCLLTGLSLILCQLSLPSILPNENEKVVQLNSSFSLRCFGESEVSWQYPMSEEESSDVEIRNEENNSGLFVTVLEVSSASAAHTGLYTCYYNHTQTEENELEGRHIYIYVPDPDVAFVPLGMTDYLVIVEDDDSAIIPCRTTDPETPVTLHNSEGVVPASYDSRQGFNGTFTVGPYICEATVKGKKFQTIPFNVYALKGTCIISFLL

SEQ ID NO: 33225 - protein, 147 aa, Homo sapiens
  ENSP00000425626
MLPRLVLNSWAQMICLPQLPKFPRAMGTSHPAFLVLGCLLTGLSLILCQLSLPSILPNENEKVVQLNSSFSLRCFGESEVSWQYPMSEEESSDVEIRNEENNSGLFVTVLEVSSASAAHTGLYTCYYNHTQTEENELEGRHIYIYVP

SEQ ID NO: 33226 - protein, 743 aa, Homo sapiens
  ENSP00000424218
MGTSHPAFLVLGCLLTGLSLILCQLSLPSILPNENEKVVQLNSSFSLRCFGESEVSWQYPMSEEESSDVEIRNEENNSGLFVTVLEVSSASAAHTGLYTCYYNHTQTEENELEGRHIYIYVPDPDVAFVPLGMTDYLVIVEDDDSAIIPCRTTDPETPVTLHNSEGVVPASYDSRQGFNGTFTVGPYICEATVKGKKFQTIPFNVYALKATSELDLEMEALKTVYKSGETIVVTCAVFNNEVVDLQWTYPGEVKGKGITMLEEIKVPSIKLVYTLTVPEATVKDSGDYECAARQATREVKEMKKVTISVHEKGFIEIKPTFSQLEAVNLHEVKHFVVEVRAYPPPRISWLKNNLTLIENLTEITTDVEKIQEIRYRSKLKLIRAKEEDSGHYTIVAQNEDAVKSYTFELLTQVPSSILDLVDDHHGSTGGQTVRCTAEGTPLPDIEWMICKDIKKCNNETSWTILANNVSNIITEIHSRDRSTVEGRVTFAKVEETIAVRCLAKNLLGAENRELKLVAPTLRSELTVAAAVLVLLVIVIISLIVLVVIWKQKPRYEIRWRVIESISPDGHEYIYVDPMQLPYDSRWEFPRDGLVLGRVLGSGAFGKVVEGTAYGLSRSQPVMKVAVKMLKPTARSSEKQALMSELKIMTHLGPHLNIVNLLGACTKSGPIYIITEYCFYGDLVNYLHKNRDSFLSHHPEKPKKELDIFGLNPADESTRSSGQGCLSSGTLQELSVDLQARGPC

SEQ ID NO: 33227 - protein, 159 aa, Homo sapiens
  ENSP00000425902
MGTSHPAFLVLGCLLTGLSLILCQLSLPSILPNENEKVVQLNSSFSLRCFGESEVSWQYPMSEEESSDVEIRNEENNSGLFVTVLEVSSASAAHTGLYTCYYNHTQTEENELEGRHIYIYVPDPDVAFVPLGMTDYLVIVEDDDSAIIPCRTTDPETPV

SEQ ID NO: 33228 - protein, 158 aa, Homo sapiens
  ENSP00000426472
MGTSHPAFLVLGCLLTGLSLILCQLSLPSILPNENEKVVQLNSSFSLRCFGESEVSWQYPMSEEESSDVEIRNEENNSGLFVTVLEVSSASAAHTGLYTCYYNHTQTEENELEGRHIYIYVPDPDVAFVPLGMTDYLVIVEDDDSAIIPCRTTDPETP

SEQ ID NO: 33229 - protein, 154 aa, Homo sapiens
  ENSP00000425232
MGTSHPAFLVLGCLLTGLSLILCQLSLPSILPNENEKVVQLNSSFSLRCFGESEVSWQYPMSEEESSDVEIRNEENNSGLFVTVLEVSSASAAHTGLYTCYYNHTQTEENELEGRHIYIYVPDPDVAFVPLGMTDYLVIVEDDDSAIIPCRTTD

SEQ ID NO: 33230 - protein, 1089 aa, Homo sapiens; identical to SEQ ID NO: 33223
  ENSP00000257290

SEQ ID NO: 33231 - protein, 218 aa, Homo sapiens; identical to SEQ ID NO: 33224
  ENSP00000425648

SEQ ID NO: 33232 - protein, 147 aa, Homo sapiens; identical to SEQ ID NO: 33225
  ENSP00000425626

SEQ ID NO: 33233 - protein, 743 aa, Homo sapiens; identical to SEQ ID NO: 33226
  ENSP00000424218

SEQ ID NO: 33234 - protein, 159 aa, Homo sapiens; identical to SEQ ID NO: 33227
  ENSP00000425902

SEQ ID NO: 33235 - protein, 158 aa, Homo sapiens; identical to SEQ ID NO: 33228
  ENSP00000426472

SEQ ID NO: 33236 - protein, 154 aa, Homo sapiens; identical to SEQ ID NO: 33229
  ENSP00000425232

SEQ ID NO: 33237 - protein, 1106 aa, Homo sapiens
  ENSP00000261799
MRLPGAMPALALKGELLLLSLLLLLEPQISQGLVVTPPGPELVLNVSSTFVLTCSGSAPVVWERMSQEPPQEMAKAQDGTFSSVLTLTNLTGLDTGEYFCTHNDSRGLETDERKRLYIFVPDPTVGFLPNDAEELFIFLTEITEITIPCRVTDPQLVVTLHEKKGDVALPVPYDHQRGFSGIFEDRSYICKTTIGDREVDSDAYYVYRLQVSSINVSVNAVQTVVRQGENITLMCIVIGNEVVNFEWTYPRKESGRLVEPVTDFLLDMPYHIRSILHIPSAELEDSGTYTCNVTESVNDHQDEKAINITVVESGYVRLLGEVGTLQFAELHRSRTLQVVFEAYPPPTVLWFKDNRTLGDSSAGEIALSTRNVSETRYVSELTLVRVKVAEAGHYTMRAFHEDAEVQLSFQLQINVPVRVLELSESHPDSGEQTVRCRGRGMPQPNIIWSACRDLKRCPRELPPTLLGNSSEEESQLETNVTYWEEEQEFEVVSTLRLQHVDRPLSVRCTLRNAVGQDTQEVIVVPHSLPFKVVVISAILALVVLTIISLIILIMLWQKKPRYEIRWKVIESVSSDGHEYIYVDPMQLPYDSTWELPRDQLVLGRTLGSGAFGQVVEATAHGLSHSQATMKVAVKMLKSTARSSEKQALMSELKIMSHLGPHLNVVNLLGACTKGGPIYIITEYCRYGDLVDYLHRNKHTFLQHHSDKRRPPSAELYSNALPVGLPLPSHVSLTGESDGGYMDMSKDESVDYVPMLDMKGDVKYADIESSNYMAPYDNYVPSAPERTCRATLINESPVLSYMDLVGFSYQVANGMEFLASKNCVHRDLAARNVLICEGKLVKICDFGLARDIMRDSNYISKGSTFLPLKWMAPESIFNSLYTTLSDVWSFGILLWEIFTLGGTPYPELPMNEQFYNAIKRGYRMAQPAHASDEIYEIMQKCWEEKFEIRPPFSQLVLLLERLLGEGYKKKYQQVDEEFLRSDHPAILRSQARLPGFHGLRSPLDTSSVLYTAVQPNEGDNDYIIPLPDPKPEVADEGPLEGSPSLASSTLNEVNTSSTISCDSPLEPQDEPEPEPQLELQVEPEPELEQLPDSGCPAPRAEAEDSFL

SEQ ID NO: 33238 - protein, 239 aa, Homo sapiens
  ENSP00000430026
MRLPGAMPALALKGELLLLSLLLLLEPQISQGLVVTPPGPELVLNVSSTFVLTCSGSAPVVWERMSQEPPQEMAKAQDGTFSSVLTLTNLTGLDTGEYFCTHNDSRGLETDERKRLYIFVPDPTVGFLPNDAEELFIFLTEITEITIPCRVTDPQLVVTLHEKKGDVALPVPYDHQRGFSGIFEDRSYICKTTIGDREVDSDAYYVYRLQGEPPFWPDAQQSVIHQRLCERSADCGPPG

SEQ ID NO: 33239 - protein, 146 aa, Homo sapiens
  ENSP00000429218
MSQEPPQEMAKAQDGTFSSVLTLTNLTGLDTGEYFCTHNDSRGLETDERKRLYIFVPDPTVGFLPNDAEELFIFLTEITEITIPCRVTDPQLVVTLHEKKGDVALPVPYDHQRGFSGIFEDRSYICKTTIGDREVDSDAYYVYRLQ

SEQ ID NO: 33240 - protein, 174 aa, Homo sapiens
  ENSP00000430715
MRLPGAMPALALKGELLLLSLLLLLEPQISQGLVVTPPGPELVLNVSSTFVLTCSGSAPVVWERMSQEPPQEMAKAQDGTFSSVLTLTNLTGLDTGEYFCTHNDSRGLETDERKRLYIFVPDPTVGFLPNDAEELFIFLTEITEITIPCRVTDPQLVVTLHEKKGDVALPVPYD

SEQ ID NO: 33241 - protein, 406 aa, Homo sapiens
  ENSP00000368460
MRLFRWLLKQPVPKQIERYSRFSPSPLSIKQFLDFGRDNACEKTSYMFLRKELPVRLANTMREVNLLPDNLLNRPSVGLVQSWYMQSFLELLEYENKSPEDPQVLDNFLQVLIKVRNRHNDVVPTMAQGVIEYKEKFGFDPFISTNIQYFLDRFYTNRISFRMLINQHTLLFGGDTNPVHPKHIGSIDPTCNVADVVKDAYETAKMLCEQYYLVAPELEVEEFNAKAPDKPIQVVYVPSHLFHMLFELFKNSMRATVELYEDRKEGYPAVKTLVTLGKEDLSIKISDLGGGVPLRKIDRLFNYMYSTAPRPSLEPTRAAPLAGFGYGLPISRLYARYFQGDLKLYSMEGVGTDAVIYLKALSSESFERLPVFNKSAWRHYKTTPEADDWSNPSSEPRDASKYKAKQ

SEQ ID NO: 33242 - protein, 415 aa, Homo sapiens
  ENSP00000387536
MRLFRWLLKQPVPKQIERYSRFSPSPLSIKQFLDFGRDNACEKTSYMFLRKELPVRLANTMREVNLLPDNLLNRPSVGLVQSWYMQSFLELLEYENKSPEDPQVLDNFLQVLIKVRNRHNDVVPTMAQGVIEYKEKFGFDPFISTNIQYFLDRFYTNRISFRMLINQHTLLFGGDTNPVHPKHIGSIDPTCNVADVVKDAYETAKMLCEQYYLVAPELEVEEFNAKAPDKPIQVVYVPSHLFHMLFELFKNSMRATVELYEDRKEGYPAVKTLVTLGKEDLSIKISDLGGGVPLRKIDRLFNYMYSTAPRPSLEPTRAAPLAGFGYGLPISRLYARYFQGDLKLYSMEGVGTDAVIYLKALSSESFERLPVFNKSAWRHYKTTPEADDWSNPSSEPRDASKYKAKQDKIKTNRTF

SEQ ID NO: 33243 - protein, 364 aa, Homo sapiens
  ENSP00000284770
MPQTVILPGPAPWGFRLSGGIDFNQPLVITRITPGSKAAAANLCPGDVILAIDGFGTESMTHADAQDRIKAAAHQLCLKIDRGETHLWSPQVSEDGKAHPFKINLESEPQDGNYFEHKHNIRPKPFVIPGRSSGCSTPSGIDCGSGRSTPSSVSTVSTICPGDLKVAAKLAPNIPLEMELPGVKIVHAQFNTPMQLYSDDNIMETLQGQVSTALGETPLMSEPTASVPPESDVYRMLHDNRNEPTQPRQSGSFRVLQGMVDDGSDDRPAGTRSVRAPVTKVHGGSGGAQRMPLCDKCGSGIVGAVVKARDKYRHPECFVCADCNLNLKQKGYFFIEGELYCETHARARTKPPEGYDTVTLYPKA

SEQ ID NO: 33244 - protein, 316 aa, Homo sapiens
  ENSP00000284771
MPQTVILPGPAPWGFRLSGGIDFNQPLVITRITPGSKAAAANLCPGDVILAIDGFGTESMTHADAQDRIKAAAHQLCLKIDRGETHLWSPQVSEDGKAHPFKINLESEPQEFKPIGTAHNRRAQPFVAAANIDDKRQVVSASYNSPIGLYSTSNIQDALHGQLRGLIPSSPQNEPTASVPPESDVYRMLHDNRNEPTQPRQSGSFRVLQGMVDDGSDDRPAGTRSVRAPVTKVHGGSGGAQRMPLCDKCGSGIVGAVVKARDKYRHPECFVCADCNLNLKQKGYFFIEGELYCETHARARTKPPEGYDTVTLYPKA

SEQ ID NO: 33245 - protein, 42 aa, Homo sapiens
  ENSP00000425138
MPQTVILPGPAPWGFRLSGGIDFNQPLVITRGRNSLMVSTSI

SEQ ID NO: 33246 - protein, 42 aa, Homo sapiens; identical to SEQ ID NO: 33245
  ENSP00000421972

SEQ ID NO: 33247 - protein, 197 aa, Homo sapiens
  ENSP00000481771
MPQTVILPGPAPWGFRLSGGIDFNQPLVITRDGNYFEHKHNIRPKPFVIPGRSSEPTASVPPESDVYRMLHDNRNEPTQPRQSGSFRVLQGMVDDGSDDRPAGTRSVRAPVTKVHGGSGGAQRMPLCDKCGSGIVGAVVKARDKYRHPECFVCADCNLNLKQKGYFFIEGELYCETHARARTKPPEGYDTVTLYPKA

SEQ ID NO: 33248 - protein, 276 aa, Homo sapiens
  ENSP00000284767
MPQTVILPGPAPWGFRLSGGIDFNQPLVITRITPGSKAAAANLCPGDVILAIDGFGTESMTHADAQDRIKAAAHQLCLKIDRGETHLWSPQVSEDGKAHPFKINLESEPQDGNYFEHKHNIRPKPFVIPGRSSEPTASVPPESDVYRMLHDNRNEPTQPRQSGSFRVLQGMVDDGSDDRPAGTRSVRAPVTKVHGGSGGAQRMPLCDKCGSGIVGAVVKARDKYRHPECFVCADCNLNLKQKGYFFIEGELYCETHARARTKPPEGYDTVTLYPKA

SEQ ID NO: 33249 - protein, 42 aa, Homo sapiens; identical to SEQ ID NO: 33245
  ENSP00000486107

SEQ ID NO: 33250 - protein, 330 aa, Homo sapiens
  ENSP00000253754
MPHSVTLRGPSPWGFRLVGGRDFSAPLTISRVHAGSKAALAALCPGDLIQAINGESTELMTHLEAQNRIKGCHDHLTLSVSRPEGRSWPSAPDDSKAQAHRIHIDPEIQDGSPTTSRRPSGTGTGPEDGRPSLGSPYGQPPRFPVPHNGSSEATLPAQMSTLHVSPPPSADPARGLPRSRDCRVDLGSEVYRMLREPAEPVAAEPKQSGSFRYLQGMLEAGEGGDWPGPGGPRNLKPTASKLGAPLSGLQGLPECTRCGHGIVGTIVKARDKLYHPECFMCSDCGLNLKQRGYFFLDERLYCESHAKARVKPPEGYDVVAVYPNAKVELV

SEQ ID NO: 33251 - protein, 246 aa, Homo sapiens
  ENSP00000368303
MPHSVTLRGPSPWGFRLVGGRDFSAPLTISRVHAGSKAALAALCPGDLIQAINGESTELMTHLEAQNRIKGCHDHLTLSVSRPEGRSWPSAPDDSKAQAHRIHIDPEIQDGSPTTSRRPSGTGTGPEDGRPSLGSPYGQPPRFPVPHNGSSEATLPAQMSTLHVSPPPSADPARGLPRSRDCRVDLGSEVYRMLREPAEPVAAEPKQSGSFRYLQGMLEAGEGGAPSSRHGTSSTIPSASCAVTAA

SEQ ID NO: 33252 - protein, 121 aa, Homo sapiens
  ENSP00000411753
MTHLEAQNRIKGCHDHLTLSVSRPEGRSWPSAPDDSKAQAHRIHIDPEIQDGSPTTSRRPSGTGTGPEDGRPSLGSPYGQPPRFPVPHNGSSEATLPAQMSTLHVSPPPSADPARGLPRSR

SEQ ID NO: 33253 - protein, 492 aa, Homo sapiens
  ENSP00000434559
MVTPSPPGNHSLSLEAPRLHTASDLLDPWSLERPRFCLLSKEEGKSFGFHLQQELGRAGHVVCRVDPGTSAQRQGLQEGDRILAVNNDVVEHEDYAVVVRRIRASSPRVLLTVLARHAHDVARAQLGEDAHLCPTLGPGVRPRLCHIVKDEGGFGFSVTHGNQGPFWLVLSTGGAAERAGVPPGARLLEVNGVSVEKFTHNQLTRKLWQSGQQVTLLVAGPEVEEQCRQLGLPLAAPLAEGWALPTKPRCLHLEKGPQGFGFLLREEKGLDGRPGQFLWEVDPGLPAKKAGMQAGDRLVAVAGESVEGLGHEETVSRIQGQGSCVSLTVVDPEADRFFSMVRLSPLLFLENTEAPASPRGSSSASLVETEDPSLEDTSVPSVPLGSRQCFLYPGPGGSYGFRLSCVASGPRLFISQVTPGGSAARAGLQVGDVILEVNGYPVGGQNDLERLQQLPEAEPPLCLKLAARSLRGLEAWIPPGAAEDWALASDLL

SEQ ID NO: 33254 - protein, 571 aa, Homo sapiens
  ENSP00000431164
MVTPSPPGNHSLSLEAPRLHTASDLLGNHSLGLPLITALVGSRDRRGRVFSPVPVPLPTNPTTQHPTRQKLPSTLSGHRVCQAHGEPVLGLCPLLPLFCCPPHPPDPWSLERPRFCLLSKEEGKSFGFHLQQELGRAGHVVCRVDPGTSAQRQGLQEGDRILAVNNDVVEHEDYAVVVRRIRASSPRVLLTVLARHAHDVARAQLGEDAHLCPTLGPGVRPRLCHIVKDEGGFGFSVTHGNQGPFWLVLSTGGAAERAGVPPGARLLEVNGVSVEKFTHNQLTRKLWQSGQQVTLLVAGPEVEEQCRQLGLPLAAPLAEGWALPTKPRCLHLEKGPQGFGFLLREEKGLDGRPGQFLWEVDPGLPAKKAGMQAGDRLVAVAGESVEGLGHEETVSRIQGQGSCVSLTVVDPEADRFFSMVRLSPLLFLENTEAPASPRGSSSASLVETEDPSLEDTSVPSVPLGSRQCFLYPGPGGSYGFRLSCVASGPRLFISQVTPGGSAARAGLQVGDVILEVNGYPVGGQNDLERLQQLPEAEPPLCLKLAARSLRGLEAWIPPGAAEDWALASDLL

SEQ ID NO: 33255 - protein, 119 aa, Homo sapiens
  ENSP00000434264
MEKAADLQDTASLTLKFKFNPKLGIDNPVLSLAEDHDPYDPWSLERPRFCLLSKEEGKSFGFHLQQELGRAGHVVCRVDPGTSAQRQGLQEGDRILAVNNDVVEHEDYAVAIRVLSGWC

SEQ ID NO: 33256 - protein, 505 aa, Homo sapiens
  ENSP00000347742
MEKAADLQDTASLTLKFKFNPKLGIDNPVLSLAEDHDPYDPWSLERPRFCLLSKEEGKSFGFHLQQELGRAGHVVCRVDPGTSAQRQGLQEGDRILAVNNDVVEHEDYAVVVRRIRASSPRVLLTVLARHAHDVARAQLGEDAHLCPTLGPGVRPRLCHIVKDEGGFGFSVTHGNQGPFWLVLSTGGAAERAGVPPGARLLEVNGVSVEKFTHNQLTRKLWQSGQQVTLLVAGPEVEEQCRQLGLPLAAPLAEGWALPTKPRCLHLEKGPQGFGFLLREEKGLDGRPGQFLWEVDPGLPAKKAGMQAGDRLVAVAGESVEGLGHEETVSRIQGQGSCVSLTVVDPEADRFFSMVRLSPLLFLENTEAPASPRGSSSASLVETEDPSLEDTSVPSVPLGSRQCFLYPGPGGSYGFRLSCVASGPRLFISQVTPGGSAARAGLQVGDVILEVNGYPVGGQNDLERLQQLPEAEPPLCLKLAARSLRGLEAWIPPGAAEDWALASDLL

SEQ ID NO: 33257 - protein, 491 aa, Homo sapiens
  ENSP00000327107
MEKAADLQDTASLTLKFKFNPKLGIDNPVLSLAEDHDPYDPWSLERPRFCLLSKEEGKSFGFHLQQELGRAGHVVCRVDPGTSAQRQGLQEGDRILAVNNDVVEHEDYAVVVRRIRASSPRVLLTVLARHAHDVARAQLGEDAHLCPTLGPGVRPRLCHIVKDEGGFGFSVTHGNQGPFWLVLSTGGAAERAGVPPGARLLEVNGLWQSGQQVTLLVAGPEVEEQCRQLGLPLAAPLAEGWALPTKPRCLHLEKGPQGFGFLLREEKGLDGRPGQFLWEVDPGLPAKKAGMQAGDRLVAVAGESVEGLGHEETVSRIQGQGSCVSLTVVDPEADRFFSMVRLSPLLFLENTEAPASPRGSSSASLVETEDPSLEDTSVPSVPLGSRQCFLYPGPGGSYGFRLSCVASGPRLFISQVTPGGSAARAGLQVGDVILEVNGYPVGGQNDLERLQQLPEAEPPLCLKLAARSLRGLEAWIPPGAAEDWALASDLL

SEQ ID NO: 33258 - protein, 133 aa, Homo sapiens
  ENSP00000474447
MAQGFAVGFDPLGLGDLSSGSLSSLSSRGHLGSDSGSTATRYLLRKQQRLLNGPPRGIRASSPMGRVILINSPIEANSDESDIIHSVRVEKSPAGRLGFSVRGGSEHGLGIFVSKVEEGSSAGKQNPQAEVHA

SEQ ID NO: 33259 - protein, 208 aa, Homo sapiens
  ENSP00000412533
  MOD_RES (1)..(1): Any amino acid
XPRPPITRSQSYLTLWEEKQQRKKEKSGSPGEKGALQRSKTLMNLFFKGGRQGRLARDGRREAWTLDSGSLAKTYPRLDIEKAGGVGPVQKFVTWRLRRDQERGRALLSARSGSPSSQLPNVDEQVQAWESRRPLIQDLAQRLLTDDEVLAVTRHCSRYVHEGGIEDLVRPLLAILDRPEKLLLLQDIRSVVAPTDLGRFDSMVMLVE

SEQ ID NO: 33260 - protein, 517 aa, Homo sapiens
  ENSP00000359234
MAQGFAVGFDPLGLGDLSSGSLSSLSSRGHLGSDSGSTATRYLLRKQQRLLNGPPRGIRASSPMGRVILINSPIEANSDESDIIHSVRVEKSPAGRLGFSVRGGSEHGLGIFVSKVEEGSSAERAGLCVGDKITEVNGLSLESTTMGSAVKVLTSSSRLHMMVRRMGRVPGIKFSKEKTTWVDVVNRRLVVEKCGSTPSDTSSEDGVRRIVHLYTTSDDFCLGFNIRGGKEFGLGIYVSKVDHGGLAEENGIKVGDQVLAANGVRFDDISHSQAVEVLKGQTHIMLTIKETGRYPAYKEMVSEYCWLDRLSNGVLQQLSPASESSSSVSSCASSAPYSSGSLPSDRMDICLGQEEPGSRGPGWGRADTAMQTEPDAGGRVETWCSVRPTVILRDTAIRSDGPHPGRRLDSALSESPKTALLLALSRPRPPITRSQSYLTLWEEKQQRKKEKSGSPGEKGALQRSKTLMNLFFKGGRQGRLARDGRREAWTLDSGSLAKTYPRLDIEKEMGVSPCCPG

SEQ ID NO: 33261 - protein, 181 aa, Homo sapiens
  ENSP00000474831
MAQGFAVGFDPLGLGDLSSGSLSSLSSRGHLGSDSGSTATRYLLRKQQRLLNGPPRGIRASSPMGRVILINSPIEANSDESDIIHSVRVEKSPAGRLGFSVRGGSEHGLGIFVSKVEEGSSAERAGLCVGDKITEVNGLSLESTTMGSAVKVLTSSSRLHMMVRRMGRVPGIKFSKEKTTW

SEQ ID NO: 33262 - protein, 1033 aa, Homo sapiens
  ENSP00000480489
MAQGFAVGFDPLGLGDLSSGSLSSLSSRGHLGSDSGSTATRYLLRKQQRLLNGPPRGIRASSPMGRVILINSPIEANSDESDIIHSVRVEKSPAGRLGFSVRGGSEHGLGIFVSKVEEGSSAERAGLCVGDKITEVNGLSLESTTMGSAVKVLTSSSRLHMMVRRMGRVPGIKFSKEKTTWVDVVNRRLVVEKCGSTPSDTSSEDGVRRIVHLYTTSDDFCLGFNIRGGKEFGLGIYVSKVDHGGLAEENGIKVGDQVLAANGVRFDDISHSQAVEVLKGQTHIMLTIKETGRYPAYKEMVSEYCWLDRLSNGVLQQLSPASESSSSVSSCASSAPYSSGSLPSDRMDICLGQEEPGSRGPGWGRADTAMQTEPDAGGRVETWCSVRPTVILRDTAIRSDGPHPGRRLDSALSESPKTALLLALSRPRPPITRSQSYLTLWEEKQQRKKEKSGSPGEKGALQRSKTLMNLFFKGGRQGRLARDGRREAWTLDSGSLAKTYPRLDIEKAGGVGPVQKFVTWRLRRDQERGRALLSARSGSPSSQLPNVDEQVQAWESRRPLIQDLAQRLLTDDEVLAVTRHCSRYVHEGGIEDLVRPLLAILDRPEKLLLLQDIRSVVAPTDLGRFDSMVMLVELEAFEALKSRAVRPPALRPARQDTPPKRHLITPVPDSRGGFYLLPVNGFPEEEDNGELRERLGALKVSPSASAPRHPHKGIPPLQDVPVDAFTPLRIACTPPPQLPPVAPRPLRPNWLLTEPLSREHPPQSQIRGRAQSRSRSRSRSRSRSSRGQGKSPGRRSPSPVPTPAPSMTNGRYHKPRKARPPLPRPLDGEAAKVGAKQGPSESGTEGTAKEAAMKNPSGELKTVTLSKMKQSLGISISGGIESKVQPMVKIEKIFPGGAAFLSGALQAGFELVAVDGENLEQVTHQRAVDTIRRAYRNKAREPMELVVRVPGPSPRPSPSDSSALTDGGLPADHLPAHQPLDAAPVPAHWLPEPPTNPQTPPTDARLLQPTPSPAPSPALQTPDSKPAPSPRIP

SEQ ID NO: 33263 - protein, 1036 aa, Homo sapiens
  ENSP00000384197
MGFALERFAEAVDPALECKLCGQVLEEPLCTPCGHVFCASCLLPWAVRRRRCPLQCQPLAPGELYRVLPLRSLIQKLRVQCDYRARGCGHSVRLHELEAHVEHCDFGPARRLRSRGGCASGLGGGEVPARGGCGPTPRAGRGGGARGGPPGGRWGRGRGPGPRVLAWRRREKALLAQLWALQGEVQLTARRYQEKFTQYMAHVRNFVGDLGGGHRRDGEHKPFTIVLERENDTLGFNIIGGRPNQNNQEGTSTEGIYVSKILENGPADRADGLEIHDKIMEVNGKDLSKATHEEAVEAFRNAKEPIVVQVLRRTPLSRPAYGMASEVQLMNASTQTDITFEHIMALAKLRPPTPPVPDICPFLLSDSCHSLHPMEHEFYEDNEYISSLPADADRTEDFEYEEVELCRVSSQEKLGLTVCYRTDDEEDTGIYVSEVDPNSIAAKDGRIREGDRILQINGEDVQNREEAVALLSNDECKRIVLLVARPEIQLDEGWLEDERNEFLEELNLEMLEEEHNEAMQPTANEVEQPKKQEEEEGTTDTATSSSNNHEKDSGVGRTDESLRNDESSEQENAAEDPNSTSLKSKRDLGQSQDTLGSVELQYNESLVSGEYIDSDCIGNPDEDCERFRQLLELKCKIRNHGEYDLYYSSSTIECNQGEQEGVEHELQLLNEELRNIELECQNIMQAHRLQKVTDQYGDIWTLHDGGFRNYNTSIDMQRGKLDDIMEHPEKSDKDSSSAYNTAESCRSTPLTVDRSPDSSLPRVINLTNKKNLRSTMAATQSSSGQSSKESTSTKAKTTEQGCSAESKEKVLEGSKLPDQEKAVSEHIPYLSPYHSSSYRYANIPAHARHYQSYMQLIQQKSAVEYAQSQLSLVSMCKESQKCSEPKMEWKVKIRSDGTRYITKRPVRDRILKERALKIKEERSGMTTDDDTMSEMKMGRYWSKEERKQHLVRAKEQRRRREFMMRSRLECLKESPQSGSEGKKEINIIELSHKKMMKKRNKKILDNWMTIQELMTHGAKSPDGTRVHNAFLSVTTV

SEQ ID NO: 33264 - protein, 778 aa, Homo sapiens
  ENSP00000439990
MGCNLCTFQKREEHYKLLYEVSQVNGKDLSKATHEEAVEAFRNAKEPIVVQVLRRTPLSRPAYGMASEVQLMNASTQTDITFEHIMALAKLRPPTPPVPDICPFLLSDSCHSLHPMEHEFYEDNEYISSLPADADRTEDFEYEEVELCRVSSQEKLGLTVCYRTDDEEDTGIYVSEVDPNSIAAKDGRIREGDRILQINGEDVQNREEAVALLSNDECKRIVLLVARPEIQLDEGWLEDERNEFLEELNLEMLEEEHNEAMQPTANEVEQPKKQEEEEGTTDTATSSSNNHEKDSGVGRTDESLRNDESSEQENAAEDPNSTSLKSKRDLGQSQDTLGSVELQYNESLVSGEYIDSDCIGNPDEDCERFRQLLELKCKIRNHGEYDLYYSSSTIECNQGEQEGVEHELQLLNEELRNIELECQNIMQAHRLQKVTDQYGDIWTLHDGGFRNYNTSIDMQRGKLDDIMEHPEKSDKDSSSAYNTAESCRSTPLTVDRSPDSSLPRVINLTNKKNLRSTMAATQSSSGQSSKESTSTKAKTTEQGCSAESKEKVLEGSKLPDQEKAVSEHIPYLSPYHSSSYRYANIPAHARHYQSYMQLIQQKSAVEYAQSQLSLVSMCKESQKCSEPKMEWKVKIRSDGTRYITKRPVRDRILKERALKIKEERSGMTTDDDTMSEMKMGRYWSKEERKQHLVRAKEQRRRREFMMRSRLECLKESPQSGSEGKKEINIIELSHKKMMKKRNKKILDNWMTIQELMTHGAKSPDGTRVHNAFLSVTTV

SEQ ID NO: 33265 - protein, 776 aa, Homo sapiens
  ENSP00000298919
MSGKRQFFLKPLALLTCWPSTVNGKDLSKATHEEAVEAFRNAKEPIVVQVLRRTPLSRPAYGMASEVQLMNASTQTDITFEHIMALAKLRPPTPPVPDICPFLLSDSCHSLHPMEHEFYEDNEYISSLPADADRTEDFEYEEVELCRVSSQEKLGLTVCYRTDDEEDTGIYVSEVDPNSIAAKDGRIREGDRILQINGEDVQNREEAVALLSNDECKRIVLLVARPEIQLDEGWLEDERNEFLEELNLEMLEEEHNEAMQPTANEVEQPKKQEEEEGTTDTATSSSNNHEKDSGVGRTDESLRNDESSEQENAAEDPNSTSLKSKRDLGQSQDTLGSVELQYNESLVSGEYIDSDCIGNPDEDCERFRQLLELKCKIRNHGEYDLYYSSSTIECNQGEQEGVEHELQLLNEELRNIELECQNIMQAHRLQKVTDQYGDIWTLHDGGFRNYNTSIDMQRGKLDDIMEHPEKSDKDSSSAYNTAESCRSTPLTVDRSPDSSLPRVINLTNKKNLRSTMAATQSSSGQSSKESTSTKAKTTEQGCSAESKEKVLEGSKLPDQEKAVSEHIPYLSPYHSSSYRYANIPAHARHYQSYMQLIQQKSAVEYAQSQLSLVSMCKESQKCSEPKMEWKVKIRSDGTRYITKRPVRDRILKERALKIKEERSGMTTDDDTMSEMKMGRYWSKEERKQHLVRAKEQRRRREFMMRSRLECLKESPQSGSEGKKEINIIELSHKKMMKKRNKKILDNWMTIQELMTHGAKSPDGTRVHNAFLSVTTV

SEQ ID NO: 33266 - protein, 130 aa, Homo sapiens
  ENSP00000353660
MAEYGTLLQDLTNNITLEDLEQLKSACKEDIPSEKSEEITTGSAWFSFLESHNKLDKDNLSYIEHIFEISRRPDLLTMVVDYRTRVLKISEEDELDTKLTRIPSAKKYKDIIRQPSEEEIIKLAPPPKKA

SEQ ID NO: 33267 - protein, 108 aa, Homo sapiens
  ENSP00000357056
MAEYGTLLQDLTNNITLEDLEQLKSACKEDIPSEKNNLSYIEHIFEISRRPDLLTMVVDYRTRVLKISEEDELDTKLTRIPSAKKYKDIIRQPSEEEIIKLAPPPKKA

SEQ ID NO: 33268 - protein, 151 aa, Homo sapiens
  ENSP00000357055
MEDEGNKLCQAPPWPGQTSPVMAEYGTLLQDLTNNITLEDLEQLKSACKEDIPSEKSEEITTGSAWFSFLESHNKLDKDNLSYIEHIFEISRRPDLLTMVVDYRTRVLKISEEDELDTKLTRIPSAKKYKDIIRQPSEEEIIKLAPPPKKA

SEQ ID NO: 33269 - protein, 227 aa, Homo sapiens
  ENSP00000256404
MGWTMRLVTAALLLGLMMVVTGDEDENSPCAHEALLDEDTLFCQGLEVFYPELGNIGCKVVPDCNNYRQKITSWMEPIVKFPGAVDGATYILVMVDPDAPSRAEPRQRFWRHWLVTDIKGADLKKGKIQGQELSAYQAPSPPAHSGFHRYQFFVYLQEGKVISLLPKENKTRGSWKMDRFLNRFHLGEPEASTQFMTQNYQDSPTLQAPRERASEPKHKNQAEIAAC

SEQ ID NO: 33270 - protein, 93 aa, Homo sapiens
  ENSP00000429414
MSRRRAEPGCGGSGRRAGAPGEGRGRRRYAPGPAAKALPRRRLALQSQVPMGWTMRLVTAALLLGLMMVVTGDEDENSPCAHEALLDEDTLFC

SEQ ID NO: 33271 - protein, 1588 aa, Homo sapiens
  ENSP00000326581
MLPPKHLSATKPKKSWAPNLYELDSDLTKEPDVIIGEGPTDSEFFHQRFRNLIYVEFVGPRKTLIKLRNLCLDWLQPETRTKEEIIELLVLEQYLTIIPEKLKPWVRAKKPENCEKLVTLLENYKEMYQPEDDNNSDVTSDDDMTRNRRESSPPHSVHSFSDRDWDRRGRSRDMEPRDRWSHTRNPRSRMPPRDLSLPVVAKTSFEMDREDDRDSRAYESRSQDAESYQNVVDLAEDRKPHNTIQDNMENYRKLLSLVQLAEDDGHSHMTQGHSSRSKRSAYPSTSRGLKTMPEAKKSTHRRGICEDESSHGVIMEKFIKDVSRSSKSGRARESSDRSQRFPRMSDDNWKDISLNKRESVIQQRVYEGNAFRGGFRFNSTLVSRKRVLERKRRYHFDTDGKGSIHDQKGCPRKKPFECGSEMRKAMSVSSLSSLSSPSFTESQPIDFGAMPYVCDECGRSFSVISEFVEHQIMHTRENLYEYGESFIHSVAVSEVQKSQVGGKRFECKDCGETFNKSAALAEHRKIHARGYLVECKNQECEEAFMPSPTFSELQKIYGKDKFYECRVCKETFLHSSALIEHQKIHFGDDKDNEREHERERERERGETFRPSPALNEFQKMYGKEKMYECKVCGETFLHSSSLKEHQKIHTRGNPFENKGKVCEETFIPGQSLKRRQKTYNKEKLCDFTDGRDAFMQSSELSEHQKIHSRKNLFEGRGYEKSVIHSGPFTESQKSHTITRPLESDEDEKAFTISSNPYENQKIPTKENVYEAKSYERSVIHSLASVEAQKSHSVAGPSKPKVMAESTIQSFDAINHQRVRAGGNTSEGREYSRSVIHSLVASKPPRSHNGNELVESNEKGESSIYISDLNDKRQKIPARENPCEGGSKNRNYEDSVIQSVFRAKPQKSVPGEGSGEFKKDGEFSVPSSNVREYQKARAKKKYIEHRSNETSVIHSLPFGEQTFRPRGMLYECQECGECFAHSSDLTEHQKIHDREKPSGSRNYEWSVIRSLAPTDPQTSYAQEQYAKEQARNKCKDFRQFFATSEDLNTNQKIYDQEKSHGEESQGENTDGEETHSEETHGQETIEDPVIQGSDMEDPQKDDPDDKIYECEDCGLGFVDLTDLTDHQKVHSRKCLVDSREYTHSVIHTHSISEYQRDYTGEQLYECPKCGESFIHSSFLFEHQRIHEQDQLYSMKGCDDGFIALLPMKPRRNRAAERNPALAGSAIRCLLCGQGFIHSSALNEHMRLHREDDLLEQSQMAEEAIIPGLALTEFQRSQTEERLFECAVCGESFVNPAELADHVTVHKNEPYEYGSSYTHTSFLTEPLKGAIPFYECKDCGKSFIHSTVLTKHKELHLEEEEEDEAAAAAAAAAQEVEANVHVPQVVLRIQGLNVEAAEPEVEAAEPEVEAAEPEVEAAEPNGEAEGPDGEAAEPIGEAGQPNGEAEQPNGDADEPDGAGIEDPEERAEEPEGKAEEPEGDADEPDGVGIEDPEEGEDQEIQVEEPYYDCHECTETFTSSTAFSEHLKTHASMIIFEPANAFGECSGYIERASTSTGGANQADEKYFKCDVCGQLFNDRLSLARHQNTHTG

SEQ ID NO: 33272 - protein, 1464 aa, Homo sapiens
  ENSP00000473190
MYQPEDDNNSDVTSDDDMTRNRRESSPPHSVHSFSGDRDWDRRGRSRDMEPRDRWSHTRNPRSRMPPRDLSLPVVAKTSFEMDREDDRDSRAYESRSQDAESYQNVVDLAEDRKPHNTIQDNMENYRKLLSLGVQLAEDDGHSHMTQGHSSRSKRSAYPSTSRGLKTMPEAKKSTHRRGICEDESSHGVIMEKFIKDVSRSSKSGRARESSDRSQRFPRMSDDNWKDISLNKRESVIQQRVYEGNAFRGGFRFNSTLVSRKRVLERKRRYHFDTDGKGSIHDQKGCPRKKPFECGSEMRKAMSVSSLSSLSSPSFTESQPIDFGAMPYVCDECGRSFSVISEFVEHQIMHTRENLYEYGESFIHSVAVSEVQKSQVGGKRFECKDCGETFNKSAALAEHRKIHARGYLVECKNQECEEAFMPSPTFSELQKIYGKDKFYECRVCKETFLHSSALIEHQKIHFGDDKDNEREHERERERERGETFRPSPALNEFQKMYGKEKMYECKVCGETFLHSSSLKEHQKIHTRGNPFENKGKVCEETFIPGQSLKRRQKTYNKEKLCDFTDGRDAFMQSSELSEHQKIHSRKNLFEGRGYEKSVIHSGPFTESQKSHTITRPLESDEDEKAFTISSNPYENQKIPTKENVYEAKSYERSVIHSLASVEAQKSHSVAGPSKPKVMAESTIQSFDAINHQRVRAGGNTSEGREYSRSVIHSLVASKPPRSHNGNELVESNEKGESSIYISDLNDKRQKIPARENPCEGGSKNRNYEDSVIQSVFRAKPQKSVPGEGSGEFKKDGEFSVPSSNVREYQKARAKKKYIEHRSNETSVIHSLPFGEQTFRPRGMLYECQECGECFAHSSDLTEHQKIHDREKPSGSRNYEWSVIRSLAPTDPQTSYAQEQYAKEQARNKCKDFRQFFATSEDLNTNQKIYDQEKSHGEESQGENTDGEETHSEETHGQETIEDPVIQGSDMEDPQKDDPDDKIYECEDCGLGFVDLTDLTDHQKVHSRKCLVDSREYTHSVIHTHSISEYQRDYTGEQLYECPKCGESFIHSSFLFEHQRIHEQDQLYSMKGCDDGFIALLPMKPRRNRAAERNPALAGSAIRCLLCGQGFIHSSALNEHMRLHREDDLLEQSQMAEEAIIPGLALTEFQRSQTEERLFECAVCGESFVNPAELADHVTVHKNEPYEYGSSYTHTSFLTEPLKGAIPFYECKDCGKSFIHSTVLTKHKELHLEEEEEDEAAAAAAAAAQEVEANVHVPQVVLRIQGLNVEAAEPEVEAAEPEVEAAEPEVEAAEPNGEAEGPDGEAAEPIGEAGQPNGEAEQPNGDADEPDGAGIEDPEERAEEPEGKAEEPEGDADEPDGVGIEDPEEGEDQEIQVEEPYYDCHECTETFTSSTAFSEHLKTHASMIIFEPANAFGECSGYIERASTSTGGANQADEKYFKCDVCGQLFNDRLSLARHQNTHTG

SEQ ID NO: 33273 - protein, 1462 aa, Homo sapiens
  ENSP00000472402
MYQPEDDNNSDVTSDDDMTRNRRESSPPHSVHSFSDRDWDRRGRSRDMEPRDRWSHTRNPRSRMPPRDLSLPVVAKTSFEMDREDDRDSRAYESRSQDAESYQNVVDLAEDRKPHNTIQDNMENYRKLLSLVQLAEDDGHSHMTQGHSSRSKRSAYPSTSRGLKTMPEAKKSTHRRGICEDESSHGVIMEKFIKDVSRSSKSGRARESSDRSQRFPRMSDDNWKDISLNKRESVIQQRVYEGNAFRGGFRFNSTLVSRKRVLERKRRYHFDTDGKGSIHDQKGCPRKKPFECGSEMRKAMSVSSLSSLSSPSFTESQPIDFGAMPYVCDECGRSFSVISEFVEHQIMHTRENLYEYGESFIHSVAVSEVQKSQVGGKRFECKDCGETFNKSAALAEHRKIHARGYLVECKNQECEEAFMPSPTFSELQKIYGKDKFYECRVCKETFLHSSALIEHQKIHFGDDKDNEREHERERERERGETFRPSPALNEFQKMYGKEKMYECKVCGETFLHSSSLKEHQKIHTRGNPFENKGKVCEETFIPGQSLKRRQKTYNKEKLCDFTDGRDAFMQSSELSEHQKIHSRKNLFEGRGYEKSVIHSGPFTESQKSHTITRPLESDEDEKAFTISSNPYENQKIPTKENVYEAKSYERSVIHSLASVEAQKSHSVAGPSKPKVMAESTIQSFDAINHQRVRAGGNTSEGREYSRSVIHSLVASKPPRSHNGNELVESNEKGESSIYISDLNDKRQKIPARENPCEGGSKNRNYEDSVIQSVFRAKPQKSVPGEGSGEFKKDGEFSVPSSNVREYQKARAKKKYIEHRSNETSVIHSLPFGEQTFRPRGMLYECQECGECFAHSSDLTEHQKIHDREKPSGSRNYEWSVIRSLAPTDPQTSYAQEQYAKEQARNKCKDFRQFFATSEDLNTNQKIYDQEKSHGEESQGENTDGEETHSEETHGQETIEDPVIQGSDMEDPQKDDPDDKIYECEDCGLGFVDLTDLTDHQKVHSRKCLVDSREYTHSVIHTHSISEYQRDYTGEQLYECPKCGESFIHSSFLFEHQRIHEQDQLYSMKGCDDGFIALLPMKPRRNRAAERNPALAGSAIRCLLCGQGFIHSSALNEHMRLHREDDLLEQSQMAEEAIIPGLALTEFQRSQTEERLFECAVCGESFVNPAELADHVTVHKNEPYEYGSSYTHTSFLTEPLKGAIPFYECKDCGKSFIHSTVLTKHKELHLEEEEEDEAAAAAAAAAQEVEANVHVPQVVLRIQGLNVEAAEPEVEAAEPEVEAAEPEVEAAEPNGEAEGPDGEAAEPIGEAGQPNGEAEQPNGDADEPDGAGIEDPEERAEEPEGKAEEPEGDADEPDGVGIEDPEEGEDQEIQVEEPYYDCHECTETFTSSTAFSEHLKTHASMIIFEPANAFGECSGYIERASTSTGGANQADEKYFKCDVCGQLFNDRLSLARHQNTHTG

SEQ ID NO: 33274 - protein, 1588 aa, Homo sapiens; identical to SEQ ID NO: 33271
  ENSP00000472395

SEQ ID NO: 33275 - protein, 1588 aa, Homo sapiens; identical to SEQ ID NO: 33271
  ENSP00000469486

SEQ ID NO: 33276 - protein, 395 aa, Homo sapiens
  ENSP00000470467
MYQPEDDNNSDVTSDDDMTRNRRESSPPHSVHSFSGDRDWDRRGRSRDMEPRDRWSHTRNPRSRMPPRDLSLPVVAKTSFEMDREDDRDSRAYESRSQDAESYQNVVDLAEDRKPHNTIQDNMENYRKLLSLGLKTMPEAKKSTHRRGICEDESSHGVIMEKFIKDVSRSSKSGRARESSDRSQRFPRMSDDNWKDISLNKRESVIQQRVYEGNAFRGGFRFNSTLVSRKRVLERKRRYHFDTDGKGSIHDQKGCPRKKPFECGSEMRKAMSVSSLSSLSSPSFTESQPIDFGAMPYVCDECGRSFSVISEFVEHQIMHTRENLYEYGESFIHSVAVSEVQKSQVGGKRFECKDCGETFNKSAALAEHRKIHARGYLVECKNQECEEAFMPSPTF

SEQ ID NO: 33277 - protein, 36 aa, Homo sapiens
  ENSP00000469144
MLPPKHLSATKPKKSWAPNLYELDSDLTKEPDVIIG

SEQ ID NO: 33278 - protein, 88 aa, Homo sapiens
  ENSP00000430268
FLTLCTWLLLLGPGLLATVRAECSQDCATCSYRLVRPADINFLKHPRIDQFIHSTNEYLMEEAPDGGKSQCNASKWRHGVLMEKQQDL

SEQ ID NO: 33279 - protein, 267 aa, Homo sapiens
  ENSP00000324248
MARFLTLCTWLLLLGPGLLATVRAECSQDCATCSYRLVRPADINFLACVMECEGKLPSLKIWETCKELLQLSKPELPQDGTSTLRENSKPEESHLLAKRYGGFMKRYGGFMKKMDELYPMEPEEEANGSEILAKRYGGFMKKDAEEDDSLANSSDLLKELLETGDNRERSHHQDGSDNEEEVSKRYGGFMRGLKRSPQLEDEAKELQKRYGGFMRRVGRPEWWMDYQKRYGGFLKRFAEALPSDEEGESYSKEVPEMEKRYGGFMRF

SEQ ID NO: 33280 - protein, 267 aa, Homo sapiens; identical to SEQ ID NO: 33279
  ENSP00000400894

SEQ ID NO: 33281 - protein, 105 aa, Homo sapiens
  ENSP00000428012
MARFLTLCTWLLLLGPGLLATVRAECSQDCATCSYRLVRPADINFLACVMECEGKLPSLKIWETCKELLQLSKPELPQDGTSTLRENSKPEESHLLAKRYGGFMK

SEQ ID NO: 33282 - protein, 79 aa, Homo sapiens
  ENSP00000429326
MARFLTLCTWLLLLGPGLLATVRAECSQDCATCSYRLVRPADINFLDCGGGEEEGCSFQNFPYCFLCSCCYHLLLLSLL

SEQ ID NO: 33283 - protein, 92 aa, Homo sapiens
  ENSP00000430592
MARFLTLCTWLLLLGPGLLATVRAECSQDCATCSYRLVRPADINFLVSVARGECCAPCETEFPQQYADCLRPTARRVWRFAPGRSRSGASPW

SEQ ID NO: 33284 - protein, 1290 aa, Homo sapiens
  ENSP00000314420
MSGPLEGADGGGDPRPGESFCPGGVPSPGPPQHRPCPGPSLADDTDANSNGSSGNESNGHESRGASQRSSHSSSSGNGKDSALLETTESSKSTNSQSPSPPSSSIAYSLLSASSEQDNPSTSGCSSEQSARARTQKELMTALRELKLRLPPERRGKGRSGTLATLQYALACVKQVQANQEYYQQWSLEEGEPCSMDMSTYTLEELEHITSEYTLQNQDTFSVAVSFLTGRIVYISEQAAVLLRCKRDVFRGTRFSELLAPQDVGVFYGSTAPSRLPTWGTGASAGSGLRDFTQEKSVFCRIRGGPDRDPGPRYQPFRLTPYVTKIRVSDGAPAQPCCLLIAERIHSGYEAPRIPPDKRIFTTRHTPSCLFQDVDERAAPLLGYLPQDLLGAPVLLFLHPEDRPLMLAIHKKILQLAGQPFDHSPIRFCARNGEYVTMDTSWAGFVHPWSRKVAFVLGRHKVRTAPLNEDVFTPPAPSPAPSLDTDIQELSEQIHRLLLQPVHSPSPTGLCGVGAVTSPGPLHSPGSSSDSNGGDAEGPGPPAPVTFQQICKDVHLVKHQGQQLFIESRARPQSRPRLPATGTFKAKALPCQSPDPELEAGSAPVQAPLALVPEEAERKEASSCSYQQINCLDSILRYLESCNLPSTTKRKCASSSSYTTSSASDDDRQRTGPVSVGTKKDPPSAALSGEGATPRKEPVVGGTLSPLALANKAESVVSVTSQCSFSSTIVHVGDKKPPESDIIMMEDLPGLAPGPAPSPAPSPTVAPDPAPDAYRPVGLTKAVLSLHTQKEEQAFLSRFRDLGRLRGLDSSSTAPSALGERGCHHGPAPPSRRHHCRSKAKRSRHHQNPRAEAPCYVSHPSPVPPSTPWPTPPATTPFPAVVQPYPLPVFSPRGGPQPLPPAPTSVPPAAFPAPLVTPMVALVLPNYLFPTPSSYPYGALQTPAEGPPTPASHSPSPSLPALAPSPPHRPDSPLFNSRCSSPLQLNLLQLEELPRAEGAAVAGGPGSSAGPPPPSAEAAEPEARLAEVTESSNQDALSGSSDLLELLLQEDSRSGTGSAASGSLGSGLGSGSGSGSHEGGSTSASITRSSQSSHTSKYFGSIDSSEAEAGAARGGAEPGDQVIKYVLQDPIWLLMANADQRVMMTYQVPSRDMTSVLKQDRERLRAMQKQQPRFSEDQRRELGAVHSWVRKGQLPRALDVMACVDCGSSTQDPGHPDDPLFSELDGLGLEPMEEGGGEQGSSGGGSGEGEGCEEAQGGAKASSSQDLAMEEEEEGRSSSSPALPTAGNCTS

SEQ ID NO: 33285 - protein, 1267 aa, Homo sapiens
  ENSP00000462064
MSGPLEGADGGGDPRPGESFCPGGVPSPGPPQHRPCPGPSLADDTDANSNGSSGNESNGHESRGASQRSSHSSSSGNGKDSALLETTESSKSTNSQSPSPPSSSIAYSLLSASSEQDNPSTSGCSSEQSARARTQKELMTALRELKLRLPPERRGKGRSGTLATLQYALACVKQVQANQEYYQQWSLEEGEPCSMDMSTYTLEELEHITSEYTLQNQAAVLLRCKRDVFRGTRFSELLAPQDVGVFYGSTAPSRLPTWGTGASAGSGLRDFTQEKSVFCRIRGGPDRDPGPRYQPFRLTPYVTKIRVSDGAPAQPCCLLIAERIHSGYEAPRIPPDKRIFTTRHTPSCLFQDVDERAAPLLGYLPQDLLGAPVLLFLHPEDRPLMLAIHKKILQLAGQPFDHSPIRFCARNGEYVTMDTSWAGFVHPWSRKVAFVLGRHKVRTAPLNEDVFTPPAPSPAPSLDTDIQELSEQIHRLLLQPVHSPSPTGLCGVGAVTSPGPLHSPGSSSDSNGGDAEGPGPPAPVTFQQICKDVHLVKHQGQQLFIESRARPQSRPRLPATGTFKAKALPCQSPDPELEAGSAPVQAPLALVPEEAERKEASSCSYQQINCLDSILRYLESCNLPSTTKRKCASSSSYTTSSASDDDRQRTGPVSVGTKKDPPSAALSGEGATPRKEPVVGGTLSPLALANKAESVVSVTSQCSFSSTIVHVGDKKPPESDIIMMEDLPGLAPGPAPSPAPSPTVAPDPAPDAYRPVGLTKAVLSLHTQKEEQAFLSRFRDLGRLRGLDSSSTAPSALGCHHGPAPPSRRHHCRSKAKRSRHHQNPRAEAPCYVSHPSPVPPSTPWPTPPATTPFPAVVQPYPLPVFSPRGGPQPLPPAPTSVPPAAFPAPLVTPMVALVLPNYLFPTPSSYPYGALQTPAEGPPTPASHSPSPSLPALAPSPPHRPDSPLFNSRCSSPLQLNLLQLEELPRAEGAAVAGGPGSSAGPPPPSAEAAEPEARLAEVTESSNQDALSGSSDLLELLLQEDSRSGTGSAASGSLGSGLGSGSGSGSHEGGSTSASITRSSQSSHTSKYFGSIDSSEAEAGAARGGAEPGDQVIKYVLQDPIWLLMANADQRVMMTYQVPSRDMTSVLKQDRERLRAMQKQQPRFSEDQRRELGAVHSWVRKGQLPRALDVMACVDCGSSTQDPGHPDDPLFSELDGLGLEPMEEGGGEQGSSGGGSGEGEGCEEAQGGAKASSSQDLAMEEEEEGRSSSSPALPTAGNCTS

SEQ ID NO: 33286 - protein, 824 aa, Homo sapiens
  ENSP00000463054
MSGPLEGADGGGDPRPGESFCPGGVPSPGPPQHRPCPGPSLADDTDANSNGSSGNESNGHESRGASQRSSHSSSSGNGKDSALLETTESSKSTNSQSPSPPSSSIAYSLLSASSEQDNPSTSGCSSEQSARARTQKELMTALRELKLRLPPERRGKGRSGTLATLQYALACVKQVQANQEYYQQWSLEEGEPCSMDMSTYTLEELEHITSEYTLQNQDTFSVAVSFLTGRIVYISEQAAVLLRCKRDVFRGTRFSELLAPQDVGVFYGSTAPSRLPTWGTGASAGSGLRDFTQEKSVFCRIRGGPDRDPGPRYQPFRLTPYVTKIRVSDGAPAQPCCLLIAERIHSGYEAPRIPPDKRIFTTRHTPSCLFQDVDERAAPLLGYLPQDLLGAPVLLFLHPEDRPLMLAIHKKILQLAGQPFDHSPIRFCARNGEYVTMDTSWAGFVHPWSRKVAFVLGRHKVRTAPLNEDVFTPPAPSPAPSLDTDIQELSEQIHRLLLQPVHSPSPTGLCGVGAVTSPGPLHSPGSSSDSNGGDAEGPGPPAPVTFQQICKDVHLVKHQGQQLFIESRARPQSRPRLPATGTFKAKALPCQSPDPELEAGSAPVQAPLALVPEEAERKEASSCSYQQINCLDSILRYLESCNLPSTTKRKCASSSSYTTSSASDDDRQRTGPVSVGTKKDPPSAALSGEGATPRKEPVVGGTLSPLALANKAESVVSVTSQCSFSSTIVHVGDKKPPESDIIMMEDLPGLAPGPAPSPAPSPTVAPDPAPDAYRPVGLTKAVLSLHTQKEEQAFLSRFRDLGRLRGLDSSSTAPSALGERGGGH

SEQ ID NO: 33287 - protein, 859 aa, Homo sapiens
  ENSP00000346979
MLEVLEEIWSVRARRAHRPCPGPSLADDTDANSNGSSGNESNGHESRGASQRSSHSSSSGNGKDSALLETTESSKSTNSQSPSPPSSSIAYSLLSASSEQDNPSTSGCSSEQSARARTQKELMTALRELKLRLPPERRGKGRSGTLATLQYALACVKQVQANQEYYQQWSLEEGEPCSMDMSTYTLEELEHITSEYTLQNQDTFSVAVSFLTGRIVYISEQAAVLLRCKRDVFRGTRFSELLAPQDVGVFYGSTAPSRLPTWGTGASAGSGLRDFTQEKSVFCRIRGGPDRDPGPRYQPFRLTPYVTKIRVSDGAPAQPCCLLIAERIHSGYEAPRIPPDKRIFTTRHTPSCLFQDVDERAAPLLGYLPQDLLGAPVLLFLHPEDRPLMLAIHKKILQLAGQPFDHSPIRFCARNGEYVTMDTSWAGFVHPWSRKVAFVLGRHKVRTAPLNEDVFTPPAPSPAPSLDTDIQELSEQIHRLLLQPVHSPSPTGLCGVGAVTSPGPLHSPGSSSDSNGGDAEGPGPPAPVTFQQICKDVHLVKHQGQQLFIESRARPQSRPRLPATGTFKAKALPCQSPDPELEAGSAPVQAPLALVPEEAERKEASSCSYQQINCLDSILRYLESCNLPSTTKRKCASSSSYTTSSASDDDRQRTGPVSVGTKKDPPSAALSGEGATPRKEPVVGGTLSPLALANKAESVVSVTSQCSFSSTIVHVGDKKPPESDIIMMEDLPGLAPGPAPSPAPSPTVAPDPAPDAYRPVGLTKAVLSLHTQKEEQAFLSRFRDLGRLRGLDSSSTAPSALGERGSHLGPPGACPLPSLGLDCWGVGLKGGVSAPGTQAGVASTTRPCLGTGPSLASPH

SEQ ID NO: 33288 - protein, 168 aa, Homo sapiens
  ENSP00000463369
VTSQCSFSSTIVHVGDKKPPESDIIMMEDLPGLAPGPAPSPAPSPTVAPDPAPDAYRPVGLTKAVLSLHTQKEEQAFLSRFRDLGRLRGLDSSSTAPSALGERGRIRPRWAGGMPRLAVPTGVWRTRAICPCVHGLTLLPPSASMPPSSAHPQLDPSCNLSLALFLSQ

SEQ ID NO: 33289 - protein, 572 aa, Homo sapiens
  ENSP00000464696
MSGPLEGADGGGDPRPGESFCPGGVPSPGPPQHRPCPGPSLADDTDANSNGSSGNESNGHESRGASQRSSHSSSSGNGKDSALLETTESSKSTNSQSPSPPSSSIAYSLLSASSEQDNPSTSGCSSEQSARARTQKELMTALRELKLRLPPERRGKGRSGTLATLQYALACVKQVQANQEYYQQWSLEEGEPCSMDMSTYTLEELEHITSEYTLQNQDTFSVAVSFLTGRIVYISEQAAVLLRCKRDVFRGTRFSELLAPQDVGVFYGSTAPSRLPTWGTGASAGSGLRDFTQEKSVFCRIRGGPDRDPGPRYQPFRLTPYVTKIRVSDGAPAQPCCLLIAERIHSGYEAPRIPPDKRIFTTRHTPSCLFQDVDERAAPLLGYLPQDLLGAPVLLFLHPEDRPLMLAIHKKILQLAGQPFDHSPIRFCARNGEYVTMDTSWAGFVHPWSRKVAFVLGRHKVRTAPLNEDVFTPPAPSPAPSLDTDIQELSEQIHRLLLQPVHSPSPTGLCGVGAVTSPGPLHSPGSSSDSNGGDAEGPGPPAPLQARSRPRPFPANPQTQSWRRVLLPSRPH

SEQ ID NO: 33290 - protein, 175 aa, Homo sapiens
  ENSP00000463385
MQPASPPARWSFHSAAGWSGGGQACGGHSCDQHRPCPGPSLADDTDANSNGSSGNESNGHESRGASQRSSHSSSSGNGKDSALLETTESSKSTNSQSPSPPSSSIAYSLLSASSEQDNPSTSGCSSEQSARARTQKELMTALRELKLRLPPERRGKGRSGTLATLQYALACVKQV

SEQ ID NO: 33291 - protein, 117 aa, Homo sapiens
  ENSP00000462546
MSGPLEGADGGGDPRPGESFCPGGVPSPGPPQHRPCPGPSLADDTDANSNGSSGNESNGHESRGASQRSSHSSSSGNGKDSALLETTESSKSSEQSARARTQKELMTALRELKLRLP

SEQ ID NO: 33292 - protein, 112 aa, Homo sapiens
  ENSP00000463661
MSGPLEGADGGGDPRPGESFCPGGVPSPGPPQHRPCPGPSLADDTDANSNGSSGNESNGHESRGASQRSSHSSSSGNGKDSALLETTESSKSTNSQSPSPPSSSIAYSLLSA

SEQ ID NO: 33293 - protein, 73 aa, Homo sapiens
  ENSP00000470539
MGVKLEIFRMIIYLTFPVAMFWVSNQAEWFEDDVIQRKRELWPPEKLQEIEEFKERLRKRREEKLLRDAQQNS

SEQ ID NO: 33294 - protein, 44 aa, Homo sapiens
  ENSP00000392303
MGVKLEIFRRELWPPEKLQEIEEFKERLRKRREEKLLRDAQQNS

SEQ ID NO: 33295 - protein, 68 aa, Homo sapiens
  ENSP00000470935
MGVKLEIFRMIIYLTFPVAMFWVSNQAEWFEDDVIQRKRELWPPEKVSDLFFLPEGWRRLDSCIRDGF

SEQ ID NO: 33296 - protein, 46 aa, Homo sapiens
  ENSP00000470314
  MOD_RES (1)..(1): Any amino acid
XVKLEIFRMIIYLTFPVAMFWVSNQAEWFEDDVIQRKRELWPPEKP

SEQ ID NO: 33297 - protein, 626 aa, Homo sapiens
  ENSP00000419975
MYQGHMQKSKEQGYGKLSSDEDLEIIVDQKQGKGSRAADKAVAMVMKEIPREESAEEKPLLTMTSQLVNEQQESRPLLSPSIDDFLCETKSEAIARPVTSNTAVLTTGLDLLDLSEPVSQTQTKAKKSEPSSKTSSLKKKADGSDLISTDAEQRGQPLRVPETSSLDLDIQTQLEKWDDVKFHGDRNTKGHPMAERKSSSSRTGSKELLWSSEHRSQPELSGGKSALNSESASELELVAPTQARLTKEHRWGSALLSRNHSLEEEFERAKAAVESDTEFWDKMQAEWEEMARRNWISENQEAQNQVTISASEKGYYFHTENPFKDWPGAFEEGLKRLKEGDLPVTILFMEAAILQDPGDAEAWQFLGITQAENENEQAAIVALQRCLELQPNNLKALMALAVSYTNTGHQQDACDALKNWIKQNPKYKYLVKSKKGSPGLTRRMSKSPVDSSVLEGVKELYLEAAHQNGDMIDPDLQTGLGVLFHLSGEFNRAIDAFNAALTVRPEDYSLWNRLGATLANGDRSEEAVEAYTRALEIQPGFIRSRYNLGISCINLGAYREAVSNFLTALSLQRKSRNQQQVPHPAISGNIWAALRIALSLMDQPELFQAANLGDLDVLLRAFNLDP

SEQ ID NO: 33298 - protein, 624 aa, Homo sapiens
  ENSP00000263962
MYQGHMQVVGVTLKKKWHCLQKSDLTLALGKGSRAADKAVAMVMKEIPREESAEEKPLLTMTSQLVNEQQESRPLLSPSIDDFLCETKSEAIARPVTSNTAVLTTGLDLLDLSEPVSQTQTKAKKSEPSSKTSSLKKKADGSDLISTDAEQRGQPLRVPETSSLDLDIQTQLEKWDDVKFHGDRNTKGHPMAERKSSSSRTGSKELLWSSEHRSQPELSGGKSALNSESASELELVAPTQARLTKEHRWGSALLSRNHSLEEEFERAKAAVESDTEFWDKMQAEWEEMARRNWISENQEAQNQVTISASEKGYYFHTENPFKDWPGAFEEGLKRLKEGDLPVTILFMEAAILQDPGDAEAWQFLGITQAENENEQAAIVALQRCLELQPNNLKALMALAVSYTNTGHQQDACDALKNWIKQNPKYKYLVKSKKGSPGLTRRMSKSPVDSSVLEGVKELYLEAAHQNGDMIDPDLQTGLGVLFHLSGEFNRAIDAFNAALTVRPEDYSLWNRLGATLANGDRSEEAVEAYTRALEIQPGFIRSRYNLGISCINLGAYREAVSNFLTALSLQRKSRNQQQVPHPAISGNIWAALRIALSLMDQPELFQAANLGDLDVLLRAFNLDP

SEQ ID NO: 33299 - protein, 591 aa, Homo sapiens
  ENSP00000418440
MYQGHMQKSKEQGYGKLSSDEDLEIIVDQKQLVNEQQESRPLLSPSIDDFLCETKSEAIARPVTSNTAVLTTGLDLLDLSEPVSQTQTKAKKSEPSSKTSSLKKKADGSDLISTDAEQRGQPLRVPETSSLDLDIQTQLEKWDDVKFHGDRNTKGHPMAERKSSSSRTGSKELLWSSEHRSQPELSGGKSALNSESASELELVAPTQARLTKEHRWGSALLSRNHSLEEEFERAKAAVESDTEFWDKMQAEWEEMARRNWISENQEAQNQVTISASEKGYYFHTENPFKDWPGAFEEGLKRLKEGDLPVTILFMEAAILQDPGDAEAWQFLGITQAENENEQAAIVALQRCLELQPNNLKALMALAVSYTNTGHQQDACDALKNWIKQNPKYKYLVKSKKGSPGLTRRMSKSPVDSSVLEGVKELYLEAAHQNGDMIDPDLQTGLGVLFHLSGEFNRAIDAFNAALTVRPEDYSLWNRLGATLANGDRSEEAVEAYTRALEIQPGFIRSRYNLGISCINLGAYREAVSNFLTALSLQRKSRNQQQVPHPAISGNIWAALRIALSLMDQPELFQAANLGDLDVLLRAFNLDP

SEQ ID NO: 33300 - protein, 434 aa, Homo sapiens
  ENSP00000418665
MAERKSSSSRTGSKELLWSSEHRSQPELSGGKSALNSESASELELVAPTQARLTKEHRWGSALLSRNHSLEEEFERAKAAVESDTEFWDKMQAEWEEMARRNWISENQEAQNQVTISASEKGYYFHTENPFKDWPGAFEEGLKRLKEGDLPVTILFMEAAILQDPGDAEAWQFLGITQAENENEQAAIVALQRCLELQPNNLKALMALAVSYTNTGHQQDACDALKNWIKQNPKYKYLVKSKKGSPGLTRRMSKSPVDSSVLEGVKELYLEAAHQNGDMIDPDLQTGLGVLFHLSGEFNRAIDAFNAALTVRPEDYSLWNRLGATLANGDRSEEAVEAYTRALEIQPGFIRSRYNLGISCINLGAYREAVSNFLTALSLQRKSRNQQQVPHPAISGNIWAALRIALSLMDQPELFQAANLGDLDVLLRAFNLDP

SEQ ID NO: 33301 - protein, 583 aa, Homo sapiens
  ENSP00000420555
MVMKEIPREESAEEKPLLTMTSQLVNEQQESRPLLSPSIDDFLCETKSEAIARPVTSNTAVLTTGLDLLDLSEPVSQTQTKAKKSEPSSKTSSLKKKADGSDLISTDAEQRGQPLRVPETSSLDLDIQTQLEKWDDVKFHGDRNTKGHPMAERKSSSSRTGSKELLWSSEHRSQPELSGGKSALNSESASELELVAPTQARLTKEHRWGSALLSRNHSLEEEFERAKAAVESDTEFWDKMQAEWEEMARRNWISENQEAQNQVTISASEKGYYFHTENPFKDWPGAFEEGLKRLKEGDLPVTILFMEAAILQDPGDAEAWQFLGITQAENENEQAAIVALQRCLELQPNNLKALMALAVSYTNTGHQQDACDALKNWIKQNPKYKYLVKSKKGSPGLTRRMSKSPVDSSVLEGVKELYLEAAHQNGDMIDPDLQTGLGVLFHLSGEFNRAIDAFNAALTVRPEDYSLWNRLGATLANGDRSEEAVEAYTRALEIQPGFIRSRYNLGISCINLGAYREAVSNFLTALSLQRKSRNQQQVPHPAISGNIWAALRIALSLMDQPELFQAANLGDLDVLLRAFNLDP

SEQ ID NO: 33302 - protein, 567 aa, Homo sapiens
  ENSP00000418054
MYQGHMQLVNEQQESRPLLSPSIDDFLCETKSEAIARPVTSNTAVLTTGLDLLDLSEPVSQTQTKAKKSEPSSKTSSLKKKADGSDLISTDAEQRGQPLRVPETSSLDLDIQTQLEKWDDVKFHGDRNTKGHPMAERKSSSSRTGSKELLWSSEHRSQPELSGGKSALNSESASELELVAPTQARLTKEHRWGSALLSRNHSLEEEFERAKAAVESDTEFWDKMQAEWEEMARRNWISENQEAQNQVTISASEKGYYFHTENPFKDWPGAFEEGLKRLKEGDLPVTILFMEAAILQDPGDAEAWQFLGITQAENENEQAAIVALQRCLELQPNNLKALMALAVSYTNTGHQQDACDALKNWIKQNPKYKYLVKSKKGSPGLTRRMSKSPVDSSVLEGVKELYLEAAHQNGDMIDPDLQTGLGVLFHLSGEFNRAIDAFNAALTVRPEDYSLWNRLGATLANGDRSEEAVEAYTRALEIQPGFIRSRYNLGISCINLGAYREAVSNFLTALSLQRKSRNQQQVPHPAISGNIWAALRIALSLMDQPELFQAANLGDLDVLLRAFNLDP

SEQ ID NO: 33303 - protein, 518 aa, Homo sapiens
  ENSP00000417270
MVMKEIPREESAEEKPLLTMTSQLVNEQQESRPLLSPSIDDFLCETKSEAIARPVTSNTADIQTQLEKWDDVKFHGDRNTKGHPMAERKSSSSRTGSKELLWSSEHRSQPELSGGKSALNSESASELELVAPTQARLTKEHRWGSALLSRNHSLEEEFERAKAAVESDTEFWDKMQAEWEEMARRNWISENQEAQNQVTISASEKGYYFHTENPFKDWPGAFEEGLKRLKEGDLPVTILFMEAAILQDPGDAEAWQFLGITQAENENEQAAIVALQRCLELQPNNLKALMALAVSYTNTGHQQDACDALKNWIKQNPKYKYLVKSKKGSPGLTRRMSKSPVDSSVLEGVKELYLEAAHQNGDMIDPDLQTGLGVLFHLSGEFNRAIDAFNAALTVRPEDYSLWNRLGATLANGDRSEEAVEAYTRALEIQPGFIRSRYNLGISCINLGAYREAVSNFLTALSLQRKSRNQQQVPHPAISGNIWAALRIALSLMDQPELFQAANLGDLDVLLRAFNLDP

SEQ ID NO: 33304 - protein, 602 aa, Homo sapiens
  ENSP00000419348
MYQGHMQGKGSRAADKAVAMVMKEIPREESAEEKPLLTMTSQLVNEQQESRPLLSPSIDDFLCETKSEAIARPVTSNTAVLTTGLDLLDLSEPVSQTQTKAKKSEPSSKTSSLKKKADGSDLISTDAEQRGQPLRVPETSSLDLDIQTQLEKWDDVKFHGDRNTKGHPMAERKSSSSRTGSKELLWSSEHRSQPELSGGKSALNSESASELELVAPTQARLTKEHRWGSALLSRNHSLEEEFERAKAAVESDTEFWDKMQAEWEEMARRNWISENQEAQNQVTISASEKGYYFHTENPFKDWPGAFEEGLKRLKEGDLPVTILFMEAAILQDPGDAEAWQFLGITQAENENEQAAIVALQRCLELQPNNLKALMALAVSYTNTGHQQDACDALKNWIKQNPKYKYLVKSKKGSPGLTRRMSKSPVDSSVLEGVKELYLEAAHQNGDMIDPDLQTGLGVLFHLSGEFNRAIDAFNAALTVRPEDYSLWNRLGATLANGDRSEEAVEAYTRALEIQPGFIRSRYNLGISCINLGAYREAVSNFLTALSLQRKSRNQQQVPHPAISGNIWAALRIALSLMDQPELFQAANLGDLDVLLRAFNLDP

SEQ ID NO: 33305 - protein, 70 aa, Homo sapiens
  ENSP00000418746
MAERKSSSSRTGSKELLWSSEHRSQPELSGGKSALNSESASELELVAPTQARLTKEHRWGSALLSRNHSL

SEQ ID NO: 33306 - protein, 34 aa, Homo sapiens
  ENSP00000419790
MAERKSSSSRTGSKELLWSSEHRSQPELSGGKSA

SEQ ID NO: 33307 - protein, 194 aa, Homo sapiens
  ENSP00000417438
MSDSEMDGRTHIPSLLNALLSRNRVMQMSYLKSKEQGYGKLSSDEDLEIIVDQKQLVNEQQESRPLLSPSIDDFLCETKSEAIARPVTSNTAVLTTGLDLLDLSEPVSQTQTKAKKSEPSSKTSSLKKKADGSDLISTDAEQRGQPLRVPETSSLDLDIQTQLEKWDDVKFHGDRNTKGHPMAERKSSSSRTGS

SEQ ID NO: 33308 - protein, 203 aa, Homo sapiens
  ENSP00000419406
MSDSEMDGRTHIPSLLNALLSRNRVMQMSYLKSKEQGYGKLSSDEDLEIIVDQKQGKGSRAADKAVAMVMKEIPREESAEEKPLLTMTSQLVNEQQESRPLLSPSIDDFLCETKSEAIARPVTSNTAVLTTGLDLLDLSEPVSQTQTKAKKSEPSSKTSSLKKKADGSDLISTDAEQRGQPLRVPETSSLDLDIQTQLEKWDD

SEQ ID NO: 33309 - protein, 518 aa, Homo sapiens; identical to SEQ ID NO: 33303
  ENSP00000376420

SEQ ID NO: 33310 - protein, 469 aa, Homo sapiens
  ENSP00000232375
MASPRELTQNPLKKIWMPYSNGRPALHACQRGVCMTNCPTLIVMVGLPARGKTYISKKLTRYLNWIGVPTREFNVGQYRRDVVKTYKSFEFFLPDNEEGLKIRKQCALAALRDVRRFLSEEGGHVAVFDATNTTRERRATIFNFGEQNGYKTFFVESICVDPEVIAANIVQVKLGSPDYVNRDSDEATEDFMRRIECYENSYESLDEDLDRDLSYIKIMDVGQSYVVNRVADHIQSRIVYYLMNIHVTPRSIYLCRHGESELNLKGRIGGDPGLSPRGREFAKSLAQFISDQNIKDLKVWTSQMKRTIQTAEALGVPYEQWKVLNEIDAGVCEEMTYEEIQDNYPLEFALRDQDKYRYRYPKGESYEDLVQRLEPVIMELERQENVLVICHQAVMRCLLAYFLDKAAEQLPYLKCPLHTVLKLTPVAYGCKVESIFLNVAAVNTHRDRPQNVDISRPPEEALVTVPAHQ

SEQ ID NO: 33311 - protein, 462 aa, Homo sapiens
  ENSP00000388394
MASPRELTQNPLKKIWMPYSNGRPALHACQRGVCMTNCPTLIVMVGLPARGKTYISKKLTRYLNWIGVPTREFNVGQYRRDVVKTYKSFEFFLPDNEEGLKIRKQCALAALRDVRRFLSEEGGHVAVFDATNTTRERRATIFNFGEQNGYKTFFVESICVDPEVIAANIVQVKLGSPDYVNRDSDEATEDFMRRIECYENSYESLDEDLDRDLSYIKIMDVGQSYVVNRVADHIQSRIVYYLMNIHVTPRSIYLCRHGESELNLKGRIGGDPGLSPRGREFAKSLAQFISDQNIKDLKVWTSQMKRTIQTAEALGVPYEQWKGVCEEMTYEEIQDNYPLEFALRDQDKYRYRYPKGESYEDLVQRLEPVIMELERQENVLVICHQAVMRCLLAYFLDKAAEQLPYLKCPLHTVLKLTPVAYGCKVESIFLNVAAVNTHRDRPQNVDISRPPEEALVTVPAHQ

SEQ ID NO: 33312 - protein, 38 aa, Homo sapiens
  ENSP00000389169
MASPRELTQNPLKKIWMPYSNGRPALHACQRGELSKVG

SEQ ID NO: 33313 - protein, 80 aa, Homo sapiens
  ENSP00000400772
MASPRELTQNPLKKIWMPYSNGRPALHACQRGGGLVFQQEEGCLLALKLSLGRNFSRDVLRIETEKYAVWACVCVPGHCA

SEQ ID NO: 33314 - protein, 434 aa, Homo sapiens
  ENSP00000373240
MASPRELTQNPLKKIWMPYSNGRPALHACQRGVCMTNCPTLIVMVGLPARGKTYISKKLTRYLNWIGVPTREFNVGQYRRDVVKTYKSFEFFLPDNEEGLKIRKQCALAALRDVRRFLSEEGGHVAVFDATNTTRERRATIFNFGEQNGYKTFFVESICVDPEVIAANIVQVKLGSPDYVNRDSDEATEDFMRRIECYENSYESLDEDLDRDLSYIKIMDVGQSYVVNRVADHIQSRIVYYLMNIHVTPRSIYLCRHGESELNLKGRIGGDPGLSPRGREFAKSLAQFISDQNIKDLKVWTSQMKRTIQTAEALGVPYEQWKVLNEIDASYEDLVQRLEPVIMELERQENVLVICHQAVMRCLLAYFLDKAAEQLPYLKCPLHTVLKLTPVAYGCKVESIFLNVAAVNTHRDRPQNVDISRPPEEALVTVPAHQ

SEQ ID NO: 33315 - protein, 318 aa, Homo sapiens
  ENSP00000407657
MDRGSLGGSSLTDLGPGSSRRVCMTNCPTLIVMVGLPARGKTYISKKLTRYLNWIGVPTREFNVGQYRRDVVKTYKSFEFFLPDNEEGLKIRKQCALAALRDVRRFLSEEGGHVAVFDATNTTRERRATIFNFGEQNGYKTFFVESICVDPEVIAANIVQVKLGSPDYVNRDSDEATEDFMRRIECYENSYESLDEDLDRDLSYIKIMDVGQSYVVNRVADHIQSRIVYYLMNIHVTPRSIYLCRHGESELNLKGRIGGDPGLSPRGREFAKSLAQFISDQNIKDLKVWTSQMKRTIQTAEALGVPYEQWKVLNEIDA

SEQ ID NO: 33316 - protein, 175 aa, Homo sapiens
  ENSP00000393047
MTNCPTLIVMVGLPARGKTYISKKLTRYLNWIGVPTREFNVGQYRRDVVKTYKSFEFFLPDNEEGLKIRKQCALAALRDVRRFLSEEGGHVAVFDATNTTRERRATIFNFGEQNGYKTFFVESICVDPEVIAANIVQVKLGSPDYVNRDSDEATEDFMRRIECYENSYESLDEDL

SEQ ID NO: 33317 - protein, 129 aa, Homo sapiens
  ENSP00000415764
MRARDSTGHPLMLREQTLGQHLHGEDTGEWEHTCEVCMTNCPTLIVMVGLPARGKTYISKKLTRYLNWIGVPTREFNVGQYRRDVVKTYKSFEFFLPDNEEGLKIRKQCALAALRDVRRFLSEEGGHVA

SEQ ID NO: 33318 - protein, 157 aa, Homo sapiens
  ENSP00000450369
MTHEEHHAAKTLGIGKAIAVLTSGGDAQGMNAAVRAVVRVGIFTGARVFFVHEGYQGLVDGGDHIKEATWESVSMMLQLGGTVIGSARCKDFREREGRLRAAYNLVKRGITNLCVIGGDGSLTGADTFRSEWSDLLSDLQKAGKITDEEATKSSYLN

SEQ ID NO: 33319 - protein, 116 aa, Homo sapiens
  ENSP00000449835
MTHEEHHAAKTLGIGKAIAVLTSGGDAQGMNAAVRAVVRVGIFTGARVFFVHEGYQGLVDGGDHIKEATWESVSMMLQLGGTVIGSARCKDFREREGRLRAAYNLVKRGITNLCVI

SEQ ID NO: 33320 - protein, 84 aa, Homo sapiens
  ENSP00000446945
MTHEEHHAAKTLGIGKAIAVLTSGGDAQGMNAAVRAVVRVGIFTGARVFFVHEGYQGLVDGGDHIKEATWESVSMMLQLGGTVI

SEQ ID NO: 33321 - protein, 152 aa, Homo sapiens
  ENSP00000446829
MRRGFRPGAERKTREPPRTGTAFTAPEESLEWIMTHEEHHAAKTLGIGKAIAVLTSGGDAQGMNAAVRAVVRVGIFTGARVFFVHEGYQGLVDGGDHIKEATWESVSMMLQLGGTVIGSARCKDFREREGRLRAAYNLVKRGITNLCVIGGD

SEQ ID NO: 33322 - protein, 149 aa, Homo sapiens
  ENSP00000447997
MRRGFRPGAERKTREPPRTGTAFTAPEESLAGEASTSSMLIPKPPPKTDILKSLDTMDDPDTVGSIPVFKTEWIMTHEEHHAAKTLGIGKAIAVLTSGGDAQGMNAAVRAVVRVGIFTGARVFFVHEGYQGLVDGGDHIKEATWESVSM

SEQ ID NO: 33323 - protein, 851 aa, Homo sapiens
  ENSP00000345771
MHKDEFHLKFFMCVIQSRQLVRTPQRTAGEASTSSMLIPKPPPKTDILKSLDTMDDPDTVGSIPVFKTEWIMTHEEHHAAKTLGIGKAIAVLTSGGDAQGMNAAVRAVVRVGIFTGARVFFVHEGYQGLVDGGDHIKEATWESVSMMLQLGGTVIGSARCKDFREREGRLRAAYNLVKRGITNLCVIGGDGSLTGADTFRSEWSDLLSDLQKAGKITDEEATKSSYLNIVGLVGSIDNDFCGTDMTIGTDSALHRIMEIVDAITTTAQSHQRTFVLEVMGRHCGYLALVTSLSCGADWVFIPECPPDDDWEEHLCRRLSETRTRGSRLNIIIVAEGAIDKNGKPITSEDIKNLVVKRLGYDTRVTVLGHVQRGGTPSAFDRILGSRMGVEAVMALLEGTPDTPACVVSLSGNQAVRLPLMECVQVTKDVTKAMDEKKFDEALKLRGRSFMNNWEVYKLLAHVRPPVSKSGSHTVAVMNVGAPAAGMNAAVRSTVRIGLIQGNRVLVVHDGFEGLAKGQIEEAGWSYVGGWTGQGGSKLGTKRTLPKKSFEQISANITKFNIQGLVIIGGFEAYTGGLELMEGRKQFDELCIPFVVIPATVSNNVPGSDFSVGADTALNTICTTCDRIKQSAAGTKRRVFIIETMGGYCGYLATMAGLAAGADAAYIFEEPFTIRDLQANVEHLVQKMKTTVKRGLVLRNEKCNENYTTDFIFNLYSEEGKGIFDSRKNVLGHMQQGGSPTPFDRNFATKMGAKAMNWMSGKIKESYRNGRIFANTPDSGCVLGMRKRALVFQPVAELKDQTDFEHRIPKEQWWLKLRPILKILAKYEIDLDTSDHAHLEHITRKRSGEAAV

SEQ ID NO: 33324 - protein, 176 aa, Homo sapiens
  ENSP00000447992
MHKDEFHLKFFMCVIQSRQLVRTPQRTAGEASTSSMLIPKPPPKTDILKSLDTMDDPDTVGSIPVFKTECAEVEIQVSKRKRAVVKARGDPTVETMKQREEWIMTHEEHHAAKTLGIGKAIAVLTSGGDAQEMGRDRPGAVAHTCNPRTLGGRGGQITRGWEFETSLTNMEKPRLY

SEQ ID NO: 33325 - protein, 125 aa, Homo sapiens
  ENSP00000450173
MHKDEFHLKFFMCVIQSRQLVRTPQRTAGEASTSSMLIPKPPPKTDILKSLDTMDDPDTVGSIPVFKTECAEVEIQVSKRKRAVVKARGDPTVETMKQREEWIMTHEEHHAAKTLGIGKAIAVLT

SEQ ID NO: 33326 - protein, 165 aa, Homo sapiens
  ENSP00000449622
MHKDEFHLKFFMCVIQSRQLVRTPQRTAGEASTSSMLIPKPPPKTDILKSLDTMDDPDTVGSIPVFKTECAEVEIQVSKRKRAVVKARGDPTVETMKQREEWIMTHEEHHAAKTLGIGKAIAVLTSGGDAQGMNAAVRAVVRVGIFTGARVFFVHEGYQGLVDGG

SEQ ID NO: 33327 - protein, 149 aa, Homo sapiens
  ENSP00000448940
MHKDEFHLKFFMCVIQSRQLVRTPQRTAGEASTSSMLIPKPPPKTDILKSLDTMDDPDTVGSIPVFKTEWIMTHEEHHAAKTLGIGKAIAVLTSGGDAQGMNAAVRAVVRVGIFTGARVFFVHEGYQGLVDGGDHIKEATWESVSMMLQ

SEQ ID NO: 33328 - protein, 141 aa, Homo sapiens
  ENSP00000448018
MHKDEFHLKFFMCVIQSRQLVRTPQRTAGEASTSSMLIPKPPPKTDILKSLDTMDDPDTVGSIPVFKTEWIMTHEEHHAAKTLGIGKAIAVLTSGGDAQGMNAAVRAVVRVGIFTGARVFFVHEGYQGLVDGGDHIKEATW

SEQ ID NO: 33329 - protein, 780 aa, Homo sapiens
  ENSP00000352842
MTHEEHHAAKTLGIGKAIAVLTSGGDAQGMNAAVRAVVRVGIFTGARVFFVHEGYQGLVDGGDHIKEATWESVSMMLQLGGTVIGSARCKDFREREGRLRAAYNLVKRGITNLCVIGGDGSLTGADTFRSEWSDLLSDLQKAGKITDEEATKSSYLNIVGLVGSIDNDFCGTDMTIGTDSALHRIMEIVDAITTTAQSHQRTFVLEVMGRHCGYLALVTSLSCGADWVFIPECPPDDDWEEHLCRRLSETRTRGSRLNIIIVAEGAIDKNGKPITSEDIKNLVVKRLGYDTRVTVLGHVQRGGTPSAFDRILGSRMGVEAVMALLEGTPDTPACVVSLSGNQAVRLPLMECVQVTKDVTKAMDEKKFDEALKLRGRSFMNNWEVYKLLAHVRPPVSKSGSHTVAVMNVGAPAAGMNAAVRSTVRIGLIQGNRVLVVHDGFEGLAKGQIEEAGWSYVGGWTGQGGSKLGTKRTLPKKSFEQISANITKFNIQGLVIIGGFEAYTGGLELMEGRKQFDELCIPFVVIPATVSNNVPGSDFSVGADTALNTICTTCDRIKQSAAGTKRRVFIIETMGGYCGYLATMAGLAAGADAAYIFEEPFTIRDLQANVEHLVQKMKTTVKRGLVLRNEKCNENYTTDFIFNLYSEEGKGIFDSRKNVLGHMQQGGSPTPFDRNFATKMGAKAMNWMSGKIKESYRNGRIFANTPDSGCVLGMRKRALVFQPVAELKDQTDFEHRIPKEQWWLKLRPILKILAKYEIDLDTSDHAHLEHITRKRSGEAAV

SEQ ID NO: 33330 - protein, 73 aa, Homo sapiens
  ENSP00000448318
MTHEEHHAAKTLGIGKAIAVLTSGGDAQEMGRDRPGAVAHTCNPRTLGGRGGQITRGWEFETSLTNMEKPRLY

SEQ ID NO: 33331 - protein, 59 aa, Homo sapiens
  ENSP00000447774
MTHEEHHAAKTLGIGKAIAVLTSGGDAQEDICVRSNGPPLWIPGPCHLSVLWGRLGFYS

SEQ ID NO: 33332 - protein, 102 aa, Homo sapiens
  ENSP00000448315
MTHEEHHAAKTLGIGKAIAVLTSGGDAQGMNAAVRAVVRVGIFTGARVFFVHEGYQGLVDGGDHIKEATWESVSMMLQLLSSLKIHGQKFNMQCLVKALPRC

SEQ ID NO: 33333 - protein, 139 aa, Homo sapiens
  ENSP00000448253
MTHEEHHAAKTLGIGKAIAVLTSGGDAQGMNAAVRAVVRVGIFTGARVFFVHEGYQGLVDGGDHIKEATWESVSMMLQLGGTVIGSARCKDFREREGRLRAAYNLVKRGITNLCVIGGDGSLTGADTFRSEWSDLLSDL

SEQ ID NO: 33334 - protein, 156 aa, Homo sapiens
  ENSP00000449269
MTHEEHHAAKTLGIGKAIAVLTSGGDAQGMNAAVRAVVRVGIFTGARVFFVHEGYQGLVDGGDHIKEATWESVSMMLQLGGTVIGSARCKDFREREGRLRAAYNLVKRGITNLCVIGGDGSLTGADTFRSEWSDLLSDLQKADDDWEEHLCRRLSE

SEQ ID NO: 33335 - protein, 749 aa, Homo sapiens
  ENSP00000448177
MTHEEHHAAKTLGIGKAIAVLTSGGDAQGMNAAVRAVVRVGIFTGARVFFVHEGYQGLVDGGDHIKEATWESVSMMLQLGGTVIGSARCKDFREREGRLRAAYNLVKRGITNLCVIGGDGSLTGADTFRSEWSDLLSDLQKAGKITDEEATKSSYLNIVGLVGSIDNDFCGTDMTIGTDSALHRIMEIVDAITTTAQSHQRTFVLEVMGRHCGYLALVTSLSCGADWVFIPECPPDDDWEEHLCRRLSETRTRGSRLNIIIVAEGAIDKNGKPITSEDIKNGSRMGVEAVMALLEGTPDTPACVVSLSGNQAVRLPLMECVQVTKDVTKAMDEKKFDEALKLRGRSFMNNWEVYKLLAHVRPPVSKSGSHTVAVMNVGAPAAGMNAAVRSTVRIGLIQGNRVLVVHDGFEGLAKGQIEEAGWSYVGGWTGQGGSKLGTKRTLPKKSFEQISANITKFNIQGLVIIGGFEAYTGGLELMEGRKQFDELCIPFVVIPATVSNNVPGSDFSVGADTALNTICTTCDRIKQSAAGTKRRVFIIETMGGYCGYLATMAGLAAGADAAYIFEEPFTIRDLQANVEHLVQKMKTTVKRGLVLRNEKCNENYTTDFIFNLYSEEGKGIFDSRKNVLGHMQQGGSPTPFDRNFATKMGAKAMNWMSGKIKESYRNGRIFANTPDSGCVLGMRKRALVFQPVAELKDQTDFEHRIPKEQWWLKLRPILKILAKYEIDLDTSDHAHLEHITRKRSGEAAV

SEQ ID NO: 33336 - protein, 161 aa, Homo sapiens
  ENSP00000446805
MTHEEHHAAKTLGIGKAIAVLTSGGDAQGMNAAVRAVVRVGIFTGARVFFVHEGYQGLVDGGDHIKEATWESVSMMLQLGGTVIGSARCKDFREREGRLRAAYNLVKRGITNLCVIGGDGSLTGADTFRSEWSDLLSDLQKAGKITDEEATKSSYLNIVGL

SEQ ID NO: 33337 - protein, 780 aa, Homo sapiens; identical to SEQ ID NO: 33329
  ENSP00000449426

SEQ ID NO: 33338 - protein, 176 aa, Homo sapiens
  ENSP00000446519
MTHEEHHAAKTLGIGKAIAVLTSGGDAQGMNAAVRSTVRIGLIQGNRVLVVHDGFEGLAKGQIEEAGWSYVGGWTGQGGSKLGTKRTLPKKSFEQISANITKFNIQGLVIIGGFEAYTGGLELMEGRKQFDELCIPFVVIPATVSNNVPGSDFSVGADTALNTICTTCDRIKQSAA

SEQ ID NO: 33339 - protein, 41 aa, Homo sapiens
  ENSP00000446740
  MOD_RES (1)..(1): Any amino acid
XSLSGNQAVRLPLMECVQVTKDVTKAMDEKKFDEALKLRGR

SEQ ID NO: 33340 - protein, 97 aa, Homo sapiens
  ENSP00000450091
  MOD_RES (1)..(1): Any amino acid
XPFVVIPATVSNNVPGSDFSVGADTALNTICTANVEHLVQKMKTTVKRGLVLRNEKCNENYTTDFIFNLYSEEGKGIFDSRKNVLGHMQQGGSPTPF

SEQ ID NO: 33341 - protein, 780 aa, Homo sapiens; identical to SEQ ID NO: 33329
  ENSP00000309438

SEQ ID NO: 33342 - protein, 102 aa, Homo sapiens; identical to SEQ ID NO: 33332
  ENSP00000486196

SEQ ID NO: 33343 - protein, 113 aa, Homo sapiens
  ENSP00000477128
MNAAVRAVVRMGIYVGAKVYFIYEGYQGMVDGGSNIAEADWESVSSILQVGGTIIGSARCQAFRTREGRLKAACNLLQRGITNLCVIGGDGSLTGANLFRKEWSGLLEELARN

SEQ ID NO: 33344 - protein, 784 aa, Homo sapiens
  ENSP00000370517
MDADDSRAPKGSLRKFLEHLSGAGKAIGVLTSGGDAQGMNAAVRAVVRMGIYVGAKVYFIYEGYQGMVDGGSNIAEADWESVSSILQVGGTIIGSARCQAFRTREGRLKAACNLLQRGITNLCVIGGDGSLTGANLFRKEWSGLLEELARNGQIDKEAVQKYAYLNVVGMVGSIDNDFCGTDMTIGTDSALHRIIEVVDAIMTTAQSHQRTFVLEVMGRHCGYLALVSALACGADWVFLPESPPEEGWEEQMCVKLSENRARKKRLNIIIVAEGAIDTQNKPITSEKIKELVVTQLGYDTRVTILGHVQRGGTPSAFDRILASRMGVEAVIALLEATPDTPACVVSLNGNHAVRLPLMECVQMTQDVQKAMDERRFQDAVRLRGRSFAGNLNTYKRLAIKLPDDQIPKTNCNVAVINVGAPAAGMNAAVRSAVRVGIADGHRMLAIYDGFDGFAKGQIKEIGWTDVGGWTGQGGSILGTKRVLPGKYLEEIATQMRTHSINALLIIGGFEAYLGLLELSAAREKHEEFCVPMVMVPATVSNNVPGSDFSIGADTALNTITDTCDRIKQSASGTKRRVFIIETMGGYCGYLANMGGLAAGADAAYIFEEPFDIRDLQSNVEHLTEKMKTTIQRGLVLRNESCSENYTTDFIYQLYSEEGKGVFDCRKNVLGHMQQGGAPSPFDRNFGTKISARAMEWITAKLKEARGRGKKFTTDDSICVLGISKRNVIFQPVAELKKQTDFEHRIPKEQWWLKLRPLMKILAKYKASYDVSDSGQLEHVQPWSV

SEQ ID NO: 33345 - protein, 776 aa, Homo sapiens
  ENSP00000370465
MCGYERCRPCRGAHGYLRGGQGVLHLRGLPGHGGRRLKHRRGRLGECLQHPASGAVRGDWREKPGCWSHRFPCPGRHALVGGTIIGSARCQAFRTREGRLKAACNLLQRGITNLCVIGGDGSLTGANLFRKEWSGLLEELARNGQIDKEAVQKYAYLNVVGMVGSIDNDFCGTDMTIGTDSALHRIIEVVDAIMTTAQSHQRTFVLEVMGRHCGYLALVSALACGADWVFLPESPPEEGWEEQMCVKLSENRARKKRLNIIIVAEGAIDTQNKPITSEKIKELVVTQLGYDTRVTILGHVQRGGTPSAFDRILASRMGVEAVIALLEATPDTPACVVSLNGNHAVRLPLMECVQMTQDVQKAMDERRFQDAVRLRGRSFAGNLNTYKRLAIKLPDDQIPKTNCNVAVINVGAPAAGMNAAVRSAVRVGIADGHRMLAIYDGFDGFAKGQIKEIGWTDVGGWTGQGGSILGTKRVLPGKYLEEIATQMRTHSINALLIIGGFEAYLGLLELSAAREKHEEFCVPMVMVPATVSNNVPGSDFSIGADTALNTITDTCDRIKQSASGTKRRVFIIETMGGYCGYLANMGGLAAGADAAYIFEEPFDIRDLQSNVEHLTEKMKTTIQRGLVLRNESCSENYTTDFIYQLYSEEGKGVFDCRKNVLGHMQQGGAPSPFDRNFGTKISARAMEWITAKLKEARGRGKKFTTDDSICVLGISKRNVIFQPVAELKKQTDFEHRIPKEQWWLKLRPLMKILAKYKASYDVSDSGQLEHVQPWSV

SEQ ID NO: 33346 - protein, 210 aa, Homo sapiens
  ENSP00000385880
MNAAVRAVVRMGIYVGAKVYFIYEGYQGMVDGGSNIAEADWESVSSILQVGGTIIGSARCQAFRTREGRLKAACNLLQRGITNLCVIGGDGSLTGANLFRKEWSGLLEELARNGQIDKEAVQKYAYLNVVGMVGSIDNDFCGTDMTIGTDSALHRIIEVVDAIMTTAQSHQRTFVLEVMGRHCGYLALVSALACGADWVFLPESPPEEGW

SEQ ID NO: 33347 - protein, 240 aa, Homo sapiens
  ENSP00000408858
MGRHCGYLALVSALACGADWVFLPESPPEEGWEEQMCVKLSENRARKKRLNIIIVAEGAIDTQNKPITSEKIKELVVTQLGYDTRVTILGHVQRGGTPSAFDRILASRMGVEAVIALLEATPDTPACVVSLNGNHAVRLPLMECVQMTQDVQKAMDERRFQDAVRLRGRSFAGNLNTYKRLAIKLPDDQIPKTNCNVAVINVGAPAAGMNAAVRSAVRVGIADGHRMLAIYDGFDGFAKG

SEQ ID NO: 33348 - protein, 118 aa, Homo sapiens
  ENSP00000476311
MGRHCGYLALVSALACGADWVFLPESPPEEGWEEQMCVKLSENRARKKRLNIIIVAEGAIDTQNKPITSEKIKELVVTQLGYDTRVTILGHVQRGGTPSAFDRILASRMGVEAVIALL

SEQ ID NO: 33349 - protein, 166 aa, Homo sapiens
  ENSP00000387871
  MOD_RES (1)..(1): Any amino acid
XADGHRMLAIYDGFDGFAKGQIKEIGWTDVGGWTGQGGSILGTKRVLPGKYLEEIATQMRTHSINALLIIGGFEAYKSACDMAEARGRHQELCIPLCVVPATISNNVPGTEISLGSDTGLNAVVETCDRIKQSASGTKRRVFIIETMGGYCGYLANMGGLAAGADA

SEQ ID NO: 33350 - protein, 202 aa, Homo sapiens
  ENSP00000370462
MGGYCGYLANMGGLAAGADAAYIFEEPFDIRDLQSNVEHLTEKMKTTIQRGLVLRNESCSENYTTDFIYQLYSEEGKGVFDCRKNVLGHMQQGGAPSPFDRNFGTKISARAMEWITAKLKEARGRGKKFTTDDSICVLGISKRNVIFQPVAELKKQTDFEHRIPKEQWWLKLRPLMKILAKYKASYDVSDSGQLEHVQPWSV

SEQ ID NO: 33351 - protein, 103 aa, Homo sapiens
  ENSP00000410275
  MOD_RES (1)..(1): Any amino acid
XFIYQLYSEEGKGVFDCRKNVLGHMQQGGAPSPFDRNFGTKISARAMEWITAKLKEARGRGKKFTTDDSICVLGISKRNVIFQPVAELKKQTDFETVSMQPPR

SEQ ID NO: 33352 - protein, 737 aa, Homo sapiens
  ENSP00000387185
MEDAGEDPTTFAAHSLPSDPRLLATVTNAYLGTRVFHDTLHVSGVYNGAGGDTHRAMLPSPLNVRLEAPAGMGEQLTETFALDTNTGSFLHTLEGPRFRASQCIYAHRTLPHVLAFRVSIARLAPGSGPITLLLRSAFSPESPDLDLHQGPDFQGARYLYGHTLTPEQPGGPQQEVHMLWTPAPPDLTLGEGEEARTWDFLTAVGGSQAEAQACLTEALQLQARGALYTAHAQAWAQLWVECGLDVVGPLQLRQALRGSLYYLLSALPQPKAPGYICHGLSPGGLSNGSREECYWGHVFWDQDLWMFPSILMFHPEAARAILEYRIRTLDGALENAQNLGYQGAKFAWESADSGLEVCPEDIYGVQEVHVNGAVVLAFELYYHTTQDLQLFREAGGWDVVRAVAEFWCSRVEWSPREEKYHLRGVMSPDEYHSGVNNSVYTNVLVQNSLRFAAALAQDLGLPIPSQWLAVADKIKVPFDVEQNFHPEFDGYEPGEVVKQADVVLLGYPVPFSLSPDVRRKNLEIYEAVTSPQGPAMTWSMFAVGWMELKDAVRARGLLDRSFANMAEPFKVWTENADGSGAVNFLTGMGGFLQAVVFGCTGFRVTRAGVTFDPVCLSGISRVSVSGIFYQGNKLNFSFSEDSVTVEVTARAGPWAPHLEAELWPSQSRLSLLPGHKVSFPRSAGRIQMSPPKLPGSSSSEFPGRTFSDVRDPLQSPLWVTLGSSSPTESLTVDPASE

SEQ ID NO: 33353 - protein, 489 aa, Homo sapiens
  ENSP00000386297
MLWTPAPPDLTLGEGEEARTWDFLTAVGGSQAEAQACLTEALQLQARGALYTAHAQAWAQLWVECGLDVVGPLQLRQALRGSLYYLLSALPQPKAPGYICHGLSPGGLSNGSREECYWGHVFWDQDLWMFPSILMFHPEAARAILEYRIRTLDGALENAQNLGYQGAKFAWESADSGLEVCPEDIYGVQEVHVNGAVVLAFELYYHTTQDLQLFREAGGWDVVRAVAEFWCSRVEWSPREEKYHLRGVMSPDEYHSGVNNSVYTNVLVQNRKNLEIYEAVTSPQGPAMTWSMFAVGWMELKDAVRARGLLDRSFANMAEPFKVWTENADGSGAVNFLTGMGGFLQAVVFGCTGFRVTRAGVTFDPVCLSGISRVSVSGIFYQGNKLNFSFSEDSVTVEVTARAGPWAPHLEAELWPSQSRLSLLPGHKVSFPRSAGRIQMSPPKLPGSSSSEFPGRTFSDVRDPLQSPLWVTLGSSSPTESLTVDPASE

SEQ ID NO: 33354 - protein, 764 aa, Homo sapiens
  ENSP00000387099
MEDAGEDPTTFAAHSLPSDPRLLATVTNAYLGTRVFHDTLHVSGVYNGAGGDTHRAMLPSPLNVRLEAPAGMGEQLTETFALDTNTGSFLHTLEGPRFRASQCIYAHRTLPHVLAFRVSIARLAPGSGPITLLLRSAFSPESPDLDLHQGPDFQGARYLYGHTLTPEQPGGPQQEVHMLWTPAPPDLTLGEGEEARTWDFLTAVGGSQAEAQACLTEALQLQARGALYTAHAQAWAQLWVECGLDVVGPLQLRQALRGSLYYLLSALPQPKAPGYICHGLSPGGLSNGSREECYWGHVFWDQDLWMFPSILMFHPEAARAILEYRIRTLDGALENAQNLGYQGAKFAWESADSGLEVCPEDIYGVQEVHVNGAVVLAFELYYHTTQDLQLFREAGGWDVVRAVAEFWCSRVEWSPREEKHLTCASPTLTTGVEGRPLRLCTEHHLGLVCPGVMSPDEYHSGVNNSVYTNVLVQNSLRFAAALAQDLGLPIPSQWLAVADKIKVPFDVEQNFHPEFDGYEPGEVVKQADVVLLGYPVPFSLSPDVRRKNLEIYEAVTSPQGPAMTWSMFAVGWMELKDAVRARGLLDRSFANMAEPFKVWTENADGSGAVNFLTGMGGFLQAVVFGCTGFRVTRAGVTFDPVCLSGISRVSVSGIFYQGNKLNFSFSEDSVTVEVTARAGPWAPHLEAELWPSQSRLSLLPGHKVSFPRSAGRIQMSPPKLPGSSSSEFPGRTFSDVRDPLQSPLWVTLGSSSPTESLTVDPASE

SEQ ID NO: 33355 - protein, 203 aa, Homo sapiens
  ENSP00000431881
  MOD_RES (1)..(1): Any amino acid
XFHDTLHVSGVYNGAGGDTHRAMLPSPLNVRLEAPAGMGEQLTETFALDTNTGSFLHTLEGPRFRASQCIYAHRTLPHVLAFRVSIARLAPGSGPITLLLRSAFSPESPDLDLHQGPDFQGARYLYGHTLTPEQPGGPQQEVHMLWTPAPPDLTLGEVPCPSPRPQDTSAMASVLGASPMGAVRNATGATSSGTRTSGCSRVS

SEQ ID NO: 33356 - protein, 193 aa, Homo sapiens
  ENSP00000380780
  MOD_RES (1)..(1): Any amino acid
XEIYEAVTSPQGPAMTWSMFAVGWMELKDAVRARGLLDRSFANMAEPFKVWTENADGSGAVNFLTGMGGFLQAVVFGCTGFRVSVSGIFYQGNKLNFSFSEDSVTVEVTARAGPWAPHLEAELWPSQSRLSLLPGHKVSFPRSAGRIQMSPPKLPGSSSSEFPGRTFSDVRDPLQSPLWVTLGSSSPTESLTV

SEQ ID NO: 33357 - protein, 622 aa, Homo sapiens
  ENSP00000298198
MAENTEGDLNSNLLHAPYHTGDPQLDTAIGQWLRWDKNPKTKEQIENLLRNGMNKELRDRLCCRMTFGTAGLRSAMGAGFCYINDLTVIQSTQGMYKYLERCFSDFKQRGFVVGYDTRGQVTSSCSSQRLAKLTAAVLLAKDVPVYLFSRYVPTPFVPYAVQKLKAVAGVMITASHNRKEDNGYKVYWETGAQITSPHDKEILKCIEECVEPWNGSWNDNLVDTSPLKRDPLQDICRRYMEDLKKICFYRELNSKTTLKFVHTSFHGVGHDYVQLAFKVFGFKPPIPVPEQKDPDPDFSTVKCPNPEEGESVLELSLRLAEKENARVVLATDPDADRLAAAELQENGCWKVFTGNELAALFGWWMFDCWKKNKSRNADVKNVYMLATTVSSKILKAIALKEGFHFEETLPGFKWIGSRIIDLLENGKEVLFAFEESIGFLCGTSVLDKDGVSAAVVVAEMASYLETMNITLKQQLVKVYEKYGYHISKTSYFLCYEPPTIKSIFERLRNFDSPKEYPKFCGTFAILHVRDVTTGYDSSQPNKKSVLPVSKNSQMITFTFQNGCVATLRTSGTEPKIKYYAEMCASPDQSDTALLEEELKKLIDALIENFLQPSKNGLIWRSV

SEQ ID NO: 33358 - protein, 387 aa, Homo sapiens
  ENSP00000379674
MEGSPIPVLTVPTAPYEDQRPAGGGGLRRPTGLFEGQRNYLPNFIQSVLSSIDLRDRQGCTMVVGSDGRYFSRTAIEIVVQMAAANGIGRLIIGQNGILSTPAVSCIIRKIKAAGGIILTASHCPGGPGGEFGVKFNVANGGPAPDVVSDKIYQISKTIEEYAICPDLRIDLSRLGRQEFDLENKFKPFRVEIVDPVDIYLNLLRTIFDFHAIKGLLTGPSQLKIRIDAMHGVMGPYVRKVLCDELGAPANSAINCVPLEDFGGQHPDPNLTYATTLLEAMKGGEYGFGAAFDADGDRYMILGQNGFFVSPSDSLAIIAANLSCIPYFRQMGVRGFGRSMPTSMALDRVAKSMKVPVYETPAGWRFFSNLMDSGRCNLCGEESFGTV

SEQ ID NO: 33359 - protein, 567 aa, Homo sapiens
  ENSP00000379678
MEGSPIPVLTVPTAPYEDQRPAGGGGLRRPTGLFEGQRNYLPNFIQSVLSSIDLRDRQGCTMVVGSDGRYFSRTAIEIVVQMAAANGIGRLIIGQNGILSTPAVSCIIRKIKAAGGIILTASHCPGGPGGEFGVKFNVANGGPAPDVVSDKIYQISKTIEEYAICPDLRIDLSRLGRQEFDLENKFKPFRVEIVDPVDIYLNLLRTIFDFHAIKGLLTGPSQLKIRIDAMHGVMGPYVRKVLCDELGAPANSAINCVPLEDFGGQHPDPNLTYATTLLEAMKGGEYGFGAAFDADGDRYMILGQNGFFVSPSDSLAIIAANLSCIPYFRQMGVRGFGRSMPTSMALDRVAKSMKVPVYETPAGWRFFSNLMDSGRCNLCGEESFGTGSDHLREKDGLWAVLVWLSIIAARKQSVEEIVRDHWAKFGRHYYCRFDYEGLDPKTTYYIMRDLEALVTDKSFIGQQFAVGSHVYSVAKTDSFEYVDPVDGTVTKKQGLRIIFSDASRLIFRLSSSSGVRATLRLYAESYERDPSGHDQEPQAVLSPLIAIALKISQIHERTGRRGPTVIT

SEQ ID NO: 33360 - protein, 205 aa, Homo sapiens
  ENSP00000394864
EGQRNYLPNFIQSVLSSIDLRDRQGCTMVVGSDGRYFSRTAIEIVVQMAAANGIGRLIIGQNGILSTPAVSCIIRKIKAAGGIILTASHCPGGPGGEFGVKFNVANGVEIVDPVDIYLNLLRTIFDFHAIKGLLTGPSQLKIRIDAMHGVMGPYVRKVLCDELGAPANSAINCVPLEDFGGQHPDPNLTYATTLLEAMKGGEYGF

SEQ ID NO: 33361 - protein, 933 aa, Homo sapiens
  ENSP00000325120
MTELKAKGPRAPHVAGGPPSPEVGSPLLCRPAAGPFPGSQTSDTLPEVSAIPISLDGLLFPRPCQGQDPSDEKTQDQQSLSDVEGAYSRAEATRGAGGSSSSPPEKDSGLLDSVLDTLLAPSGPGQSQPSPPACEVTSSWCLFGPELPEDPPAAPATQRVLSPLMSRSGCKVGDSSGTAAAHKVLPRGLSPARQLLLPASESPHWSGAPVKPSPQAAAVEVEEEDGSESEESAGPLLKGKPRALGGAAAGGGAAAVPPGAAAGGVALVPKEDSRFSAPRVALVEQDAPMAPGRSPLATTVMDFIHVPILPLNHALLAARTRQLLEDESYDGGAGAASAFAPPRSSPCASSTPVAVGDFPDCAYPPDAEPKDDAYPLYSDFQPPALKIKEEEEGAEASARSPRSYLVAGANPAAFPDFPLGPPPPLPPRATPSRPGEAAVTAAPASASVSSASSSGSTLECILYKAEGAPPQQGPFAPPPCKAPGASGCLLPRDGLPSTSASAAAAGAAPALYPALGLNGLPQLGYQAAVLKEGLPQVYPPYLNYLRPDSEASQSPQYSFESLPQKICLICGDEASGCHYGVLTCGSCKVFFKRAMEGQHNYLCAGRNDCIVDKIRRKNCPACRLRKCCQAGMVLGGRKFKKFNKVRVVRALDAVALPQPVGVPNESQALSQRFTFSPGQDIQLIPPLINLLMSIEPDVIYAGHDNTKPDTSSSLLTSLNQLGERQLLSVVKWSKSLPGFRNLHIDDQITLIQYSWMSLMVFGLGWRSYKHVSGQMLYFAPDLILNEQRMKESSFYSLCLTMWQIPQEFVKLQVSQEEFLCMKVLLLLNTIPLEGLRSQTQFEEMRSSYIRELIKAIGLRQKGVVSSSQRFYQLTKLLDNLHDLVKQLHLYCLNTFIQSRALSVEFPEMMSEVIAAQLPKILAGMVKPLLFHKK

SEQ ID NO: 33362 - protein, 339 aa, Homo sapiens
  ENSP00000436561
MEGQHNYLCAGRNDCIVDKIRRKNCPACRLRKCCQAGMVLGGRKFKKFNKVRVVRALDAVALPQPVGVPNESQALSQRFTFSPGQDIQLIPPLINLLMSIEPDVIYAGHDNTKPDTSSSLLTSLNQLGERQLLSVVKWSKSLPGFRNLHIDDQITLIQYSWMSLMVFGLGWRSYKHVSGQMLYFAPDLILNEQRMKESSFYSLCLTMWQIPQEFVKLQVSQEEFLCMKVLLLLNTIPLEGLRSQTQFEEMRSSYIRELIKAIGLRQKGVVSSSQRFYQLTKLLDNLHDLVKQLHLYCLNTFIQSRALSVEFPEMMSEVIAAQLPKILAGMVKPLLFHKK

SEQ ID NO: 33363 - protein, 764 aa, Homo sapiens
  ENSP00000432914
MTELKAKGPRAPHVAGGPPSPEVGSPLLCRPAAGPFPGSQTSDTLPEVSAIPISLDGLLFPRPCQGQDPSDEKTQDQQSLSDVEGAYSRAEATRGAGGSSSSPPEKDSGLLDSVLDTLLAPSGPGQSQPSPPACEVTSSWCLFGPELPEDPPAAPATQRVLSPLMSRSGCKVGDSSGTAAAHKVLPRGLSPARQLLLPASESPHWSGAPVKPSPQAAAVEVEEEDGSESEESAGPLLKGKPRALGGAAAGGGAAAVPPGAAAGGVALVPKEDSRFSAPRVALVEQDAPMAPGRSPLATTVMDFIHVPILPLNHALLAARTRQLLEDESYDGGAGAASAFAPPRSSPCASSTPVAVGDFPDCAYPPDAEPKDDAYPLYSDFQPPALKIKEEEEGAEASARSPRSYLVAGANPAAFPDFPLGPPPPLPPRATPSRPGEAAVTAAPASASVSSASSSGSTLECILYKAEGAPPQQGPFAPPPCKAPGASGCLLPRDGLPSTSASAAAAGAAPALYPALGLNGLPQLGYQAAVLKEGLPQVYPPYLNYLRPDSEASQSPQYSFESLPQKICLICGDEASGCHYGVLTCGSCKVFFKRAMEGRKFKKFNKVRVVRALDAVALPQPVGVPNESQALSQRFTFSPGQDIQLIPPLINLLMSIEPDVIYAGHDNTKPDTSSSLLTSLNQLGERQLLSVVKWSKSLPGFRNLHIDDQITLIQYSWMSLMVFGLGWRSYKHVSGQMLYFAPDLILNESHRSLSSFKLAKKSSSV

SEQ ID NO: 33364 - protein, 803 aa, Homo sapiens
  ENSP00000432352
MTELKAKGPRAPHVAGGPPSPEVGSPLLCRPAAGPFPGSQTSDTLPEVSAIPISLDGLLFPRPCQGQDPSDEKTQDQQSLSDVEGAYSRAEATRGAGGSSSSPPEKDSGLLDSVLDTLLAPSGPGQSQPSPPACEVTSSWCLFGPELPEDPPAAPATQRVLSPLMSRSGCKVGDSSGTAAAHKVLPRGLSPARQLLLPASESPHWSGAPVKPSPQAAAVEVEEEDGSESEESAGPLLKGKPRALGGAAAGGGAAAVPPGAAAGGVALVPKEDSRFSAPRVALVEQDAPMAPGRSPLATTVMDFIHVPILPLNHALLAARTRQLLEDESYDGGAGAASAFAPPRSSPCASSTPVAVGDFPDCAYPPDAEPKDDAYPLYSDFQPPALKIKEEEEGAEASARSPRSYLVAGANPAAFPDFPLGPPPPLPPRATPSRPGEAAVTAAPASASVSSASSSGSTLECILYKAEGAPPQQGPFAPPPCKAPGASGCLLPRDGLPSTSASAAAAGAAPALYPALGLNGLPQLGYQAAVLKEGLPQVYPPYLNYLRPDSEASQSPQYSFESLPQKICLICGDEASGCHYGVLTCGSCKVFFKRAMEGQHNYLCAGRNDCIVDKIRRKNCPACRLRKCCQAGMVLGGRKFKKFNKVRVVRALDAVALPQPVGVPNESQALSQRFTFSPGQDIQLIPPLINLLMSIEPDVIYAGHDNTKPDTSSSLLTSLNQLGERQLLSVVKWSKSLPGFRNLHIDDQITLIQYSWMSLMVFGLGWRSYKHVSGQMLYFAPDLILNESHRSLSSFKLAKKSSSV

SEQ ID NO: 33365 - protein, 695 aa, Homo sapiens
  ENSP00000436803
MTELKAKGPRAPHVAGGPPSPEVGSPLLCRPAAGPFPGSQTSDTLPEVSAIPISLDGLLFPRPCQGQDPSDEKTQDQQSLSDVEGAYSRAEATRGAGGSSSSPPEKDSGLLDSVLDTLLAPSGPGQSQPSPPACEVTSSWCLFGPELPEDPPAAPATQRVLSPLMSRSGCKVGDSSGTAAAHKVLPRGLSPARQLLLPASESPHWSGAPVKPSPQAAAVEVEEEDGSESEESAGPLLKGKPRALGGAAAGGGAAAVPPGAAAGGVALVPKEDSRFSAPRVALVEQDAPMAPGRSPLATTVMDFIHVPILPLNHALLAARTRQLLEDESYDGGAGAASAFAPPRSSPCASSTPVAVGDFPDCAYPPDAEPKDDAYPLYSDFQPPALKIKEEEEGAEASARSPRSYLVAGANPAAFPDFPLGPPPPLPPRATPSRPGEAAVTAAPASASVSSASSSGSTLECILYKAEGAPPQQGPFAPPPCKAPGASGCLLPRDGLPSTSASAAAAGAAPALYPALGLNGLPQLGYQAAVLKEGLPQVYPPYLNYLRPDSEASQSPQYSFESLPQKICLICGDEASGCHYGVLTCGSCKVFFKRAMEGQHNYLCAGRNDCIVDKIRRKNCPACRLRKCCQAGMVLGGFRNLHIDDQITLIQYSWMSLMVFGLGWRSYKHVSGQMLYFAPDLILNDSFGRATKSNPV

SEQ ID NO: 33366 - protein, 831 aa, Homo sapiens
  ENSP00000263463
MTELKAKGPRAPHVAGGPPSPEVGSPLLCRPAAGPFPGSQTSDTLPEVSAIPISLDGLLFPRPCQGQDPSDEKTQDQQSLSDVEGAYSRAEATRGAGGSSSSPPEKDSGLLDSVLDTLLAPSGPGQSQPSPPACEVTSSWCLFGPELPEDPPAAPATQRVLSPLMSRSGCKVGDSSGTAAAHKVLPRGLSPARQLLLPASESPHWSGAPVKPSPQAAAVEVEEEDGSESEESAGPLLKGKPRALGGAAAGGGAAAVPPGAAAGGVALVPKEDSRFSAPRVALVEQDAPMAPGRSPLATTVMDFIHVPILPLNHALLAARTRQLLEDESYDGGAGAASAFAPPRSSPCASSTPVAVGDFPDCAYPPDAEPKDDAYPLYSDFQPPALKIKEEEEGAEASARSPRSYLVAGANPAAFPDFPLGPPPPLPPRATPSRPGEAAVTAAPASASVSSASSSGSTLECILYKAEGAPPQQGPFAPPPCKAPGASGCLLPRDGLPSTSASAAAAGAAPALYPALGLNGLPQLGYQAAVLKEGLPQVYPPYLNYLRPDSEASQSPQYSFESLPQKICLICGDEASGCHYGVLTCGSCKVFFKRAMEGQHNYLCAGRNDCIVDKIRRKNCPACRLRKCCQAGMVLGGFRNLHIDDQITLIQYSWMSLMVFGLGWRSYKHVSGQMLYFAPDLILNEQRMKESSFYSLCLTMWQIPQEFVKLQVSQEEFLCMKVLLLLNTIPLEGLRSQTQFEEMRSSYIRELIKAIGLRQKGVVSSSQRFYQLTKLLDNLHDLVKQLHLYCLNTFIQSRALSVEFPEMMSEVIAAQLPKILAGMVKPLLFHKK

SEQ ID NO: 33367 - protein, 170 aa, Homo sapiens
  ENSP00000487607
MKCFFLRRRTFTRSACLGEEPDSEASQSPQYSFESLPQKICLICGDEASGCHYGVLTCGSCKVFFKRAMEGQHNYLCAGRNDCIVDKIRRKNCPACRLRKCCQAGMVLGGRKFKKFNKVRVVRALDAVALPQPVGVPNESQALSQRFTFSPGQDIQLIPPLINLLMSIEP

SEQ ID NO: 33368 - protein, 764 aa, Homo sapiens; identical to SEQ ID NO: 33363
  ENSP00000482698

SEQ ID NO: 33369 - protein, 690 aa, Homo sapiens [sequence omitted]

SEQ ID NO: 33370 - protein, 496 aa, Homo sapiens
  ENSP00000355743
MAAAAGPGAALSPRPCDSDPATPGAQSPKDDNEDNSNDGTQPSKRRRMGSGDSSRSCETSSQDLGFSYYPAENLIEYKWPPDETGEYYMLQEQVSEYLGVTSFKRKYPERRDLSHKEKLYLRELNVITETQCTLGLTALRSDEVIDLMIKEYPAKHAEYSVILQEKERQRITDHYKEYSQMQQQNTQKVEASKVPEYIKKAAKKAAEFNSNLNRERMEERRAYFDLQTHVIQVPQGKYKVLPTERTKVSSYPVALIPGQFQEYYKRYSPDELRYLPLNTALYEPPLDPELPALDSDGDSDDGEDGRGDEKRKNKGTSDSSSGNVSEGESPPDSQEDSFQGRQKSKDKAATPRKDGPKRSVLSKSVPGYKPKVIPNAICGICLKGKESNKKGKAESLIHCSQCENSGHPSCLDMTMELVSMIKTYPWQCMECKTCIICGQPHHEEEMMFCDMCDRGYHTFCVGLGAIPSGRWICDCCQRAPPTPRKVGRRGKNSKEG

SEQ ID NO: 33371 - protein, 498 aa, Homo sapiens
  ENSP00000341805
MAAAAGPGAALSPRPCDSDPATPGAQSPKDDNEDNSNDGTQPSKRRRMGSGDSSRSCETSSQDLGFSYYPAENLIEYKWPPDETGEYYMLQEQVSEYLGVTSFKRKYPDLERRDLSHKEKLYLRELNVITETQCTLGLTALRSDEVIDLMIKEYPAKHAEYSVILQEKERQRITDHYKEYSQMQQQNTQKVEASKVPEYIKKAAKKAAEFNSNLNRERMEERRAYFDLQTHVIQVPQGKYKVLPTERTKVSSYPVALIPGQFQEYYKRYSPDELRYLPLNTALYEPPLDPELPALDSDGDSDDGEDGRGDEKRKNKGTSDSSSGNVSEGESPPDSQEDSFQGRQKSKDKAATPRKDGPKRSVLSKSVPGYKPKVIPNAICGICLKGKESNKKGKAESLIHCSQCENSGHPSCLDMTMELVSMIKTYPWQCMECKTCIICGQPHHEEEMMFCDMCDRGYHTFCVGLGAIPSGRWICDCCQRAPPTPRKVGRRGKNSKEG

SEQ ID NO: 33372 - protein, 377 aa, Homo sapiens
  ENSP00000479515
MAAAAGPGAALSPRPCDSDPATPGAQSPKDDNEDNSNDGTQPSKRRRMGSGDSSRSCETSSQDLGFSYYPAENLIEYKWPPDETGEYYMLQEQVSEYLGVTSFKRKYPDLERRDLSHKEKLYLRELNVITETQCTLGLTALRSDEVIDLMIKEYPAKHAEYSVILQEKERQRITDHYKEYSQMQQQNTQKVEASKVPEYIKKAAKKAAEFNSNLNRERMEERRAYFDLQTHVIQVPQGKYKVLPTERTKVSSYPVALIPGQFQEYYKRYSPDELRYLPLNTALYEPPLDPELPALDSDGDSDDGEDGRGDEKRKNKGTSDSSSGNVSEGESPPDSQEDSFQGRQKSKDKAATPRKDGPKRSVLSKSVPGYKVEEKSP

SEQ ID NO: 33373 - protein, 451 aa, Homo sapiens
  ENSP00000484117
MGSGDSSRSCETSSQDLGFSYYPAENLIEYKWPPDETGEYYMLQEQVSEYLGVTSFKRKYPDLERRDLSHKEKLYLRELNVITETQCTLGLTALRSDEVIDLMIKEYPAKHAEYSVILQEKERQRITDHYKEYSQMQQQNTQKVEASKVPEYIKKAAKKAAEFNSNLNRERMEERRAYFDLQTHVIQVPQGKYKVLPTERTKVSSYPVALIPGQFQEYYKRYSPDELRYLPLNTALYEPPLDPELPALDSDGDSDDGEDGRGDEKRKNKGTSDSSSGNVSEGESPPDSQEDSFQGRQKSKDKAATPRKDGPKRSVLSKSVPGYKPKVIPNAICGICLKGKESNKKGKAESLIHCSQCENSGHPSCLDMTMELVSMIKTYPWQCMECKTCIICGQPHHEEEMMFCDMCDRGYHTFCVGLGAIPSGRWICDCCQRAPPTPRKVGRRGKNSKEG

SEQ ID NO: 33374 - protein, 327 aa, Homo sapiens
  ENSP00000385053
MAPSTAVSVVSDSIKVQPLLISADNKVIIIQPQVQTQPESTAESRPPTEEPSQGAQATKKKKEDRPPTQENPEKIAFMVALGLVTTEHLEEIQSKRQERKRRSTANPAYSGLLETERKRLASNYLNNPLFLTARANEDPCWKNEITHDEHCAACKRGANLQPCGTCPGAYHLSCLEPPLKTAPKGVWVCPRCQQKALKKDEGVPWTGMLAIVHSYVTHKTVKEEEKQKLLQRGSELQNEHQQLEERDRRLASAVQKCLELKTSLLARQRGTQSSLDRLRALLRLIQGEQLLQVTMTTTSPAPLLAGPWTKPSVAATHPTVQHPQGHN

SEQ ID NO: 33375 - protein, 531 aa, Homo sapiens
  ENSP00000324403
MELQSRPEALAVELARHQNGDLKKQLHERQPRIAALSDKQALGTITAVPVTGPQVSSLQRLAGQGAAVLPQVRPKTLIPDSLPVAPGRDRPPKQPPTFQKATVVSVKNPSPALPTANNTVSHVPAPGSQPQALAEPAALASPLSSAGVAYAIISTSPSNAAAMAPSTAVSVVSDSIKVQPLLISADNKPPPRLLSSPHPATHHCPLHPSSLPLTPPSPSLSPSPLHGIFQVIIIQPQVQTQPESTAESRPPTEEPSQGAQATKKKKEDRPPTQENPEKIAFMVALGLVTTEHLEEIQSKRQERKRRSTANPAYSGLLETERKRLASNYLNNPLFLTARANEDPCWKNEITHDEHCAACKRGANLQPCGTCPGAYHLSCLEPPLKTAPKGVWVCPRCQQKALKKDEGVPWTGMLAIVHSYVTHKTVKEEEKQKLLQRGSELQNEHQQLEERDRRLASAVQKCLELKTSLLARQRGTQSSLDRLRALLRLIQGEQLLQVTMTTTSPAPLLAGPWTKPSVAATHPTVQHPQGHN

SEQ ID NO: 33376 - protein, 489 aa, Homo sapiens
  ENSP00000487086
MELQSRPEALAVELARHQNGDLKKQLHERQPRIAALSDKQALGTITAVPVTGPQVSSLQRLAGQGAAVLPQVRPKTLIPDSLPVAPGRDRPPKQPPTFQKATVVSVKNPSPALPTANNTVSHVPAPGSQPQALAEPAALASPLSSAGVAYAIISTSPSNAAAMAPSTAVSVVSDSIKVQPLLISADNKVIIIQPQVQTQPESTAESRPPTEEPSQGAQATKKKKEDRPPTQENPEKIAFMVALGLVTTEHLEEIQSKRQERKRRSTANPAYSGLLETERKRLASNYLNNPLFLTARANEDPCWKNEITHDEHCAACKRGANLQPCGTCPGAYHLSCLEPPLKTAPKGVWVCPRCQQKALKKDEGVPWTGMLAIVHSYVTHKTVKEEEKQKLLQRGSELQNEHQQLEERDRRLASAVQKCLELKTSLLARQRGTQSSLDRLRALLRLIQGEQLLQVTMTTTSPAPLLAGPWTKPSVAATHPTVQHPQGHN

SEQ ID NO: 33377 - protein, 137 aa, Homo sapiens
  ENSP00000401091
MAPSTAVSVVSDSIKVQPLLISADNKVIIIQPQVQTQPESTAESRPPTEEPSQGAQATKKKKEDRPPTQENPEKIAFMVALGLVTTEHLEEIQSKRQERKRRSTANPAYSGLLETERKRLASNYLNNPLFLTARANE

SEQ ID NO: 33378 - protein, 191 aa, Homo sapiens
  ENSP00000401294
MRRQPQNGDLKKQLHERQPRIAALSDKQALGTITAVPVTGPQVSSLQRLAGQGAAVLPQVRPKTLIPDSLPVAPGRDRPPKQPPTFQKATVVSVKNPSPALPTANNTVSHVPAPGSQPQALAEPAALASPLSSAGVAYAIISTSPSNAAAMAPSTAVSVVSDSIKVQPLLISADNKVIIIQPQVQTQPEST

SEQ ID NO: 33379 - protein, 477 aa, Homo sapiens
  ENSP00000379410
MRRQPQNGDLKKQLHERQPRIAALSDKQALGTITAVPVTGPQVSSLQRLAGQGAAVLPQVRPKTLIPDSLPVAPGRDRPPKQPPTFQKATVVSVKNPSPALPTANNTVSHVPAPGSQPQALAEPAALASPLSSAGVAYAIISTSPSNAAAMAPSTAVSVVSDSIKVQPLLISADNKVIIIQPQVQTQPESTAESRPPTEEPSQGAQATKKKKEDRPPTQENPEKIAFMVALGLVTTEHLEEIQSKRQERKRRSTANPAYSGLLETERKRLASNYLNNPLFLTARANEDPCWKNEITHDEHCAACKRGANLQPCGTCPGAYHLSCLEPPLKTAPKGVWVCPRCQQKALKKDEGVPWTGMLAIVHSYVTHKTVKEEEKQKLLQRGSELQNEHQQLEERDRRLASAVQKCLELKTSLLARQRGTQSSLDRLRALLRLIQGEQLLQVTMTTTSPAPLLAGPWTKPSVAATHPTVQHPQGHN

SEQ ID NO: 33380 - protein, 400 aa, Homo sapiens
  ENSP00000242315
MGVLMSKRQTVEQVQKVSLAVSAFKDGLRDRPSIRRTGELPGSRRGTVEGSVQEVQEEKEAEAGTSVVQEESSAGRAAWERLRDGRGVEPEEFDRTSRFTPPAFIRPTRKLDDDKPPEICLEPREPVVNDEMCDVCEVWTAESLFPCRVCTRVFHDGCLRRMGYIQGDSAAEVTEMAHTETGWSCHYCDNINLLLTEEEMYSLTETFQRCKVIPDCSLTLEDFLRYRHQAAKRGDRDRALSEEQEEQAARQFAALDPEHRGHIEWPDFLSHESLLLLQQLRPQNSLLRLLTVKERERARAAFLARGSGSTVSEAECRRAQHSWFCKRFPEAPSCSVSISHVGPIADSSPASSSSKSQDKTLLPTEQESRFVDWPTFLQENVLYILAARPNSAAIHLKPPG

SEQ ID NO: 33381 - protein, 1223 aa, Homo sapiens
  ENSP00000362643
MRSRSNSGVRLDGYARLVQQTILCHQNPVTGLLPASYDQKDAWVRDNVYSILAVWGLGLAYRKNADRDEDKAKAYELEQSVVKLMRGLLHCMIRQVDKVESFKYSQSTKDSLHAKYNTKTCATVVGDDQWGHLQLDATSVYLLFLAQMTASGLHIIHSLDEVNFIQNLVFYIEAAYKTADFGIWERGDKTNQGISELNASSVGMAKAALEALDELDLFGVKGGPQSVIHVLADEVQHCQSILNSLLPRASTSKEVDASLLSVVSFPAFAVEDSQLVELTKQEIITKLQGRYGCCRFLRDGYKTPKEDPNRLYYEPAELKLFENIECEWPLFWTYFILDGVFSGNAEQVQEYKEALEAVLIKGKNGVPLLPELYSVPPDRVDEEYQNPHTVDRVPMGKLPHMWGQSLYILGSLMAEGFLAPGEIDPLNRRFSTVPKPDVVVQVSILAETEEIKTILKDKGIYVETIAEVYPIRVQPARILSHIYSSLGCNNRMKLSGRPYRHMGVLGTSKLYDIRKTIFTFTPQFIDQQQFYLALDNKMIVEMLRTDLSYLCSRWRMTGQPTITFPISHSMLDEDGTSLNSSILAALRKMQDGYFGGARVQTGKLSEFLTTSCCTHLSFMDPGPEGKLYSEDYDDNYDYLESGNWMNDYDSTSHARCGDEVARYLDHLLAHTAPHPKLAPTSQKGGLDRFQAAVQTTCDLMSLVTKAKELHVQNVHMYLPTKLFQASRPSFNLLDSPHPRQENQVPSVRVEIHLPRDQSGEVDFKALVLQLKETSSLQEQADILYMLYTMKGPDWNTELYNERSATVRELLTELYGKVGEIRHWGLIRYISGILRKKVEALDEACTDLLSHQKHLTVGLPPEPREKTISAPLPYEALTQLIDEASEGDMSISILTQEIMVYLAMYMRTQPGLFAEMFRLRIGLIIQVMATELAHSLRCSAEEATEGLMNLSPSAMKNLLHHILSGKEFGVERSVRPTDSNVSPAISIHEIGAVGATKTERTGIMQLKSEIKQVEFRRLSISAESQSPGTSMTPSSGSFPSAYDQQSSKDSRQGQWQRRRRLDGALNRVPVGFYQKVWKVLQKCHGLSVEGFVLPSSTTREMTPGEIKFSVHVESVLNRVPQPEYRQLLVEAILVLTMLADIEIHSIGSIIAVEKIVHIANDLFLQEQKTLGADDTMLAKDPASGICTLLYDSAPSGRFGTMTYLSKAAATYVQEFLPHSICAMQ

SEQ ID NO: 33382 - protein, 1181 aa, Homo sapiens
  ENSP00000362646
MRSRSNSGVRLDGYARLVQQTILCHQNPVTGLLPASYDQKDAWVRDNVYSILAVWGLGLAYRKNADRDEDKAKAYELEQSVVKLMRGLLHCMIRQVDKVESFKYSQSTKDSLHAKYNTKTCATVVGDDQWGHLQLDATSVYLLFLAQMTASGLHIIHSLDEVNFIQNLVFYIEAAYKTADFGIWERGDKTNQGISELNASSVGMAKAALEALDELDLFGVKGGPQSVIHVLADEVQHCQSILNSLLPRASTSKEVDASLLSVVSFPAFAVEDSQLVELTKQEIITKLQGRYGCCRFLRDGYKTPKEDPNRLYYEPAELKLFENIECEWPLFWTYFILDGVFSGNAEQVQEYKEALEAVLIKGKNGVPLLPELYSVPPDRVDEEYQNPHTVDRVPMGKLPHMWGQSLYILGSLMAEGFLAPGEIDPLNRRFSTVPKPDVVVQVSILAETEEIKTILKDKGIYVETIAEVYPIRVQPARILSHIYSSLGCNNRMKLSGRPYRHMGVLGTSKLYDIRKTIFTFTPQFIDQQQFYLALDNKMIVEMLRTDLSYLCSRWRMTGQPTITFPISHSMLDEDGTSLNSSILAALRKMQDGYFGGARVQTGKLSEFLTTSCCTHLSFMDPGPEGKLYSEDYDDNYDYLESGNWMNDYDSTSHDVHMYLPTKLFQASRPSFNLLDSPHPRQENQVPSVRVEIHLPRDQSGEVDFKALVLQLKETSSLQEQADILYMLYTMKGPDWNTELYNERSATVRELLTELYGKVGEIRHWGLIRYISGILRKKVEALDEACTDLLSHQKHLTVGLPPEPREKTISAPLPYEALTQLIDEASEGDMSISILTQEIMVYLAMYMRTQPGLFAEMFRLRIGLIIQVMATELAHSLRCSAEEATEGLMNLSPSAMKNLLHHILSGKEFGVERSVRPTDSNVSPAISIHEIGAVGATKTERTGIMQLKSEIKQVEFRRLSISAESQSNGGHPLGIDLMSPSFMSPGTSMTPSSGSFPSAYDQQSSKDSRQGQWQRRRRLDGALNRVPVGFYQKVWKVLQKCHGLSVEGFVLPSSTTREMTPGEIKFSVHVESVLNRVPQPEYRQLLVEAILVLTMLADIEIHSIGSIIAVEKIVHIANDLFLQEQKTLGADDTMLAKDPASGICTLLYDSAPSGRFGTMTYLSKAAATYVQEFLPHSICAMQ

SEQ ID NO: 33383 - protein, 1240 aa, Homo sapiens
  ENSP00000362640
MRSRSNSGVRLDGYARLVQQTILCHQNPVTGLLPASYDQKDAWVRDNVYSILAVWGLGLAYRKNADRDEDKAKAYELEQSVVKLMRGLLHCMIRQVDKVESFKYSQSTKDSLHAKYNTKTCATVVGDDQWGHLQLDATSVYLLFLAQMTASGLHIIHSLDEVNFIQNLVFYIEAAYKTADFGIWERGDKTNQGISELNASSVGMAKAALEALDELDLFGVKGGPQSVIHVLADEVQHCQSILNSLLPRASTSKEVDASLLSVVSFPAFAVEDSQLVELTKQEIITKLQGRYGCCRFLRDGYKTPKEDPNRLYYEPAELKLFENIECEWPLFWTYFILDGVFSGNAEQVQEYKEALEAVLIKGKNGVPLLPELYSVPPDRVDEEYQNPHTVDRVPMGKLPHMWGQSLYILGSLMAEGFLAPGEIDPLNRRFSTVPKPDVVVQVSILAETEEIKTILKDKGIYVETIAEVYPIRVQPARILSHIYSSLGCNNRMKLSGRPYRHMGVLGTSKLYDIRKTIFTFTPQFIDQQQFYLALDNKMIVEMLRTDLSYLCSRWRMTGQPTITFPISHSMLDEDGTSLNSSILAALRKMQDGYFGGARVQTGKLSEFLTTSCCTHLSFMDPGPEGKLYSEDYDDNYDYLESGNWMNDYDSTSHARCGDEVARYLDHLLAHTAPHPKLAPTSQKGGLDRFQAAVQTTCDLMSLVTKAKELHVQNVHMYLPTKLFQASRPSFNLLDSPHPRQENQVPSVRVEIHLPRDQSGEVDFKALVLQLKETSSLQEQADILYMLYTMKGPDWNTELYNERSATVRELLTELYGKVGEIRHWGLIRYISGILRKKVEALDEACTDLLSHQKHLTVGLPPEPREKTISAPLPYEALTQLIDEASEGDMSISILTQEIMVYLAMYMRTQPGLFAEMFRLRIGLIIQVMATELAHSLRCSAEEATEGLMNLSPSAMKNLLHHILSGKEFGVERSVRPTDSNVSPAISIHEIGAVGATKTERTGIMQLKSEIKQVEFRRLSISAESQSNGGHPLGIDLMSPSFMSPGTSMTPSSGSFPSAYDQQSSKDSRQGQWQRRRRLDGALNRVPVGFYQKVWKVLQKCHGLSVEGFVLPSSTTREMTPGEIKFSVHVESVLNRVPQPEYRQLLVEAILVLTMLADIEIHSIGSIIAVEKIVHIANDLFLQEQKTLGADDTMLAKDPASGICTLLYDSAPSGRFGTMTYLSKAAATYVQEFLPHSICAMQ

SEQ ID NO: 33384 - protein, 1210 aa, Homo sapiens
  ENSP00000342469
MRSRSNSGVRLDGYARLVQQTILCHQNPVTGLLPASYDQKDAWVRDNVYSILAVWGLGLAYRKNADRDEDKAKAYELEQSVVKLMRGLLHCMIRQVDKVESFKYSQSTKDSLHAKYNTKTCATVVGDDQWGHLQLDATSVYLLFLAQMTASGLHIIHSLDEVNFIQNLVFYIEAAYKTADFGIWERGDKTNQGISELNASSVGMAKAALEALDELDLFGVKGGPQSVIHVLADEVQHCQSILNSLLPRASTSKEVDASLLSVVSFPAFAVEDSQLVELTKQEIITKLQGRYGCCRFLRDGYKTPKEDPNRLYYEPAELKLFENIECEWPLFWTYFILDGVFSGNAEQVQEYKEALEAVLIKGKNGVPLLPELYSVPPDRVDEEYQNPHTVDRVPMGKLPHMWGQSLYILGSLMAEGFLAPGEIDPLNRRFSTVPKPDVVVQVSILAETEEIKTILKDKGIYVETIAEVYPIRVQPARILSHIYSSLGCNNRMKLSGRPYRHMGVLGTSKLYDIRKTIFTFTPQFIDQQQFYLALDNKMIVEMLRTDLSYLCSRWRMTGQPTITFPISHSMLDEDGTSLNSSILAALRKMQDGYFGGARVQTGKLSEFLTTSCCTHLSFMDPGPEGKLYSEDYDDNYDYLESGNWMNDYDSTSHARCGDEVARYLDHLLAHTAPHPKLAPTSQKGGLDRFQAAVQTTCDLMSLVTKAKELHVQNVHMYLPTKLFQASRPSFNLLDSPHPRQENQVPSVRVEIHLPRDQSGEVDFKALVLQLKETSSLQEQADILYMLYTMKGPDWNTELYNERSATVRELLTELYGKVGEIRHWGLIRYISGILRKKVEALDEACTDLLSHQKHLTVGLPPEPREKTISAPLPYEALTQLIDEASEGDMSISILTQEIMVYLAMYMRTQPGLFAEMFRLRIGLIIQVMATELAHSLRCSAEEATEGLMNLSPSAMKNLLHHILSGKEFGVERSVRPTDSNVSPAISIHEIGAVGATKTERTGIMQLKSEIKQSPGTSMTPSSGSFPSAYDQQSSKDSRQGQWQRRRRLDGALNRVPVGFYQKVWKVLQKCHGLSVEGFVLPSSTTREMTPGEIKFSVHVESVLNRVPQPEYRQLLVEAILVLTMLADIEIHSIGSIIAVEKIVHIANDLFLQEQKTLGADDTMLAKDPASGICTLLYDSAPSGRFGTMTYLSKAAATYVQEFLPHSICAMQ

SEQ ID NO: 33385 - protein, 1151 aa, Homo sapiens
  ENSP00000441251
MRSRSNSGVRLDGYARLVQQTILCHQNPVTGLLPASYDQKDAWVRDNVYSILAVWGLGLAYRKNADRDEDKAKAYELEQSVVKLMRGLLHCMIRQVDKVESFKYSQSTKDSLHAKYNTKTCATVVGDDQWGHLQLDATSVYLLFLAQMTASGLHIIHSLDEVNFIQNLVFYIEAAYKTADFGIWERGDKTNQGISELNASSVGMAKAALEALDELDLFGVKGGPQSVIHVLADEVQHCQSILNSLLPRASTSKEVDASLLSVVSFPAFAVEDSQLVELTKQEIITKLQGRYGCCRFLRDGYKTPKEDPNRLYYEPAELKLFENIECEWPLFWTYFILDGVFSGNAEQVQEYKEALEAVLIKGKNGVPLLPELYSVPPDRVDEEYQNPHTVDRVPMGKLPHMWGQSLYILGSLMAEGFLAPGEIDPLNRRFSTVPKPDVVVQVSILAETEEIKTILKDKGIYVETIAEVYPIRVQPARILSHIYSSLGCNNRMKLSGRPYRHMGVLGTSKLYDIRKTIFTFTPQFIDQQQFYLALDNKMIVEMLRTDLSYLCSRWRMTGQPTITFPISHSMLDEDGTSLNSSILAALRKMQDGYFGGARVQTGKLSEFLTTSCCTHLSFMDPGPEGKLYSEDYDDNYDYLESGNWMNDYDSTSHDVHMYLPTKLFQASRPSFNLLDSPHPRQENQVPSVRVEIHLPRDQSGEVDFKALVLQLKETSSLQEQADILYMLYTMKGPDWNTELYNERSATVRELLTELYGKVGEIRHWGLIRYISGILRKKVEALDEACTDLLSHQKHLTVGLPPEPREKTISAPLPYEALTQLIDEASEGDMSISILTQEIMVYLAMYMRTQPGLFAEMFRLRIGLIIQVMATELAHSLRCSAEEATEGLMNLSPSAMKNLLHHILSGKEFGVERSVRPTDSNVSPAISIHEIGAVGATKTERTGIMQLKSEIKQSPGTSMTPSSGSFPSAYDQQSSKDSRQGQWQRRRRLDGALNRVPVGFYQKVWKVLQKCHGLSVEGFVLPSSTTREMTPGEIKFSVHVESVLNRVPQPEYRQLLVEAILVLTMLADIEIHSIGSIIAVEKIVHIANDLFLQEQKTLGADDTMLAKDPASGICTLLYDSAPSGRFGTMTYLSKAAATYVQEFLPHSICAMQ

SEQ ID NO: 33386 - protein, 1235 aa, Homo sapiens
  ENSP00000369274
MRSRSNSGVRLDGYARLVQQTILCYQNPVTGLLSASHEQKDAWVRDNIYSILAVWGLGMAYRKNADRDEDKAKAYELEQNVVKLMRGLLQCMMRQVAKVEKFKHTQSTKDSLHAKYNTATCGTVVGDDQWGHLQVDATSLFLLFLAQMTASGLRIIFTLDEVAFIQNLVFYIEAAYKVADYGMWERGDKTNQGIPELNASSVGMAKAALEAIDELDLFGAHGGRKSVIHVLPDEVEHCQSILFSMLPRASTSKEIDAGLLSIISFPAFAVEDVNLVNVTKNEIISKLQGRYGCCRFLRDGYKTPREDPNRLHYDPAELKLFENIECEWPVFWTYFIIDGVFSGDAVQVQEYREALEGILIRGKNGIRLVPELYAVPPNKVDEEYKNPHTVDRVPMGKVPHLWGQSLYILSSLLAEGFLAAGEIDPLNRRFSTSVKPDVVVQVTVLAENNHIKDLLRKHGVNVQSIADIHPIQVQPGRILSHIYAKLGRNKNMNLSGRPYRHIGVLGTSKLYVIRNQIFTFTPQFTDQHHFYLALDNEMIVEMLRIELAYLCTCWRMTGRPTLTFPISRTMLTNDGSDIHSAVLSTIRKLEDGYFGGARVKLGNLSEFLTTSFYTYLTFLDPDCDEKLFDNASEGTFSPDSDSDLVGYLEDTCNQESQDELDHYINHLLQSTSLRSYLPPLCKNTEDRHVFSAIHSTRDILSVMAKAKGLEVPFVPMTLPTKVLSAHRKSLNLVDSPQPLLEKVPESDFQWPRDDHGDVDCEKLVEQLKDCSNLQDQADILYILYVIKGPSWDTNLSGQHGVTVQNLLGELYGKAGLNQEWGLIRYISGLLRKKVEVLAEACTDLLSHQKQLTVGLPPEPREKIISAPLPPEELTKLIYEASGQDISIAVLTQEIVVYLAMYVRAQPSLFVEMLRLRIGLIIQVMATELARSLNCSGEEASESLMNLSPFDMKNLLHHILSGKEFGVERSVRPIHSSTSSPTISIHEVGHTGVTKTERSGINRLRSEMKQMTRRFSADEQFFSVGQAASSSAHSSKSARSSTPSSPTGTSSSDSGGHHIGWGERQGQWLRRRRLDGAINRVPVGFYQRVWKILQKCHGLSIDGYVLPSSTTREMTPHEIKFAVHVESVLNRVPQPEYRQLLVEAIMVLTLLSDTEMTSIGGIIHVDQIVQMASQLFLQDQVSIGAMDTLEKDQATGICHFFYDSAPSGAYGTMTYLTRAVASYLQELLPNSGCQMQ

SEQ ID NO: 33387 - protein, 387 aa, Homo sapiens
  ENSP00000297373
MTRDEALPDSHSAQDFYENYEPKEILGRGVSSVVRRCIHKPTSQEYAVKVIDVTGGGSFSPEEVRELREATLKEVDILRKVSGHPNIIQLKDTYETNTFFFLVFDLMKRGELFDYLTEKVTLSEKETRKIMRALLEVICTLHKLNIVHRDLKPENILLDDNMNIKLTDFGFSCQLEPGERLREVCGTPSYLAPEIIECSMNEDHPGYGKEVDMWSTGVIMYTLLAGSPPFWHRKQMLMLRMIMSGNYQFGSPEWDDYSDTVKDLVSRFLVVQPQNRYTAEEALAHPFFQQYLVEEVRHFSPRGKFKVIALTVLASVRIYYQYRRVKPVTREIVIRDPYALRPLRRLIDAYAFRIYGHWVKKGQQQNRAALFENTPKAVLLSLAEEDY

SEQ ID NO: 33388 - protein, 117 aa, Homo sapiens
  ENSP00000389721
MTRDEALPDSHSAQDFYENYEPKEILGRMKRGELFDYLTEKVTLSEKETRKIMRALLEVICTLHKLNIVHRDLKPENILLDDNMNIKLTDFGFSCQLEPGERLRGLPIPGGATPEPL

SEQ ID NO: 33389 - protein, 145 aa, Homo sapiens
  ENSP00000397193
MTRDEALPDSHSAQDFYENYEPKEILGRMKRGELFDYLTEKVTLSEKETRKIMRALLEVICTLHKLNIVHRDLKPENILLDDNMNIKLTDFGFSCQLEPGERLREVCGTPSYLAPEIIECSMNEDHPGYGKEVDMWSTGVIMYTL

SEQ ID NO: 33390 - protein, 88 aa, Homo sapiens
  ENSP00000378817
MTRDEALPDSHSAQDFYENYEPKEILGRGVSSVVRRCIHKPTSQEYAVKVIDVTGGGSFSPEEVRELREATLKEVDILRKVSGHPNIR

SEQ ID NO: 33391 - protein, 419 aa, Homo sapiens
  ENSP00000445440
MTRDEALPDSHSAQDFYENYEPKEILGRGVSSVVRRCIHKPTSQEYAVKVIDVTGGGSFSPEEVRELREATLKEVDILRKVSGHPNIIQLKDTYETNTFFFLVFDLWEDTDTMEMEQKWCLGWDSPKSTNFRAQGRARMKRGELFDYLTEKVTLSEKETRKIMRALLEVICTLHKLNIVHRDLKPENILLDDNMNIKLTDFGFSCQLEPGERLREVCGTPSYLAPEIIECSMNEDHPGYGKEVDMWSTGVIMYTLLAGSPPFWHRKQMLMLRMIMSGNYQFGSPEWDDYSDTVKDLVSRFLVVQPQNRYTAEEALAHPFFQQYLVEEVRHFSPRGKFKVIALTVLASVRIYYQYRRVKPVTREIVIRDPYALRPLRRLIDAYAFRIYGHWVKKGQQQNRAALFENTPKAVLLSLAEEDY

SEQ ID NO: 33392 - protein, 390 aa, Homo sapiens [sequence omitted]

SEQ ID NO: 33393 - protein, 85 aa, Homo sapiens
  ENSP00000444845
  MOD_RES (1)..(1): Any amino acid
XERVFAETHYPDIYTREELALKIDLTEARGALWAGVAGGGGGGPGAGAAELLKAWQPAESGPGPFSGVLSSFHRKPGPALKTNLF

SEQ ID NO: 33394 - protein, 284 aa, Homo sapiens
  ENSP00000298231
MDYSYLNSYDSCVAAMEASAYGDFGACSQPGGFQYSPLRPAFPAAGPPCPALGSSNCALGALRDHQPAPYSAVPYKFFPEPSGLHEKRKQRRIRTTFTSAQLKELERVFAETHYPDIYTREELALKIDLTEARVQVWFQNRRAKFRKQERAASAKGAAGAAGAKKGEARCSSEDDDSKESTCSPTPDSTASLPPPPAPGLASPRLSPSPLPVALGSGPGPGPGPQPLKGALWAGVAGGGGGGPGAGAAELLKAWQPAESGPGPFSGVLSSFHRKPGPALKTNLF

SEQ ID NO: 33395 - protein, 330 aa, Homo sapiens
  ENSP00000320017
MELLSTPHSIEINNITCDSFRISWAMEDSDLERVTHYFIDLNKKENKNSNKFKHRDVPTKLVAKAVPLPMTVRGHWFLSPRTEYSVAVQTAVKQSDGEYLVSGWSETVEFCTGDYAKEHLAQLQEKAEQIAGRMLRFSVFYRNHHKEYFQHARTHCGNMLQPYLKDNSGSHGSPTSGMLHGVFFSCNTEFNTGQPPQDSPYGRWRFQIPAQRLFNPSTNLYFADFYCMYTAYHYAILVLAPKGSLGDRFCRDRLPLLDIACNKFLTCSVEDGELVFRHAQDLILEIIYTEPVDLSLGTLGEISGHQLMSLSTADAKKDPSCKTCNISVGR

SEQ ID NO: 33396 - protein, 330 aa, Homo sapiens; identical to SEQ ID NO: 33395
  ENSP00000415491

SEQ ID NO: 33397 - protein, 248 aa, Homo sapiens
  ENSP00000430870
MGESPPWDVPTKLVAKAVPLPMTVRGHWFLSPRTEYSVAVQTAVKQSDGEYLVSGWSETVEFCTGDYAKEHLAQLQEKAEQIAGRMLRFSVFYRNHHKEYFQHARTHCGNMLQPYLKDNSGSHGSPTSGMLHGVFFSCNTEFNTGQPPQDSPYGRWRFQIPAQRLFNPSTNLYFADFYCMYTAYHYAILVLAPKGSLGDRFCRDRLPLLDIACNKFLTCSVEDGELVFRHAQDLILEIIYTEPVDLSL

SEQ ID NO: 33398 - protein, 463 aa, Homo sapiens
  ENSP00000362778
MHGSCSFLMLLLPLLLLLVATTGPVGALTDEEKRLMVELHNLYRAQVSPTASDMLHMRWDEELAAFAKAYARQCVWGHNKERGRRGENLFAITDEGMDVPLAMEEWHHEREHYNLSAATCSPGQMCGHYTQVVWAKTERIGCGSHFCEKLQGVEETNIELLVCNYEPPGNVKGKRPYQEGTPCSQCPSGYHCKNSLCEPIGSPEDAQDLPYLVTEAPSFRATEASDSRKMGTPSSLATGIPAFLVTEVSGSLATKALPAVETQAPTSLATKDPPSMATEAPPCVTTEVPSILAAHSLPSLDEEPVTFPKSTHVPIPKSADKVTDKTKVPSRSPENSLDPKMSLTGARELLPHAQEEAEAEAELPPSSEVLASVFPAQDKPGELQATLDHTGHTSSKSLPNFPNTSATANATGGRALALQSSLPGAEGPDKPSVVSGLNSGPGHVWGPLLGLLLLPPLVLAGIF

SEQ ID NO: 33399 - protein, 463 aa, Homo sapiens; identical to SEQ ID NO: 33398
  ENSP00000478888

SEQ ID NO: 33400 - protein, 248 aa, Homo sapiens
  ENSP00000375907
MPRIAGNHLMLEESRTCSSPELLDGVWPCQPLHFGLPASEMHFQTMLKSKLNVLTLKKEPLPAVIFHEPEAIELCTTTPLMKTRTHSGCKVTYLGKVSTTGMQFLSGCTEKPVIELWKKHTLAREDVFPANALLEIRPFQVWLHHLDHKGEATVHMDTFQVARIAYCTADHNVSPNIFAWVYREINDDLSYQMDCHAVECESKLEAKKLAHAMMEAFRKTFHSMKSDGRIHSNSSSEEVSQELESDDG

SEQ ID NO: 33401 - protein, 168 aa, Homo sapiens
  ENSP00000386826
MWQPATERLQVTYLGKVSTTGMQFLSGCTEKPVIELWKKHTLAREDVFPANALLEIRPFQVWLHHLDHKGEATVHMDTFQVARIAYCTADHNVSPNIFAWVYREINDDLSYQMDCHAVECESKLEAKKLAHAMMEAFRKTFHSMKSDGRIHSNSSSEEVSQELESDDG

SEQ ID NO: 33402 - protein, 217 aa, Homo sapiens
  ENSP00000375908
MWQPATERLQHFQTMLKSKLNVLTLKKEPLPAVIFHEPEAIELCTTTPLMKTRTHSGCKVTYLGKVSTTGMQFLSGCTEKPVIELWKKHTLAREDVFPANALLEIRPFQVWLHHLDHKGEATVHMDTFQVARIAYCTADHNVSPNIFAWVYREINDDLSYQMDCHAVECESKLEAKKLAHAMMEAFRKTFHSMKSDGRIHSNSSSEEVSQELESDDG

SEQ ID NO: 33403 - protein, 250 aa, Homo sapiens
  ENSP00000283937
MFSLPLSLPLCEDTAFLPSKCCSSHKTIKQARTLIMIFLASGTHFQTMLKSKLNVLTLKKEPLPAVIFHEPEAIELCTTTPLMKTRTHSGCKVTYLGKVSTTGMQFLSGCTEKPVIELWKKHTLAREDVFPANALLEIRPFQVWLHHLDHKGEATVHMDTFQVARIAYCTADHNVSPNIFAWVYREINDDLSYQMDCHAVECESKLEAKKLAHAMMEAFRKTFHSMKSDGRIHSNSSSEEVSQELESDDG

SEQ ID NO: 33404 - protein, 41 aa, Homo sapiens
  ENSP00000438228
MWQPATERLQDGCCNSSHNTLVPQYPWGIDSGPLVNTKIYR

SEQ ID NO: 33405 - protein, 92 aa, Homo sapiens
  ENSP00000462187
WWSSMTKSVPQVWGSWLAMAFRLHVRPCPDVHPDPQHGRGLVVHWQSPSDLPSQDVLWRIFKGNLPVAASPCLQFENGLEPLAQDSGYLACP

SEQ ID NO: 33406 - protein, 2689 aa, Homo sapiens
  ENSP00000303316
MASEVVCGLIFRLLLPICLAVACAFRYNGLSFVYLIYLLLIPLFSEPTKTTMQGHTGRLLKSLCFISLSFLLLHIIFHITLVSLEAQHRIAPGYNCSTWEKTFRQIGFESLKGADAGNGIRVFVPDIGMFIASLTIWLLCRNIVQKPVTDEAAQSNPEFENEELAEGEKIDSEEALIYEEDFNGGDGVEGELEESTKLKMFRRLASVASKLKEFIGNMITTAGKVVVTILLGSSGMMLPSLTSSVYFFVFLGLCTWWSWCRTFDPLLFSCLCVLLAIFTAGHLIGLYLYQFQFFQEAVPPNDYYARLFGIKSVIQTDCSSTWKIIVNPDLSWYHHANPILLLVMYYTLATLIRIWLQEPLVQDEGTKEEDKALACSPIQITAGRRRSLWYATHYPTDERKLLSMTQDDYKPSDGLLVTVNGNPVDYHTIHPSLPMENGPGKADLYSTPQYRWEPSDESSEKREEEEEEKEEFEEERSREEKRSIKVHAMVSVFQFIMKQSYICALIAMMAWSITYHSWLTFVLLIWSCTLWMIRNRRKYAMISSPFMVVYGNLLLILQYIWSFELPEIKKVPGFLEKKEPGELASKILFTITFWLLLRQHLTEQKALQEKEALLSEVKIGSQENEEKDEELQDIQVEGEPKEEEEEEAKEEKQERKKVEQEEAEEEDEQDIMKVLGNLVVAMFIKYWIYVCGGMFFFVSFEGKIVMYKIIYMVLFLFCVALYQVHYEWWRKILKYFWMSVVIYTMLVLIFIYTYQFENFPGLWQNMTGLKKEKLEDLGLKQFTVAELFTRIFIPTSFLLVCILHLHYFHDRFLELTDLKSIPSKEDNTIYRLAHPEGSLPDLTMMHLTASLEKPEVRKLAEPGEEKLEGYSEKAQKGDLGKDSEESEEDGEEEEESEEEEETSDLRNKWHLVIDRLTVLFLKFLEYFHKLQVFMWWILELHIIKIVSSYIIWVSVKEVSLFNYVFLISWAFALPYAKLRRLASSVCTVWTCVIIVCKMLYQLQTIKPENFSVNCSLPNENQTNIPFNELNKSLLYSAPIDPTEWVGLRKSSPLLVYLRNNLLMLAILAFEVTIYRHQEYYRGRNNLTAPVSRTIFHDITRLHLDDGLINCAKYFINYFFYKFGLETCFLMSVNVIGQRMDFYAMIHACWLIAVLYRRRRKAIAEIWPKYCCFLACIITFQYFICIGIPPAPCRDYPWRFKGASFNDNIIKWLYFPDFIVRPNPVFLVYDFMLLLCASLQRQIFEDENKAAVRIMAGDNVEICMNLDAASFSQHNPVPDFIHCRSYLDMSKVIIFSYLFWFVLTIIFITGTTRISIFCMGYLVACFYFLLFGGDLLLKPIKSILRYWDWLIAYNVFVITMKNILSIGACGYIGTLVHNSCWLIQAFSLACTVKGYQMPAANSPCTLPSGEAGIIWDSICFAFLLLQRRVFMSYYFLHVVADIKASQILASRGAELFQATIVKAVKARIEEEKKSMDQLKRQMDRIKARQQKYKKGKERMLSLTQEPGEGQDMQKLSEEDDEREADKQKAKGKKKQWWRPWVDHASMVRSGDYYLFETDSEEEEEEELKKEDEEPPRRSAFQFVYQAWITDPKTALRQRHKEKKRSAREERKRRRKGSKEGPVEWEDREDEPIKKKSDGPDNIIKRIFNILKFTWVLFLATVDSFTTWLNSISREHIDISTVLRIERCMLTREIKKGNVPTRESIHMYYQNHIMNLSRESGLDTIDEHPGAASGAQTAHRMDSLDSHDSISSEPTQCTMLYSRQGTTETIEEVEAEQEEEAGSTAPEPREAKEYEATGYDVGAMGAEEASLTPEEELTQFSTLDGDVEAPPSYSKAVSFEHLSFGSQDDSAGKNRMAVSPDDSRTDKLGSSILPPLTHELTASELLLKKMFHDDELEESEKFYVGQPRFLLLFYAMYNTLVARSEMVCYFVIILNHMVSASMITLLLPILIFLWAMLSVPRPSRRFWMMAIVYTEVAIVVKYFFQFGFFPWNKNVEVNKDKPYHPPNIIGVEKKEGYVLYDLIQLLALFFHRSILKCHGLWDEDDMTESGMAREESDDELSLGHGRRDSSDSLKSINLAASVESVHVTFPEQQTAVRRKRSGSSSEPSQRSSFSSNRSQRGSTSTRNSSQKGSSVLSIKQKGKRELYMEKLQEHLIKAKAFTIKKTLEIYVPIKQFFYNLIHPEYSAVTDVYVLMFLADTVDFIIIVFGFWAFGKHSAAADITSSLSEDQVPGPFLVMVLIQFGTMVVDRALYLRKTVLGKVIFQVILVFGIHFWMFFILPGVTERKFSQNLVAQLWYFVKCVYFGLSAYQIRCGYPTRVLGNFLTKSYNYVNLFLFQGFRLVPFLTELRAVMDWVWTDTTLSLSSWICVEDIYAHIFILKCWRESEKPIFTMSAQQSQLKVMDQQSFNKFIQAFSRDTGAMQFLENYEKEDITVAELEGNSNSLWTISPPSKQKMIHELLDPNSSFSVVFSWSIQRNLSLGAKSEIATDKLSFPLKNITRKNIAKMIAGNSTESSKTPVTIEKIYPYYVKAPSDSNSKPIKQLLSENNFMDITIILSRDNTTKYNSEWWVLNLTGNRIYNPNSQALELVVFNDKVSPPSLGFLAGYGIMGLYASVVLVIGKFVREFFSGISHSIMFEELPNVDRILKLCTDIFLVRETGELELEEDLYAKLIFLYRSPETMIKWTREKTN

SEQ ID NO: 33407 - protein, 709 aa, Homo sapiens
  ENSP00000443129
MTESGMAREESDDELSLGHGRRDSSDSLKSINLAASVESVHVTFPEQQTAVRRKRSGSSSEPSQRSSFSSNRSQRGSTSTRNSSQKGSSVLSIKQKGKRELYMEKLQEHLIKAKAFTIKKTLEIYVPIKQFFYNLIHPEYSAVTDVYVLMFLADTVDFIIIVFGFWAFGKHSAAADITSSLSEDQVPGPFLVMVLIQFGTMVVDRALYLRKTVLGKVIFQVILVFGIHFWMFFILPGVTERKFSQNLVAQLWYFVKCVYFGLSAYQIRCGYPTRVLGNFLTKSYNYVNLFLFQGFRLVPFLTELRAVMDWVWTDTTLSLSSWICVEDIYAHIFILKCWRESEKRYPQPRGQKKKKVVKYGMGGMIIVLLICIVWFPLLFMSLIKSVAGVINQPLDVSVTITLGGYQPIFTMSAQQSQLKVMDQQSFNKFIQAFSRDTGAMQFLENYEKEDITVAELEGNSNSLWTISPPSKQKMIHELLDPNSSFSVVFSWSIQRNLSLGAKSEIATDKLSFPLKNITRKNIAKMIAGNSTESSKTPVTIEKIYPYYVKAPSDSNSKPIKQLLSENNFMDITIILSRDNTTKYNSEWWVLNLTGNRIYNPNSQALELVVFNDKVSPPSLGFLAGYGIMGLYASVVLVIGKFVREFFSGISHSIMFEELPNVDRILKLCTDIFLVRETGELELEEDLYAKLIFLYRSPETMIKWTREKTN

SEQ ID NO: 33408 - protein, 2777 aa, Homo sapiens
  ENSP00000463094
MASEVVCGLIFRLLLPICLAVACAFRYNGLSFVYLIYLLLIPLFSEPTKTTMQGHTGRLLKSLCFISLSFLLLHIIFHITLVSLEAQHRIAPGYNCSTWEKTFRQIGFESLKGADAGNGIRVFVPDIGMFIASLTIWLLCRNIVQKPVTDEAAQSNPEFENEELAEGEKIDSEEALIYEEDFNGGDGVEGELEESTKLKMFRRLASVASKLKEFIGNMITTAGKVVVTILLGSSGMMLPSLTSSVYFFVFLGLCTWWSWCRTFDPLLFSCLCVLLAIFTAGHLIGLYLYQFQFFQEAVPPNDYYARLFGIKSVIQTDCSSTWKIIVNPDLSWYHHANPILLLVMYYTLATLIRIWLQEPLVQDEGTKEEDKALACSPIQITAGRRRSLWYATHYPTDERKLLSMTQDDYKPSDGLLVTVNGNPVDYHTIHPSLPMENGPGKADLYSTPQYRWEPSDESSEKREEEEEEKEEFEEERSREEKRSIKVHAMVSVFQFIMKQSYICALIAMMAWSITYHSWLTFVLLIWSCTLWMIRNRRKYAMISSPFMVVYGNLLLILQYIWSFELPEIKKVPGFLEKKEPGELASKILFTITFWLLLRQHLTEQKALQEKEALLSEVKIGSQENEEKDEELQDIQVEGEPKEEEEEEAKEEKQERKKVEQEEAEEEDEQDIMKVLGNLVVAMFIKYWIYVCGGMFFFVSFEGKIVMYKIIYMVLFLFCVALYQVHYEWWRKILKYFWMSVVIYTMLVLIFIYTYQFENFPGLWQNMTGLKKEKLEDLGLKQFTVAELFTRIFIPTSFLLVCILHLHYFHDRFLELTDLKSIPSKEDNTIYSHAKVNGRVYLIINSIKKKLPIHQNELAHPEGSLPDLTMMHLTASLEKPEVRKLAEPGEEKLEGYSEKAQKGDLGKDSEESEEDGEEEEESEEEEETSDLRNKWHLVIDRLTVLFLKFLEYFHKLQVFMWWILELHIIKIVSSYIIWVSVKEVSLFNYVFLISWAFALPYAKLRRLASSVCTVWTCVIIVCKMLYQLQTIKPENFSVNCSLPNENQTNIPFNELNKSLLYSAPIDPTEWVGLRKSSPLLVYLRNNLLMLAILAFEVTIYRHQEYYRGRNNLTAPVSRTIFHDITRLHLDDGLINCAKYFINYFFYKFGLETCFLMSVNVIGQRMDFYAMIHACWLIAVLYRRRRKAIAEIWPKYCCFLACIITFQYFICIGIPPAPCRDYPWRFKGASFNDNIIKWLYFPDFIVRPNPVFLVYDFMLLLCASLQRQIFEDENKAAVRIMAGDNVEICMNLDAASFSQHNPVPDFIHCRSYLDMSKVIIFSYLFWFVLTIIFITGTTRISIFCMGYLVACFYFLLFGGDLLLKPIKSILRYWDWLIAYNVFVITMKNILSIGACGYIGTLVHNSCWLIQAFSLACTVKGYQMPAANSPCTLPSGEAGIIWDSICFAFLLLQRRVFMSYYFLHVVADIKASQILASRGAELFQATIVKAVKARIEEEKKSMDQLKRQMDRIKARQQKYKKGKERMLSLTQEPGEGQDMQKLSEEDDEREADKQKAKGKKKQWWRPWVDHASMVRSGDYYLFETDSEEEEEEELKKEDEEPPRRSAFQFVYQAWITDPKTALRQRHKEKKRSAREERKRRRKGSKEGPVEWEDREDEPIKKKSDGPDNIIKRIFNILKFTWVLFLATVDSFTTWLNSISREHIDISTVLRIERCMLTREIKKGNVPTRESIHMYYQNHIMNLSRESGLDTIDEHPGAASGAQTAHRMDSLDSHDSISSEPTQCTMLYSRQGTTETIEEVEAEQEEEAGSTAPEPREAKEYEATGYDVGAMGAEEASLTPEEELTQFSTLDGDVEAPPSYSKAVSFEHLSFGSQDDSAGKNRMAVSPDDSRTDKLGSSILPPLTHELTASELLLKKMFHDDELEESEKFYVGQPRFLLLFYAMYNTLVARSEMVCYFVIILNHMVSASMITLLLPILIFLWAMLSVPRPSRRFWMMAIVYTEVAIVVKYFFQFGFFPWNKNVEVNKDKPYHPPNIIGVEKKEGYVLYDLIQLLALFFHRSILKCHGLWDEDDMTESGMAREESDDELSLGHGRRDSSDSLKSINLAASVESVHVTFPEQQTAVRRKRSGSSSEPSQRSSFSSNRSQRGSTSTRNSSQKGSSVLSIKQKGKRELYMEKLQEHLIKAKAFTIKKTLEIYVPIKQFFYNLIHPEYSAVTDVYVLMFLADTVDFIIIVFGFWAFGKHSAAADITSSLSEDQVPGPFLVMVLIQFGTMVVDRALYLRKTVLGKVIFQVILVFGIHFWMFFILPGVTERKFSQNLVAQLWYFVKCVYFGLSAYQIRCGYPTRVLGNFLTKSYNYVNLFLFQGFRLVPFLTELRAVMDWVWTDTTLSLSSWICVEDIYAHIFILKCWRESEKRYPQPRGQKKKKVVKYGMGGMIIVLLICIVWFPLLFMSLIKSVAGVINQPLDVSVTITLGGYQPIFTMSAQQSQLKVMDQQSFNKFIQAFSRDTGAMQFLENYEKEDITVAELEGNSNSLWTISPPSKQKMIHELLDPNSSFSVVFSWSIQRNLSLGAKSEIATDKLSFPLKNITRKNIAKMIAGNSTESSKTPVTIEKIYPYYVKAPSDSNSKPIKQLLSENNFMDITIILSRDNTTKYNSEWWVLNLTGNRIYNPNSQALELVVFNDKVSPPSLGFLAGYGIMGLYASVVLVIGKFVREFFSGISHSIMFEELPNVDRILKLCTDIFLVRETGELELEEDLYAKLIFLYRSPETMIKWTREKTN

SEQ ID NO: 33409 - protein, 2752 aa, Homo sapiens
  ENSP00000421377
MASEVVCGLIFRLLLPICLAVACAFRYNGLSFVYLIYLLLIPLFSEPTKTTMQGHTGRLLKSLCFISLSFLLLHIIFHITLVSLEAQHRIAPGYNCSTWEKTFRQIGFESLKGADAGNGIRVFVPDIGMFIASLTIWLLCRNIVQKPVTDEAAQSNPEFENEELAEGEKIDSEEALIYEEDFNGGDGVEGELEESTKLKMFRRLASVASKLKEFIGNMITTAGKVVVTILLGSSGMMLPSLTSSVYFFVFLGLCTWWSWCRTFDPLLFSCLCVLLAIFTAGHLIGLYLYQFQFFQEAVPPNDYYARLFGIKSVIQTDCSSTWKIIVNPDLSWYHHANPILLLVMYYTLATLIRIWLQEPLVQDEGTKEEDKALACSPIQITAGRRRSLWYATHYPTDERKLLSMTQDDYKPSDGLLVTVNGNPVDYHTIHPSLPMENGPGKADLYSTPQYRWEPSDESSEKREEEEEEKEEFEEERSREEKRSIKVHAMVSVFQFIMKQSYICALIAMMAWSITYHSWLTFVLLIWSCTLWMIRNRRKYAMISSPFMVVYGNLLLILQYIWSFELPEIKKVPGFLEKKEPGELASKILFTITFWLLLRQHLTEQKALQEKEALLSEVKIGSQENEEKDEELQDIQVEGEPKEEEEEEAKEEKQERKKVEQEEAEEEDEQDIMKVLGNLVVAMFIKYWIYVCGGMFFFVSFEGKIVMYKIIYMVLFLFCVALYQVHYEWWRKILKYFWMSVVIYTMLVLIFIYTYQFENFPGLWQNMTGLKKEKLEDLGLKQFTVAELFTRIFIPTSFLLVCILHLHYFHDRFLELTDLKSIPSKEDNTIYRLAHPEGSLPDLTMMHLTASLEKPEVRKLAEPGEEKLEGYSEKAQKGDLGKDSEESEEDGEEEEESEEEEETSDLRNKWHLVIDRLTVLFLKFLEYFHKLQVFMWWILELHIIKIVSSYIIWVSVKEVSLFNYVFLISWAFALPYAKLRRLASSVCTVWTCVIIVCKMLYQLQTIKPENFSVNCSLPNENQTNIPFNELNKSLLYSAPIDPTEWVGLRKSSPLLVYLRNNLLMLAILAFEVTIYRHQEYYRGRNNLTAPVSRTIFHDITRLHLDDGLINCAKYFINYFFYKFGLETCFLMSVNVIGQRMDFYAMIHACWLIAVLYRRRRKAIAEIWPKYCCFLACIITFQYFICIGIPPAPCRDYPWRFKGASFNDNIIKWLYFPDFIVRPNPVFLVYDFMLLLCASLQRQIFEDENKAAVRIMAGDNVEICMNLDAASFSQHNPVPDFIHCRSYLDMSKVIIFSYLFWFVLTIIFITGTTRISIFCMGYLVACFYFLLFGGDLLLKPIKSILRYWDWLIAYNVFVITMKNILSIGACGYIGTLVHNSCWLIQAFSLACTVKGYQMPAANSPCTLPSGEAGIIWDSICFAFLLLQRRVFMSYYFLHVVADIKASQILASRGAELFQATIVKAVKARIEEEKKSMDQLKRQMDRIKARQQKYKKGKERMLSLTQEPGEGQDMQKLSEEDDEREADKQKAKGKKKQWWRPWVDHASMVRSGDYYLFETDSEEEEEEELKKEDEEPPRRSAFQFVYQAWITDPKTALRQRHKEKKRSAREERKRRRKGSKEGPVEWEDREDEPIKKKSDGPDNIIKRIFNILKFTWVLFLATVDSFTTWLNSISREHIDISTVLRIERCMLTREIKKGNVPTRESIHMYYQNHIMNLSRESGLDTIDEHPGAASGAQTAHRMDSLDSHDSISSEPTQCTMLYSRQGTTETIEEVEAEQEEEAGSTAPEPREAKEYEATGYDVGAMGAEEASLTPEEELTQFSTLDGDVEAPPSYSKAVSFEHLSFGSQDDSAGKNRMAVSPDDSRTDKLGSSILPPLTHELTASELLLKKMFHDDELEESEKFYVGQPRFLLLFYAMYNTLVARSEMVCYFVIILNHMVSASMITLLLPILIFLWAMLSVPRPSRRFWMMAIVYTEVAIVVKYFFQFGFFPWNKNVEVNKDKPYHPPNIIGVEKKEGYVLYDLIQLLALFFHRSILKCHGLWDEDDMTESGMAREESDDELSLGHGRRDSSDSLKSINLAASVESVHVTFPEQQTAVRRKRSGSSSEPSQRSSFSSNRSQRGSTSTRNSSQKGSSVLSIKQKGKRELYMEKLQEHLIKAKAFTIKKTLEIYVPIKQFFYNLIHPEYSAVTDVYVLMFLADTVDFIIIVFGFWAFGKHSAAADITSSLSEDQVPGPFLVMVLIQFGTMVVDRALYLRKTVLGKVIFQVILVFGIHFWMFFILPGVTERKFSQNLVAQLWYFVKCVYFGLSAYQIRCGYPTRVLGNFLTKSYNYVNLFLFQGFRLVPFLTELRAVMDWVWTDTTLSLSSWICVEDIYAHIFILKCWRESEKRYPQPRGQKKKKVVKYGMGGMIIVLLICIVWFPLLFMSLIKSVAGVINQPLDVSVTITLGGYQPIFTMSAQQSQLKVMDQQSFNKFIQAFSRDTGAMQFLENYEKEDITVAELEGNSNSLWTISPPSKQKMIHELLDPNSSFSVVFSWSIQRNLSLGAKSEIATDKLSFPLKNITRKNIAKMIAGNSTESSKTPVTIEKIYPYYVKAPSDSNSKPIKQLLSENNFMDITIILSRDNTTKYNSEWWVLNLTGNRIYNPNSQALELVVFNDKVSPPSLGFLAGYGIMGLYASVVLVIGKFVREFFSGISHSIMFEELPNVDRILKLCTDIFLVRETGELELEEDLYAKLIFLYRSPETMIKWTREKTN

SEQ ID NO: 33410 - protein, 1473 aa, Homo sapiens
  ENSP00000462115
MASEVVCGLIFRLLLPICLAVACAFRYNGLSFVYLIYLLLIPLFSEPTKTTMQGHTGRLLKSLCFISLSFLLLHIIFHITLVSLEAQHRIAPGYNCSTWEKTFRQIGFESLKGADAGNGIRVFVPDIGMFIASLTIWLLCRNIVQKPVTDEAAQSNPEFENEELAEGEKIDSEEALIYEEDFNGGDGVEGELEESTKLKMFRRLASVASKLKEFIGNMITTAGKVVVTILLGSSGMMLPSLTSSVYFFVFLGLCTWWSWCRTFDPLLFSCLCVLLAIFTAGHLIGLYLYQFQFFQEAVPPNDYYARLFGIKSVIQTDCSSTWKIIVNPDLSWYHHANPILLLVMYYTLATLIRIWLQEPLVQDEGTKEEDKALACSPIQITAGRRRSLWYATHYPTDERKLLSMTQDDYKPSDGLLVTVNGNPVDYHTIHPSLPMENGPGKADLYSTPQYRWEPSDESSEKREEEEEEKEEFEEERSREEKRSIKVHAMVSVFQFIMKQSYICALIAMMAWSITYHSWLTFVLLIWSCTLWMIRNRRKYAMISSPFMVVYGNLLLILQYIWSFELPEIKKVPGFLEKKEPGELASKILFTITFWLLLRQHLTEQKALQEKEALLSEVKIGSQENEEKDEELQDIQVEGEPKEEEEEEAKEEKQERKKVEQEEAEEEDEQDIMKVLGNLVVAMFIKYWIYVCGGMFFFVSFEGKIVMYKIIYMVLFLFCVALYQVHYEWWRKILKYFWMSVVIYTMLVLIFIYTYQFENFPGLWQNMTGLKKEKLEDLGLKQFTVAELFTRIFIPTSFLLVCILHLHYFHDRFLELTDLKSIPSKEDNTIYSHAKVNGRVYLIINRLAHPEGSLPDLTMMHLTASLEKPEVRKLAEPGEEKLEGYSEKAQKGDLGKDSEESEEDGEEEEESEEEEETSDLRNKWHLVIDRLTVLFLKFLEYFHKLQVFMWWILELHIIKIVSSYIIWVSVKEVSLFNYVFLISWAFALPYAKLRRLASSVCTVWTCVIIVCKMLYQLQTIKPENFSVNCSLPNENQTNIPFNELNKSLLYSAPIDPTEWVGLRKSSPLLVYLRNNLLMLAILAFEVTIYRHQEYYRGRNNLTAPVSRTIFHDITRLHLDDGLINCAKYFINYFFYKFGLETCFLMSVNVIGQRMDFYAMIHACWLIAVLYRRRRKAIAEIWPKYCCFLACIITFQYFICIGIPPAPCRDYPWRFKGASFNDNIIKWLYFPDFIVRPNPVFLVYDFMLLLCASLQRQIFEDENKAAVRIMAGDNVEICMNLDAASFSQHNPVPDFIHCRSYLDMSKVIIFSYLFWFVLTIIFITGTTRISIFCMGYLVACFYFLLFGGDLLLKPIKSILRYWDWLIAYNVFVITMKNILSIGACGYIGTLVHNSCWLIQAFSLACTVKGYQMPAANSPCTLPSGEAGIIWDSICFAFLLLQRRVFMSYYFLHVVADIKASQILASRWLNFSRPQL

SEQ ID NO: 33411 - protein, 153 aa, Homo sapiens
  ENSP00000477311
  MOD_RES (1)..(1): Any amino acid
XIKASQILASRGAELFQATIVKAVKARIEEEKKSMDQLKRQMDRIKARQQKYKKGKERMLSLTQEPGEGQDMQKLSEEDDEREADKQKAKGKKKQWWRPWVDHASSRFSRSPYNLIDSNPYILDQNSGVPVTHVFHAWFDPCDLIGGRSVGKF

SEQ ID NO: 33412 - protein, 192 aa, Homo sapiens
  ENSP00000462560
MKVLGNLVVAMFIKYWIYVCGGMFFFVSFEGKIVMYKIIYMVLFLFCVALYQVHYEWWRKILKYFWMSVVIYTMLVLIFIYTYQFENFPGLWQNMTGLKKEKLEDLGLKQFTVAELFTRIFIPTSFLLVCILHLHYFHDRFLELTDLKSIPSKEDNTIYRLAHPEGSLPDLTMMHLTASLEKPEVRKLAEPG

SEQ ID NO: 33413 - protein, 178 aa, Homo sapiens
  ENSP00000463589
  MOD_RES (1)..(1): Any amino acid
XTAGHLIGLYLYQFQFFQEAVPPNDYYARLFGIKSVIQTDCSSTWKIIVNPDLSWYHHANPILLLVMYYTLATLIRIWLQEPLVQDEGTKEEDKALACSPIQITAGRRRSLWYATHYPTDERKGLLVTVNGNPVDYHTIHPSLPMENGPGKADLYSTPQYRWEPSDESSEKREEEEEE

SEQ ID NO: 33414 - protein, 2703 aa, Homo sapiens
  ENSP00000372900
MQGHTGRLLKSLCFISLSFLLLHIIFHITLVSLEAQHRIAPGYNCSTWEKTFRQIGFESLKGADAGNGIRVFVPDIGMFIASLTIWLLCRNIVQKPVTDEAAQSNPEFENEELAEGEKIDSEEALIYEEDFNGGDGVEGELEESTKLKMFRRLASVASKLKEFIGNMITTAGKVVVTILLGSSGMMLPSLTSSVYFFVFLGLCTWWSWCRTFDPLLFSCLCVLLAIFTAGHLIGLYLYQFQFFQEAVPPNDYYARLFGIKSVIQTDCSSTWKIIVNPDLSWYHHANPILLLVMYYTLATLIRIWLQEPLVQDEGTKEEDKALACSPIQITAGRRRSLWYATHYPTDERKLLSMTQDDYKPSDGLLVTVNGNPVDYHTIHPSLPMENGPGKADLYSTPQYRWEPSDESSEKREEEEEEKEEFEEERSREEKRSIKVHAMVSVFQFIMKQSYICALIAMMAWSITYHSWLTFVLLIWSCTLWMIRNRRKYAMISSPFMVVYGNLLLILQYIWSFELPEIKKVPGFLEKKEPGELASKILFTITFWLLLRQHLTEQKALQEKEALLSEVKIGSQENEEKDEELQDIQVEGEPKEEEEEEAKEEKQERKKVEQEEAEEEDEQDIMKVLGNLVVAMFIKYWIYVCGGMFFFVSFEGKIVMYKIIYMVLFLFCVALYQVHYEWWRKILKYFWMSVVIYTMLVLIFIYTYQFENFPGLWQNMTGLKKEKLEDLGLKQFTVAELFTRIFIPTSFLLVCILHLHYFHDRFLELTDLKSIPSKEDNTIYRLAHPEGSLPDLTMMHLTASLEKPEVRKLAEPGEEKLEGYSEKAQKGDLGKDSEESEEDGEEEEESEEEEETSDLRNKWHLVIDRLTVLFLKFLEYFHKLQVFMWWILELHIIKIVSSYIIWVSVKEARVSLFNYVFLISWAFALPYAKLRRLASSVCTVWTCVIIVCKMLYQLQTIKPENFSVNCSLPNENQTNIPFNELNKSLLYSAPIDPTEWVGLRKSSPLLVYLRNNLLMLAILAFEVTIYRHQEYYRGRNNLTAPVSRTIFHDITRLHLDDGLINCAKYFINYFFYKFGLETCFLMSVNVIGQRMDFYAMIHACWLIAVLYRRRRKAIAEIWPKYCCFLACIITFQYFICIGIPPAPCRDYPWRFKGASFNDNIIKWLYFPDFIVRPNPVFLVYDFMLLLCASLQRQIFEDENKAAVRIMAGDNVEICMNLDAASFSQHNPVPDFIHCRSYLDMSKVIIFSYLFWFVLTIIFITGTTRISIFCMGYLVACFYFLLFGGDLLLKPIKSILRYWDWLIAYNVFVITMKNILSIGACGYIGTLVHNSCWLIQAFSLACTVKGYQMPAANSPCTLPSGEAGIIWDSICFAFLLLQRRVFMSYYFLHVVADIKASQILASRGAELFQATIVKAVKARIEEEKKSMDQLKRQMDRIKARQQKYKKGKERMLSLTQEPGEGQDMQKLSEEDDEREADKQKAKGKKKQWWRPWVDHASMVRSGDYYLFETDSEEEEEEELKKEDEEPPRRSAFQFVYQAWITDPKTALRQRHKEKKRSAREERKRRRKGSKEGPVEWEDREDEPIKKKSDGPDNIIKRIFNILKFTWVLFLATVDSFTTWLNSISREHIDISTVLRIERCMLTREIKKGNVPTRESIHMYYQNHIMNLSRESGLDTIDEHPGAASGAQTAHRMDSLDSHDSISSEPTQCTMLYSRQGTTETIEEVEAEQEEEAGSTAPEPREAKEYEATGYDVGAMGAEEASLTPEEELTQFSTLDGDVEAPPSYSKAVSFEHLSFGSQDDSAGKNRMAVSPDDSRTDKLGSSILPPLTHELTASELLLKKMFHDDELEESEKFYVGQPRFLLLFYAMYNTLVARSEMVCYFVIILNHMVSASMITLLLPILIFLWAMLSVPRPSRRFWMMAIVYTEVAIVVKYFFQFGFFPWNKNVEVNKDKPYHPPNIIGVEKKEGYVLYDLIQLLALFFHRSILKCHGLWDEDDMTESGMAREESDDELSLGHGRRDSSDSLKSINLAASVESVHVTFPEQQTAVRRKRSGSSSEPSQRSSFSSNRSQRGSTSTRNSSQKGSSVLSIKQKGKRELYMEKLQEHLIKAKAFTIKKTLEIYVPIKQFFYNLIHPEYSAVTDVYVLMFLADTVDFIIIVFGFWAFGKHSAAADITSSLSEDQVPGPFLVMVLIQFGTMVVDRALYLRKTVLGKVIFQVILVFGIHFWMFFILPGVTERKFSQNLVAQLWYFVKCVYFGLSAYQIRCGYPTRVLGNFLTKSYNYVNLFLFQGFRLVPFLTELRAVMDWVWTDTTLSLSSWICVEDIYAHIFILKCWRESEKRYPQPRGQKKKKVVKYGMGGMIIVLLICIVWFPLLFMSLIKSVAGVINQPLDVSVTITLGGYQPIFTMSAQQSQLKVMDQQSFNKFIQAFSRDTGAMQFLENYEKEDITVAELEGNSNSLWTISPPSKQKMIHELLDPNSSFSVVFSWSIQRNLSLGAKSEIATDKLSFPLKNITRKNIAKMIAGNSTESSKTPVTIEKIYPYYVKAPSDSNSKPIKQLLSENNFMDITIILSRDNTTKYNSEWWVLNLTGNRIYNPNSQALELVVFNDKVSPPSLGFLAGYGIMGLYASVVLVIGKFVREFFSGISHSIMFEELPNVDRILKLCTDIFLVRETGELELEEDLYAKLIFLYRSPETMIKWTREKTN

SEQ ID NO: 33415 - protein, 484 aa, Homo sapiens
  ENSP00000369820
MACRGGAGNGHRASATLSRVSPGSLYTCRTRTHNICMVSDFFYPNMGGVESHIYQLSQCLIERGHKVIIVTHAYGNRKGIRYLTSGLKVYYLPLKVMYNQSTATTLFHSLPLLRYIFVRERVTIIHSHSSFSAMAHDALFHAKTMGLQTVFTDHSLFGFADVSSVLTNKLLTVSLCDTNHIICVSYTSKENTVLRAALNPEIVSVIPNAVDPTDFTPDPFRRHDSITIVVVSRLVYRKGIDLLSGIIPELCQKYPDLNFIIGGEGPKRIILEEVRERYQLHDRVRLLGALEHKDVRNVLVQGHIFLNTSLTEAFCMAIVEAASCGLQVVSTRVGGIPEVLPENLIILCEPSVKSLCEGLEKAIFQLKSGTLPAPENIHNIVKTFYTWRNVAERTEKVYDRVSVEAVLPMDKRLDRLISHCGPVTGYIFALLAVFNFLFLIFLRWMTPDSIIDVAIDATGPRGAWTNNYSHSKRGGENNEISETR

SEQ ID NO: 33416 - protein, 484 aa, Homo sapiens; identical to SEQ ID NO: 33415
  ENSP00000442653

SEQ ID NO: 33417 - protein, 118 aa, Homo sapiens
  ENSP00000489207
MACRGGAGNGHRASATLSRVSPGSLYTCRTRTHNICMVSDFFYPNMGGVESHIYQLSQCLIERGHKVIIVTHAYGNRKGIRYLTSGLKVYYLPLKVMYNQSTATTLFHSLPLLRDRFA

SEQ ID NO: 33418 - protein, 274 aa, Homo sapiens
  ENSP00000489928
MACRGGAGNGHRASATLSRVSPGSLYTCRTRTHNICMVSDFFYPNMGGVESHIYQLSQCLIERGHKVIIVTHAYGNRKGIRYLTSGLKVYYLPLKVMYNQSTATTLFHSLPLLRYIFVRERVTIIHSHSSFSAMAHDALFHAKTMGLQTVFTDHSLFGFADVSSVLTNKLLTVSLCDTNHIICVSYTSKENTVLRAALNPEIVSVIPNAVDPTDFTPDPFRRHDSITIVVVSRLVYRKDGVSLCLPGWSAVAQSRLTANSASRVHAILLPQPPE

SEQ ID NO: 33419 - protein, 44 aa, Homo sapiens
  ENSP00000490483
MACRGGAGNGHRASATLSRVSPGSLYTCRTRTHNICMGSICLVV

SEQ ID NO: 33420 - protein, 169 aa, Homo sapiens
  ENSP00000490545
MAIVEAASCGLQVVSTRVGGIPEVLPENLIILCEPSVKSLCEGLEKAIFQLKSGTLPAPENIHNIVKTFYTWRNVAERTEKVYDRVSVEAVLPMDKRLDRLISHCGPVTGYIFALLAVFNFLFLIFLRWMTPDSIIDVAIDATGPRGAWTNNYSHSKRGGENNEISETR

SEQ ID NO: 33421 - protein, 250 aa, Homo sapiens
  ENSP00000489540
MELTGIDLLSGIIPELCQKYPDLNFIIGGEGPKRIILEEVRERYQLHDRVRLLGALEHKDVRNVLVQGHIFLNTSLTEAFCMAIVEAASCGLQVVSTRVGGIPEVLPENLIILCEPSVKSLCEGLEKAIFQLKSGTLPAPENIHNIVKTFYTWRNVAERTEKVYDRVSVEAVLPMDKRLDRLISHCGPVTGYIFALLAVFNFLFLIFLRWMTPDSIIDVAIDATGPRGAWTNNYSHSKRGGENNEISETR

SEQ ID NO: 33422 - protein, 315 aa, Homo sapiens
  ENSP00000489528
MACRGGAGNGHRASATLSRVSPGSLYTCRTRTHNICMVSDFFYPNMGGVESHIYQLSQCLIERGHKVIIVTHAYGNRKGIRYLTSGLKVYYLPLKVMYNQSTATTLFHSLPLLRVRLLGALEHKDVRNVLVQGHIFLNTSLTEAFCMAIVEAASCGLQVVSTRVGGIPEVLPENLIILCEPSVKSLCEGLEKAIFQLKSGTLPAPENIHNIVKTFYTWRNVAERTEKVYDRVSVEAVLPMDKRLDRLISHCGPVTGYIFALLAVFNFLFLIFLRWMTPDSIIDVAIDATGPRGAWTNNYSHSKRGGENNEISETR

SEQ ID NO: 33423 - protein, 150 aa, Homo sapiens
  ENSP00000489083
MAIVEAASCGLQVVSTRVGGIPEVLPENLIILCEPSVKSLCEGLEKAIFQLKSGTLPAPENIHNIVKTFYTWRNVAERTEKVYDRVSVEAVLPMDKRLDRLISHCGPVTGYIFALLAVFNFLFLIFLRWMTPDSIIDVAIDATGPRGAWT

SEQ ID NO: 33424 - protein, 51 aa, Homo sapiens
  ENSP00000488970
QGHIFLNTSLTEAFCMAIVEAASCGLQVYDRVSVEAVLPMDKRLDRLISHC

SEQ ID NO: 33425 - protein, 99 aa, Homo sapiens
  ENSP00000489491
VTHAYGNRKGIRYLTSGLKVYYLPLKVMYNQSTATTLFHSLPLLRSLLDQISKSHWNVLSEREDKSKFSLSRLFGCLFPEPPLPSLFCSQSGFTSTLHV

SEQ ID NO: 33426 - protein, 152 aa, Homo sapiens
  ENSP00000489205
MACRGGAGNGHRASATLSRVSPGSLYTCRTRTHNICMVSDFFYPNMGGVESHIYQLSQCLIERGHKVIIVTHAYGNRKGIRYLTSGLKVYYLPLKVMYNQSTATTLFHSLPLLRYIFVRERVTIIHSHSSFSAMAHDALFHAKTMGLQTVFT

SEQ ID NO: 33427 - protein, 182 aa, Homo sapiens
  ENSP00000453759
  MOD_RES (1)..(1): Any amino acid
XGRLALQRRYYSPSCREFCLSCPRLSLRSLTAVTCTVWLAAYGLFTLCENSMILSAAIFITLLGLLGYLHFVKIDQETLLIIDSLGIQMTSSYASGKESTTFIEMGKVKDIVINEAIYMQKVIYYLCILLKDPVEPHGISQVVPVFQAAWCIHSKLATRPSCFLNRTLPGPSGQPSQEPIPC

SEQ ID NO: 33428 - protein, 188 aa, Homo sapiens
  ENSP00000216452
MEDERSFSDICGGRLALQRRYYSPSCREFCLSCPRLSLRSLTAVTCTVWLAAYGLFTLCENSMILSAAIFITLLGLLGYLHFVKIDQETLLIIDSLGIQMTSSYASGKESTTFIEMGKVKDIVINEAIYMQKVIYYLCILLKDPVEPHGISQVVPVFQSAKPRLDCLIEVYRSCQEILAHQKATSTSP

SEQ ID NO: 33429 - protein, 136 aa, Homo sapiens
  ENSP00000452816
  MOD_RES (1)..(1): Any amino acid
XLLGLLGYLHFVKIDQETLLIIDSLGIQMTSSYASGKESTTFIEMGKVKDIVINEAIYMQKVIYYLCILLKDPVEPHGISQVVPVFQRQSLTLSPRLECSDNHHSLQPPPPRLKKSSCLSLLRTWDYRVPSPGWTA

SEQ ID NO: 33430 - protein, 187 aa, Homo sapiens
  ENSP00000453394
MEDERSFSDICGGRLALQRRYYSPSCREFCLSCPRLSLRSLTAVTCTVWLAAYGLFTLCENSMILSAAIFITLLGLLGYLHFVKIDQETLLIIDSLGIQMTSSYASGKESTTFIEMGKVKDIVINEAIYMKVIYYLCILLKDPVEPHGISQVVPVFQSAKPRLDCLIEVYRSCQEILAHQKATSTSP

SEQ ID NO: 33431 - protein, 137 aa, Homo sapiens
  ENSP00000453158
  MOD_RES (1)..(1): Any amino acid
XSCREFCLSCPRLSLRSLTAVTCTVWLAAYGLFTLCENSMILSAAIFITLLGLLGYLHFVKIDQETLLIIDSLGIQMTSSYASGKESTTFIEMGKVKDIVINEAIYMSAKPRLDCLIEVYRSCQEILAHQKATSTSP

SEQ ID NO: 33432 - protein, 83 aa, Homo sapiens
  ENSP00000452924
MEDERSFSDICGGRLALQRRYYSPSCREFCLSCPRLSLRSLTAVTCTVWLAAYGLFTLCEHDPLCCHLHHPLRSAWLSPFCED

SEQ ID NO: 33433 - protein, 133 aa, Homo sapiens
  ENSP00000452974
MEDERSFSDICGGRLALQRRYYSPSCREFCLSCPRLSLRSLTAVTCTVWLAAYGLFTLCENSMILSAAIFITLLGLLGYLHFVKIDQETLLIIDSLGIQMTSSYASGKESTTFIEMGKVKDIVINEAIYMVSI

SEQ ID NO: 33434 - protein, 83 aa, Homo sapiens; identical to SEQ ID NO: 33432
  ENSP00000454061

SEQ ID NO: 33435 - protein, 183 aa, Homo sapiens
  ENSP00000453733
MEDERSFSDICGGRLALQRRYYSPSCREFCLSCPRLSLRSLTAVTCTVWLAAYGLFTLCEMTSSYASGKESTTFIEMGKVKDIVINEAIYMQKVIYYLCILLKDPVEPHGISQVVPVFQRQSLTLSPRLECSDNHHSLQPPPPRLKKSSCLSLLRTWDYRCAPSRLANFFFLFLVEMRSCHVA

SEQ ID NO: 33436 - protein, 137 aa, Homo sapiens
  ENSP00000452996
MEDERSFSDICGGRLALQRRYYSPSCREFCLSCPRLSLRSLTAVTCTVWLAAYGLFTLCENSMILSAAIFITLLGKESTTFIEMGKVKDIVINEAIYMQKVIYYLCILLKDPVEPHGISQVVPVFQRQSLTLSPRLE

SEQ ID NO: 33437 - protein, 41 aa, Homo sapiens
  ENSP00000268758
MAAAGAAATHLAPPHGACHCRVYAGVSAPGRPGEAALHRCA

SEQ ID NO: 33438 - protein, 547 aa, Homo sapiens
  ENSP00000378755
MPSEVARGKRAALFFAAVAIVLGLPLWWKTTETYRASLPYSQISGLNALQLRLMVPVTVVFTRESVPLDDQEKLPFTVVHEREIPLKYKMKIKCRFQKAYRRALDHEEEALSSGSVQEAEAMLDEPQEQAEGSLTVYVISEHSSLLPQDMMSYIGPKRTAVVRGIMHREAFNIIGRRIVQVAQAMSLTEDVLAAALADHLPEDKWSAEKRRPLKSSLGYEITFSLLNPDPKSHDVYWDIEGAVRRYVQPFLNALGAAGNFSVDSQILYYAMLGVNPRFDSASSSYYLDMHSLPHVINPVESRLGSSAASLYPVLNFLLYVPELAHSPLYIQDKDGAPVATNAFHSPRWGGIMVYNVDSKTYNASVLPVRVEVDMVRVMEVFLAQLRLLFGIAQPQLPPKCLLSGPTSEGLMTWELDRLLWARSVENLATATTTLTSLAQLLGKISNIVIKDDVASEVYKAVAAVQKSAEELASGHLASAFVASQEAVTSSELAFFDPSLLHLLYFPDDQKFAIYIPLFLPMAVPILLSLVKIFLETRKSWRKPEKTD

SEQ ID NO: 33439 - protein, 555 aa, Homo sapiens
  ENSP00000309430
MAAAGAAATHLEVARGKRAALFFAAVAIVLGLPLWWKTTETYRASLPYSQISGLNALQLRLMVPVTVVFTRESVPLDDQEKLPFTVVHEREIPLKYKMKIKCRFQKAYRRALDHEEEALSSGSVQEAEAMLDEPQEQAEGSLTVYVISEHSSLLPQDMMSYIGPKRTAVVRGIMHREAFNIIGRRIVQVAQAMSLTEDVLAAALADHLPEDKWSAEKRRPLKSSLGYEITFSLLNPDPKSHDVYWDIEGAVRRYVQPFLNALGAAGNFSVDSQILYYAMLGVNPRFDSASSSYYLDMHSLPHVINPVESRLGSSAASLYPVLNFLLYVPELAHSPLYIQDKDGAPVATNAFHSPRWGGIMVYNVDSKTYNASVLPVRVEVDMVRVMEVFLAQLRLLFGIAQPQLPPKCLLSGPTSEGLMTWELDRLLWARSVENLATATTTLTSLAQLLGKISNIVIKDDVASEVYKAVAAVQKSAEELASGHLASAFVASQEAVTSSELAFFDPSLLHLLYFPDDQKFAIYIPLFLPMAVPILLSLVKIFLETRKSWRKPEKTD

SEQ ID NO: 33440 - protein, 41 aa, Homo sapiens; identical to SEQ ID NO: 33437
  ENSP00000463406

SEQ ID NO: 33441 - protein, 116 aa, Homo sapiens
  ENSP00000466846
MAAAGAAATHLEVARGKRAALFFAAVAIVLGLPLWWKTTETYRASLPYSQISGLNALQVRLLCGRVGGQPPRQGGDSVTALMLLPVAPPHGACHCRVYAGVSAPGRPGEAALHRCA

SEQ ID NO: 33442 - protein, 579 aa, Homo sapiens
  ENSP00000413405
MQICGSSVASVAAGTSFQVLGPVCWQQLDLKMAVRVLWGGLSLLRVLWCLLPQTGYVHPDEFFQSPEVMAEDILGVQAARPWEFYPSSSCRSVLFPLLISGSTFWLLRLWEELGPWPGLVSGYALLVGPRLLLTALSFALDGAVYHLAPPMGADRWNALALLSGSYVTLVFYTRTFSNTIEGLLFTWLLVLVSSHVTWGPTRKEPAPGPRWRSWLLGGIVAAGFFNRPTFLAFAVVPLYLWGTRGATNPGLKSLTREALVLLPGAALTAAVFVATDSWYFSSPATSRNLVLTPVNFLHYNLNPQNLARHGTHARLTHLAVNGFLLFGVLHAQALQAAWQRLQVGLQASAQMGLLRALGARSLLSSPRSYLLLLYFMPLALLSAFSHQEARFLIPLLVPLVLLCSPQTQPVPWKGTVVLFNALGALLFGCLHQGGLVPGLEYLEQVVHAPVLPSTPTHYTLLFTHTYMPPRHLLHLPGLGAPVEVVDMGGTEDWALCQTLKSFTRQPACQVAGGPWLCRLFVVTPGTTRRAVEKCSFPFKNETLLFPHLTLEDPPALSSLLSGAWRDHLSLHIVELGEET

SEQ ID NO: 33443 - protein, 49 aa, Homo sapiens
  ENSP00000405341
  MOD_RES (1)..(1): Any amino acid
XRVLWGGLSLLRVLWCLLPQTGYVHPDEFFQSPEVMAGSGRSWGRGLAW

SEQ ID NO: 33444 - protein, 92 aa, Homo sapiens
  ENSP00000389327
MQICGSSVASVAAGTSFQVLGPVCWQQLDLKMAVRVLWGGLSLLRVLWCLLPQTGYVHPDEFFQSPEVMAGPSPTPLRDSSSRGCWCWYPPM

SEQ ID NO: 33445 - protein, 214 aa, Homo sapiens
  ENSP00000361531
MESENMDSENMKTENMESQNVDFESVSSVTALEALSKLLNPEEEDDSDYGQTNGLSTIGAMGPGNIGPPQIEELKVIPETSEENNEDIWNSEEIPEGAEYDDMWDVREIPEYEIIFRQQVGTEDIFLGLSKKDSSTGCCSELVAKIKLPNTNPSDIQIDIQETILDLRTPQKKLLITLPELVECTSAKAFYIPETETLEITMTMKRELDIANFF

SEQ ID NO: 33446 - protein, 214 aa, Homo sapiens; identical to SEQ ID NO: 33445
  ENSP00000337757

SEQ ID NO: 33447 - protein, 214 aa, Homo sapiens; identical to SEQ ID NO: 33445
  ENSP00000441930

SEQ ID NO: 33448 - protein, 1634 aa, Homo sapiens
  ENSP00000356155
MSSTQGNGEHWKSLESVGISRKELAMAEALQMEYDALSRLRHDKEENRAKQNADPSLISWDEPGVDFYSKPAGRRTDLKLLRGLSGSDPTLNYNSLSPQEGPPNHSTSQGPQPGSDPWPKGSLSGDYLYIFDGSDGGVSSSPGPGDIEGSCKKLSPPPLPPRASIWDTPPLPPRKGSPSSSKISQPSDINTFSLVEQLPGKLLEHRILEEEEVLGGGGQGRLLGSVDYDGINDAITRLNLKSTYDAEMLRDATRGWKEGRGPLDFSKDTSGKPVARSKTMPPQVPPRTYASRYGNRKNATPGKNRRISAAPVGSRPHTVANGHELFEVSEERDEEVAAFCHMLDILRSGSDIQDYFLTGYVWSAVTPSPEHLGDEVNLKVTVLCDRLQEALTFTCNCSSTVDLLIYQTLCYTHDDLRNVDVGDFVLKPCGLEEFLQNKHALGSHEYIQYCRKFDIDIRLQLMEQKVVRSDLARTVNDDQSPSTLNYLVHLQERPVKQTISRQALSLLFDTYHNEVDAFLLADGDFPLKADRVVQSVKAICNALAAVETPEITSALNQLPPCPSRMQPKIQKDPSVLAVRENREKVVEALTAAILDLVELYCNTFNADFQTAVPGSRKHDLVQEACHFARSLAFTVYATHRIPIIWATSYEDFYLSCSLSHGGKELCSPLQTRRAHFSKYLFHLIVWDQQICFPVQVNRLPRETLLCATLYALPIPPPGSSSEANKQRRVPEALGWVTTPLFNFRQVLTCGRKLLGLWPATQENPSARWSAPNFHQPDSVILQIDFPTSAFDIKFTSPPGDKFSPRYEFGSLREEDQRKLKDIMQKESLYWLTDADKKRLWEKRYYCHSEVSSLPLVLASAPSWEWACLPDIYVLLKQWTHMNHQDALGLLHATFPDQEVRRMAVQWIGSLSDAELLDYLPQLVQALKYECYLDSPLVRFLLKRAVSDLRVTHYFFWLLKDGLKDSQFSIRYQYLLAALLCCCGKGLREEFNRQCWLVNALAKLAQQVREAAPSARQGILRTGLEEVKQFFALNGSCRLPLSPSLLVKGIVPRDCSYFNSNAVPLKLSFQNVDPLGENIRVIFKCGDDLRQDMLTLQMIRIMSKIWVQEGLDMRMVIFRCFSTGRGRGMVEMIPNAETLRKIQVEHGVTGSFKDRPLADWLQKHNPGEDEYEKAVENFIYSCAGCCVATYVLGICDRHNDNIMLKTTGHMFHIDFGRFLGHAQMFGNIKRDRAPFVFTSDMAYVINGGDKPSSRFHDFVDLCCQAYNLIRKHTHLFLNLLGLMLSCGIPELSDLEDLKYVYDALRPQDTEANATTYFTRLIESSLGSVATKLNFFIHNLAQMKFTGSDDRLTLSFASRTHTLKSSGRISDVFLCRHEKIFHPNKGYIYVVKVMRENTHEATYIQRTFEEFQELHNKLRLLFPSSHLPSFPSRFVIGRSRGEAVAERRREELNGYIWHLIHAPPEVAECDLVYTFFHPLPRDEKAMGTSPAPKSSDGTWARPVGKVGGEVKLSISYKNNKLFIMVMHIRGLQLLQDGNDPDPYVKIYLLPDPQKTTKRKTKVARKTCNPTYNEMLVYDGIPKGDLQQRELQLSVLSEQGFWENVLLGEVNIRLRELDLAQEKTGWFALGSRSHGTL

SEQ ID NO: 33449 - protein, 173 aa, Homo sapiens
  ENSP00000356152
MRPWSSPAQLVAGAQPAGRGDPLGPRPIPPPRFRRASSQREPPYPRPAEPALELAGSKCQPDTPAASLCPADSPSQHRVMPPGPASWANVGSRPHTVANGHELFEVSEERDEEVAAFCHMLDILRSGSDIQDYFLTGYVWSAVTPSPEHLGDEVNLKVTVLCDRLQEALTFTC

SEQ ID NO: 33450 - protein, 131 aa, Homo sapiens
  ENSP00000401795
MSSTQGNGEHWKSLESVGISRKELAMAEALQMEYDALSRLRHDKEENRAKQNADPSLISWDEPGVDFYSKPAGRRTDLKLLRGLSGSDPTLNYNSLSPQEGPPNHSTSQGPQPGSDPWPKGSLSGDYLYIF

SEQ ID NO: 33451 - protein, 60 aa, Homo sapiens
  ENSP00000409554
MSSTQGNGEHWKSLESVGISRKELAMAEALQMEYDALSRLRHDKEENRAKQNADPSLISW

SEQ ID NO: 33452 - protein, 1606 aa, Homo sapiens
  ENSP00000400561
MSSTQGNGEHWKSLESVGISRKELAMAEALQMEYDALSRLRHDKEENRAKQNADPSLISWDEPGVDFYSKPAGRRTDLKLLRGLSGSDPTLNYNSLSPQEGPPNHSTSQGPQPGSDPWPKGSLSGDYLYIFDGSDGGVSSSPGPGDIEGSCKKLSPPPLPPRASIWDTPPLPPRKGSPSSSKISQPSDINTFSLVEQLPGKLLEHRILEEEEVLGGGGQGRLLGSVDYDGINDAITRLNLKSTYDAEMLRDATRGWKEGRGPLDFSKDTSGKPVARSKTMPPQVPPRTYASRYGNRKNATPGKNRRISAAPVGSRPHTVANGHELFEVSEERDEEVAAFCHMLDILRSGSDIQDYFLTGYVWSAVTPSPEHLGDEVNLKVTVLCDRLQEALTFTCNCSSTVDLLIYQTLCYTHDDLRNVDVGDFVLKPCGLEEFLQNKHALGSHEYIQYCRKFDIDIRLQLMEQKVVRSDLARTVNDDQSPSTLNYLVHLQERPVKQTISRQALSLLFDTYHNEVDAFLLADGDFPLKADRVVQSVKAICNALAAVETPEITSALNQLPPCPSRMQPKIQKDPSVLAVRENREKVVEALTAAILDLVELYCNTFNADFQTAVPGSRKHDLVQEACHFARSLAFTVYATHRIPIIWATSYEDFYLSCSLSHGGKELCSPLQTRRAHFSKYLFHLIVWDQQICFPVQVNRLPRETLLCATLYALPIPPPGSSSEANKQRRVPEALGWVTTPLFNFRQVLTCGRKLLGLWPATQENPSARWSAPNFHQPDSVILQIDFPTSAFDIKFTSPPGDKFSPRYEFGSLREEDQRKLKDIMQKESLYWLTDADKKRLWEKRYYCHSEWTHMNHQDALGLLHATFPDQEVRRMAVQWIGSLSDAELLDYLPQLVQALKYECYLDSPLVRFLLKRAVSDLRVTHYFFWLLKDGLKDSQFSIRYQYLLAALLCCCGKGLREEFNRQCWLVNALAKLAQQVREAAPSARQGILRTGLEEVKQFFALNGSCRLPLSPSLLVKGIVPRDCSYFNSNAVPLKLSFQNVDPLGENIRVIFKCGDDLRQDMLTLQMIRIMSKIWVQEGLDMRMVIFRCFSTGRGRGMVEMIPNAETLRKIQVEHGVTGSFKDRPLADWLQKHNPGEDEYEKAVENFIYSCAGCCVATYVLGICDRHNDNIMLKTTGHMFHIDFGRFLGHAQMFGNIKRDRAPFVFTSDMAYVINGGDKPSSRFHDFVDLCCQAYNLIRKHTHLFLNLLGLMLSCGIPELSDLEDLKYVYDALRPQDTEANATTYFTRLIESSLGSVATKLNFFIHNLAQMKFTGSDDRLTLSFASRTHTLKSSGRISDVFLCRHEKIFHPNKGYIYVVKVMRENTHEATYIQRTFEEFQELHNKLRLLFPSSHLPSFPSRFVIGRSRGEAVAERRREELNGYIWHLIHAPPEVAECDLVYTFFHPLPRDEKAMGTSPAPKSSDGTWARPVGKVGGEVKLSISYKNNKLFIMVMHIRGLQLLQDGNDPDPYVKIYLLPDPQKTTKRKTKVARKTCNPTYNEMLVYDGIPKGDLQQRELQLSVLSEQGFWENVLLGEVNIRLRELDLAQEKTGWFALGSRSHGTL

SEQ ID NO: 33453 - protein, 724 aa, Homo sapiens
  ENSP00000428056
MSAEGYQYRALYDYKKEREEDIDLHLGDILTVNKGSLVALGFSDGQEARPEEIGWLNGYNETTGERGDFPGTYVEYIGRKKISPPTPKPRPPRPLPVAPGSSKTEADVEQQALTLPDLAEQFAPPDIAPPLLIKLVEAIEKKGLECSTLYRTQSSSNLAELRQLLDCDTPSVDLEMIDVHVLADAFKRYLLDLPNPVIPAAVYSEMISLAPEVQSSEEYIQLLKKLIRSPSIPHQYWLTLQYLLKHFFKLSQTSSKNLLNARVLSEIFSPMLFRFSAASSDNTENLIKVIEILISTEWNERQPAPALPPKPPKPTTVANNGMNNNMSLQDAEWYWGDISREEVNEKLRDTADGTFLVRDASTKMHGDYTLTLRKGGNNKLIKIFHRDGKYGFSDPLTFSSVVELINHYRNESLAQYNPKLDVKLLYPVSKYQQDQVVKEDNIEAVGKKLHEYNTQFQEKSREYDRLYEEYTRTSQEIQMKRTAIEAFNETIKIFEEQCQTQERYSKEYIEKFKREGNEKEIQRIMHNYDKLKSRISEIIDSRRRLEEDLKKQAAEYREIDKRMNSIKPDLIQLRKTRDQYLMWLTQKGVRQKKLNEWLGNENTEDQYSLVEDDEDLPHHDEKTWNVGSSNRNKAENLLRGKRDGTFLVRESSKQGCYACSVVVDGEVKHCVINKTATGYGFAEPYNLYSSLKELVLHYQHTSLVQHNDSLNVTLAYPVYAQQRR

SEQ ID NO: 33454 - protein, 724 aa, Homo sapiens; identical to SEQ ID NO: 33453
  ENSP00000429277

SEQ ID NO: 33455 - protein, 131 aa, Homo sapiens
  ENSP00000428566
TAKEPHQNRRLERALTLPDLAEQFAPPDIAPPLLIKLVEAIEKKGLECSTLYRTQSSSNLAELRQLLDCDTPSVDLEMIDVHVLADAFKRYLLDLPNPVIPAAVYSEMISLAPEVQSSEEYIQLLKKLIRS

SEQ ID NO: 33456 - protein, 117 aa, Homo sapiens
  ENSP00000430126
MLFRFSAASSDNTENLIKVIEILISTEWNERQPAPALPPKPPKPTTVANNGMNNNMSLQDAEWYWGDISREEVNEKLRDTADGTFLVRDASTKMHGDYTLTLRKGGNNKLIKIFHRD

SEQ ID NO: 33457 - protein, 102 aa, Homo sapiens
  ENSP00000429766
MLFRFSAASSDNTENLIKVIEILISTEWNERQPAPALPPKPPKPTTVANNGMNNNMSLQDAEWYWGDISREEVNEKLRDTADGTFLVRDASTKMHGDYTLTL

SEQ ID NO: 33458 - protein, 424 aa, Homo sapiens
  ENSP00000323512
MHNLQTLPPKPPKPTTVANNGMNNNMSLQDAEWYWGDISREEVNEKLRDTADGTFLVRDASTKMHGDYTLTLRKGGNNKLIKIFHRDGKYGFSDPLTFSSVVELINHYRNESLAQYNPKLDVKLLYPVSKYQQDQVVKEDNIEAVGKKLHEYNTQFQEKSREYDRLYEEYTRTSQEIQMKRTAIEAFNETIKIFEEQCQTQERYSKEYIEKFKREGNEKEIQRIMHNYDKLKSRISEIIDSRRRLEEDLKKQAAEYREIDKRMNSIKPDLIQLRKTRDQYLMWLTQKGVRQKKLNEWLGNENTEDQYSLVEDDEDLPHHDEKTWNVGSSNRNKAENLLRGKRDGTFLVRESSKQGCYACSVVVDGEVKHCVINKTATGYGFAEPYNLYSSLKELVLHYQHTSLVQHNDSLNVTLAYPVYAQQRR

SEQ ID NO: 33459 - protein, 137 aa, Homo sapiens
  ENSP00000431058
MHGDYTLTLRKGGNNKLIKIFHRDGKYGFSDPLTFSSVVELINHYRNESLAQYNPKLDVKLLYPVSKYQQDQVVKEDNIEAVGKKLHEYNTQFQEKSREYDRLYEEYTRTSQEIQMKRTAIEAFNETIKIFEEQCQT

SEQ ID NO: 33460 - protein, 454 aa, Homo sapiens
  ENSP00000338554
MYNTVWNMEDLDLEYAKTDINCGTDLMFYIEMDPPALPPKPPKPTTVANNGMNNNMSLQDAEWYWGDISREEVNEKLRDTADGTFLVRDASTKMHGDYTLTLRKGGNNKLIKIFHRDGKYGFSDPLTFSSVVELINHYRNESLAQYNPKLDVKLLYPVSKYQQDQVVKEDNIEAVGKKLHEYNTQFQEKSREYDRLYEEYTRTSQEIQMKRTAIEAFNETIKIFEEQCQTQERYSKEYIEKFKREGNEKEIQRIMHNYDKLKSRISEIIDSRRRLEEDLKKQAAEYREIDKRMNSIKPDLIQLRKTRDQYLMWLTQKGVRQKKLNEWLGNENTEDQYSLVEDDEDLPHHDEKTWNVGSSNRNKAENLLRGKRDGTFLVRESSKQGCYACSVVVDGEVKHCVINKTATGYGFAEPYNLYSSLKELVLHYQHTSLVQHNDSLNVTLAYPVYAQQRR

SEQ ID NO: 33461 - protein, 38 aa, Homo sapiens
  ENSP00000430424
MYNTVWNMEDLDLEYAKTDINCGTDLMFYIEMDPPGKK

SEQ ID NO: 33462 - protein, 189 aa, Homo sapiens
  ENSP00000429156
KDDQKKSLSTGELEEVNEKLRDTADGTFLVRDASTKMHGDYTLTLRKGGNNKLIKIFHRDGKYGFSDPLTFSSVVELINHYRNESLAQYNPKLDVKLLYPVSKYQQDQVVKEDNIEAVGKKLHEYNTQFQEKSREYDRLYEEYTRTSQEIQMKRTAIEAFNETIKIFEEQCQTQERYSKEYIEKFKREG

SEQ ID NO: 33463 - protein, 361 aa, Homo sapiens
  ENSP00000430098
MHGDYTLTLRKGGNNKLIKIFHRDGKYGFSDPLTFSSVVELINHYRNESLAQYNPKLDVKLLYPVSKYQQDQVVKEDNIEAVGKKLHEYNTQFQEKSREYDRLYEEYTRTSQEIQMKRTAIEAFNETIKIFEEQCQTQERYSKEYIEKFKREGNEKEIQRIMHNYDKLKSRISEIIDSRRRLEEDLKKQAAEYREIDKRMNSIKPDLIQLRKTRDQYLMWLTQKGVRQKKLNEWLGNENTEDQYSLVEDDEDLPHHDEKTWNVGSSNRNKAENLLRGKRDGTFLVRESSKQGCYACSVVVDGEVKHCVINKTATGYGFAEPYNLYSSLKELVLHYQHTSLVQHNDSLNVTLAYPVYAQQRR

SEQ ID NO: 33464 - protein, 166 aa, Homo sapiens
  ENSP00000415111
MGRPLLLPLLPLLLPPAFLQPSGSTGSGPSYLYGVTQPKHLSASMGGSVEIPFSFYYPWELATAPDVRISWRRGHFHRQSFYSTRPPSIHKDYVNRLFLNWTEGQKSGFLRISNLQKQDQSVYFCRVELDTRSSGRQQWQSIEGTKLSITQGQQRTKATTPAREPF

SEQ ID NO: 33465 - protein, 303 aa, Homo sapiens
  ENSP00000198536
MGRPLLLPLLPLLLPPAFLQPSGSTGSGPSYLYGVTQPKHLSASMGGSVEIPFSFYYPWELATAPDVRISWRRGHFHRQSFYSTRPPSIHKDYVNRLFLNWTEGQKSGFLRISNLQKQDQSVYFCRVELDTRSSGRQQWQSIEGTKLSITQAVTTTTQRPSSMTTTWRLSSTTTTTGLRVTQGKRRSDSWHISLETAVGVAVAVTVLGIMILGLICLLRWRRRKGQQRTKATTPAREPFQNTEEPYENIRNEGQNTDPKLNPKDDGIVYASLALSSSTSPRAPPSHRPLKSPQNETLYSVLKA

SEQ ID NO: 33466 - protein, 226 aa, Homo sapiens
  ENSP00000390026
MGRPLLLPLLPLLLPPAFLQPSGSTGSGPSYLYGVTQPKHLSASMGGSVEIPFSFYYPWELATAPDVRISWRRGHFHRQSFYSTRPPSIHKDYVNRLFLNWTEGQKSGFLRISNLQKQDQSVYFCRVELDTRSSGRQQWQSIEGTKLSITQGQQRTKATTPAREPFQNTEEPYENIRNEGQNTDPKLNPKLHLTQSTSQPPSPQEPPERDPVLCLKGLTNGQPSQD

SEQ ID NO: 33467 - protein, 175 aa, Homo sapiens
  ENSP00000377569
MGRPLLLPLLPLLLPPAFLQPSGSTGSGPSYLYGVTQPKHLSASMGGSVEIPFSFYYPWELATAPDVRISWRRGHFHRQSFYSTRPPSIHKDYVNRLFLNWTEGQKSGFLRISNLQKQDQSVYFCRVELDTRSSGRQQWQSIEGTKLSITQGNPSKTQRSHMRISGMKDKIQIPS

SEQ ID NO: 33468 - protein, 230 aa, Homo sapiens
  ENSP00000340109
MGRPLLLPLLPLLLPPAFLQPSGSTGSGPSYLYGVTQPKHLSASMGGSVEIPFSFYYPWELATAPDVRISWRRGHFHRQSFYSTRPPSIHKDYVNRLFLNWTEGQKSGFLRISNLQKQDQSVYFCRVELDTRSSGRQQWQSIEGTKLSITQGQQRTKATTPAREPFQNTEEPYENIRNEGQNTDPKLNPKDDGIVYASLALSSSTSPRAPPSHRPLKSPQNETLYSVLKA

SEQ ID NO: 33469 - protein, 326 aa, Homo sapiens
  ENSP00000353824
MLLSKFGSLAHLCGPGGVDHLPVKILQPAKADKESFEKAYQVGAVLGSGGFGTVYAGSRIADGLPVAVKHVVKERVTEWGSLGGATVPLEVVLLRKVGAAGGARGVIRLLDWFERPDGFLLVLERPEPAQDLFDFITERGALDEPLARRFFAQVLAAVRHCHSCGVVHRDIKDENLLVDLRSGELKLIDFGSGALLKDTVYTDFDGTRVYSPPEWIRYHRYHGRSATVWSLGVLLYDMVCGDIPFEQDEEILRGRLLFRRRVSPECQQLIRWCLSLRPSERPSLDQIAAHPWMLGADGGVPESCDLRLCTLDPDDVASTTSSSESL

SEQ ID NO: 33470 - protein, 106 aa, Homo sapiens
  ENSP00000421392
MPMAGLLKGLVRQLERFSVQQQASKMPPKGKSGSGKAGKACQLSLVLAYFVWPKIILPLWPREAERLDTLVVKCLAEFPFEVWRYDGNIHSGCVLDLSVNMEVQFK

SEQ ID NO: 33471 - protein, 111 aa, Homo sapiens
  ENSP00000218432
MPMAGLLKGLVRQLERFSVQQQASKMPPKGKSGSGKAGKGGAASGSDSADKKAQGPKGGGNAVKVRHILCEKHGKIMEAMEKLKSGMRFNEVAAQYSEDKARQGVCCSYYL

SEQ ID NO: 33472 - protein, 156 aa, Homo sapiens
  ENSP00000362773
MPMAGLLKGLVRQLERFSVQQQASKMPPKGKSGSGKAGKGGAASGSDSADKKAQGPKGGGNAVKVRHILCEKHGKIMEAMEKLKSGMRFNEVAAQYSEDKARQGGDLGWMTRGSMVGPFQEAAFALPVSGMDKPVFTDPPVKTKFGYHIIMVEGRK

SEQ ID NO: 33473 - protein, 115 aa, Homo sapiens
  ENSP00000421676
VQQQASKMPPKGKSGSGKAGKGGAASGSDSADKKAQGPKGGGNAVKVRHILCEKHGKIMEAMEKLKSGMRFNEVAAQYSEDKARQGIPSLQQHAGHHRDLRSTLISLVSYLQTTP

SEQ ID NO: 33474 - protein, 91 aa, Homo sapiens
  ENSP00000394066
VQQQASKMPPKGKSGSGKAGKGGAASGSDSADKKAQGPKGGGNAVKVRHILCEKHGKIMEAMEKLKSGMRFNEVAAQYSEDKARQGAFRLR

SEQ ID NO: 33475 - protein, 116 aa, Homo sapiens
  ENSP00000402330
  MOD_RES (1)..(1): Any amino acid
XKEKVVLEKRGKVERPERSRRMGAGEERREGTDSPSPESGTDAAGGAASGSDSADKKAQGPKGGGNAVKVRHILCEKHGKIMEAMEKLKSGMRFNEVAAQYSEDKARQGVCCSYYL

SEQ ID NO: 33476 - protein, 133 aa, Homo sapiens
  ENSP00000409154
MPMAGLLKGLVRQLERFSVQQQASKMPPKGKSGSGKAGKGGAASGSDSADKKAQGPKGGGNAVKVRHILCEKHGKIMEAMEKLKSGMRFNEVAAQYSEDKARQGIPSLQQHAGHHRDLRSTLISLVSYLQTTP

SEQ ID NO: 33477 - protein, 406 aa, Homo sapiens
  ENSP00000365757
MATPGNLGSSVLASKTKTKKKHFVAQKVKLFRASDPLLSVLMWGVNHSINELSHVQIPVMLMPDDFKAYSKIKVDNHLFNKENMPSHFKFKEYCPMVFRNLRERFGIDDQDFQNSLTRSAPLPNDSQARSGARFHTSYDKRYIIKTITSEDVAEMHNILKKYHQYIVECHGITLLPQFLGMYRLNVDGVEIYVIVTRNVFSHRLSVYRKYDLKGSTVAREASDKEKAKELPTLKDNDFINEGQKIYIDDNNKKVFLEKLKKDVEFLAQLKLMDYSLLVGIHDVERAEQEEVECEENDGEEEGESDGTHPVGTPPDSPGNTLNSSPPLAPGEFDPNIDVYGIKCHENSPRKEVYFMAIIDILTHYDAKKKAAHAAKTVKHGAGAEISTVNPEQYSKRFLDFIGHILT

SEQ ID NO: 33478 - protein, 266 aa, Homo sapiens
  ENSP00000326294
MHNILKKYHQYIVECHGITLLPQFLGMYRLNVDGVEIYVIVTRNVFSHRLSVYRKYDLKMANLKATFTFPKPTGSTVAREASDKEKAKELPTLKDNDFINEGQKIYIDDNNKKVFLEKLKKDVEFLAQLKLMDYSLLVGIHDVERAEQEEVECEENDGEEEGESDGTHPVGTPPDSPGNTLNSSPPLAPGEFDPNIDVYGIKCHENSPRKEVYFMAIIDILTHYDAKKKAAHAAKTVKHGAGAEISTVNPEQYSKRFLDFIGHILT

SEQ ID NO: 33479 - protein, 347 aa, Homo sapiens
  ENSP00000442098
MLMPDDFKAYSKIKVDNHLFNKENMPSHFKFKEYCPMVFRNLRERFGIDDQDFQNSLTRSAPLPNDSQARSGARFHTSYDKRYIIKTITSEDVAEMHNILKKYHQYIVECHGITLLPQFLGMYRLNVDGVEIYVIVTRNVFSHRLSVYRKYDLKGSTVAREASDKEKAKELPTLKDNDFINEGQKIYIDDNNKKVFLEKLKKDVEFLAQLKLMDYSLLVGIHDVERAEQEEVECEENDGEEEGESDGTHPVGTPPDSPGNTLNSSPPLAPGEFDPNIDVYGIKCHENSPRKEVYFMAIIDILTHYDAKKKAAHAAKTVKHGAGAEISTVNPEQYSKRFLDFIGHILT

SEQ ID NO: 33480 - protein, 142 aa, Homo sapiens
  ENSP00000473858
MHNILKKYHQYIVECHGITLLPQFLGMYRLNVDGVEIYVIVTRNVFSHRLSVYRKYDLKGSTVAREASDKEKAKELPTLKDNDFINEGQKIYIDDNNKKVFLEKLKKDVEFLAQLKLMDYSLLVGIHDVERAEQEEVECEEN

SEQ ID NO: 33481 - protein, 668 aa, Homo sapiens
  ENSP00000335333
MELEVPDEAESAEAGAVPSEAAWAAESGAAAGLAQKKAAPTEVLSMTAQPGPGHGKKLGHRGVDASGETTYKKTTSSTLKGAIQLGIGYTVGHLSSKPERDVLMQDFYVVESIFFPSEGSNLTPAHHFQDFRFKTYAPVAFRYFRELFGIRPDDYLYSLCNEPLIELSNPGASGSLFYVTSDDEFIIKTVMHKEAEFLQKLLPGYYMNLNQNPRTLLPKFYGLYCVQSGGKNIRVVVMNNILPRVVKMHLKFDLKGSTYKRRASKKEKEKSFPTYKDLDFMQDMPEGLLLDADTFSALVKTLQRDCLVLESFKIMDYSLLLGVHNIDQHERERQAQGAQSTSDEKRPVGQKALYSTAMESIQGGAARGEAIESDDTMGGIPAVNGRGERLLLHIGIIDILQSYRFIKKLEHTWKALVHDGDTVSVHRPSFYAERFFKFMSNTVFRKNSSLKSSPSKKGRGGALLAVKPLGPTAAFSASQIPSEREEAQYDLRGARSYPTLEDEGRPDLLPCTPPSFEEATTASIATTLSSTSLSIPERSPSETSEQPRYRRRTQSSGQDGRPQEEPPAEEDLQQITVQVEPACSVEIVVPKEEDAGVEASPAGASAAVEVETASQASDEEGAPASQASDEEDAPATDIYFPTDERSWVYSPLHYSAQAPPASDGESDT

SEQ ID NO: 33482 - protein, 640 aa, Homo sapiens
  ENSP00000445992
MELEVPDEAESAEAGAVPSEAAWAAESGAAAGLAQKKAAPTEVLSMTAQPGPGHGKKLGHRGVDASGETTYKKTTSSTLKGAIQLGIGYTVGHLSSKPERDVLMQDFYVVESIFFPSEGSNLTPAHHFQDFRFKTYAPVAFRYFRELFGIRPDDYLYSLCNEPLIELSNPGASGSLFYVTSDDEFIIKTVMHKEAEFLQKLLPGYYMNLNQNPRTLLPKFYGLYCVQSGGKNIRVVVMNNILPRVVKMHLKFDLKGSTYKRRASKKEKEKSFPTYKDLDFMQDMPEGLLLDADTFSALVKTLQRDCLVLESFKIMDYSLLLGVHNIDQHERERQAQGAQSTSDEKRPVGQKALYSTAMESIQGGAARGEAIESDDTMGGIPAVNGRGERLLLHIGIIDILQSYRFIKKLEHTWKALVHDGDTVSVHRPSFYAERFFKFMSNTVFRKNSSLKSSPSKKGRGGALLAVKPLGPTAAFSASQIPSEREEAQYDLRGARSYPTLEDEGRPDLLPCTPPSFEEATTASIATTLSSTSLSIPERSPSETSEQPRYRRRTQSSGQDGRPQEEPPAEEDLQQITVQVEPACSVEIVVPKEEDAGVEASPAGASAAVEVETASQASDEEGAPASQASDEEDAPATDIYF

SEQ ID NO: 33483 - protein, 707 aa, Homo sapiens
  ENSP00000466363
MELEVPDEAESAEAGAVPSEAAWAAESGAAAGLAQKKAAPTEVLSMTAQPGPGHGKKLGHRGVDASGETTYKKTTSSTLKGAIQLGIGYTVGHLSSKPERDVLMQDFYVVESIFFPSEGSNLTPAHHFQDFRFKTYAPVAFRYFRELFGIRPDDYLYSLCNEPLIELSNPGASGSLFYVTSDDEFIIKTVMHKEAEFLQKLLPGYYMNLNQNPRTLLPKFYGLYCVQSGGKNIRVVVMNNILPRVVKMHLKFDLKGSTYKRRASKKEKEKSFPTYKDLDFMQDMPEGLLLDADTFSALVKTLQRDCLVLESFKIMDYSLLLGVHNIDQHERERQAQGAQSTSDEKRPVGQKALYSTAMESIQGGAARGEAIESDDTMGGIPAVNGRGERLLLHIGIIDILQSYRFIKKLEHTWKALVHDGDTVSVHRPSFYAERFFKFMSNTVFRKNSSLKSSPSKKGRGGALLAVKPLGPTAAFSASQIPSEREEAQYDLRGARSYPTLEDEGRPDLLPCTPPSFEEATTASIATTLSSTSLSIPERSPSETSEQPRYRRRTQSSGQDGRPQEEPPAEEDLQQITVQVEPACSVEIVVPKEEDAGVEASPAGASAAVEVETASQASDEEGAPASQASDEEDAPATDIYFFTDGRYWIYSPRHRRLRAVTLSASGTVSDRSRPPWGEGAVPLGQQGAAGPRPEAQCLTSVVFQKGFG

SEQ ID NO: 33484 - protein, 700 aa, Homo sapiens
  ENSP00000444779
MELEVPDEAESAEAGAVPSEAAWAAESGAAAGLAQKKAAPTEVLSMTAQPGPGHGKKLGHRGVDASGETTYKKTTSSTLKGAIQLGIGYTVGHLSSKPERDVLMQDFYVVESIFFPSEGSNLTPAHHFQDFRFKTYAPVAFRYFRELFGIRPDDYLYSLCNEPLIELSNPGASGSLFYVTSDDEFIIKTVMHKEAEFLQKLLPGYYMNLNQNPRTLLPKFYGLYCVQSGGKNIRVVVMNNILPRVVKMHLKFDLKGSTYKRRASKKEKEKSFPTYKDLDFMQDMPEGLLLDADTFSALVKTLQRDCLVLESFKIMDYSLLLGVHNIDQHERERQAQGAQSTSDEKRPVGQKALYSTAMESIQGGAARGEAIESDDTMGGIPAVNGRGERLLLHIGIIDILQSYRFIKKLEHTWKALVHDGDTVSVHRPSFYAERFFKFMSNTVFRKNSSLKSSPSKKGRGGALLAVKPLGPTAAFSASQIPSEREEAQYDLRGARSYPTLEDEGRPDLLPCTPPSFEEATTASIATTLSSTSLSIPERSPSETSEQPRYRRRTQSSGQDGRPQEEPPAEEDLQQITVQVEPACSVEIVVPKEEDAGVEASPAGASAAVEVETASQASDEEGAPASQASDEEDAPATDIYFWRLWGPHAPTWPWRREGRAACLCPYPPHVVTPFPGTGLCASWSPDGTGGLGAMSCCVSVS

SEQ ID NO: 33485 - protein, 390 aa, Homo sapiens
  ENSP00000317721
MAAQKDLWDAIVIGAGIQGCFTAYHLAKHRKRILLLEQFFLPHSRGSSHGQSRIIRKAYLEDFYTRMMHECYQIWAQLEHEAGTQLHRQTGLLLLGMKENQELKTIQANLSRQRVEHQCLSSEELKQRFPNIRLPRGEVGLLDNSGGVIYAYKALRALQDAIRQLGGIVRDGEKVVEINPGLLVTVKTTSRSYQAKSLVITAGPWTNQLLRPLGIEMPLQTLRINVCYWREMVPGSYGVSQAFPCFLWLGLCPHHIYGLPTGEYPGLMKVSYHHGNHADPEERDCPTARTDIGDVQILSSFVRDHLPDLKPEPAVIESCMYTNTPDEQFILDRHPKYDNIVIGAGFSGHGFKLAPVVGKILYELSMKLTPSYDLAPFRISRFPSLGKAHL

SEQ ID NO: 33486 - protein, 153 aa, Homo sapiens
  ENSP00000465428
MMHECYQIWAQLEHEAGTQLHRQTGLLLLGMKENQELKTIQANLSRQRVEHQCLSSEELKQRFPNIRLPRGEVGLLDNSGGVIYAYKALRALQDAIRQLGGIVRDGEKVVEINPGLLVTVKTTSRSYQAKSLVITAGPWTNQLLRPLGIEMPL

SEQ ID NO: 33487 - protein, 204 aa, Homo sapiens
  ENSP00000465329
MMHECYQIWAQLEHEAGTQLHRQTGLLLLGMKENQELKTIQANLSRQRVEHQCLSSEELKQRFPNIRLPRGEVGLLDNSGGVIYAYKALRALQDAIRQLGGIVRDGEKVVEINPGLLVTVKTTSRSYQAKSLVITAGPWTNQLLRPLGIEMPLQTLRINVCYWREMVPGSYGVSQAFPCFLWLGLCPHHIYGLPTGEYPGLMKV

SEQ ID NO: 33488 - protein, 938 aa, Homo sapiens
  ENSP00000407882
MAKAGRAGGPPPGGGAPWHLRNVLSDSVESSDDEFFDARGEGTAPCTSSILQEKQRELYRVSLRRQRFPAQGSIEIHEDSEEGCPQRSCKTHVLLLVLHGGNILDTGAGDPSCKAADIHTFSSVLEKVTRAHFPAALGHILIKFVPCPAICSEAFSLVSHLNPYSHDEGCLSSSQDHVPLAALPLLAISSPQYQDAVATVIERANQVYREFLKSSDGIGFSGQVCLIGDCVGGLLAFDAICYSAGPSGDSPASSSRKGSISSTQDTPVAVEEDCSLASSKRLSKSNIDISSGLEDEEPKRPLPRKQSDSSTYDCEAITQHHAFLSSIHSSVLKDESETPAAGGPQLPEVSLGRFDFDVSDFFLFGSPLGLVLAMRRTVLPGLDGFQVRPACSQVYSFFHCADPSASRLEPLLEPKFHLVPPVSVPRYQRFPLGDGQSLLLADALHTHSPLFLEGSSRDSPPLLDAPASPPQASRFQRPGRRMSEGSSHSESSESSDSMAPVGASRITAKWWGSKRIDYALYCPDVLTAFPTVALPHLFHASYWESTDVVAFILRQVMRYESVNIKESARLDPAALSPANPREKWLRKRTQVKLRNVTANHRANDVIAAEDGPQVLVGRFMYGPLDMVALTGEKVDILVMAEPSSGRWVHLDTEITNSSGRITYNVPRPRRLGVGVYPVKMVVRGDQTCAMSYLTVLPRGMECVVFSIDGSFAASVSIMGSDPKVRPGAVDVVRHWQDLGYMILYITGRPDMQKQRVVSWLSQHNFPQGMIFFSDGLVHDPLRQKAIFLRNLMQECFIKISAAYGSTKDISVYSVLGLPASQIFIVGRPTKKYQTQCQFLSEGYAAHLAALEASHRSRPKKNNSRMILRKGSFGLHAQPEFLRKRNHLRRTMSVQQPDPPAANPKPERAQSQPESDKDHERPLPALSWARGPPKFESVP

SEQ ID NO: 33489 - protein, 974 aa, Homo sapiens
  ENSP00000262483
MAKAGRAGGPPPGGGAPWHLRNVLSDSVESSDDEFFDAREEMAEGKNAILIGMSQWNSNDLVEQIETMGKLDEHQGEGTAPCTSSILQEKQRELYRVSLRRQRFPAQGSIEIHEDSEEGCPQRSCKTHVLLLVLHGGNILDTGAGDPSCKAADIHTFSSVLEKVTRAHFPAALGHILIKFVPCPAICSEAFSLVSHLNPYSHDEGCLSSSQDHVPLAALPLLAISSPQYQDAVATVIERANQVYREFLKSSDGIGFSGQVCLIGDCVGGLLAFDAICYSAGPSGDSPASSSRKGSISSTQDTPVAVEEDCSLASSKRLSKSNIDISSGLEDEEPKRPLPRKQSDSSTYDCEAITQHHAFLSSIHSSVLKDESETPAAGGPQLPEVSLGRFDFDVSDFFLFGSPLGLVLAMRRTVLPGLDGFQVRPACSQVYSFFHCADPSASRLEPLLEPKFHLVPPVSVPRYQRFPLGDGQSLLLADALHTHSPLFLEGSSRDSPPLLDAPASPPQASRFQRPGRRMSEGSSHSESSESSDSMAPVGASRITAKWWGSKRIDYALYCPDVLTAFPTVALPHLFHASYWESTDVVAFILRQVMRYESVNIKESARLDPAALSPANPREKWLRKRTQVKLRNVTANHRANDVIAAEDGPQVLVGRFMYGPLDMVALTGEKVDILVMAEPSSGRWVHLDTEITNSSGRITYNVPRPRRLGVGVYPVKMVVRGDQTCAMSYLTVLPRGMECVVFSIDGSFAASVSIMGSDPKVRPGAVDVVRHWQDLGYMILYITGRPDMQKQRVVSWLSQHNFPQGMIFFSDGLVHDPLRQKAIFLRNLMQECFIKISAAYGSTKDISVYSVLGLPASQIFIVGRPTKKYQTQCQFLSEGYAAHLAALEASHRSRPKKNNSRMILRKGSFGLHAQPEFLRKRNHLRRTMSVQQPDPPAANPKPERAQSQPESDKDHERPLPALSWARGPPKFESVP

SEQ ID NO: 33490 - protein, 116 aa, Homo sapiens
  ENSP00000458901
  MOD_RES (1)..(1): Any amino acid
XGDQTCAMSYLTVLPRGMECVVFSIDGSFAASVSIMGSDPKVRPGAVDVVRHWQDLGYMILYITGRPDMQKQRVVSWLSQHNFPQGMIFFSDGLVHDPLRQKAIFLRNLMQEMCFP

SEQ ID NO: 33491 - protein, 861 aa, Homo sapiens
  ENSP00000245255
MTGRARARARGRARGQETAQLVGSTASQQPGYIQPRPQPPPAEGELFGRGRQRGTAGGTAKSQGLQISAGFQELSLAERGGRRRDFHDLGVNTRQNLDHVKESKTGSSGIIVRLSTNHFRLTSRPQWALYQYHIDYNPLMEARRLRSALLFQHEDLIGKCHAFDGTILFLPKRLQQKVTEVFSKTRNGEDVRITITLTNELPPTSPTCLQFYNIIFRRLLKIMNLQQIGRNYYNPNDPIDIPSHRLVIWPGFTTSILQYENSIMLCTDVSHKVLRSETVLDFMFNFYHQTEEHKFQEQVSKELIGLVVLTKYNNKTYRVDDIDWDQNPKSTFKKADGSEVSFLEYYRKQYNQEITDLKQPVLVSQPKRRRGPGGTLPGPAMLIPELCYLTGLTDKMRNDFNVMKDLAVHTRLTPEQRQREVGRLIDYIHKNDNVQRELRDWGLSFDSNLLSFSGRILQTEKIHQGGKTFDYNPQFADWSKETRGAPLISVKPLDNWLLIYTRRNYEAANSLIQNLFKVTPAMGMQMRKAIMIEVDDRTEAYLRVLQQKVTADTQIVVCLLSSNRKDKYDAIKKYLCTDCPTPSQCVVARTLGKQQTVMAIATKIALQMNCKMGGELWRVDIPLKLVMIVGIDCYHDMTAGRRSIAGFVASINEGMTRWFSRCIFQDRGQELVDGLKVCLQAALRAWNSCNEYMPSRIIVYRDGVGDGQLKTLVNYEVPQFLDCLKSIGRGYNPRLTVIVVKKRVNTRFFAQSGGRLQNPLPGTVIDVEVTRPEWYDFFIVSQAVRSGSVSPTHYNVIYDNSGLKPDHIQRLTYKLCHIYYNWPGVIRVPAPCQYAHKLAFLVGQSIHREPNLSLSNRLYYL

SEQ ID NO: 33492 - protein, 165 aa, Homo sapiens
  ENSP00000442086
MTGRARARARGRARGQETAQLVGSTASQQPGYIQPRPQPPPAEGELFGRGRQRGTAGGTAKSQGLQISAGFQELSLAERGGRRRDFHDLGVNTRQNLDHVKESKTGSSGIIVRLSTNHFRLTSRPQWALYQYHIDYNPLMEARRLRSALLFQHEDLIGKCHAFDG

SEQ ID NO: 33493 - protein, 122 aa, Homo sapiens
  ENSP00000440677
MTGRARARARGRARGQETAQLVGSTASQQPGYIQPRPQPPPAEGELFGRGRQRGTAGGTAKSQGLQISAGFQELSLAERGGRRRDFHDLGVNTRQNLDHVKESKTGSSGIIVRLSTNHFRLT

SEQ ID NO: 33494 - protein, 150 aa, Homo sapiens
  ENSP00000439096
MTGRARARARGRARGQETAQLVGSTASQQPGYIQPRPQPPPAEGELFGRGRQRGTAGGTAKSQGLQISAGFQELSLAERGGRRRDFHDLGVNTRQNLDHVKESKTGSSGIIVRLSTNHFRLTSRPQWALYQYHIDYNPLMEARRLRSALL

SEQ ID NO: 33495 - protein, 117 aa, Homo sapiens
  ENSP00000444353
MTGRARARARGRARGQETAQLVGSTASQQPGYIQPRPQPPPAEGELFGRGRQRGTAGGTAKSQGLQISAGFQELSLAERGGRRRDFHDLGVNTRQNLDHVKESKTGSSGIIVRLSTN

SEQ ID NO: 33496 - protein, 172 aa, Homo sapiens
  ENSP00000438582
MTGRARARARGRARGQETAQLVGSTASQQPGYIQPRPQPPPAEGELFGRGRQRGTAGGTAKSQGLQISAGFQELSLAERGGRRRDFHDLGVNTRQNLDHVKESKTGSSGIIVRLSTNHFRLTSRPQWALYQYHIDYNPLMEARRLRSALLFQHEDLIGKCHAFDGTILFLPK

SEQ ID NO: 33497 - protein, 861 aa, Homo sapiens; identical to SEQ ID NO: 33491
  ENSP00000481042

SEQ ID NO: 33498 - protein, 829 aa, Homo sapiens
  ENSP00000487688
MTGRARARARGRARGQETAQLVGSTASQQPGYIQPRPQPPPAEGELFGRGRQRGTAGGTAKSQGLQISAGFQELSLAERGGRRRDFHDLGVNTRQNLDHVKESKTGSSGIIVRLSTNHFRLTSRPQWALYQYHIDYNPLMEARRLRSALLFQHEDLIGKCHAFDGTILFLPKRLQQKVTEVFSKTRNGEDVRITITLTNELPPTSPTCLQFYNIIFRRLLKIMNLQQIGRNYYNPNDPIDIPSHRLVIWPGFTTSILQYENSIMLCTDVSHKVLRSETVLDFMFNFYHQTEEHKFQEQVSKELIGLVVLTKYNNKTYRVDDIDWDQNPKSTFKKADGSEVSFLEYYRKQYNQEITDLKQPVLVSQPKRRRGPGGTLPGPAMLIPELCYLTGLTDKMRNDFNVMKDLAVHTRLTPEQRQREVGRLIDYIHKNDNVQRELRDWGLSFDSNLLSFSGRILQTEKIHQGGKTFDYNPQFADWSKETRGAPLISVKPLDNWLLIYTRRNYEAANSLIQNLFKVTPAMGMQMRKAIMIEVDDRTEAYLRVLQQKVTADTQIVVCLLSSNRKDKYDAIKKYLCTDCPTPSQCVVARTLGKQQTVMAIATKIALQMNCKMGGELWRVDIPLKLVMIVGIDCYHDMTAGRRSIAGFVASINEGMTRWFSRCIFQDRGQELVDGLKVCLQAALRAWNSCNEYMPSRIIVYRDGVGDGQLKTLVNYEVPQFLDCLKSIGRGYNPRLTVIVVKKRVNTRFFAQSGGRLQNPLPGTVIDVEVTRPEWYDFFIVSQAVRSGSVSPTHYNVIYDNSGLKPDHIQRLTYKLCHIYYNWPVSASTC

SEQ ID NO: 33499 - protein, 165 aa, Homo sapiens; identical to SEQ ID NO: 33492
  ENSP00000487799

SEQ ID NO: 33500 - protein, 122 aa, Homo sapiens; identical to SEQ ID NO: 33493
  ENSP00000487920

SEQ ID NO: 33501 - protein, 150 aa, Homo sapiens; identical to SEQ ID NO: 33494
  ENSP00000488716

SEQ ID NO: 33502 - protein, 117 aa, Homo sapiens; identical to SEQ ID NO: 33495
  ENSP00000488677

SEQ ID NO: 33503 - protein, 172 aa, Homo sapiens; identical to SEQ ID NO: 33496
  ENSP00000488197

SEQ ID NO: 33504 - protein, 805 aa, Homo sapiens
  ENSP00000325296
MNAVGSPEGQELQKLGSGAWDNPAYSGPPSPHGTLRVCTISSTGPLQPQPKKPEDEPQETAYRTQVSSCCLHICQGIRGLWGTTLTENTAENRELYIKTTLRELLVYIVFLVDICLLTYGMTSSSAYYYTKVMSELFLHTPSDTGVSFQAISSMADFWDFAQGPLLDSLYWTKWYNNQSLGHGSHSFIYYENMLLGVPRLRQLKVRNDSCVVHEDFREDILSCYDVYSPDKEEQLPFGPFNGTAWTYHSQDELGGFSHWGRLTSYSGGGYYLDLPGSRQGSAEALRALQEGLWLDRGTRVVFIDFSVYNANINLFCVLRLVVEFPATGGAIPSWQIRTVKLIRYVSNWDFFIVGCEVIFCVFIFYYVVEEILELHIHRLRYLSSIWNILDLVVILLSIVAVGFHIFRTLEVNRLMGKLLQQPNTYADFEFLAFWQTQYNNMNAVNLFFAWIKIFKYISFNKTMTQLSSTLARCAKDILGFAVMFFIVFFAYAQLGYLLFGTQVENFSTFIKCIFTQFRIILGDFDYNAIDNANRILGPAYFVTYVFFVFFVLLNMFLAIINDTYSEVKEELAGQKDELQLSDLLKQGYNKTLLRLRLRKERVSDVQKVLQGGEQEIQFEDFTNTLRELGHAEHEITELTATFTKFDRDGNRILDEKEQEKMRQDLEEERVALNTEIEKLGRSIVSSPQGKSGPEAARAGGWVSGEEFYMLTRRVLQLETVLEGVVSQIDAVGSKLKMLERKGWLAPSPGVKEQAIWKHPQPAPAVTPDPWGVQGGQESEVPYKREEEALEERRLSRGEIPTLQRS

SEQ ID NO: 33505 - protein, 62 aa, Homo sapiens
  ENSP00000434019
  MOD_RES (1)..(1): Any amino acid
XPLQPQPKKPEDEPQETAYRTQVSSCCLHICQGIREVPYKREEEALEERRLSRGEIPTLQRS

SEQ ID NO: 33506 - protein, 39 aa, Homo sapiens
  ENSP00000436514
  MOD_RES (1)..(1): Any amino acid
XEPQETAYRTQVSSCCLHICQGIRGISPMPLRTLGNNPD

SEQ ID NO: 33507 - protein, 71 aa, Homo sapiens
  ENSP00000434224
MNAVGSPEGQELQKLGSGAWDNPAYSGPPSPHGTLRVCTISSTGPLQPQPKKPEDEPQETAYRTQDFGEQP

SEQ ID NO: 33508 - protein, 493 aa, Homo sapiens
  ENSP00000294964
MRRRRAAVAAGFCASFLLGSVLNVLFAPGSEPPRPGQSPEPSPAPGPGRRGGRGELARQIRARYEEVQRYSRGGPGPGAGRPERRRLMDLAPGGPGLPRPRPPWARPLSDGAPGWPPAPGPGSPGPGPRLGCAALRNVSGAQYMGSGYTKAVYRVRLPGGAAVALKAVDFSGHDLGSCVREFGVRRGCYRLAAHKLLKEMVLLERLRHPNVLQLYGYCYQDSEDIPDTLTTITELGAPVEMIQLLQTSWEDRFRICLSLGRLLHHLAHSPLGSVTLLDFRPRQFVLVDGELKVTDLDDARVEETPCAGSTDCILEFPARNFTLPCSAQGWCEGMNEKRNLYNAYRFFFTYLLPHSAPPSLRPLLDSIVNATGELAWGVDETLAQLEKVLHLYRSGQYLQNSTASSSTEYQCIPDSTIPQEDYRCWPSYHHGSCLLSVFNLAEAVDVCESHAQCRAFVVTNQTTWTGRQLVFFKTGWSQVVPDPNKTTYVKASG

SEQ ID NO: 33509 - protein, 181 aa, Homo sapiens
  ENSP00000385220
MRRRRAAVAAGFCASFLLGSVLNVLFAPGSEPPRPGQSPEPSPAPGPGRRGGRGELARQIRARYEEAGPRLPAQAPPARARAWAAPRFATCPARSTWAQATPRPCTGSACPAVPRWRSRRWTLAATIWAAACASSGYGGAAIGWRPTSCLRRWCCWSGCGTPTCCSSMATATRTARTSQTP

SEQ ID NO: 33510 - protein, 76 aa, Homo sapiens
  ENSP00000379696
MTDVETTYADFIASGRTGRRNAIHDILVSSASGNSNELALKLAGLDINKTEGEEDAQRSSTEQSGEAQGEAAKSES

SEQ ID NO: 33511 - protein, 76 aa, Homo sapiens; identical to SEQ ID NO: 33510
  ENSP00000336552

SEQ ID NO: 33512 - protein, 76 aa, Homo sapiens; identical to SEQ ID NO: 33510
  ENSP00000430887

SEQ ID NO: 33513 - protein, 568 aa, Homo sapiens
  ENSP00000392855
MLERPPALAMPMPTEGTPPPLSGTPIPVPAYFRHAEPGFSLKRPRGLSRSLPPPPPAKGSIPISRLFPPRTPGWHQLQPRRVSFRGEASETLQSPGYDPSRPESFFQQSFQRLSRLGHGSYGEVFKVRSKEDGRLYAVKRSMSPFRGPKDRARKLAEVGSHEKVGQHPCCVRLEQAWEEGGILYLQTELCGPSLQQHCEAWGASLPEAQVWGYLRDTLLALAHLHSQGLVHLDVKPANIFLGPRGRCKLGDFGLLVELGTAGAGEVQEGDPRYMAPELLQGSYGTAADVFSLGLTILEVACNMELPHGGEGWQQLRQGYLPPEFTAGLSSELRSVLVMMLEPDPKLRATAEALLALPVLRQPRAWGVLWCMAAEALSRGWALWQALLALLCWLWHGLAHPASWLQPLGPPATPPGSPPCSLLLDSSLSSNWDDDSLGPSLSPEAVLARTVGSTSTPRSRCTPRVLTPLRLSPAAEPSAPGLGPAAEAPCCVEQRGFLSRHIPRSFSAFQAAPPKSACNALHLHGHTQPSAFVWSLTCSSHHGRTFEARTKVDPLFKICGGFLTVFADL

SEQ ID NO: 33514 - protein, 480 aa, Homo sapiens
  ENSP00000397739
MLERPPALAMPMPTEGTPPPLSGTPIPVPAYFRHAEPGFSLKRPRGLSRSLPPPPPAKGSIPISRLFPPRTPGWHQLQPRRVSFRGEASETLQSPGYDPSRPESFFQQSFQRLSRLGHGSYGEVFKVRSKEDGRLYAVKRSMSPFRGPKDRARKLAEVGSHEKVGQHPCCVRLEQAWEEGGILYLQTELCGPSLQQHCEAWGASLPEAQVWGYLRDTLLALAHLHSQGLVHLDVKPANIFLGPRGRCKLGDFGLLVELGTAGAGEVQEGDPRYMAPELLQGSYGTAADVFSLGLTILEVACNMELPHGGEGWQQLRQGYLPPEFTAGLSSELRSVLVMMLEPDPKLRATAEALLALPVLRQPRAWGVLWCMAAEALSRGWALWQALLALLCWLWHGLAHPASWLQPLGPPATPPGSPPCSLLLDSSLSSNWDDDSLGPGHPPCLACPPAGLHSPLRLSWPGLWGAPPPPGAGAHPGMPWT

SEQ ID NO: 33515 - protein, 499 aa, Homo sapiens
  ENSP00000262300
MLERPPALAMPMPTEGTPPPLSGTPIPVPAYFRHAEPGFSLKRPRGLSRSLPPPPPAKGSIPISRLFPPRTPGWHQLQPRRVSFRGEASETLQSPGYDPSRPESFFQQSFQRLSRLGHGSYGEVFKVRSKEDGRLYAVKRSMSPFRGPKDRARKLAEVGSHEKVGQHPCCVRLEQAWEEGGILYLQTELCGPSLQQHCEAWGASLPEAQVWGYLRDTLLALAHLHSQGLVHLDVKPANIFLGPRGRCKLGDFGLLVELGTAGAGEVQEGDPRYMAPELLQGSYGTAADVFSLGLTILEVACNMELPHGGEGWQQLRQGYLPPEFTAGLSSELRSVLVMMLEPDPKLRATAEALLALPVLRQPRAWGVLWCMAAEALSRGWALWQALLALLCWLWHGLAHPASWLQPLGPPATPPGSPPCSLLLDSSLSSNWDDDSLGPSLSPEAVLARTVGSTSTPRSRCTPRDALDLSDINSEPPRGSFPSFEPRNLLSLFEDTLDPT

SEQ ID NO: 33516 - protein, 60 aa, Homo sapiens
  ENSP00000459880
  MOD_RES (1)..(1): Any amino acid
XAEGGPCGRPCLPCSAGSGMGWLTLPAGYSPWARQPPRLAHHPAVCSWTAASPATGMTTA

SEQ ID NO: 33517 - protein, 490 aa, Homo sapiens
  ENSP00000458943
MPMPTEGTPPPLSGTPIPVPAYFRHAEPGFSLKRPRGLSRSLPPPPPAKGSIPISRLFPPRTPGWHQLQPRRVSFRGEASETLQSPGYDPSRPESFFQQSFQRLSRLGHGSYGEVFKVRSKEDGRLYAVKRSMSPFRGPKDRARKLAEVGSHEKVGQHPCCVRLEQAWEEGGILYLQTELCGPSLQQHCEAWGASLPEAQVWGYLRDTLLALAHLHSQGLVHLDVKPANIFLGPRGRCKLGDFGLLVELGTAGAGEVQEGDPRYMAPELLQGSYGTAADVFSLGLTILEVACNMELPHGGEGWQQLRQGYLPPEFTAGLSSELRSVLVMMLEPDPKLRATAEALLALPVLRQPRAWGVLWCMAAEALSRGWALWQALLALLCWLWHGLAHPASWLQPLGPPATPPGSPPCSLLLDSSLSSNWDDDSLGPSLSPEAVLARTVGSTSTPRSRCTPRDALDLSDINSEPPRGSFPSFEPRNLLSLFEDTLDPT

SEQ ID NO: 33518 - protein, 430 aa, Homo sapiens
  ENSP00000460868
MLERWHQLQPRRVSFRGEASETLQSPGYDPSRPESFFQQSFQRLSRLGHGSYGEVFKVRSKEDGRLYAVKRSMSPFRGPKDRARKLAEVGSHEKVGQHPCCVRLEQAWEEGGILYLQTELCGPSLQQHCEAWGASLPEAQVWGYLRDTLLALAHLHSQGLVHLDVKPANIFLGPRGRCKLGDFGLLVELGTAGAGEVQEGDPRYMAPELLQGSYGTAADVFSLGLTILEVACNMELPHGGEGWQQLRQGYLPPEFTAGLSSELRSVLVMMLEPDPKLRATAEALLALPVLRQPRAWGVLWCMAAEALSRGWALWQALLALLCWLWHGLAHPASWLQPLGPPATPPGSPPCSLLLDSSLSSNWDDDSLGPSLSPEAVLARTVGSTSTPRSRCTPRDALDLSDINSEPPRGSFPSFEPRNLLSLFEDTLDPT

SEQ ID NO: 33519 - protein, 490 aa, Homo sapiens; identical to SEQ ID NO: 33517
  ENSP00000459123

SEQ ID NO: 33520 - protein, 447 aa, Homo sapiens
  ENSP00000371675
MPMPTEGTPPPLSGTPIPVPAYFRHAEPGFSLKRPRGLSRSLPPPPPAKGSIPISRLFPPRTPGWHQLQPRRVSFRGEASETLQSPGYDPSRPESFFQQSFQRLSRLGHGSYGEVFKVRSKEDGRLYAVKRSMSPFRGPKDRARKLAEVGSHEKVGQHPCCVRLEQAWEEGGILYLQTELCGPSLQQHCEAWGASLPEAQVWGYLRDTLLALAHLHSQGLVHLDVKPANIFLGPRGRCKLGDFGLLVELGTAGAGEVQEGDPRYMAPELLQGSYGTAADVFSLGLTILEVACNMELPHGGEGWQQLRQGYLPPEFTAGLSSELRSVLVMMLEPDPKLRATAEALLALPVLRQPRAWGVLWCMAAEALSRGWALWQALLALLCWLWHGLAHPASWLQPLGPPATPPGSPPCSLLLDSSLSSNWDDDSLGPCVLKRTEGALECSQMEGL

SEQ ID NO: 33521 - protein, 274 aa, Homo sapiens
  ENSP00000458545
MPMPTEGTPPPLSGTPIPVPAYFRHAEPGFSLKRPRGLSRSLPPPPPAKGSIPISRLFPPRTPGWHQLQPRRVSFRGEASETLQSPGYDPSRPESFFQQSFQRLSRLGHGSYGEVFKVRSKEDGRLYAVKRSMSPFRGPKDRARKLAEVGSHEKVGQHPCCVRLEQAWEEGGILYLQTELCGPSLQQHCEAWGASLPEAQVWGYLRDTLLALAHLHSQGLVHLDVKPANIFLGPRGRCKLGDFGLLVELGTAGAGEVQEGDPRYMAPELLQGSY

SEQ ID NO: 33522 - protein, 215 aa, Homo sapiens
  ENSP00000460598
MLERPPALAMPMPTEGTPPPLSGTPIPVPAYFRHAEPGFSLKRPRGLSRSLPPPPPAKGSIPISRLFPPRTPGWHQLQPRRVSFRGEASETLQSPGYDPSRPESFFQQSFQRLSRLGHGSYGEVFKLLFPPRDTSKRSPGVSAGRPWLLRRWVSTDPARGMEVRSKEDGRLYAVKRSMSPFRGPKDRARKLAEVGSHEKVGQHPCCVRLEQAWEE

SEQ ID NO: 33523 - protein, 169 aa, Homo sapiens
  ENSP00000461330
MLERPPALAMPMPTEGTPPPLSGTPIPVPAYFRHAEPGFSLKRPRGLSRSLPPPPPAKGSIPISRLFPPRTPGWHQLQPRRVSFRGEASETLQSPGYDPSRPESFFQQSFQRLSRLGHGSYGEVFKVRSKEDGRLYAVKRSMSPFRGPKDRARKLAEVGSHEKVGQHPC

SEQ ID NO: 33524 - protein, 147 aa, Homo sapiens
  ENSP00000458842
MLERPPALAMPMPTEGTPPPLSGTPIPVPAYFRHAEPGFSLKRPRGLSRSLPPPPPAKGSIPISRLFPPRTPGWHQLQPRRVSFRGEASETLQSPGYDPSRPESFFQQSFQRLSRLGHGSYGEVFKVRSKEDGRLYAVKRSMSPFRG

SEQ ID NO: 33525 - protein, 50 aa, Homo sapiens
  ENSP00000461628
MLERPPALAMPMPTEGTPPPLSGTPIPVPAYFRHAEPGFSLKRPRGLSRS

SEQ ID NO: 33526 - protein, 472 aa, Homo sapiens
  ENSP00000298282
MMQHASPAPALTMMATQNVPPPPYQDSPQMTATAQPPSKAQAVHISAPSAAASTPVPSAPIDPQAQLEADKRAVYRHPLFPLLTLLFEKCEQATQGSECITSASFDVDIENFVHQQEQEHKPFFSDDPELDNLMVKAIQVLRIHLLELEKVNELCKDFCNRYITCLKTKMHSDNLLRNDLGGPYSPNQPSINLHSQDLLQNSPNSMSGVSNNPQGIVVPASALQQGNIAMTTVNSQVVSGGALYQPVTMVTSQGQVVTQAIPQGAIQIQNTQVNLDLTSLLDNEDKKSKNKRGVLPKHATNIMRSWLFQHLMHPYPTEDEKRQIAAQTNLTLLQVNNWFINARRRILQPMLDASNPDPAPKAKKIKSQHRPTQRFWPNSIAAGVLQQQGGAPGTNPDGSINLDNLQSLSSDSATMAMQQAMMAAHDDSLDGTEEEDEDEMEEEEEEELEEEVDELQTTNVSDLGLEHSDSLE

SEQ ID NO: 33527 - protein, 39 aa, Homo sapiens
  ENSP00000431599
MMQHASPAPALTMMATQNVPPPPYQDSPQMTATAQPPSK

SEQ ID NO: 33528 - protein, 40 aa, Homo sapiens
  ENSP00000434377
MMQHASPAPALTMMATQNVPPPPYQDSPQAPSFPAPDAAV

SEQ ID NO: 33529 - protein, 40 aa, Homo sapiens
  ENSP00000434255
MMQHASPAPALTMMATQNVPPPPYQDSPQMTATAQPPSKA

SEQ ID NO: 33530 - protein, 98 aa, Homo sapiens
  ENSP00000453374
MMQHASPAPALTMMATQNVPPPPYQDSPQMTATAQPPSKAQAVHISAPSAAASTPVPSAPIDPQAQLEADKRAVYRHPLFPLLTLLFEKCEQATQGSE

SEQ ID NO: 33531 - protein, 247 aa, Homo sapiens
  ENSP00000434517
MESWTPRPSAVASGMSWEAGGIRTTSRPEAGVCSLALPSDLQLDRRGAEGPEAERLRAARVQEQVRARLLQLGQQPRHNGAAEPEPEAETARGTSRGQYHTLQAGFSSRSQGLSGDKTSGFRPIAKPAYSPASWSSRSAVDLSCSRRLSSAHNGGSAFGAAGYGGAQPTPPMPTRPVSFHERGGVGSRADYDTLSLRSLRLGPGGLDDRYSLVSEQLEPAATSTYRAFAYERQASSSSSRAGGLDWP

SEQ ID NO: 33532 - protein, 197 aa, Homo sapiens
  ENSP00000435383
MPTRPVSFHERGGVGSRADYDTLSLRSLRLGPGGLDDRYSLVSEQLEPAATSTYRAFAYERQASSSSSRAGGLDWPEATEVSPSRTIRAPAVRTLQRFQSSHRSRGVGGAVPGAVLEPVARAPSVRSLSLSLADSGHLPDVHGFNSYGSHRTLQRLSSGFDDIDLPSAVKYLMASDPNLQVLGAAYIQHKCYSDAAA

SEQ ID NO: 33533 - protein, 120 aa, Homo sapiens
  ENSP00000435522
MPTRPVSFHERGGVGSRADYDTLSLRSLRLGPGGLDDRYSLVSEQLEPAATSTYRAFAYERQASSSSSRAGGLDWPEATEVSPSRTIRAPAVRTLQRFQSSHRSRGVGGAVPGAVLEPVA

SEQ ID NO: 33534 - protein, 156 aa, Homo sapiens
  ENSP00000434110
MPTRPVSFHERGGVGSRADYDTLSLRSLRLGPGGLDDRYSLVSEQLEPAATSTYRAFAYERQASSSSSRAGGLDWPEATEVSPSRTIRAPAVRTLQRFQSSHRSRGVGGAVPGAVLEPVARAPSVRSLSLSLADSGHLPDVHGFNSYGSHRTLQRL

SEQ ID NO: 33535 - protein, 797 aa, Homo sapiens
  ENSP00000331678
MQDGNFLLSALQPEAGVCSLALPSDLQLDRRGAEGPEAERLRAARVQEQVRARLLQLGQQPRHNGAAEPEPEAETARGTSRGQYHTLQAGFSSRSQGLSGDKTSGFRPIAKPAYSPASWSSRSAVDLSCSRRLSSAHNGGSAFGAAGYGGAQPTPPMPTRPVSFHERGGVGSRADYDTLSLRSLRLGPGGLDDRYSLVSEQLEPAATSTYRAFAYERQASSSSSRAGGLDWPEATEVSPSRTIRAPAVRTLQRFQSSHRSRGVGGAVPGAVLEPVARAPSVRSLSLSLADSGHLPDVHGFNSYGSHRTLQRLSSGFDDIDLPSAVKYLMASDPNLQVLGAAYIQHKCYSDAAAKKQARSLQAVPRLVKLFNHANQEVQRHATGAMRNLIYDNADNKLALVEENGIFELLRTLREQDDELRKNVTGILWNLSSSDHLKDRLARDTLEQLTDLVLSPLSGAGGPPLIQQNASEAEIFYNATGFLRNLSSASQATRQKMRECHGLVDALVTSINHALDAGKCEDKSVENAVCVLRNLSYRLYDEMPPSALQRLEGRGRRDLAGAPPGEVVGCFTPQSRRLRELPLAADALTFAEVSKDPKGLEWLWSPQIVGLYNRLLQRCELNRHTTEAAAGALQNITAGDRRWAGVLSRLALEQERILNPLLDRVRTADHHQLRSLTGLIRNLSRNARNKDEMSTKVVSHLIEKLPGSVGEKSPPAEVLVNIIAVLNNLVVASPIAARDLLYFDGLRKLIFIKKKRDSPDSEKSSRAASSLLANLWQYNKLHRDFRAKGYRKEDFLGP

SEQ ID NO: 33536 - protein, 212 aa, Homo sapiens
  ENSP00000435478
MQDGNFLLSALQPEAETARGTSRGQYHTLQAGFSSRSQGLSGDKTSGFRPIAKPAYSPASWSSRSAVDLSCSRRLSSAHNGGSAFGAAGYGGAQPTPPMPTRPVSFHERGGVGSRADYDTLSLRSLRLGPGGLDDRYSLVSEQLEPAATSTYRAFAYERQASSSSSRAGGLDWPEATEVSPSRTIRAPAVRTLQRFQSSHRSRGVGGAVPGA

SEQ ID NO: 33537 - protein, 115 aa, Homo sapiens
  ENSP00000436847
  MOD_RES (1)..(1): Any amino acid
XFDGLRKLIFIKKKRDSPDSEKSSRAASSLLANLWQYNKLHRDFRAVRFPSPGQAGTRVQGMGRRGRVSEEAHGRMETRDPERKGPGHTQHTAGGTAGRGPHGQTCTLTLGLSPL

SEQ ID NO: 33538 - protein, 162 aa, Homo sapiens
  ENSP00000320337
MRAPIPEPKPGDLIEIFRPFYRHWAIYVGDGYVVHLAPPSEVAGAGAASVMSALTDKAIVKKELLYDVAGSDKYQVNNKHDDKYSPLPCSKIIQRAEELVGQEVLYKLTSENCEHFVNELRYGVARSDQVRDVIIAASVAGMGLAAMSLIGVMFSRNKRQKQ

SEQ ID NO: 33539 - protein, 27 aa, Homo sapiens
  ENSP00000442576
MSALTDKAIVKKELLYDVAGSDKYQVN

SEQ ID NO: 33540 - protein, 162 aa, Homo sapiens; identical to SEQ ID NO: 33538
  ENSP00000389124

SEQ ID NO: 33541 - protein, 161 aa, Homo sapiens [sequence omitted]

SEQ ID NO: 33542 - protein, 509 aa, Homo sapiens
  ENSP00000215885
MGVQAGLFGMLGFLGVALGGSPALRWYRTSCHLTKAVPGNPLGYLSFLAKDAQGLALIHARWDAHRRLQSCSWEDEPELTAAYGALCAHETAWGSFIHTPGPELQRALATLQSQWEACRALEESPAGARKKRAAGQSGVPGGGHQREKRGWTMPGTLWCGVGDSAGNSSELGVFQGPDLCCREHDRCPQNISPLQYNYGIRNYRFHTISHCDCDTRFQQCLQNQHDSISDIVGVAFFNVLEIPCFVLEEQEACVAWYWWGGCRMYGTVPLARLQPRTFYNASWSSRATSPTPSSRSPAPPKPRQKQHLRKGPPHQKGSKRPSKANTTALQDPMVSPRLDVAPTGLQGPQGGLKPQGARWVCRSFRRHLDQCEHQIGPREIEFQLLNSAQEPLFHCNCTRRLARFLRLHSPPEVTNMLWELLGTTCFKLAPPLDCVEGKNCSRDPRAIRVSARHLRRLQQRRHQLQDKGTDERQPWPSEPLRGPMSFYNQCLQLTQAARRPDRQQKSWSQ

SEQ ID NO: 33543 - protein, 749 aa, Homo sapiens
  ENSP00000356436
MSFIDPYQHIIVEHQYSHKFTVVVLRATKVTKGAFGDMLDTPDPYVELFISTTPDSRKRTRHFNNDINPVWNETFEFILDPNQENVLEITLMDANYVMDETLGTATFTVSSMKVGEKKEVPFIFNQVTEMVLEMSLEVCSCPDLRFSMALCDQEKTFRQQRKEHIRESMKKLLGPKNSEGLHSARDVPVVAILGSGGGFRAMVGFSGVMKALYESGILDCATYVAGLSGSTWYMSTLYSHPDFPEKGPEEINEELMKNVSHNPLLLLTPQKVKRYVESLWKKKSSGQPVTFTDIFGMLIGETLIHNRMNTTLSSLKEKVNTAQCPLPLFTCLHVKPDVSELMFADWVEFSPYEIGMAKYGTFMAPDLFGSKFFMGTVVKKYEENPLHFLMGVWGSAFSILFNRVLGVSGSQSRGSTMEEELENITTKHIVSNDSSDSDDESHEPKGTENEDAGSDYQSDNQASWIHRMIMALVSDSALFNTREGRAGKVHNFMLGLNLNTSYPLSPLSDFATQDSFDDDELDAAVADPDEFERIYEPLDVKSKKIHVVDSGLTFNLPYPLILRPQRGVDLIISFDFSARPSDSSPPFKELLLAEKWAKMNKLPFPKIDPYVFDREGLKECYVFKPKNPDMEKDCPTIIHFVLANINFRKYRAPGVPRETEEEKEIADFDIFDDPESPFSTFNFQYPNQAFKRLHDLMHFNTLNNIDVIKEAMVESIEYRRQNPSRCSVSLSNVEARRFFNKEFLSKPKA

SEQ ID NO: 33544 - protein, 868 aa, Homo sapiens
  ENSP00000382434
MSLQASEGCPGLGTNVFVPQSPQTDEEGSRSGRSFSEFEDTQDLDTPGLPPFCPMAPWGSEEGLSPCHLLTVRVIRMKNVRQADMLSQTDCFVSLWLPTASQKKLRTRTISNCPNPEWNESFNFQIQSRVKNVLELSVCDEDTVTPDDHLLTVLYDLTKLCFRKKTHVKFPLNPQGMEELEVEFLLEESPSPPETLVTNGVLVSRQVSCLEVHAQSRRRRKREKMKDLLVMVNESFENTQRVRPCLEPCCPTSACFQTAACFHYPKYFQSQVHVEVPKSHWSCGLCCRSRKKGPISQPLDCLSDGQVMTLPVGESYELHMKSTPCPETLDVRLGFSLCPAELEFLQKRKVVVAKALKQVLQLEEDLQEDEVPLIAIMATGGGTRSMTSMYGHLLGLQKLNLLDCASYITGLSGATWTMATLYRDPDWSSKNLEPAIFEARRHVVKDKLPSLFPDQLRKFQEELRQRSQEGYRVTFTDFWGLLIETCLGDERNECKLSDQRAALSCGQNPLPIYLTINVKDDVSNQDFREWFEFSPYEVGLQKYGAFIPSELFGSEFFMGRLVKRIPESRICYMLGLWSSIFSLNLLDAWNLSHTSEEFFHRWTREKVQDIEDEPILPEIPKCDANILETTVVIPGSWLSNSFREILTHRSFVSEFHNFLSGLQLHTNYLQNGQFSRWKDTVLDGFPNQLTESANHLCLLDTAFFVNSSYPPLLRPERKADLIIHLNYCAGSQTKPLKQTCEYCTVQNIPFPKYELPDENENLKECYLMENPQEPDAPIVTFFPLINDTFRKYKAPGVERSPEELEQGQVDIYGPKTPYATKELTYTEATFDKLVKLSEYNILNNKDTLLQALRLAVEKKKRLKGQCPS

SEQ ID NO: 33545 - protein, 138 aa, Homo sapiens
  ENSP00000364249
MKGLLPLAWFLACSVPAVQGGLLDLKSMIEKVTGKNALTNYGFYGCYCGWGGRGTPKDGTDWCCWAHDHCYGRLEEKGCNIRTQSYKYRFAWGVVTCEPGPFCHVNLCACDRKLVYCLKRNLRSYNPQYQYFPNILCS

SEQ ID NO: 33546 - protein, 441 aa, Homo sapiens
  ENSP00000274793
MVPPKLHVLFCLCGCLAVVYPFDWQYINPVAHMKSSAWVNKIQVLMAAASFGQTKIPRGNGPYSVGCTDLMFDHTNKGTFLRLYYPSQDNDRLDTLWIPNKEYFWGLSKFLGTHWLMGNILRLLFGSMTTPANWNSPLRPGEKYPLVVFSHGLGAFRTLYSAIGIDLASHGFIVAAVEHRDRSASATYYFKDQSAAEIGDKSWLYLRTLKQEEETHIRNEQVRQRAKECSQALSLILDIDHGKPVKNALDLKFDMEQLKDSIDREKIAVIGHSFGGATVIQTLSEDQRFRCGIALDAWMFPLGDEVYSRIPQPLFFINSEYFQYPANIIKMKKCYSPDKERKMITIRGSVHQNFADFTFATGKIIGHMLKLKGDIDSNVAIDLSNKASLAFLQKHLGLHKDFDQWDCLIEGDDENLIPGTNINTTNQHIMLQNSSGIEKYN

SEQ ID NO: 33547 - protein, 441 aa, Homo sapiens; identical to SEQ ID NO: 33546
  ENSP00000445666

SEQ ID NO: 33548 - protein, 500 aa, Homo sapiens
  ENSP00000325546
MATVIPGDLSEVRDTQKVPSGKRKRGETKPRKNFPCQLCDKAFNSVEKLKVHSYSHTGERPYKCIQQDCTKAFVSKYKLQRHMATHSPEKTHKCNYCEKMFHRKDHLKNHLHTHDPNKETFKCEECGKNYNTKLGFKRHLALHAATSGDLTCKVCLQTFESTGVLLEHLKSHAGKSSGGVKEKKHQCEHCDRRFYTRKDVRRHMVVHTGRKDFLCQYCAQRFGRKDHLTRHMKKSHNQELLKVKTEPVDFLDPFTCNVSVPIKDELLPVMSLPSSELLSKPFTNTLQLNLYNTPFQSMQSSGSAHQMITTLPLGMTCPIDMDTVHPSHHLSFKYPFSSTSYAISIPEKEQPLKGEIESYLMELQGGVPSSSQDSQASSSSKLGLDPQIGSLDDGAGDLSLSKSSISISDPLNTPALDFSQLFNFIPLNGPPYNPLSVGSLGMSYSQEEAHSSVSQLPPQTQDLQDPANTIGLGSLHSLSAAFTSSLSTSTTLPRFHQAFQ

SEQ ID NO: 33549 - protein, 418 aa, Homo sapiens
  ENSP00000404067
MATHSPEKTHKCNYCEKMFHRKDHLKNHLHTHDPNKETFKCEECGKNYNTKLGFKRHLALHAATSGDLTCKVCLQTFESTGVLLEHLKSHAGKSSGGVKEKKHQCEHCDRRFYTRKDVRRHMVVHTGRKDFLCQYCAQRFGRKDHLTRHMKKSHNQELLKVKTEPVDFLDPFTCNVSVPIKDELLPVMSLPSSELLSKPFTNTLQLNLYNTPFQSMQSSGSAHQMITTLPLGMTCPIDMDTVHPSHHLSFKYPFSSTSYAISIPEKEQPLKGEIESYLMELQGGVPSSSQDSQASSSSKLGLDPQIGSLDDGAGDLSLSKSSISISDPLNTPALDFSQLFNFIPLNGPPYNPLSVGSLGMSYSQEEAHSSVSQLPPQTQDLQDPANTIGLGSLHSLSAAFTSSLSTSTTLPRFHQAFQ

SEQ ID NO: 33550 - protein, 500 aa, Homo sapiens; identical to SEQ ID NO: 33548
  ENSP00000416537

SEQ ID NO: 33551 - protein, 562 aa, Homo sapiens
  ENSP00000392045
MDAMKRGLCCVLLLCGAVFVSPSQEIHARFRRGARSYQVICRDEKTQMIYQQHQSWLRPVLRSNRVEYCWCNSGRAQCHSVPVKSCSEPRCFNGGTCQQALYFSDFVCQCPEGFAGKCCEIDTRATCYEDQGISYRGTWSTAESGAECTNWNSSALAQKPYSGRRPDAIRLGLGNHNYCRNPDRDSKPWCYVFKAGKYSSEFCSTPACSEGNSDCYFGNGSAYRGTHSLTESGASCLPWNSMILIGKVYTAQNPSAQALGLGKHNYCRNPDGDAKPWCHVLKNRRLTWEYCDVPSCSTCGLRQYSQPQFRIKGGLFADIASHPWQAAIFAKHRRSPGERFLCGGILISSCWILSAAHCFQERFPPHHLTVILGRTYRVVPGEEEQKFEVEKYIVHKEFDDDTYDNDIALLQLKSDSSRCAQESSVVRTVCLPPADLQLPDWTECELSGYGKHEALSPFYSERLKEAHVRLYPSSRCTSQHLLNRTVTDNMLCAGDTRSGGPQANLHDACQGDSGGPLVCLNDGRMTLVGIISWGLGCGQKDVPGVYTKVTNYLDWIRDNMRP

SEQ ID NO: 33552 - protein, 562 aa, Homo sapiens; identical to SEQ ID NO: 33551
  ENSP00000220809

SEQ ID NO: 33553 - protein, 516 aa, Homo sapiens
  ENSP00000270188
MDAMKRGLCCVLLLCGAVFVSPSQEIHARFRRGARSYQGCSEPRCFNGGTCQQALYFSDFVCQCPEGFAGKCCEIDTRATCYEDQGISYRGTWSTAESGAECTNWNSSALAQKPYSGRRPDAIRLGLGNHNYCRNPDRDSKPWCYVFKAGKYSSEFCSTPACSEGNSDCYFGNGSAYRGTHSLTESGASCLPWNSMILIGKVYTAQNPSAQALGLGKHNYCRNPDGDAKPWCHVLKNRRLTWEYCDVPSCSTCGLRQYSQPQFRIKGGLFADIASHPWQAAIFAKHRRSPGERFLCGGILISSCWILSAAHCFQERFPPHHLTVILGRTYRVVPGEEEQKFEVEKYIVHKEFDDDTYDNDIALLQLKSDSSRCAQESSVVRTVCLPPADLQLPDWTECELSGYGKHEALSPFYSERLKEAHVRLYPSSRCTSQHLLNRTVTDNMLCAGDTRSGGPQANLHDACQGDSGGPLVCLNDGRMTLVGIISWGLGCGQKDVPGVYTKVTNYLDWIRDNMRP

SEQ ID NO: 33554 - protein, 499 aa, Homo sapiens
  ENSP00000428886
MDAMKRGLCCVLLLCGAVFVSPSQEIHARFRRGARSYQVICRDEKTQMIYQQHQSWLRPVLRSNRVEYCWCNSGRAQCHSVPVKSCSEPRCFNGGTCQQALYFSDFVCQCPEGFAGKCCEIDSKPWCYVFKAGKYSSEFCSTPACSEGNSDCYFGNGSAYRGTHSLTESGASCLPWNSMILIGKVYTAQNPSAQALGLGKHNYCRNPDGDAKPWCHVLKNRRLTWEYCDVPSCSTCGLRQYSQPQFRIKGGLFADIASHPWQAAIFAKHRRSPGERFLCGGILISSCWILSAAHCFQERFPPHHLTVILGRTYRVVPGEEEQKFEVEKYIVHKEFDDDTYDNDIALLQLKSDSSRCAQESSVVRTVCLPPADLQLPDWTECELSGYGKHEALSPFYSERLKEAHVRLYPSSRCTSQHLLNRTVTDNMLCAGDTRSGGPQANLHDACQGDSGGPLVCLNDGRMTLVGIISWGLGCGQKDVPGVYTKVTNYLDWIRDNMRP

SEQ ID NO: 33555 - protein, 436 aa, Homo sapiens
  ENSP00000407861
MDAMKRGLCCVLLLCGAVFVSPSQEIHARFRRGARSYQVICRDEKTQMIYQQHQSWLRPVLRSNRVEYCWCNSGRAQCHSVPVKRNSDCYFGNGSAYRGTHSLTESGASCLPWNSMILIGKVYTAQNPSAQALGLGKHNYCRNPDGDAKPWCHVLKNRRLTWEYCDVPSCSTCGLRQYSQPQFRIKGGLFADIASHPWQAAIFAKHRRSPGERFLCGGILISSCWILSAAHCFQERFPPHHLTVILGRTYRVVPGEEEQKFEVEKYIVHKEFDDDTYDNDIALLQLKSDSSRCAQESSVVRTVCLPPADLQLPDWTECELSGYGKHEALSPFYSERLKEAHVRLYPSSRCTSQHLLNRTVTDNMLCAGDTRSGGPQANLHDACQGDSGGPLVCLNDGRMTLVGIISWGLGCGQKDVPGVYTKVTNYLDWIRDNMRP

SEQ ID NO: 33556 - protein, 473 aa, Homo sapiens
  ENSP00000429401
MDAMKRGLCCVLLLCGAVFVSPSQEIHARFRRGARSYQVICRDEKTQMIYQQHQSWLRPVLRSNRVEYCWCNSGRAQCHSVPVKSCSEPRCFNGGTCQQALYFSDFVCQCPEGFAGKCCEIGNSDCYFGNGSAYRGTHSLTESGASCLPWNSMILIGKVYTAQNPSAQALGLGKHNYCRNPDGDAKPWCHVLKNRRLTWEYCDVPSCSTCGLRQYSQPQFRIKGGLFADIASHPWQAAIFAKHRRSPGERFLCGGILISSCWILSAAHCFQERFPPHHLTVILGRTYRVVPGEEEQKFEVEKYIVHKEFDDDTYDNDIALLQLKSDSSRCAQESSVVRTVCLPPADLQLPDWTECELSGYGKHEALSPFYSERLKEAHVRLYPSSRCTSQHLLNRTVTDNMLCAGDTRSGGPQANLHDACQGDSGGPLVCLNDGRMTLVGIISWGLGCGQKDVPGVYTKVTNYLDWIRDNMRP

SEQ ID NO: 33557 - protein, 96 aa, Homo sapiens
  ENSP00000429542
  MOD_RES (1)..(1): Any amino acid
XFAGKCCEIDTRATCYEDQGISYRGTWSTAESGAECTNWNSSALAQKPYSGRRPDAIRLGLGNHNYCRTPVPRHWAWANIITAGILMGMPSPGATC

SEQ ID NO: 33558 - protein, 178 aa, Homo sapiens
  ENSP00000428797
MDAMKRGLCCVLLLCGAVFVSPSQEIHARFRRGARSYQVICRDEKTQMIYQQHQSWLRPVLRSNRVEYCWCNSGRAQCHSVPVKSCSEPRCFNGGTCQQALYFSDFVCQCPEGFAGKCCEIDTRATCYEDQGISYRGTWSTAESGAECTNWNSSALAQKPYSGRRPDAIRLGLGNHNY

SEQ ID NO: 33559 - protein, 157 aa, Homo sapiens
  ENSP00000429801
MDAMKRGLCCVLLLCGAVFVSPSQEIHARFRRGARSYQVICRDEKTQMIYQQHQSWLRPVLRSNRVEYCWCNSGRAQCHSVPVKSCSEPRCFNGGTCQQALYFSDFVCQCPEGFAGKCCEIDTRATCYEDQGISYRGTWSTAESGAECTNWNSSALA

SEQ ID NO: 33560 - protein, 1072 aa, Homo sapiens
  ENSP00000490862
MITVVYGPDLVNISHLNLVAFQEEVAKEWTNEVFSLATNLLAQNMSRDAFLEKAYTKLKLQVTPEGRIPLKNIYRLFSADRKRVETALEACSLPSSRNDSIPQEDFTPEVYRVFLNNLCPRPEIDNIFSEFGAKSKPYLTVDQMMDFINLKQRDPRLNEILYPPLKQEQVQVLIEKYEPNNSLARKGQISVDGFMRYLSGEENGVVSPEKLDLNEDMSQPLSHYFINSSHNTYLTAGQLAGNSSVEMYRQVLLSGCRCVELDCWKGRTAEEEPVITHGFTMTTEISFKEVIEAIAECAFKTSPFPILLSFENHVDSPKQQAKMAEYCRLIFGDALLMEPLEKYPLESGVPLPSPMDLMYKILVKNKKKSHKSSEGSGKKKLSEQASNTYSDSSSMFEPSSPGAGEADTESDDDDDDDDCKKSSMDEGTAGSEAMATEEMSNLVNYIQPVKFESFEISKKRNKSFEMSSFVETKGLEQLTKSPVEFVEYNKMQLSRIYPKGTRVDSSNYMPQLFWNAGCQMVALNFQTMDLAMQINMGMYEYNGKSGYRLKPEFMRRPDKHFDPFTEGIVDGIVANTLSVKIISGQFLSDKKVGTYVEVDMFGLPVDTRRKAFKTKTSQGNAVNPVWEEEPIVFKKVVLPTLACLRIAVYEEGGKFIGHRILPVQAIRPGYHYICLRNERNQPLTLPAVFVYIEVKDYVPDTYADVIEALSNPIRYVNLMEQRAKQLAALTLEDEEEVKKEADPGETPSEAPSEARTTPAENGVNHTTTLTPKPPSQALHSQPAPGSVKAPAKTEDLIQSVLTEVEAQTIEELKQQKSFVKLQKKHYKEMKDLVKRHHKKTTDLIKEHTTKYNEIQNDYLRRRAALEKSAKKDSKKKSEPSSPDHGSSTIEQDLAALDAEMTQKLIDLKDKQQQQLLNLRQEQYYSEKYQKREHIKLLIQKLTDVAEECQNNQLKKLKEICEKEKKELKKKMDKKRQEKITEAKSKDKSQMEEEKTEMIRSYIQEVVQYIKRLEEAQSKRQEKLVEKHKEIRQQILDEKPKGEGSSSFLSETCHEDPSVSPNFTPPNPQALKW

SEQ ID NO: 33561 - protein, 960 aa, Homo sapiens
  ENSP00000486301
MITVVYGPDLVNISHLNLVAFQEEVAKEWTNEVFSLATNLLAQNMSRDAFLEKAYTKLKLQVTPEGRIPLKNIYRLFSADRKRVETALEACSLPSSRNDSIPQEDFTPEVYRVFLNNLCPRPEIDNIFSEFGAKSKPYLTVDQMMDFINLKQRDPRLNEILYPPLKQEQVQVLIEKYEPNNSLARKGQISVDGFMRYLSGEENGVVSPEKLDLNEDMSQPLSHYFINSSHNTYLTAGQLAGNSSVEMYRQVLLSGCRCVELDCWKGRTAEEEPVITHGFTMTTEISFKEVIEAIAECAFKTSPFPILLSFENHVDSPKQQAKMAEYCRLIFGDALLMEPLEKYPLESGVPLPSPMDLMYKILVKNKKKSHKSSEGSGKKKLSEQASNTYSDSSSMFEPSSPGAGEADTESDDDDDDDDCKKSSMDEGTAGSEAMATEEMSNLVNYIQPVKFESFEISKKRNKSFEMSSFVETKGLEQLTKSPVEFVEYNKMQLSRIYPKGTRVDSSNYMPQLFWNAGCQMVALNFQTMDLAMQINMGMYEYNGKSGYRLKPEFMRRPDKHFDPFTEGIVDGIVANTLSVKIISGQFLSDKKVGTYVEVDMFGLPVDTRRKAFKTKTSQGNAVNPVWEEEPIVFKKVVLPTLACLRIAVYEEGGKFIGHRILPVQAIRPGYHYICLRNERNQPLTLPAVFVYIEVKDYVPDTYADVIEALSNPIRYVNLMEQRAKQLAALTLEDEEEVKKEADPGETPSEAPSEARTTPAENGVNHTTTLTPKPPSQALHSQPAPGSVKAPAKTEDLIQSVLTEVEAQTIEELKQQKSFVKLQKKHYKEMKDLVKRHHKKTTDLIKEHTTKYNEIQNDYLRRRAALEKSAKKDSKKKSEPSSPDHGSSTIEQDLAALDAEMTQKLIDLKDKQQQQLLNLRQEQYYSEKYQKREHIKLLIQKLTDVAEECQNNQLKKLKEIC

SEQ ID NO: 33562 - protein, 136 aa, Homo sapiens
  ENSP00000486655
MITVVYGPDLVNISHLNLVAFQEEVAKEWTNEVFSLATNLLAQNMSRDAFLEKAYTKLKLQVTPEGRIPLKNIYRLFSADRKRVETALEACSLPSSRNDSIPQEDFTPEVYRVFLNNLCPRPEIDNIFSEFGAKSK

SEQ ID NO: 33563 - protein, 1173 aa, Homo sapiens
  ENSP00000367908
MAGAQPGVHALQLKPVCVSDSLKKGTKFVKWDDDSTIVTPIILRTDPQGFFFYWTDQNKETELLDLSLVKDARCGRHAKAPKDPKLRELLDVGNIGRLEQRMITVVYGPDLVNISHLNLVAFQEEVAKEWTNEVFSLATNLLAQNMSRDAFLEKAYTKLKLQVTPEGRIPLKNIYRLFSADRKRVETALEACSLPSSRNDSIPQEDFTPEVYRVFLNNLCPRPEIDNIFSEFGAKSKPYLTVDQMMDFINLKQRDPRLNEILYPPLKQEQVQVLIEKYEPNNSLARKGQISVDGFMRYLSGEENGVVSPEKLDLNEDMSQPLSHYFINSSHNTYLTAGQLAGNSSVEMYRQVLLSGCRCVELDCWKGRTAEEEPVITHGFTMTTEISFKEVIEAIAECAFKTSPFPILLSFENHVDSPKQQAKMAEYCRLIFGDALLMEPLEKYPLESGVPLPSPMDLMYKILVKNKKKSHKSSEGSGKKKLSEQASNTYSDSSSMFEPSSPGAGEADTESDDDDDDDDCKKSSMDEGTAGSEAMATEEMSNLVNYIQPVKFESFEISKKRNKSFEMSSFVETKGLEQLTKSPVEFVEYNKMQLSRIYPKGTRVDSSNYMPQLFWNAGCQMVALNFQTMDLAMQINMGMYEYNGKSGYRLKPEFMRRPDKHFDPFTEGIVDGIVANTLSVKIISGQFLSDKKVGTYVEVDMFGLPVDTRRKAFKTKTSQGNAVNPVWEEEPIVFKKVVLPTLACLRIAVYEEGGKFIGHRILPVQAIRPGYHYICLRNERNQPLTLPAVFVYIEVKDYVPDTYADVIEALSNPIRYVNLMEQRAKQLAALTLEDEEEVKKEADPGETPSEAPSEARTTPAENGVNHTTTLTPKPPSQALHSQPAPGSVKAPAKTEDLIQSVLTEVEAQTIEELKQQKSFVKLQKKHYKEMKDLVKRHHKKTTDLIKEHTTKYNEIQNDYLRRRAALEKSAKKDSKKKSEPSSPDHGSSTIEQDLAALDAEMTQKLIDLKDKQQQQLLNLRQEQYYSEKYQKREHIKLLIQKLTDVAEECQNNQLKKLKEICEKEKKELKKKMDKKRQEKITEAKSKDKSQMEEEKTEMIRSYIQEVVQYIKRLEEAQSKRQEKLVEKHKEIRQQILDEKPKGEGSSSFLSETCHEDPSVSPNFTPPNPQALKW

SEQ ID NO: 33564 - protein, 1216 aa, Homo sapiens
  ENSP00000338185
MAGAQPGVHALQLKPVCVSDSLKKGTKFVKWDDDSTIVTPIILRTDPQGFFFYWTDQNKETELLDLSLVKDARCGRHAKAPKDPKLRELLDVGNIGRLEQRMITVVYGPDLVNISHLNLVAFQEEVAKEWTNEVFSLATNLLAQNMSRDAFLEKAYTKLKLQVTPEGRIPLKNIYRLFSADRKRVETALEACSLPSSRNDSIPQEDFTPEVYRVFLNNLCPRPEIDNIFSEFGAKSKPYLTVDQMMDFINLKQRDPRLNEILYPPLKQEQVQVLIEKYEPNNSLARKGQISVDGFMRYLSGEENGVVSPEKLDLNEDMSQPLSHYFINSSHNTYLTAGQLAGNSSVEMYRQVLLSGCRCVELDCWKGRTAEEEPVITHGFTMTTEISFKEVIEAIAECAFKTSPFPILLSFENHVDSPKQQAKMAEYCRLIFGDALLMEPLEKYPLESGVPLPSPMDLMYKILVKNKKKSHKSSEGSGKKKLSEQASNTYSDSSSMFEPSSPGAGEADTESDDDDDDDDCKKSSMDEGTAGSEAMATEEMSNLVNYIQPVKFESFEISKKRNKSFEMSSFVETKGLEQLTKSPVEFVEYNKMQLSRIYPKGTRVDSSNYMPQLFWNAGCQMVALNFQTMDLAMQINMGMYEYNGKSGYRLKPEFMRRPDKHFDPFTEGIVDGIVANTLSVKIISGQFLSDKKVGTYVEVDMFGLPVDTRRKAFKTKTSQGNAVNPVWEEEPIVFKKVVLPTLACLRIAVYEEGGKFIGHRILPVQAIRPGYHYICLRNERNQPLTLPAVFVYIEVKDYVPDTYADVIEALSNPIRYVNLMEQRAKQLAALTLEDEEEVKKEADPGETPSEAPSEARTTPAENGVNHTTTLTPKPPSQALHSQPAPGSVKAPAKTEDLIQSVLTEVEAQTIEELKQQKSFVKLQKKHYKEMKDLVKRHHKKTTDLIKEHTTKYNEIQNDYLRRRAALEKSAKKDSKKKSEPSSPDHGSSTIEQDLAALDAEMTQKLIDLKDKQQQQLLNLRQEQYYSEKYQKREHIKLLIQKLTDVAEECQNNQLKKLKEICEKEKKELKKKMDKKRQEKITEAKSKDKSQMEEEKTEMIRSYIQEVVQYIKRLEEAQSKRQEKLVEKHKEIRQQILDEKPKLQVELEQEYQDKFKRLPLEILEFVQEAMKGKISEDSNHGSAPLSLSSDPGKVNHKTPSSEELGGDIPGKEFDTPL

SEQ ID NO: 33565 - protein, 248 aa, Homo sapiens
  ENSP00000486531
MAGAQPGVHALQLKPVCVSDSLKKGTKFVKWDDDSTIVTPIILRTDPQGFFFYWTDQNKETELLDLSLVKDARCGRHAKAPKDPKLRELLDVGNIGRLEQRMITVVYGPDLVNISHLNLVAFQEEVAKEWTNEVFSLATNLLAQNMSRDAFLEKAYTKLKLQVTPEGRIPLKNIYRLFSADRKRVETALEACSLPSSRVEKANEAAKSEQSCGKAPPKHFHLHFIKQNKMLEPACYCFFVRCFGIGKI

SEQ ID NO: 33566 - protein, 178 aa, Homo sapiens
  ENSP00000490455
MAGAQPGVHALQLKPVCVSDSLKKGTKFVKWDDDSTIVTPIILRTDPQGFFFYWTDQNKETELLDLSLVKDARCGRHAKAPKDPKLRELLDVGNIGRLEQRMITVVYGPDLVNISHLNLVAFQEEVAKEWTNEVFSLATNLLAQNMSRDAFLEKAYTKLKLQVTPEGRIPLKNRSEAS

SEQ ID NO: 33567 - protein, 205 aa, Homo sapiens
  ENSP00000384001
MAGAQPGVHALQLKPVCVSDSLKKGTKFVKWDDDSTIVTPIILRTDPQGFFFYWTDQNKETELLDLSLVKDARCGRHAKAPKDPKLRELLDVGNIGRLEQRMITVVYGPDLVNISHLNLVAFQEEVAKEWTNEVFSLATNLLAQNMSRDAFLEKAYTKLKLQVTPEGRIPLKNIYRLFSADRKRVETALEACSLPSSRVSMCVML

SEQ ID NO: 33568 - protein, 1173 aa, Homo sapiens; identical to SEQ ID NO: 33563
  ENSP00000367904

SEQ ID NO: 33569 - protein, 33 aa, Homo sapiens
  ENSP00000490771
  MOD_RES (1)..(1): Any amino acid
XTDPQGFFFYWTDQNKVRNEETELLDLSLVKDA

SEQ ID NO: 33570 - protein, 961 aa, Homo sapiens
  ENSP00000487075
MITVVYGPDLVNISHLNLVAFQEEVAKEWTNEVFSLATNLLAQNMSRDAFLEKAYTKLKLQVTPEGRIPLKNIYRLFSADRKRVETALEACSLPSSRNDSIPQEDFTPEVYRVFLNNLCPRPEIDNIFSEFGAKSKPYLTVDQMMDFINLKQRDPRLNEILYPPLKQEQVQVLIEKYEPNNSLARKGQISVDGFMRYLSGEENGVVSPEKLDLNEDMSQPLSHYFINSSHNTYLTAGQLAGNSSVEMYRQVLLSGCRCVELDCWKGRTAEEEPVITHGFTMTTEISFKEVIEAIAECAFKTSPFPILLSFENHVDSPKQQAKMAEYCRLIFGDALLMEPLEKYPLESGVPLPSPMDLMYKILVKNKKKSHKSSEGSGKKKLSEQASNTYSDSSSMFEPSSPGAGEADTESDDDDDDDDCKKSSMDEGTAGSEAMATEEMSNLVNYIQPVKFESFEISKKRNKSFEMSSFVETKGLEQLTKSPVEFVEYNKMQLSRIYPKGTRVDSSNYMPQLFWNAGCQMVALNFQTMDLAMQINMGMYEYNGKSGYRLKPEFMRRPDKHFDPFTEGIVDGIVANTLSVKIISGQFLSDKKVGTYVEVDMFGLPVDTRRKAFKTKTSQGNAVNPVWEEEPIVFKKVVLPTLACLRIAVYEEGGKFIGHRILPVQAIRPGYHYICLRNERNQPLTLPAVFVYIEVKDYVPDTYADVIEALSNPIRYVNLMEQRAKQLAALTLEDEEEVKKEADPGETPSEAPSEARTTPAENGVNHTTTLTPKPPSQALHSQPAPGSVKAPAKTEDLIQSVLTEVEAQTIEELKQQKSFVKLQKKHYKEMKDLVKRHHKKTTDLIKEHTTKYNEIQNDYLRRRAALEKSAKKDSKKKSEPSSPDHGSSTIEQDLAALDAEMTQKLIDLKDKQQQQLLNLRQEQYYSEKYQKREHIKLLIQKLTDVAEECQNNQLKKLKEICE

SEQ ID NO: 33571 - protein, 26 aa, Homo sapiens
  ENSP00000486428
  MOD_RES (1)..(1): Any amino acid
XADRKRVETALEACSLPSSRALRIWW

SEQ ID NO: 33572 - protein, 914 aa, Homo sapiens
  ENSP00000431704
  MOD_RES (1)..(1): Any amino acid
XILYPPLKQEQVQVLIEKYEPNNSLARKGQISVDGFMRYLSGEENGVVSPEKLDLNEDMSQPLSHYFINSSHNTYLTAGQLAGNSSVEMYRQVLLSGCRCVELDCWKGRTAEEEPVITHGFTMTTEISFKEVIEAIAECAFKTSPFPILLSFENHVDSPKQQAKMAEYCRLIFGDALLMEPLEKYPLESGVPLPSPMDLMYKILVKNKKKSHKSSEGSGKKKLSEQASNTYSDSSSMFEPSSPGAGEADTESDDDDDDDDCKKSSMDEGTAGSEAMATEEMSNLVNYIQPVKFESFEISKKRNKSFEMSSFVETKGLEQLTKSPVEFVEYNKMQLSRIYPKGTRVDSSNYMPQLFWNAGCQMVALNFQTMDLAMQINMGMYEYNGKSGYRLKPEFMRRPDKHFDPFTEGIVDGIVANTLSVKIISGQFLSDKKVGTYVEVDMFGLPVDTRRKAFKTKTSQGNAVNPVWEEEPIVFKKVVLPTLACLRIAVYEEGGKFIGHRILPVQAIRPGYHYICLRNERNQPLTLPAVFVYIEVKDYVPDTYADVIEALSNPIRYVNLMEQRAKQLAALTLEDEEEVKKEADPGETPSEAPSEARTTPAENGVNHTTTLTPKPPSQALHSQPAPGSVKAPAKTEDLIQSVLTEVEAQTIEELKQQKSFVKLQKKHYKEMKDLVKRHHKKTTDLIKEHTTKYNEIQNDYLRRRAALEKSAKKDSKKKSEPSSPDHGSSTIEQDLAALDAEMTQKLIDLKDKQQQQLLNLRQEQYYSEKYQKREHIKLLIQKLTDVAEECQNNQLKKLKEICEKEKKELKKKMDKKRQEKITEAKSKDKSQMEEEKTEMIRSYIQEVVQYIKRLEEAQSKRQEKLVEKHKEIRQQILDEKPKGEGSSSFLSETCHEDPSVSPNFTPPNPQALKW

SEQ ID NO: 33573 - protein, 196 aa, Homo sapiens
  ENSP00000391162
IISGQFLSDKKVGTYVEVDMFGLPVDTRRKAFKTKTSQGNAVNPVWEEEPIVFKKVVLPTLACLRIAVYEEGGKFIGHRILPVQAIRPGYHYICLRNERNQPLTLPAVFVYIEVKDYVPDTYADVIEALSNPIRYVNLMEQRAKQLAALTLEDEEEVKKEGGFLHDEIMRLTRNTLEKLMALPLTHVVPIQSKMLS

SEQ ID NO: 33574 - protein, 231 aa, Homo sapiens
  ENSP00000487544
  MOD_RES (1)..(1): Any amino acid
XQQKSFVKLQKKHYKEMKDLVKRHHKKTTDLIKEHTTKYNEIQNDYLRRRAALEKSAKKDSKKKSEPSSPDHGSSTIEQDLAALDAEMTQKLIDLKDKQQQQLLNLRQEQYYSEKYQKREHIKLLIQKLTDVAEECQNNQLKKLKEICEKEKKELKKKMDKKRQEKITEAKSKDKSQMEEEKTEMIRSYIQEVVQYIKRLEEAQSKRQEKLVEKHKEIRQQILDEKPKVAP

SEQ ID NO: 33575 - protein, 199 aa, Homo sapiens
  ENSP00000490792
  MOD_RES (1)..(1): Any amino acid
XIKEHTTKYNEIQNDYLRRRAALEKSAKKDSKKKSEPSSPDHGSSTIEQDLAALDAEMTQKLIDLKDKQQQQLLNLRQEQYYSEKYQKREHIKLLIQKLTDVAEECQNNQLKKLKEICEKEKKELKKKMDKKRQEKITEAKSKDKSQMEEEKTEMIRSYIQEVVQYIKRLEEAQSKRQEKLVEKHKEIRQQILDEKPKS

SEQ ID NO: 33576 - protein, 41 aa, Homo sapiens
  ENSP00000389911
IQEVVQYIKRLEEAQSKRQEKLVEKHKEIRQQILDEKPKVP

SEQ ID NO: 33577 - protein, 34 aa, Homo sapiens
  ENSP00000489643
RQEKLVEKHKEIRQQILDEKPKIQTVNSVMRWLP

SEQ ID NO: 33578 - protein, 87 aa, Homo sapiens
  ENSP00000490641
  MOD_RES (1)..(1): Any amino acid
XKEIRQQILDEKPKVELEQEYQDKFKRLPLEILEFVQEAMKGKISEDSNHGSAPLSLSSDPGKVNHKTPSSEELGGDIPGKEFDTPL

SEQ ID NO: 33579 - protein, 1136 aa, Homo sapiens [sequence omitted]

SEQ ID NO: 33580 - protein, 1093 aa, Homo sapiens [sequence omitted]

SEQ ID NO: 33581 - protein, 2302 aa, Homo sapiens
  ENSP00000360431
MTSEEMTASVLIPVTQRKVVSAQSAADESSEKVSDINISKAHTVRRSGETSHTISQLNKLKEEPSGSNLPKILSIAREKIVSDENSNEKCWEKIMPDSAKNLNINCNNILRNHQHGLPQRQFYEMYNSVAEEDLCLETGIPSPLERKVFPGIQLELDRPSMGISPLGNQSVIIETGRAHPDSRRAVFHFHYEVDRRMSDTFCTLSENLILDDCGNCVPLPGGEEKQKKNYVAYTCKLMELAKNCDNKNEQLQCDHCDTLNDKYFCFEGSCEKVDMVYSGDSFCRKDFTDSQAAKTFLSHFEDFPDNCDDVEEDAFKSKKERSTLLVRRFCKNDREVKKSVYTGTRAIVRTLPSGHIGLTAWSYIDQKRNGPLLPCGRVMEPPSTVEIRQDGSQRLSEAQWYPIYNAVRREETENTVGSLLHFLTKLPASETAHGRISVGPCLKQCVRDTVCEYRATLQRTSISQYITGSLLEATTSLGARSGLLSTFGGSTGRMMLKERQPGPSVANSNALPSSSAGISKELIDLQPLIQFPEEVASILMEQEQTIYRRVLPVDYLCFLTRDLGTPECQSSLPCLKASISASILTTQNGEHNALEDLVMRFNEVSSWVTWLILTAGSMEEKREVFSYLVHVAKCCWNMGNYNAVMEFLAGLRSRKVLKMWQFMDQSDIETMRSLKDAMAQHESSCEYRKVVTRALHIPGCKVVPFCGVFLKELCEVLDGASGLMKLCPRYNSQEETLEFVADYSGQDNFLQRVGQNGLKNSEKESTVNSIFQVIRSCNRSLETDEEDSPSEGNSSRKSSLKDKSRWQFIIGDLLDSDNDIFEQSKEYDSHGSEDSQKAFDHGTELIPWYVLSIQADVHQFLLQGATVIHYDQDTHLSARCFLQLQPDNSTLTWVKPTTASPASSKAKLGVLNNTAEPGKFPLLGNAGLSSLTEGVLDLFAVKAVYMGHPGIDIHTVCVQNKLGSMFLSETGVTLLYGLQTTDNRLLHFVAPKHTAKMLFSGLLELTRAVRKMRKFPDQRQQWLRKQYVSLYQEDGRYEGPTLAHAVELFGGRRWSARNPSPGTSAKNAEKPNMQRNNTLGISTTKKKKKILMRGESGEVTDDEMATRKAKMHKECRSRSGSDPQDINEQEESEVNAIANPPNPLPSRRAHSLTTAGSPNLAAGTSSPIRPVSSPVLSSSNKSPSSAWSSSSWHGRIKGGMKGFQSFMVSDSNMSFVEFVELFKSFSVRSRKDLKDLFDVYAVPCNRSGSESAPLYTNLTIDENTSDLQPDLDLLTRNVSDLGLFIKSKQQLSDNQRQISDAIAAASIVTNGTGIESTSLGIFGVGILQLNDFLVNCQGEHCTYDEILSIIQKFEPSISMCHQGLMSFEGFARFLMDKENFASKNDESQENIKELQLPLSYYYIESSHNTYLTGHQLKGESSVELYSQVLLQGCRSVELDCWDGDDGMPIIYHGHTLTTKIPFKEVVEAIDRSAFINSDLPIIISIENHCSLPQQRKMAEIFKTVFGEKLVTKFLFETDFSDDPMLPSPDQLRKKVLLKNKKLKAHQTPVDILKQKAHQLASMQVQAYNGGNANPRPANNEEEEDEEDEYDYDYESLSDDNILEDRPENKSCNDKLQFEYNEEIPKRIKKADNSACNKGKVYDMELGEEFYLDQNKKESRQIAPELSDLVIYCQAVKFPGLSTLNASGSSRGKERKSRKSIFGNNPGRMSPGETASFNKTSGKSSCEGIRQTWEESSSPLNPTTSLSAIIRTPKCYHISSLNENAAKRLCRRYSQKLTQHTACQLLRTYPAATRIDSSNPNPLMFWLHGIQLVALNYQTDDLPLHLNAAMFEANGGCGYVLKPPVLWDKNCPMYQKFSPLERDLDSMDPAVYSLTIVSGQNVCPSNSMGSPCIEVDVLGMPLDSCHFRTKPIHRNTLNPMWNEQFLFHVHFEDLVFLRFAVVENNSSAVTAQRIIPLKALKRGYRHLQLRNLHNEVLEISSLFINSRRMEENSSGNTMSASSMFNTEERKCLQTHRVTVHGVPGPEPFTVFTINGGTKAKQLLQQILTNEQDIKPVTTDYFLMEEKYFISKEKNECRKQPFQRAIGPEEEIMQILSSWFPEEGYMGRIVLKTQQENLEEKNIVQDDKEVILSSEEESFFVQVHDVSPEQPRTVIKAPRVSTAQDVIQQTLCKAKYSYSILSNPNPSDYVLLEEVVKDTTNKKTTTPKSSQRVLLDQECVFQAQSKWKGAGKFILKLKEQVQASREDKKKGISFASELKKLTKSTKQPRGLTSPSQLLTSESIQTKEEKPVGGLSSSDTMDYRQ

SEQ ID NO: 33582 - protein, 1994 aa, Homo sapiens
  ENSP00000360426
MVSEGSAAGRDFAGMEEVRQLHVRFCKGIKIWHQAWFLCSLLGREPQEREAGCQLWLCTLSAVLKVGWLFPLSEVPNFTLLKDGCGCWRLKEDQIYNAVRREETENTVGSLLHFLTKLPASETAHGRISVGPCLKQCVRDTVCEYRATLQRTSISQYITGSLLEATTSLGARSGLLSTFGGSTGRMMLKERQPGPSVANSNALPSSSAGISKELIDLQPLIQFPEEVASILMEQEQTIYRRVLPVDYLCFLTRDLGTPECQSSLPCLKASISASILTTQNGEHNALEDLVMRFNEVSSWVTWLILTAGSMEEKREVFSYLVHVAKCCWNMGNYNAVMEFLAGLRSRKVLKMWQFMDQSDIETMRSLKDAMAQHESSCEYRKVVTRALHIPGCKVVPFCGVFLKELCEVLDGASGLMKLCPRYNSQEETLEFVADYSGQDNFLQRVGQNGLKNSEKESTVNSIFQVIRSCNRSLETDEEDSPSEGNSSRKSSLKDKSRWQFIIGDLLDSDNDIFEQSKEYDSHGSEDSQKAFDHGTELIPWYVLSIQADVHQFLLQGATVIHYDQDTHLSARCFLQLQPDNSTLTWVKPTTASPASSKAKLGVLNNTAEPGKFPLLGNAGLSSLTEGVLDLFAVKAVYMGHPGIDIHTVCVQNKLGSMFLSETGVTLLYGLQTTDNRLLHFVAPKHTAKMLFSGLLELTRAVRKMRKFPDQRQQWLRKQYVSLYQEDGRYEGPTLAHAVELFGGRRWSARNPSPGTSAKNAEKPNMQRNNTLGISTTKKKKKILMRGESGEVTDDEMATRKAKMHKECRSRSGSDPQDINEQEESEVNAIANPPNPLPSRRAHSLTTAGSPNLAAGTSSPIRPVSSPVLSSSNKSPSSAWSSSSWHGRIKGGMKGFQSFMVSDSNMSFVEFVELFKSFSVRSRKDLKDLFDVYAVPCNRSGSESAPLYTNLTIDENTSDLQPDLDLLTRNVSDLGLFIKSKQQLSDNQRQISDAIAAASIVTNGTGIESTSLGIFGVGILQLNDFLVNCQGEHCTYDEILSIIQKFEPSISMCHQGLMSFEGFARFLMDKENFASKNDESQENIKELQLPLSYYYIESSHNTYLTGHQLKGESSVELYSQVLLQGCRSVELDCWDGDDGMPIIYHGHTLTTKIPFKEVVEAIDRSAFINSDLPIIISIENHCSLPQQRKMAEIFKTVFGEKLVTKFLFETDFSDDPMLPSPDQLRKKVLLKNKKLKAHQTPVDILKQKAHQLASMQVQAYNGGNANPRPANNEEEEDEEDEYDYDYESLSDDNILEDRPENKSCNDKLQFEYNEEIPKRIKKADNSACNKGKVYDMELGEEFYLDQNKKESRQIAPELSDLVIYCQAVKFPGLSTLNASGSSRGKERKSRKSIFGNNPGRMSPGETASFNKTSGKSSCEGIRQTWEESSSPLNPTTSLSAIIRTPKCYHISSLNENAAKRLCRRYSQKLTQHTACQLLRTYPAATRIDSSNPNPLMFWLHGIQLVALNYQTDDLPLHLNAAMFEANGGCGYVLKPPVLWDKNCPMYQKFSPLERDLDSMDPAVYSLTIVSGQNVCPSNSMGSPCIEVDVLGMPLDSCHFRTKPIHRNTLNPMWNEQFLFHVHFEDLVFLRFAVVENNSSAVTAQRIIPLKALKRGYRHLQLRNLHNEVLEISSLFINSRRMEENSSGNTMSASSMFNTEERKCLQTHRVTVHGVPGPEPFTVFTINGGTKAKQLLQQILTNEQDIKPVTTDYFLMEEKYFISKEKNECRKQPFQRAIGPEEEIMQILSSWFPEEGYMGRIVLKTQQENLEEKNIVQDDKEVILSSEEESFFVQVHDVSPEQPRTVIKAPRVSTAQDVIQQTLCKAKYSYSILSNPNPSDYVLLEEVVKDTTNKKTTTPKSSQRVLLDQECVFQAQSKWKGAGKFILKLKEQVQASREDKKKGISFASELKKLTKSTKQPRGLTSPSQLLTSESIQTKEEKPVGGLSSSDTMDYRQ

SEQ ID NO: 33583 - protein, 1994 aa, Homo sapiens; identical to SEQ ID NO: 33582
  ENSP00000360438

SEQ ID NO: 33584 - protein, 1014 aa, Homo sapiens
  ENSP00000419100
MADLEVYKNLSPEKVERCMSVMQSGTQMIKLKRGTKGLVRLFYLDEHRTRLRWRPSRKSEKAKILIDSIYKVTEGRQSEIFHRQAEGNFDPSCCFTIYHGNHMESLDLITSNPEEARTWITGLKYLMAGISDEDSLAKRQRTHDQWVKQTFEEADKNGDGLLNIEEIHQLMHKLNVNLPRRKVRQMFQEADTDENQGTLTFEEFCVFYKMMSLRRDLYLLLLSYSDKKDHLTVEELAQFLKVEQKMNNVTTDYCLDIIKKFEVSEENKVKNVLGIEGFTNFMRSPACDIFNPLHHEVYQDMDQPLCNYYIASSHNTYLTGDQLLSQSKVDMYARVLQEGCRCVEVDCWDGPDGEPVVHHGYTLTSKILFRDVVETINKHAFVKNEFPVILSIENHCSIQQQRKIAQYLKGIFGDKLDLSSVDTGECKQLPSPQSLKGKILVKGKKLPYHLGDDAEEGEVSDEDSADEIEDECKFKLHYSNGTTEHQVESFIRKKLESLLKESQIRDKEDPDSFTVRALLKATHEGLNAHLKQSPDVKESGKKSHGRSLMTNFGKHKKTTKSRSKSYSTDDEEDTQQSTGKEGGQLYRLGRRRKTMKLCRELSDLVVYTNSVAAQDIVDDGTTGNVLSFSETRAHQVVQQKSEQFMIYNQKQLTRIYPSAYRIDSSNFNPLPYWNAGCQLVALNYQSEGRMMQLNRAKFKANGNCGYVLKPQQMCKGTFNPFSGDPLPANPKKQLILKVISGQQLPKPPDSMFGDRGEIIDPFVEVEIIGLPVDCCKDQTRVVDDNGFNPVWEETLTFTVHMPEIALVRFLVWDHDPIGRDFVGQRTVTFSSLVPGYRHVYLEGLTEASIFVHITINEIYGKNRQLQGLKGLFNKNPRHSSSENNSHYVRKRSIGDRILRRTASAPAKGRKKSKMGFQEMVEIKDSVSEATRDQDGVLRRTTRSLQARPVSMPVDRNLLGALSLPVSETAKDIEGKENSLDSSFCRPTEQAKAEMCKVPFPRQLECVMKMEISET

SEQ ID NO: 33585 - protein, 1655 aa, Homo sapiens
  ENSP00000417502
MSVMQSGTQMIKLKRGTKGLVRLFYLDEHRTRLRWRPSRKSEKAKILIDSIYKVTEGRQSEIFHRQAEGNFDPSCCFTIYHGNHMESLDLITSNPEEARTWITGLKYLMAGISDEDSLAKRQRTHDQWVKQTFEEADKNGDGLLNIEEIHQLMHKLNVNLPRRKVRQMFQEADTDENQGTLTFEEFCVFYKMMSLRRDLYLLLLSYSDKKDHLTVEELAQFLKVEQKMNNVTTDYCLDIIKKFEVSEENKVKNVLGIEGFTNFMRSPACDIFNPLHHEVYQDMDQPLCNYYIASSHNTYLTGDQLLSQSKVDMYARVLQEGCRCVEVDCWDGPDGEPVVHHGYTLTSKILFRDVVETINKHAFVKNEFPVILSIENHCSIQQQRKIAQYLKGIFGDKLDLSSVDTGECKQLPSPQSLKGKILVKGKKLPYHLGDDAEEGEVSDEDSADEIEDECKFKLHYSNGTTEHQVESFIRKKLESLLKESQIRDKEDPDSFTVRALLKATHEGLNAHLKQSPDVKESGKKSHGRSLMTNFGKHKKTTKSRSKSYSTDDEEDTQQSTGKEGGQLYRLGRRRKTMKLCRELSDLVVYTNSVAAQDIVDDGTTGNVLSFSETRAHQVVQQKSEQFMIYNQKQLTRIYPSAYRIDSSNFNPLPYWNAGCQLVALNYQSEGRMMQLNRAKFKANGNCGYVLKPQQMCKGTFNPFSGDPLPANPKKQLILKVISGQQLPKPPDSMFGDRGEIIDPFVEVEIIGLPVDCCKDQTRVVDDNGFNPVWEETLTFTVHMPEIALVRFLVWDHDPIGRDFVGQRTVTFSSLVPGYRHVYLEGLTEASIFVHITINEIYGKNRQLQGLKGLFNKNPRHSSSENNSHYVRKRSIGDRILRRTASAPAKGRKKSKMGFQEMVEIKDSVSEATRDQDGVLRRTTRSLQARPVSMPVDRNLLGALSLPVSETAKDIEGKENSLAEDKDGRRKGKASIKDPHFLNFNKKLSSSSSALLHKDTSQGDTIVSTAHMSVTGEQLGMSSPRGGRTTSNATSNCQENPCPSKSLSPKQHLAPDPVVNPTQDLHGVKIKEKGNPEDFVEGKSILSGSVLSHSNLEIKNLEGNRGKGRAATSFSLSDVSMLCSDIPDLHSTAILQESVISHLIDNVTLTNENEPGSSISALIGQFDETNNQALTVVSHLHNTSVMSGHCPLPSLGLKMPIKHGFCKGKSKSSFLCSSPELIALSSSETTKHATNTVYETTCTPISKTKPDDDLSSKAKTAALESNLPGSPNTSRGWLPKSPTKGEDWETLKSCSPASSPDLTLEDVIADPTLCFNSGESSLVEIDGESENLSLTTCEYRREGTSQLASPLKLKYNQGVVEHFQRGLRNGYCKETLRPSVPEIFNNIQDVKTQSISYLAYQGAGFVHNHFSDSDAKMFQTCVPQQSSAQDMHVPVPKQLAHLPLPALKLPSPCKSKSLGDLTSEDIACNFESKYQCISKSFVTTGIRDKKGVTVKTKSLEPIDALTEQLRKLVSFDQEDNCQVLYSKQDANQLPRALVRKLSSRSQSRVRNIASRAKEKQEANKQKVPNPSNGAGVVLRNKPSAPTPAVNRHSTGSYIAGYLKNTKGGGLEGRGIPEGACTALHYGHVDQFCSDNSVLQTEPSSDDKPEIYFLLRL

SEQ ID NO: 33586 - protein, 1002 aa, Homo sapiens
  ENSP00000402759
MADLEVYKNLSPEKVERCMSVMQSGTQMIKLKRGTKGLVRLFYLDEHRTRLRWRPSRKSEKAKILIDSIYKVTEGRQSEIFHRQAEGNFDPSCCFTIYHGNHMESLDLITSNPEEARTWITGLKYLMAGISDEDSLAKRQRTHDQWVKQTFEEADKNGDGLLNIEEIHQLMHKLNVNLPRRKVRQMFQEADTDENQGTLTFEEFCVFYKMMSLRRDLYLLLLSYSDKKDHLTVEELAQFLKVEQKMNNVTTDYCLDIIKKFEVSEENKVKNVLGIEGFTNFMRSPACDIFNPLHHEVYQDMDQPLCNYYIASSHNTYLTGDQLLSQSKVDMYARVLQEGCRCVEVDCWDGPDGEPVVHHGYTLTSKILFRDVVETINKHAFVKNEFPVILSIENHCSIQQQRKIAQYLKGIFGDKLDLSSVDTGECKQLPSPQSLKGKILVKGKKLPYHLGDDAEEGEVSDEDSADEIEDECKFKLHYSNGTTEHQVESFIRKKLESLLKESQIRDKEDPDSFTVRALLKATHEGLNAHLKQSPDVKESGKKSHGRSLMTNFGKHKKTTKSRSKSYSTDDEEDTQQSTGKEGGQLYRLGRRRKTMKLCRELSDLVVYTNSVAAQDIVDDGTTGNVLSFSETRAHQVVQQKSEQFMIYNQKQLTRIYPSAYRIDSSNFNPLPYWNAGCQLVALNYQSEGRMMQLNRAKFKANGNCGYVLKPQQMCKGTFNPFSGDPLPANPKKQLILKVISGQQLPKPPDSMFGDRGEIIDPFVEVEIIGLPVDCCKDQTRVVDDNGFNPVWEETLTFTVHMPEIALVRFLVWDHDPIGRDFVGQRTVTFSSLVPGYRHVYLEGLTEASIFVHITINEIYGKWSPLILNPSYTILHFLGATKNRQLQGLKGLFNKNPRHSSSENNSHYVRKRSIGDRILRRTASAPAKGRKKSKMGFQEMVEIKDSVSEATRDQDGVLRRTTRSLQARPVSMPVDRNLLGALSLPVSETAKDIEGKENSLVQI

SEQ ID NO: 33587 - protein, 1693 aa, Homo sapiens
  ENSP00000345988
MADLEVYKNLSPEKVERCMSVMQSGTQMIKLKRGTKGLVRLFYLDEHRTRLRWRPSRKSEKAKILIDSIYKVTEGRQSEIFHRQAEGNFDPSCCFTIYHGNHMESLDLITSNPEEARTWITGLKYLMAGISDEDSLAKRQRTHDQWVKQTFEEADKNGDGLLNIEEIHQLMHKLNVNLPRRKVRQMFQEADTDENQGTLTFEEFCVFYKMMSLRRDLYLLLLSYSDKKDHLTVEELAQFLKVEQKMNNVTTDYCLDIIKKFEVSEENKVKNVLGIEGFTNFMRSPACDIFNPLHHEVYQDMDQPLCNYYIASSHNTYLTGDQLLSQSKVDMYARVLQEGCRCVEVDCWDGPDGEPVVHHGYTLTSKILFRDVVETINKHAFVKNEFPVILSIENHCSIQQQRKIAQYLKGIFGDKLDLSSVDTGECKQLPSPQSLKGKILVKGKKLPYHLGDDAEEGEVSDEDSADEIEDECKFKLHYSNGTTEHQVESFIRKKLESLLKESQIRDKEDPDSFTVRALLKATHEGLNAHLKQSPDVKESGKKSHGRSLMTNFGKHKKTTKSRSKSYSTDDEEDTQQSTGKEGGQLYRLGRRRKTMKLCRELSDLVVYTNSVAAQDIVDDGTTGNVLSFSETRAHQVVQQKSEQFMIYNQKQLTRIYPSAYRIDSSNFNPLPYWNAGCQLVALNYQSEGRMMQLNRAKFKANGNCGYVLKPQQMCKGTFNPFSGDPLPANPKKQLILKVISGQQLPKPPDSMFGDRGEIIDPFVEVEIIGLPVDCCKDQTRVVDDNGFNPVWEETLTFTVHMPEIALVRFLVWDHDPIGRDFVGQRTVTFSSLVPGYRHVYLEGLTEASIFVHITINEIYGKWSPLILNPSYTILHFLGATKNRQLQGLKGLFNKNPRHSSSENNSHYVRKRSIGDRILRRTASAPAKGRKKSKMGFQEMVEIKDSVSEATRDQDGVLRRTTRSLQARPVSMPVDRNLLGALSLPVSETAKDIEGKENSLAEDKDGRRKGKASIKDPHFLNFNKKLSSSSSALLHKDTSQGDTIVSTAHMSVTGEQLGMSSPRGGRTTSNATSNCQENPCPSKSLSPKQHLAPDPVVNPTQDLHGVKIKEKGNPEDFVEGKSILSGSVLSHSNLEIKNLEGNRGKGRAATSFSLSDVSMLCSDIPDLHSTAILQESVISHLIDNVTLTNENEPGSSISALIGQFDETNNQALTVVSHLHNTSVMSGHCPLPSLGLKMPIKHGFCKGKSKSSFLCSSPELIALSSSETTKHATNTVYETTCTPISKTKPDDDLSSKAKTAALESNLPGSPNTSRGWLPKSPTKGEDWETLKSCSPASSPDLTLEDVIADPTLCFNSGESSLVEIDGESENLSLTTCEYRREGTSQLASPLKLKYNQGVVEHFQRGLRNGYCKETLRPSVPEIFNNIQDVKTQSISYLAYQGAGFVHNHFSDSDAKMFQTCVPQQSSAQDMHVPVPKQLAHLPLPALKLPSPCKSKSLGDLTSEDIACNFESKYQCISKSFVTTGIRDKKGVTVKTKSLEPIDALTEQLRKLVSFDQEDNCQVLYSKQDANQLPRALVRKLSSRSQSRVRNIASRAKEKQEANKQKVPNPSNGAGVVLRNKPSAPTPAVNRHSTGSYIAGYLKNTKGGGLEGRGIPEGACTALHYGHVDQFCSDNSVLQTEPSSDDKPEIYFLLRL

SEQ ID NO: 33588 - protein, 1655 aa, Homo sapiens; identical to SEQ ID NO: 33585
  ENSP00000335469

SEQ ID NO: 33589 - protein, 1129 aa, Homo sapiens
  ENSP00000487140
MEEPGPPGGLSQDQVERCMGAMQEGMQMVKLRGGSKGLVRFYYLDEHRSCIRWRPSRKNEKAKISIDSIQEVSEGRQSEVFQRYPDGSFDPNCCFSIYHGSHRESLDLVSTSSEVARTWVTGLRYLMAGISDEDSLARRQRTRDQWLKQTFDEADKNGDGSLSIGEVLQLLHKLNVNLPRQRVKQMFREADTDDHQGTLGFEEFCAFYKMMSTRRDLYLLMLTYSNHKDHLDAASLQRFLQVEQKMAGVTLESCQDIIEQFEPCPENKSKGLLGIDGFTNYTRSPAGDIFNPEHHHVHQDMTQPLSHYFITSSHNTYLVGDQLMSQSRVDMYAWVLQAGCRCVEVDCWDGPDGEPIVHHGYTLTSKILFKDVIETINKYAFIKNEYPVILSIENHCSVIQQKKMAQYLTDILGDKLDLSSVSSEDATTLPSPQMLKGKILVKGKKLPANISEDAEEGEVSDEDSADEIDDDCKLLNGDASTNRKRVENTAKRKLDSLIKESKIRDCEDPNNFSVSTLSPSGKLGRKSKAEEDVESGEDAGASRRNGRLVVGSFSRRKKKGSKLKKAASVEEGDEGQDSPGGQSRGATRQKKTMKLSRALSDLVKYTKSVATHDIEMEAASSWQVSSFSETKAHQILQQKPAQYLRFNQQQLSRIYPSSYRVDSSNYNPQPFWNAGCQMVALNYQSEGRMLQLNRAKFSANGGCGYVLKPGCMCQGVFNPNSEDPLPGQLKKQLVLRIISGQQLPKPRDSMLGDRGEIIDPFVEVEIIGLPVDCSREQTRVVDDNGFNPTWEETLVFMVHMPEIALVRFLVWDHDPIGRDFIGQRTLAFSSMMPGYRHVYLEGMEEASIFVHVAVSDISGKVKQALGLKGLFLRGPKPGSLDSHAAGRPPARPSVSQRILRRTASAPTKSQKPGRRGFPELVLGTRDTGSKGVADDVVPPGPGPAPEAPAQEGPGSGSPRGKAPAAVAEKSPVRVRPPRVLDGPGPAGMAATCMKCVVGSCAGVNTGGLQRERPPSPGPASRQAAIRQQPRARADSLGAPCCGLDPHAIPGRSREAPKGPGAWRQGPGGSGSMSSDSSSPDSPGIPERSPRWPEGACRQPGALQGEMSALFAQKLEEIRSKSPMFSAVRN

SEQ ID NO: 33590 - protein, 1416 aa, Homo sapiens
  ENSP00000486186
MSGPWPSPDSRTKGTVAWLAEVLLWVGGSVVLSSEWQLGPLVERCMGAMQEGMQMVKLRGGSKGLVRFYYLDEHRSCIRWRPSRKNEKAKISIDSIQEVSEGRQSEVFQRYPDGSFDPNCCFSIYHGSHRESLDLVSTSSEVARTWVTGLRYLMAGISDEDSLARRQRTRDQWLKQTFDEADKNGDGSLSIGEVLQLLHKLNVNLPRQRVKQMFREADTDDHQGTLGFEEFCAFYKMMSTRRDLYLLMLTYSNHKDHLDAASLQRFLQVEQKMAGVTLESCQDIIEQFEPCPENKSKGLLGIDGFTNYTRSPAGDIFNPEHHHVHQDMTQPLSHYFITSSHNTYLVGDQLMSQSRVDMYAWVLQAGCRCVEVDCWDGPDGEPIVHHGYTLTSKILFKDVIETINKYAFIKNEYPVILSIENHCSVIQQKKMAQYLTDILGDKLDLSSVSSEDATTLPSPQMLKGKILVKGKKLPANISEDAEEGEVSDEDSADEIDDDCKLLNGDASTNRKRVENTAKRKLDSLIKESKIRDCEDPNNFSVSTLSPSGKLGRKSKAEEDVESGEDAGASRRNGRLVVGSFSRRKKKGSKLKKAASVEEGDEGQDSPGGQSRGATRQKKTMKLSRALSDLVKYTKSVATHDIEMEAASSWQVSSFSETKAHQILQQKPAQYLRFNQQQLSRIYPSSYRVDSSNYNPQPFWNAGCQMVALNYQSEGRMLQLNRAKFSANGGCGYVLKPGCMCQGVFNPNSEDPLPGQLKKQLVLRIISGQQLPKPRDSMLGDRGEIIDPFVEVEIIGLPVDCSREQTRVVDDNGFNPTWEETLVFMVHMPEIALVRFLVWDHDPIGRDFIGQRTLAFSSMMPGYRHVYLEGMEEASIFVHVAVSDISGKVKQALGLKGLFLRGPKPGSLDSHAAGRPPARPSVSQRILRRTASAPTKSQKPGRRGFPELVLGTRDTGSKGVADDVVPPGPGPAPEAPAQEGPGSGSPRDTRPLSTQRPLPPLCSLETIAEEPAPGPGPPPPAAVPTSSSQGRPPYPTGPGANVASPLEDTEEPRDSRPRPCNGEGAGGAYERAPGSQTDGRSQPRTLGHLPVIRRVKSEGQVPTEPLGGWRPLAAPFPAPAVYSDATGSDPLWQRLEPCGHRDSVSSSSSMSSSDTVIDLSLPSLGLGRSRENLAGAHMGRLPPRPHSASAARPDLPPVTKSKSNPNLRATGQRPPIPDELQPRSLAPRMAGLPFRPPWGCLSLVGVQDCPVAAKSKSLGDLTADDFAPSFEGGSRRLSHSLGLPGGTRRVSGPGVRRDTLTEQLRWLTVFQQAGDITSPTSLGPAGEGVAGGPGFVRRSSSRSHSRVRAIASRARQAQERQQRLQGLGRQGPPEEERGTPEGACSVGHEGSVDAPAPSKGALGPASAAAENLVLLRL

SEQ ID NO: 33591 - protein, 1416 aa, Homo sapiens; identical to SEQ ID NO: 33590
  ENSP00000481938

SEQ ID NO: 33592 - protein, 111 aa, Homo sapiens
  ENSP00000476436
MMAPPTAGPLPGPALPPEDPGPDPESRWLFLSANILPVVERCMGAMQEGMQMVKLRGGSKGLVRFYYLDEHRSCIRWRPSRKNEKAKISIDSIQEVSEGRQSEVFQRYPDG

SEQ ID NO: 33593 - protein, 1129 aa, Homo sapiens; identical to SEQ ID NO: 33589
  ENSP00000397289

SEQ ID NO: 33594 - protein, 1416 aa, Homo sapiens; identical to SEQ ID NO: 33590
  ENSP00000389803

SEQ ID NO: 33595 - protein, 1239 aa, Homo sapiens
  ENSP00000278878
  MOD_RES (1)..(1): Any amino acid
XARTWVTGLRYLMAGISDEDSLARRQRTRDQWLKQTFDEADKNGDGSLSIGEVLQLLHKLNVNLPRQRVKQMFREADTDDHQGTLGFEEFCAFYKMMSTRRDLYLLMLTYSNHKDHLDAASLQRFLQVEQKMAGVTLESCQDIIEQFEPCPENKSKGLLGIDGFTNYTRSPAGDIFNPEHHHVHQDMTQPLSHYFITSSHNTYLVGDQLMSQSRVDMYAWVLQAGCRCVEVDCWDGPDGEPIVHHGYTLTSKILFKDVIETINKYAFIKNEYPVILSIENHCSVIQQKKMAQYLTDILGDKLDLSSVSSEDATTLPSPQMLKGKILVKGKKLPANISEDAEEGEVSDEDSADEIDDDCKLLNGDASTNRKRVENTAKRKLDSLIKESKIRDCEDPNNFSVSTLSPSGKLGRKSKAEEDVESGEDAGASRRNGRLVVGSFSRRKKKGSKLKKAASVEEGDEGQDSPGGQSRGATRQKKTMKLSRALSDLVKYTKSVATHDIEMEAASSWQVSSFSETKAHQILQQKPAQYLRFNQQQLSRIYPSSYRVDSSNYNPQPFWNAGCQMGVFNPNSEDPLPGQLKKQLVLRIISGQQLPKPRDSMLGDRGEIIDPFVEVEIIGLPVDCSREQTRVVDDNGFNPTWEETLVFMVHMPEIALVRFLVWDHDPIGRDFIGQRTLAFSSMMPGYRHVYLEGMEEASIFVHVAVSDISGKVKQALGLKGLFLRGPKPGSLDSHAAGRPPARPSVSQRILRRTASAPTKSQKPGRRGFPELVLGTRDTGSKGVADDVVPPGPGPAPEAPAQEGPGSGSPRDTRPLSTQRPLPPLCSLETIAEEPAPGPGPPPPAAVPTSSSQGRPPYPTGPGANVASPLEDTEEPRDSRPRPCNGEGAGGAYERAPGSQTDGRSQPRTLGHLPVIRRVKSEGQVPTEPLGGWRPLAAPFPAPAVYSDATGSDPLWQRLEPCGHRDSVSSSSSMSSSDTVIDLSLPSLGLGRSRENLAGAHMGRLPPRPHSASAARPDLPPVTKSKSNPNLRATGQRPPIPDELQPRSLAPRMAGLPFRPPWGCLSLVGVQDCPVAAKSKSLGDLTADDFAPSFEGGSRRLSHSLGLPGGTRRVSGPGVRRDTLTEQLRWLTVFQQAGDITSPTSLGPAGEGVAGGPGFVRRSSSRSHSRVRAIASRARQAQERQQRLQGLGRQGPPEEERGTPEGACSVGHEGSVDAPAPSKGALGPASAAAENLVLLRL

SEQ ID NO: 33596 - protein, 1416 aa, Homo sapiens; identical to SEQ ID NO: 33590
  ENSP00000367747

SEQ ID NO: 33597 - protein, 1095 aa, Homo sapiens
  ENSP00000402861
MAEGAAGREDPAPPDAAGGEDDPRVGPDAAGDCVTAASGGRMRDRRSGVALPGAAGTPADSEAGLLEAARATPRRSSIIKDPSNQKCGGRKKTVSFSSMPSEKKISSANDCISFMQAGCELKKVRPNSRIYNRFFTLDTDLQALRWEPSKKDLEKAKLDISAIKEIRLGKNTETFRNNGLADQICEDCAFSILHGENYESLDLVANSADVANIWVSGLRYLVSRSKQPLDFMEGNQNTPRFMWLKTVFEAADVDGNGIMLEDTSVELIKQLNPTLKEAKIRLKFKEIQKSKEKLTTRVTEEEFCEAFCELCTRPEVYFLLVQISKNKEYLDANDLMLFLEAEQGVTHITEDICLDIIRRYELSEEGRQKGFLAIDGFTQYLLSSECDIFDPEQKKVAQDMTQPLSHYYINASHNTYLIEDQFRGPADINGYIRALKMGCRSVELDVSDGSDNEPILCNRNNMTTHVSFRSVIEVINKFAFVASEYPLILCLGNHCSLPQQKVMAQQMKKVFGNKLYTEAPLPSESYLPSPEKLKRMIIVKGKKLPSDPDVLEGEVTDEDEEAEMSRRMSVDYNGEQKQIRLCRELSDLVSICKSVQYRDFELSMKSQNYWEMCSFSETEASRIANEYPEDFVNYNKKFLSRIYPSAMRIDSSNLNPQDFWNCGCQIVAMNFQTPGPMMDLHTGWFLQNGGCGYVLRPSIMRDEVSYFSANTKGILPGVSPLALHIKIISGQNFPKPKGACAKGDVIDPYVCIEIHGIPADCSEQRTKTVQQNSDNPIFDETFEFQVNLPELAMIRFVVLDDDYIGDEFIGQYTIPFECLQPGYRHVPLRSFVGDIMEHVTLFVHIAITNRSGGGKAQKRSLSVRMGKKVREYTMLRNIGLKTIDDIFKIAVHPLREAIDMRENMQNAIVSIKELCGLPPIASLKQCLLTLSSRLITSDNTPSVSLVMKDSFPYLEPLGAIPDVQKKMLTAYDLMIQESRFLIEMADTVQEKIVQCQKAGMEFHEELHNLGAKEGLKGRKLNKATESFAWNITVLKGQGDLLKNAKNEAIENMKQIQLACLSCGLSKAPSSSAEAKSKRSLEAIEEKESSEENGKL

SEQ ID NO: 33598 - protein, 94 aa, Homo sapiens
  ENSP00000410488
MAEGAAGREDPAPPDAAGGEDDPRVGPDAAGDCVTAASGGRMRDRRSGVALPGAAGTPADSEAGLLEAARATPRRSSIIKMGLCSCRKTAQSFH

SEQ ID NO: 33599 - protein, 1012 aa, Homo sapiens
  ENSP00000457588
MKNKLQDPSNQKCGGRKKTVSFSSMPSEKKISSANDCISFMQAGCELKKVRPNSRIYNRFFTLDTDLQALRWEPSKKDLEKAKLDISAIKEIRLGKNTETFRNNGLADQICEDCAFSILHGENYESLDLVANSADVANIWVSGLRYLVSRSKQPLDFMEGNQNTPRFMWLKTVFEAADVDGNGIMLEDTSVELIKQLNPTLKEAKIRLKFKEIQKSKEKLTTRVTEEEFCEAFCELCTRPEVYFLLVQISKNKEYLDANDLMLFLEAEQGVTHITEDICLDIIRRYELSEEGRQKGFLAIDGFTQYLLSSECDIFDPEQKKVAQDMTQPLSHYYINASHNTYLIEDQFRGPADINGYIRALKMGCRSVELDVSDGSDNEPILCNRNNMTTHVSFRSVIEVINKFAFVASEYPLILCLGNHCSLPQQKVMAQQMKKVFGNKLYTEAPLPSESYLPSPEKLKRMIIVKGKKLPSDPDVLEGEVTDEDEEAEMSRRMSVDYNGEQKQIRLCRELSDLVSICKSVQYRDFELSMKSQNYWEMCSFSETEASRIANEYPEDFVNYNKKFLSRIYPSAMRIDSSNLNPQDFWNCGCQIVAMNFQTPGPMMDLHTGWFLQNGGCGYVLRPSIMRDEVSYFSANTKGILPGVSPLALHIKIISGQNFPKPKGACAKGDVIDPYVCIEIHGIPADCSEQRTKTVQQNSDNPIFDETFEFQVNLPELAMIRFVVLDDDYIGDEFIGQYTIPFECLQPGYRHVPLRSFVGDIMEHVTLFVHIAITNRSGGGKAQKRSLSVRMGKKVREYTMLRNIGLKTIDDIFKIAVHPLREAIDMRENMQNAIVSIKELCGLPPIASLKQCLLTLSSRLITSDNTPSVSLVMKDSFPYLEPLGAIPDVQKKMLTAYDLMIQESRFLIEMADTVQEKIVQCQKAGMEFHEELHNLGAKEGLKGRKLNKATESFAWNITVLKGQGDLLKNAKNEAIENMKQIQLACLSCGLSKAPSSSAEAKSKRSLEAIEEK

SEQ ID NO: 33600 - protein, 1018 aa, Homo sapiens [sequence omitted]

SEQ ID NO: 33601 - protein, 321 aa, Homo sapiens
  ENSP00000367032
MASSQGKNELKLADWMATLPESMHSIPLTNLAIPGSHDSFSFYIDEASPVGPEQPETVQNFVSVFGTVAKKLMRKWLATQTMNFTGQLGAGIRYFDLRISTKPRDPDNELYFAHGLFSAKVNEGLEEINAFLTDHHKEVVFLDFNHFYGMQKYHHEKLVQMLKDIYGNKMCPAIFAQEVSLKYLWEKDYQVLVFYHSPVALEVPFLWPGQMMPAPWANTTDPEKLIQFLQASITERRKKGSFFISQVVLTPKASTVVKGVASGLRETITERALPAMMQWVRTQKPGESGINIVTADFVELGDFISTVIKLNYVFDEGEANT

SEQ ID NO: 33602 - protein, 321 aa, Homo sapiens; identical to SEQ ID NO: 33601
  ENSP00000333751

SEQ ID NO: 33603 - protein, 1036 aa, Homo sapiens
  ENSP00000348681
MSLKNEPRVNTSALQKIAADMSNIIENLDTRELHFEGEEVDYDVSPSDPKIQEVYIPFSAIYNTQGFKEPNIQTYLSGCPIKAQVLEVERFTSTTRVPSINLYTIELTHGEFKWQVKRKFKHFQEFHRELLKYKAFIRIPIPTRRHTFRRQNVREEPREMPSLPRSSENMIREEQFLGRRKQLEDYLTKILKMPMYRNYHATTEFLDISQLSFIHDLGPKGIEGMIMKRSGGHRIPGLNCCGQGRACYRWSKRWLIVKDSFLLYMKPDSGAIAFVLLVDKEFKIKVGKKETETKYGIRIDNLSRTLILKCNSYRHARWWGGAIEEFIQKHGTNFLKDHRFGSYAAIQENALAKWYVNAKGYFEDVANAMEEANEEIFITDWWLSPEIFLKRPVVEGNRWRLDCILKRKAQQGVRIFIMLYKEVELALGINSEYTKRTLMRLHPNIKVMRHPDHVSSTVYLWAHHEKLVIIDQSVAFVGGIDLAYGRWDDNEHRLTDVGSVKRVTSGPSLGSLPPAAMESMESLRLKDKNEPVQNLPIQKSIDDVDSKLKGIGKPRKFSKFSLYKQLHRHHLHDADSISSIDSTSNTGSIRSLQTGVGELHGETRFWHGKDYCNFVFKDWVQLDKPFADFIDRYSTPRMPWHDIASAVHGKAARDVARHFIQRWNFTKIMKSKYRSLSYPFLLPKSQTTAHELRYQVPGSVHANVQLLRSAADWSAGIKYHEESIHAAYVHVIENSRHYIYIENQFFISCADDKVVFNKIGDAIAQRILKAHRENQKYRVYVVIPLLPGFEGDISTGGGNALQAIMHFNYRTMCRGENSILGQLKAELGNQWINYISFCGLRTHAELEGNLVTELIYVHSKLLIADDNTVIIGSANINDRSMLGKRDSEMAVIVQDTETVPSVMDGKEYQAGRFARGLRLQCFRVVLGYLDDPSEDIQDPVSDKFFKEVWVSTAARNATIYDKVFRCLPNDEVHNLIQLRDFINKPVLAKEDPIRAEEELKKIRGFLVQFPFYFLSEESLLPSVGTKEAIVPMEVWT

SEQ ID NO: 33604 - protein, 1074 aa, Homo sapiens
  ENSP00000342793
MSLKNEPRVNTSALQKIAADMSNIIENLDTRELHFEGEEVDYDVSPSDPKIQEVYIPFSAIYNTQGFKEPNIQTYLSGCPIKAQVLEVERFTSTTRVPSINLYTIELTHGEFKWQVKRKFKHFQEFHRELLKYKAFIRIPIPTRRHTFRRQNVREEPREMPSLPRSSENMIREEQFLGRRKQLEDYLTKILKMPMYRNYHATTEFLDISQLSFIHDLGPKGIEGMIMKRSGGHRIPGLNCCGQGRACYRWSKRWLIVKDSFLLYMKPDSGAIAFVLLVDKEFKIKVGKKETETKYGIRIDNLSRTLILKCNSYRHARWWGGAIEEFIQKHGTNFLKDHRFGSYAAIQENALAKWYVNAKGYFEDVANAMEEANEEIFITDWWLSPEIFLKRPVVEGNRWRLDCILKRKAQQGVRIFIMLYKEVELALGINSEYTKRTLMRLHPNIKVMRHPDHVSSTVYLWAHHEKLVIIDQSVAFVGGIDLAYGRWDDNEHRLTDVGSVKRVTSGPSLGSLPPAAMESMESLRLKDKNEPVQNLPIQKSIDDVDSKLKGIGKPRKFSKFSLYKQLHRHHLHDADSISSIDSTSSYFNHYRSHHNLIHGLKPHFKLFHPSSESEQGLTRPHADTGSIRSLQTGVGELHGETRFWHGKDYCNFVFKDWVQLDKPFADFIDRYSTPRMPWHDIASAVHGKAARDVARHFIQRWNFTKIMKSKYRSLSYPFLLPKSQTTAHELRYQVPGSVHANVQLLRSAADWSAGIKYHEESIHAAYVHVIENSRHYIYIENQFFISCADDKVVFNKIGDAIAQRILKAHRENQKYRVYVVIPLLPGFEGDISTGGGNALQAIMHFNYRTMCRGENSILGQLKAELGNQWINYISFCGLRTHAELEGNLVTELIYVHSKLLIADDNTVIIGSANINDRSMLGKRDSEMAVIVQDTETVPSVMDGKEYQAGRFARGLRLQCFRVVLGYLDDPSEDIQDPVSDKFFKEVWVSTAARNATIYDKVFRCLPNDEVHNLIQLRDFINKPVLAKEDPIRAEEELKKIRGFLVQFPFYFLSEESLLPSVGTKEAIVPMEVWT

SEQ ID NO: 33605 - protein, 234 aa, Homo sapiens
  ENSP00000395556
  MOD_RES (1)..(1): Any amino acid
XHANVQLLRSAADWSAGIKYHEESIHAAYVHVIENSRHYIYIENQFFISCADDKVVFNKIGDAIAQRILKAHRENQKYRVYVVIPLLPGFEGDISTGGGNALQAIMHFNYRTMCRGENSILGQLKAELGNQWINYISFCGLRTHAELEGNLVTELIYVHSKLLIADDNTVIIGSANINDRSMLGKRDSEMAVIVQDTETVPSVMDGKEYQAGRFARGLRLQCFRSKMTPGVEDP

SEQ ID NO: 33606 - protein, 57 aa, Homo sapiens
  ENSP00000391164
MSLKNEPRVNTSALQKIAADMSNIIENLDTRELHFEGEEVDYDVSPSDPKIQEGTKY

SEQ ID NO: 33607 - protein, 141 aa, Homo sapiens
  ENSP00000400639
MSLKNEPRVNTSALQKIAADMSNIIENLDTRELHFEGEEVDYDVSPSDPKIQEVYIPFSAIYNTQGFKEPNIQTYLSGCPIKAQVLEVERFTSTTRVPSINLYTIELTHGEFKWQVKRKFKHFQEFHRELLKYKAFIRIPI

SEQ ID NO: 33608 - protein, 57 aa, Homo sapiens; identical to SEQ ID NO: 33606
  ENSP00000486967

SEQ ID NO: 33609 - protein, 152 aa, Homo sapiens
  ENSP00000328422
MPGLVFFKFANLGGGWGSRKMLEPGMCPAEMSLTPFVTRSLNLLCFSVTHRGRGKDNPLHFFLQLLAPSASASLGLGRETGPLPSPGLSPGLLSETFVSEGPLLTLQISWCGTECLMDGQGPLIHLHSQNIRISFGATQPPLLLVYEIRWNR

SEQ ID NO: 33610 - protein, 513 aa, Homo sapiens
  ENSP00000438677
MPGCPVQMLKPLWKAAVAPTWPCSMPPRRPWDREAGTLQVLGALAVLWLGSVALICLLWQVPRPPTWGQVQPKDVPRSWEHGSSPAWEPLEAEARQQRDSCQLVLVESIPQDLPSAAGSPSAQPLGQAWLQLLDTAQESVHVASYYWSLTGPDIGVNDSSSQLGEALLQKLQQLLGRNISLAVATSSPTLARTSTDLQVLAARGAHVRQVPMGRLTRGVLHSKFWVVDGRHIYMGSANMDWRSLTQVKELGAVIYNCSHLAQDLEKTFQTYWVLGVPKAVLPKTWPQNFSSHFNRFQPFHGLFDGVPTTAYFSASPPALCPQGRTRDLEALLAVMGSAQEFIYASVMEYFPTTRFSHPPRYWPVLDNALRAAAFGKGVRVRLLVGCGLNTDPTMFPYLRSLQALSNPAANVSVDVKVFIVPVGNHSNIPFSRVNHSKFMVTEKAAYIGTSNWSEDYFSSTAGVGLVVTQSPGAQPAGATVQEQLRQLFERDWSSRYAVGLDGQAPGQDCVWQG

SEQ ID NO: 33611 - protein, 506 aa, Homo sapiens
  ENSP00000376372
MLKPLWKAAVAPTWPCSMPPRRPWDREAGTLQVLGALAVLWLGSVALICLLWQVPRPPTWGQVQPKDVPRSWEHGSSPAWEPLEAEARQQRDSCQLVLVESIPQDLPSAAGSPSAQPLGQAWLQLLDTAQESVHVASYYWSLTGPDIGVNDSSSQLGEALLQKLQQLLGRNISLAVATSSPTLARTSTDLQVLAARGAHVRQVPMGRLTRGVLHSKFWVVDGRHIYMGSANMDWRSLTQVKELGAVIYNCSHLAQDLEKTFQTYWVLGVPKAVLPKTWPQNFSSHFNRFQPFHGLFDGVPTTAYFSASPPALCPQGRTRDLEALLAVMGSAQEFIYASVMEYFPTTRFSHPPRYWPVLDNALRAAAFGKGVRVRLLVGCGLNTDPTMFPYLRSLQALSNPAANVSVDVKVFIVPVGNHSNIPFSRVNHSKFMVTEKAAYIGTSNWSEDYFSSTAGVGLVVTQSPGAQPAGATVQEQLRQLFERDWSSRYAVGLDGQAPGQDCVWQG

SEQ ID NO: 33612 - protein, 257 aa, Homo sapiens
  ENSP00000451278
MLKPLWKAAVAPTWPCSMPPRRPWDREAGTVLGALAVLWLGSVALICLLWQVPRPPTWGQVQPKDVPRSWEHGSSPAWEPLEAEARQQRDSCQLVLVESIPQDLPSAAGSPSAQPLGQAWLQLLDTAQESVHVASYYWSLTGPDIGVNDSSSQLGEALLQKLQQLLGRNISLAVATSSPTLARTSTDLQVLAARGAHVRQVPMGRLTRGVLHSKFWVVDGRHIYMGSANMDWRSLTQVKELGAVIYNCSHLAQDLEK

SEQ ID NO: 33613 - protein, 75 aa, Homo sapiens
  ENSP00000451636
MVTEKAAYIGTSNWSEDYFSSTAGVGLVVTQSPGAQPAGATVQEQLRQLFERDWSSRYAVGLDGQAPGQDCVWQG

SEQ ID NO: 33614 - protein, 536 aa, Homo sapiens
  ENSP00000440896
MEIRQHEWLSASPHEGFEQMRLKSRPKEPSPSLTRVGANFYSSVKQQDYSASVWLRRKDKLEHSQQKCIVIFALVCCFAILVALIFSAVDIMGEDEDGLSEKNCQNKCRIALVENIPEGLNYSENAPFHLSLFQGWMNLLNMAKKSVDIVSSHWDLNHTHPSACQGQRLFEKLLQLTSQNIEIKLVSDVTADSKVLEALKLKGAEVTYMNMTAYNKGRLQSSFWIVDKQHVYIGSAGLDWQSLGQMKELGVIFYNCSCLVLDLQRIFALYSSLKFKSRVPQTWSKRLYGVYDNEKKLQLQLNETKSQAFVSNSPKLFCPKNRSFDIDAIYSVIDDAKQYVYIAVMDYLPISSTSTKRTYWPDLDAKIREALVLRSVRVRLLLSFWKETDPLTFNFISSLKAICTEIANCSLKVKFFDLERENACATKEQKNHTFPRLNRNKYMVTDGAAYIGNFDWVGNDFTQNAGTGLVINQADVRNNRSIIKQLKDVFERDWYSPYAKTLQPTKQPNCSSLFKLKPLSNKTATDDTGGKDPRNV

SEQ ID NO: 33615 - protein, 47 aa, Homo sapiens
  ENSP00000314748
MSQQKCIVIFALVCCFAILVALIFSAVDIMGEDEDGLSEKNCQNKCR

SEQ ID NO: 33616 - protein, 109 aa, Homo sapiens
  ENSP00000355503
MEIRQHEWLSASPHEGFEQMRLKSRPKEPSPSLTRVGANFYSSVKQQDYSASVWLRRKDKLEHSQQKCIVIFALVCCFAILVALIFSAVDIMGEDEDGLSEKNCQNKCR

SEQ ID NO: 33617 - protein, 197 aa, Homo sapiens
  ENSP00000440132
MEIRQHEWLSASPHEGFEQMRLKSRPKEPSPSLTRVGANFYSSVKQQDYSASVWLRRKDKLEHSQQKCIVIFALVCCFAILVALIFSAVDIMGEDEDGLSEKNCQNKCRIALVENIPEGLNYSENAPFHLSLFQGWMNLLNMAKKSVDIVSSHWDLNHTHPSACQGQRLFEKLLQLTSQNIEIKLVSDVTADSKEPR

SEQ ID NO: 33618 - protein, 140 aa, Homo sapiens
  ENSP00000438191
MSQQKCIVIFALVCCFAILVALIFSAVDIMGEDEDGLSEKNCQNKCRIALVENIPEGLNYSENAPFHLSLFQGWMNLLNMAKKSVDIVSSHWDLNHTHPSACQGQRLFEKLLQLTSQNIEIKLVSDVTADSKVLEALKLK

SEQ ID NO: 33619 - protein, 536 aa, Homo sapiens; identical to SEQ ID NO: 33614
  ENSP00000414188

SEQ ID NO: 33620 - protein, 474 aa, Homo sapiens
  ENSP00000401285
MSQQKCIVIFALVCCFAILVALIFSAVDIMGEDEDGLSEKNCQNKCRIALVENIPEGLNYSENAPFHLSLFQGWMNLLNMAKKSVDIVSSHWDLNHTHPSACQGQRLFEKLLQLTSQNIEIKLVSDVTADSKVLEALKLKGAEVTYMNMTAYNKGRLQSSFWIVDKQHVYIGSAGLDWQSLGQMKELGVIFYNCSCLVLDLQRIFALYSSLKFKSRVPQTWSKRLYGVYDNEKKLQLQLNETKSQAFVSNSPKLFCPKNRSFDIDAIYSVIDDAKQYVYIAVMDYLPISSTSTKRTYWPDLDAKIREALVLRSVRVRLLLSFWKETDPLTFNFISSLKAICTEIANCSLKVKFFDLERENACATKEQKNHTFPRLNRNKYMVTDGAAYIGNFDWVGNDFTQNAGTGLVINQADVRNNRSIIKQLKDVFERDWYSPYAKTLQPTKQPNCSSLFKLKPLSNKTATDDTGGKDPRNV

SEQ ID NO: 33621 - protein, 506 aa, Homo sapiens
  ENSP00000317175
MFTSKSNSVSPSPSLEQADSDALDISTKVQLYGVLWKRPFGRPSAKWSRRFFIIKESFLLYYSESEKKSFETNKYFNIHPKGVIPLGGCLVEPKEEPSMPYAMKISHQDFHGNILLAAESEFEQTQWLEMLQESGKVTWKNAQLGEAMIKSLEAQGLQLAKEKQEYLDKLMEETEELCLQREQREELERLNQVLEAEKQQFEEVVQELRMEQEQIKRELELTARCLKGVEQEKKELRHLTESLQQTLEELSIEKKKTLEMLEENENHLQTLANQSEQPPPSGGLHSNLRQIEEKMQQLLEEKLLAEKRMKENEERSRALEEEREFYSSQSQALQNSLQELTAEKQQAERELKAEVKVRMDLERRLREAEGALRSLEQGLNSKVRNKEKEERMRADVSHLKRFFEECIRNAELEAKMPVIMKNSVYIHKAATRRIKSCRFHRRRSSTSWNDMKPSQSFMTSQLDANNMEELKEVAKRLSRDQRFRESIYHIMATQPGAPSALSRGGK

SEQ ID NO: 33622 - protein, 188 aa, Homo sapiens
  ENSP00000450501
MPVSTSLHQDGSQERPVSLTSTTSSSGSSCDSRSAMEEPSSSEAPAKNGAGSLRSRHLPNSNNNSSSWLNVKGPLSPFNSRAAAGPAHHKLSYLGRVVREIVETERMYVQDLRSIVEDYLLKIIDTPGLLKPEQVSALFGNIENIYALNSQLLRDLDSCNSDPVAVASCFVERSQEFDIYTQYCNNYP

SEQ ID NO: 33623 - protein, 603 aa, Homo sapiens
  ENSP00000489373
MPVSTSLHQDGSQERPVSLTSTTSSSGSSCDSRSAMEEPSSSEAPAKNGAGSLRSRHLPNSNNNSSSWLNVKGPLSPFNSRAAAGPAHHKLSYLGRVVREIVETERMYVQDLRSIVESQEFDIYTQYCNNYPNSVAALTECMRDKQQAKFFRDRQELLQHSLPLGSYLLKPVQRILKYHLLLQEIAKHFDEEEDGFEVVEDAIDTMTCVAWYINDMKRRHEHAVRLQEIQSLLINWKGPDLTTYGELVLEGTFRVHRVRNERTFFLFDKTLLITKKRGDHFVYKGNIPCSSLMLIESTRDSLCFTVTHYKHSKQQYSIQAKTVEEKRNWTHHIKRLILENHHATIPQKAKEAILEMDSYYPNRYRCSPERLKKAWSSQDEVSTNVRQGRRQSEPTKHLLRQLNEKARAAGMKGKGRRESESSRSSRRPSGRSPTSTEKRMSFESISSLPEVEPDPEAGSEQEVFSAVEGPSAEETPSDTESPEVLETQLDAHQGLLGMDPPGDMVDFVAAESTEDLKALSSEEEEEMGGAAQEPESLLPPSVLDQASVIAERFVSSFSRRSSVAQEDSKSSGFGSPRLVSRSSSVLSLEGSEKGLARHGSATD

SEQ ID NO: 33624 - protein, 1219 aa, Homo sapiens
  ENSP00000247226
MPVSTSLHQDGSQERPVSLTSTTSSSGSSCDSRSAMEEPSSSEAPAKNGAGSLRSRHLPNSNNNSSSWLNVKGPLSPFNSRAAAGPAHHKLSYLGRVVREIVETERMYVQDLRSIVEDYLLKIIDTPGLLKPEQVSALFGNIENIYALNSQLLRDLDSCNSDPVAVASCFVERSQEFDIYTQYCNNYPNSVAALTECMRDKQQAKFFRDRQELLQHSLPLGSYLLKPVQRILKYHLLLQEIAKHFDEEEDGFEVVEDAIDTMTCVAWYINDMKRRHEHAVRLQEIQSLLINWKGPDLTTYGELVLEGTFRVHRVRNERTFFLFDKTLLITKKRGDHFVYKGNIPCSSLMLIESTRDSLCFTVTHYKHSKQQYSIQAKTVEEKRNWTHHIKRLILENHHATIPQKAKEAILEMDSYYPNRYRCSPERLKKAWSSQDEVSTNVRQGRRQSEPTKHLLRQLNEKARAAGMKGKGRRESESSRSSRRPSGRSPTSTEKRMSFESISSLPEVEPDPEAGSEQEVFSAVEGPSAEETPSDTESPEVLETQLDAHQGLLGMDPPGDMVDFVAAESTEDLKALSSEEEEEMGGAAQEPESLLPPSVLDQASVIAERFVSSFSRRSSVAQEDSKSSGFGSPRLVSRSSSVLSLEGSEKGLARHGSATDSLSCQLSPEVDISVGVATEDSPSVNGMEPPSPGCPVEPDRSSCKKKESALSTRDRLLLDKIKSYYENAEHHDAGFSVRRRESLSYIPKGLVRNSISRFNSLPRPDPEPVPPVGSKRQVGSRPTSWALFELPGPSQAVKGDPPPISDAEFRPSSEIVKIWEGMESSGGSPGKGPGQGQANGFDLHEPLFILEEHELGAITEESATASPESSSPTEGRSPAHLARELKELVKELSSSTQGELVAPLHPRIVQLSHVMDSHVSERVKNKVYQLARQYSLRIKSNKPVMARPPLQWEKVAPERDGKSPTVPCLQEEAGEPLGGKGKRKPVLSLFDYEQLMAQEHSPPKPSSAGEMSPQRFFFNPSAVSQRTTSPGGRPSARSPLSPTETFSWPDVRELCSKYASRDEARRAGGGRPRGPPVNRSHSVPENMVEPPLSGRVGRCRSLSTKRGRGGGEAAQSPGPLPQSKPDGGETLYVTADLTLEDNRRVIVMEKGPLPSPTAGLEESSGQGPSSPVALLGQVQDFQQSAECQPKEEGSRDPADPSQQGRVRNLREKFQALNSVG

SEQ ID NO: 33625 - protein, 62 aa, Homo sapiens
  ENSP00000450880
MGALLRKANLPGVPSPGSNARMPVSTSLHQDGSQERPVSLTSTTSSSGSSCDSRSAMEEPSS

SEQ ID NO: 33626 - protein, 161 aa, Homo sapiens
  ENSP00000451256
MPVSTSLHQDGSQERPVSLTSTTSSSGSSCDSRSAMEEPSSSEAPAKNGAGSLRSRHLPNSNNNSSSWLNVKGPLSPFNSRAAAGPAHHKLSYLGRVVREIVETERMYVQDLRSIVEDYLLKIIDTPGLLKPEQVSALFGNIENIYALNSQLLRDLDSCNS

SEQ ID NO: 33627 - protein, 752 aa, Homo sapiens
  ENSP00000450945
MGKGRRESESSRSSRRPSGRSPTSTEKRMSFESISSLPEVEPDPEAGSEQEVFSAVEGPSAEETPSDTESPEVLETQLDAHQGLLGMDPPGDMVDFVAAESTEDLKALSSEEEEEMGGAAQEPESLLPPSVLDQASVIAERFVSSFSRRSSVAQEDSKSSGFGSPRLVSRSSSVLSLEGSEKGLARHGSATDSLSCQLSPEVDISVGVATEDSPSVNGMEPPSPGCPVEPDRSSCKKKESALSTRDRLLLDKIKSYYENAEHHDAGFSVRRRESLSYIPKGLVRNSISRFNSLPRPDPEPVPPVGSKRQVGSRPTSWALFELPGPSQAVKGDPPPISDAEFRPSSEIVKIWEGMESSGGSPGKGPGQGQANGFDLHEPLFILEEHELGAITEESATASPESSSPTEGRSPAHLARELKELVKELSSSTQGELVAPLHPRIVQLSHVMDSHVSERVKNKVYQLARQYSLRIKSNKPVMARPPLQWEKVAPERDGKSPTVPCLQEEAGEPLGGKGKRKPVLSLFDYEQLMAQEHSPPKPSSAGEMSPQRFFFNPSAVSQRTTSPGGRPSARSPLSPTETFSWPDVRELCSKYASRDEARRAGGGRPRGPPVNRSHSVPENMVEPPLSGRVGRCRSLSTKRGRGGGEAAQSPGPLPQSKPDGGETLYVTADLTLEDNRRVIVMEKGPLPSPTAGLEESSGQGPSSPVALLGQVQDFQQSAECQPKEEGSRDPADPSQQGRVRNLREKFQALNSVG

SEQ ID NO: 33628 - protein, 724 aa, Homo sapiens
  ENSP00000450973
MSFESISSLPEVEPDPEAGSEQEVFSAVEGPSAEETPSDTESPEVLETQLDAHQGLLGMDPPGDMVDFVAAESTEDLKALSSEEEEEMGGAAQEPESLLPPSVLDQASVIAERFVSSFSRRSSVAQEDSKSSGFGSPRLVSRSSSVLSLEGSEKGLARHGSATDSLSCQLSPEVDISVGVATEDSPSVNGMEPPSPGCPVEPDRSSCKKKESALSTRDRLLLDKIKSYYENAEHHDAGFSVRRRESLSYIPKGLVRNSISRFNSLPRPDPEPVPPVGSKRQVGSRPTSWALFELPGPSQAVKGDPPPISDAEFRPSSEIVKIWEGMESSGGSPGKGPGQGQANGFDLHEPLFILEEHELGAITEESATASPESSSPTEGRSPAHLARELKELVKELSSSTQGELVAPLHPRIVQLSHVMDSHVSERVKNKVYQLARQYSLRIKSNKPVMARPPLQWEKVAPERDGKSPTVPCLQEEAGEPLGGKGKRKPVLSLFDYEQLMAQEHSPPKPSSAGEMSPQRFFFNPSAVSQRTTSPGGRPSARSPLSPTETFSWPDVRELCSKYASRDEARRAGGGRPRGPPVNRSHSVPENMVEPPLSGRVGRCRSLSTKRGRGGGEAAQSPGPLPQSKPDGGETLYVTADLTLEDNRRVIVMEKGPLPSPTAGLEESSGQGPSSPVALLGQVQDFQQSAECQPKEEGSRDPADPSQQGRVRNLREKFQALNSVG

SEQ ID NO: 33629 - protein, 1163 aa, Homo sapiens
  ENSP00000378183
MPVSTSLHQDGSQERPVSLTSTTSSSGSSCDSRSAMEEPSSSEAPAKNGAGSLRSRHLPNSNNNSSSWLNVKGPLSPFNSRAAAGPAHHKLSYLGRVVREIVETERMYVQDLRSIVESQEFDIYTQYCNNYPNSVAALTECMRDKQQAKFFRDRQELLQHSLPLGSYLLKPVQRILKYHLLLQEIAKHFDEEEDGFEVVEDAIDTMTCVAWYINDMKRRHEHAVRLQEIQSLLINWKGPDLTTYGELVLEGTFRVHRVRNERTFFLFDKTLLITKKRGDHFVYKGNIPCSSLMLIESTRDSLCFTVTHYKHSKQQYSIQAKTVEEKRNWTHHIKRLILENHHATIPQKAKEAILEMDSYYPNRYRCSPERLKKAWSSQDEVSTNVRQGRRQSEPTKHLLRQLNEKARAAGMKGKGRRESESSRSSRRPSGRSPTSTEKRMSFESISSLPEVEPDPEAGSEQEVFSAVEGPSAEETPSDTESPEVLETQLDAHQGLLGMDPPGDMVDFVAAESTEDLKALSSEEEEEMGGAAQEPESLLPPSVLDQASVIAERFVSSFSRRSSVAQEDSKSSGFGSPRLVSRSSSVLSLEGSEKGLARHGSATDSLSCQLSPEVDISVGVATEDSPSVNGMEPPSPGCPVEPDRSSCKKKESALSTRDRLLLDKIKSYYENAEHHDAGFSVRRRESLSYIPKGLVRNSISRFNSLPRPDPEPVPPVGSKRQVGSRPTSWALFELPGPSQAVKGDPPPISDAEFRPSSEIVKIWEGMESSGGSPGKGPGQGQANGFDLHEPLFILEEHELGAITEESATASPESSSPTEGRSPAHLARELKELVKELSSSTQGELVAPLHPRIVQLSHVMDSHVSERVKNKVYQLARQYSLRIKSNKPVMARPPLQWEKVAPERDGKSPTVPCLQEEAGEPLGGKGKRKPVLSLFDYEQLMAQEHSPPKPSSAGEMSPQRFFFNPSAVSQRTTSPGGRPSARSPLSPTETFSWPDVRELCSKYASRDEARRAGGGRPRGPPVNRSHSVPENMVEPPLSGRVGRCRSLSTKRGRGGGEAAQSPGPLPQSKPDGGETLYVTADLTLEDNRRVIVMEKGPLPSPTAGLEESSGQGPSSPVALLGQVQDFQQSAECQPKEEGSRDPADPSQQGRVRNLREKFQALNSVG

SEQ ID NO: 33630 - protein, 1083 aa, Homo sapiens
  ENSP00000366977
MNSVLTKHGSPPRSWLSLCSGTDDQSPAEKKGLRCQNPACMDKGRAAKVCHHADCQQLHRRGPLNLCEACDSKFHSTMHYDGHVRFDLPPQGSVLARNVSTRSCPPRTSPAVDLEEEEEESSVDGKGDRKSTGLKLSKKKARRRHTDDPSKECFTLKFDLNVDIETEIVPAMKKKSLGEVLLPVFERKGIALGKVDIYLDQSNTPLSLTFEAYRFGGHYLRVKAPAKPGDEGKVEQGMKDSKSLSLPILRPAGTGPPALERVDAQSRRESLDILAPGRRRKNMSEFLGEASIPGQEPPTPSSCSLPSGSSGSTNTGDSWKNRAASRFSGFFSSGPSTSAFGREVDKMEQLEGKLHTYSLFGLPRLPRGLRFDHDSWEEEYDEDEDEDNACLRLEDSWRELIDGHEKLTRRQCHQQEAVWELLHTEASYIRKLRVIINLFLCCLLNLQESGLLCEVEAERLFSNIPEIAQLHRRLWASVMAPVLEKARRTRALLQPGDFLKGFKMFGSLFKPYIRYCMEEEGCMEYMRGLLRDNDLFRAYITWAEKHPQCQRLKLSDMLAKPHQRLTKYPLLLKSVLRKTEEPRAKEAVVAMIGSVERFIHHVNACMRQRQERQRLAAVVSRIDAYEVVESSSDEVDKLLKEFLHLDLTAPIPGASPEETRQLLLEGSLRMKEGKDSKMDVYCFLFTDLLLVTKAVKKAERTRVIRPPLLVDKIVCRELRDPGSFLLIYLNEFHSAVGAYTFQASGQALCRGWVDTIYNAQNQLQQLRAQEPPGSQQPLQSLEEEEDEQEEEEEEEEEEEEGEDSGTSAASSPTIMRKSSGSPDSQHCASDGSTETLAMVVVEPGDTLSSPEFDSGPFSSQSDETSLSTTASSATPTSELLPLGPVDGRSCSMDSAYGTLSPTSLQDFVAPGPMAELVPRAPESPRVPSPPPSPRLRRRTPVQLLSCPPHLLKSKSEASLLQLLAGAGTHGTPSAPSRSLSELCLAVPAPGIRTQGSPQEAGPSWDCRGAPSPGSGPGLVGCLAGEPAGSHRKRCGDLPSGASPRVQPEPPPGVSAQHRKLTLAQLYRIRTTLLLNSTLTASEV

SEQ ID NO: 33631 - protein, 930 aa, Homo sapiens
  ENSP00000366954
MHYDGHVRFDLPPQGSVLARNVSTRSCPPRTSPAVDLEEEEEESSVDGKGDRKSTGLKLSKKKARRRHTDDPSKECFTLKFDLNVDIETEIVPAMKKKSLGEVLLPVFERKGIALGKVDIYLDQSNTPLSLTFEAYRFGGHYLRVKAPAKPGDEGKVEQGMKDSKSLSLPILRPAGTGPPALERVDAQSRRESLDILAPGRRRKNMSEFLGEASIPGQEPPTPSSCSLPSGSSGSTNTGDSWKNRAASRFSGFFSSGPSTSAFGREVDKMEQLEGKLHTYSLFGLPRLPRGLRFDHDSWEEEYDEDEDEDNACLRLEDSWRELIDGHEKLTRRQCHQQEAVWELLHTEASYIRKLRVIINLFLCCLLNLQESGLLCEVEAERLFSNIPEIAQLHRRLWASVMAPVLEKARRTRALLQPGDFLKGFKMFGSLFKPYIRYCMEEEGCMEYMRGLLRDNDLFRAYITWAEKHPQCQRLKLSDMLAKPHQRLTKYPLLLKSVLRKTEEPRAKEAVVAMIGSVERFIHHVNACMRQRQERQRLAAVVSRIDAYEVVESSSDEVDKLLKEFLHLDLTAPIPGASPEETRQLLLEGSLRMKEGKDSKMDVYCFLFTDLLLVTKAVKKAERTRVIRPPLLVDKIVCRELRDPGSFLLIYLNEFHSAVGAYTFQASGQALCRGWVDTIYNAQNQLQQLRAQEPPGSQQPLQSLEEEEDEQEEEEEEEEEEEEGEDSGTSAASSPTIMRKSSGSPDSQHCASDGSTETLAMVVVEPGDTLSSPEFDSGPFSSQSDETSLSTTASSATPTSELLPLGPVDGRSCSMDSAYGTLSPTSLQDFVAPGPMAELVPRAPESPRVPSPPPSPRLRRRTPVQLLSCPPHLLKSKSEASLLQLLAGAGTHGTPSAPSRSLSELCLAVPAPAQEADPGPALPNQDHPAA

SEQ ID NO: 33632 - protein, 1006 aa, Homo sapiens
  ENSP00000366957
MHYDGHVRFDLPPQGSVLARNVSTRSCPPRTSPAVDLEEEEEESSVDGKGDRKSTGLKLSKKKARRRHTDDPSKECFTLKFDLNVDIETEIVPAMKKKSLGEVLLPVFERKGIALGKVDIYLDQSNTPLSLTFEAYRFGGHYLRVKAPAKPGDEGKVEQGMKDSKSLSLPILRPAGTGPPALERVDAQSRRESLDILAPGRRRKNMSEFLGEASIPGQEPPTPSSCSLPSGSSGSTNTGDSWKNRAASRFSGFFSSGPSTSAFGREVDKMEQLEGKLHTYSLFGLPRLPRGLRFDHDSWEEEYDEDEDEDNACLRLEDSWRELIDGHEKLTRRQCHQQEAVWELLHTEASYIRKLRVIINLFLCCLLNLQESGLLCEVEAERLFSNIPEIAQLHRRLWASVMAPVLEKARRTRALLQPGDFLKGFKMFGSLFKPYIRYCMEEEGCMEYMRGLLRDNDLFRAYITWAEKHPQCQRLKLSDMLAKPHQRLTKYPLLLKSVLRKTEEPRAKEAVVAMIGSVERFIHHVNACMRQRQERQRLAAVVSRIDAYEVVESSSDEVDKLLKEFLHLDLTAPIPGASPEETRQLLLEGSLRMKEGKDSKMDVYCFLFTDLLLVTKAVKKAERTRVIRPPLLVDKIVCRELRDPGSFLLIYLNEFHSAVGAYTFQASGQALCRGWVDTIYNAQNQLQQLRAQEPPGSQQPLQSLEEEEDEQEEEEEEEEEEEEGEDSGTSAASSPTIMRKSSGSPDSQHCASDGSTETLAMVVVEPGDTLSSPEFDSGPFSSQSDETSLSTTASSATPTSELLPLGPVDGRSCSMDSAYGTLSPTSLQDFVAPGPMAELVPRAPESPRVPSPPPSPRLRRRTPVQLLSCPPHLLKSKSEASLLQLLAGAGTHGTPSAPSRSLSELCLAVPAPGIRTQGSPQEAGPSWDCRGAPSPGSGPGLVGCLAGEPAGSHRKRCGDLPSGASPRVQPEPPPGVSAQHRKLTLAQLYRIRTTLLLNSTLTASEV

SEQ ID NO: 33633 - protein, 1043 aa, Homo sapiens
  ENSP00000366961
MDKGRAAKVCHHADCQQLHRRGPLNLCEACDSKFHSTMHYDGHVRFDLPPQGSVLARNVSTRSCPPRTSPAVDLEEEEEESSVDGKGDRKSTGLKLSKKKARRRHTDDPSKECFTLKFDLNVDIETEIVPAMKKKSLGEVLLPVFERKGIALGKVDIYLDQSNTPLSLTFEAYRFGGHYLRVKAPAKPGDEGKVEQGMKDSKSLSLPILRPAGTGPPALERVDAQSRRESLDILAPGRRRKNMSEFLGEASIPGQEPPTPSSCSLPSGSSGSTNTGDSWKNRAASRFSGFFSSGPSTSAFGREVDKMEQLEGKLHTYSLFGLPRLPRGLRFDHDSWEEEYDEDEDEDNACLRLEDSWRELIDGHEKLTRRQCHQQEAVWELLHTEASYIRKLRVIINLFLCCLLNLQESGLLCEVEAERLFSNIPEIAQLHRRLWASVMAPVLEKARRTRALLQPGDFLKGFKMFGSLFKPYIRYCMEEEGCMEYMRGLLRDNDLFRAYITWAEKHPQCQRLKLSDMLAKPHQRLTKYPLLLKSVLRKTEEPRAKEAVVAMIGSVERFIHHVNACMRQRQERQRLAAVVSRIDAYEVVESSSDEVDKLLKEFLHLDLTAPIPGASPEETRQLLLEGSLRMKEGKDSKMDVYCFLFTDLLLVTKAVKKAERTRVIRPPLLVDKIVCRELRDPGSFLLIYLNEFHSAVGAYTFQASGQALCRGWVDTIYNAQNQLQQLRAQEPPGSQQPLQSLEEEEDEQEEEEEEEEEEEEGEDSGTSAASSPTIMRKSSGSPDSQHCASDGSTETLAMVVVEPGDTLSSPEFDSGPFSSQSDETSLSTTASSATPTSELLPLGPVDGRSCSMDSAYGTLSPTSLQDFVAPGPMAELVPRAPESPRVPSPPPSPRLRRRTPVQLLSCPPHLLKSKSEASLLQLLAGAGTHGTPSAPSRSLSELCLAVPAPGIRTQGSPQEAGPSWDCRGAPSPGSGPGLVGCLAGEPAGSHRKRCGDLPSGASPRVQPEPPPGVSAQHRKLTLAQLYRIRTTLLLNSTLTASEV

SEQ ID NO: 33634 - protein, 1062 aa, Homo sapiens
  ENSP00000383706
MDDQSPAEKKGLRCQNPACMDKGRAAKVCHHADCQQLHRRGPLNLCEACDSKFHSTMHYDGHVRFDLPPQGSVLARNVSTRSCPPRTSPAVDLEEEEEESSVDGKGDRKSTGLKLSKKKARRRHTDDPSKECFTLKFDLNVDIETEIVPAMKKKSLGEVLLPVFERKGIALGKVDIYLDQSNTPLSLTFEAYRFGGHYLRVKAPAKPGDEGKVEQGMKDSKSLSLPILRPAGTGPPALERVDAQSRRESLDILAPGRRRKNMSEFLGEASIPGQEPPTPSSCSLPSGSSGSTNTGDSWKNRAASRFSGFFSSGPSTSAFGREVDKMEQLEGKLHTYSLFGLPRLPRGLRFDHDSWEEEYDEDEDEDNACLRLEDSWRELIDGHEKLTRRQCHQQEAVWELLHTEASYIRKLRVIINLFLCCLLNLQESGLLCEVEAERLFSNIPEIAQLHRRLWASVMAPVLEKARRTRALLQPGDFLKGFKMFGSLFKPYIRYCMEEEGCMEYMRGLLRDNDLFRAYITWAEKHPQCQRLKLSDMLAKPHQRLTKYPLLLKSVLRKTEEPRAKEAVVAMIGSVERFIHHVNACMRQRQERQRLAAVVSRIDAYEVVESSSDEVDKLLKEFLHLDLTAPIPGASPEETRQLLLEGSLRMKEGKDSKMDVYCFLFTDLLLVTKAVKKAERTRVIRPPLLVDKIVCRELRDPGSFLLIYLNEFHSAVGAYTFQASGQALCRGWVDTIYNAQNQLQQLRAQEPPGSQQPLQSLEEEEDEQEEEEEEEEEEEEGEDSGTSAASSPTIMRKSSGSPDSQHCASDGSTETLAMVVVEPGDTLSSPEFDSGPFSSQSDETSLSTTASSATPTSELLPLGPVDGRSCSMDSAYGTLSPTSLQDFVAPGPMAELVPRAPESPRVPSPPPSPRLRRRTPVQLLSCPPHLLKSKSEASLLQLLAGAGTHGTPSAPSRSLSELCLAVPAPGIRTQGSPQEAGPSWDCRGAPSPGSGPGLVGCLAGEPAGSHRKRCGDLPSGASPRVQPEPPPGVSAQHRKLTLAQLYRIRTTLLLNSTLTASEV

SEQ ID NO: 33635 - protein, 852 aa, Homo sapiens
  ENSP00000366969
MNSVLTKHGSPPRSWLSLCSGTDDQSPAEKKGLRCQNPACMDKGRAAKVCHHADCQQLHRRGPLNLCEACDSKFHSTMHYDGHVRFDLPPQGSVLARNVSTRSCPPRTSPAVDLEEEEEESSVDGKGDRKSTGLKLSKKKARRRHTDDPSKECFTLKFDLNVDIETEIVPAMKKKSLGEVLLPVFERKGIALGKVDIYLDQSNTPLSLTFEAYRFGGHYLRVKAPAKPGDEGKVEQGMKDSKSLSLPILRPAGTGPPALERVDAQSRRESLDILAPGRRRKNMSEFLGEASIPGQEPPTPSSCSLPSGSSGSTNTGDSWKNRAASRFSGFFSSGPSTSAFGREVDKMEQLEGKLHTYSLFGLPRLPRGLRFDHDSWEEEYDEDEDEDNACLRLEDSWRELIDGHEKLTRRQCHQQEAVWELLHTEASYIRKLRVIINLFLCCLLNLQESGLLCEVEAERLFSNIPEIAQLHRRLWASVMAPVLEKARRTRALLQPGDFLKGFKMFGSLFKPYIRYCMEEEGCMEYMRGLLRDNDLFRAYITWAEKHPQCQRLKLSDMLAKPHQRLTKYPLLLKSVLRKTEEPRAKEAVVAMIGSVERFIHHVNACMRQRQERQRLAAVVSRIDAYEVVESSSDEVDKLLKEFLHLDLTAPIPGASPEETRQLLLEGSLRMKEGKDSKMDVYCFLFTDLLLVTKAVKKAERTRVIRPPLLVDKIVCRELRDPGSFLLIYLNEFHSAVGAYTFQASGQALCRGWVDTIYNAQNQLQQLRAQEPPGSQQPLQSLEEEEDEQEEEEEEEEEEEEGEDSGTSAASSPTIMRKSSGSPDSQHWKLTLAQLYRIRTTLLLNSTLTASEV

SEQ ID NO: 33636 - protein, 70 aa, Homo sapiens
  ENSP00000491569
MFLYWRKRGTYELEALPGDLAELELGTVERFSWSSTLDIIEDLGDDQSPAEKKGLRCQNPACMDKGRAAK

SEQ ID NO: 33637 - protein, 1006 aa, Homo sapiens; identical to SEQ ID NO: 33632
  ENSP00000383704

SEQ ID NO: 33638 - protein, 1075 aa, Homo sapiens
  ENSP00000441445
MGTGPGVSGRLAASRPGPGLPLRDSEPSWAGGRARDGDSQVCHHADCQQLHRRGPLNLCEACDSKFHSTMHYDGHVRFDLPPQGSVLARNVSTRSCPPRTSPAVDLEEEEEESSVDGKGDRKSTGLKLSKKKARRRHTDDPSKECFTLKFDLNVDIETEIVPAMKKKSLGEVLLPVFERKGIALGKVDIYLDQSNTPLSLTFEAYRFGGHYLRVKAPAKPGDEGKVEQGMKDSKSLSLPILRPAGTGPPALERVDAQSRRESLDILAPGRRRKNMSEFLGEASIPGQEPPTPSSCSLPSGSSGSTNTGDSWKNRAASRFSGFFSSGPSTSAFGREVDKMEQLEGKLHTYSLFGLPRLPRGLRFDHDSWEEEYDEDEDEDNACLRLEDSWRELIDGHEKLTRRQCHQQEAVWELLHTEASYIRKLRVIINLFLCCLLNLQESGLLCEVEAERLFSNIPEIAQLHRRLWASVMAPVLEKARRTRALLQPGDFLKGFKMFGSLFKPYIRYCMEEEGCMEYMRGLLRDNDLFRAYITWAEKHPQCQRLKLSDMLAKPHQRLTKYPLLLKSVLRKTEEPRAKEAVVAMIGSVERFIHHVNACMRQRQERQRLAAVVSRIDAYEVVESSSDEVDKLLKEFLHLDLTAPIPGASPEETRQLLLEGSLRMKEGKDSKMDVYCFLFTDLLLVTKAVKKAERTRVIRPPLLVDKIVCRELRDPGSFLLIYLNEFHSAVGAYTFQASGQALCRGWVDTIYNAQNQLQQLRAQEPPGSQQPLQSLEEEEDEQEEEEEEEEEEEEGEDSGTSAASSPTIMRKSSGSPDSQHCASDGSTETLAMVVVEPGDTLSSPEFDSGPFSSQSDETSLSTTASSATPTSELLPLGPVDGRSCSMDSAYGTLSPTSLQDFVAPGPMAELVPRAPESPRVPSPPPSPRLRRRTPVQLLSCPPHLLKSKSEASLLQLLAGAGTHGTPSAPSRSLSELCLAVPAPGIRTQGSPQEAGPSWDCRGAPSPGSGPGLVGCLAGEPAGSHRKRCGDLPSGASPRVQPEPPPGVSAQHRKLTLAQLYRIRTTLLLNSTLTASEV

SEQ ID NO: 33639 - protein, 1006 aa, Homo sapiens; identical to SEQ ID NO: 33632
  ENSP00000344570

SEQ ID NO: 33640 - protein, 1085 aa, Homo sapiens
  ENSP00000439625
MSLGERGSPQTFGGSSVSKGSDAGHDQSPAEKKGLRCQNPACMDKGRAAKVCHHADCQQLHRRGPLNLCEACDSKFHSTMHYDGHVRFDLPPQGSVLARNVSTRSCPPRTSPAVDLEEEEEESSVDGKGDRKSTGLKLSKKKARRRHTDDPSKECFTLKFDLNVDIETEIVPAMKKKSLGEVLLPVFERKGIALGKVDIYLDQSNTPLSLTFEAYRFGGHYLRVKAPAKPGDEGKVEQGMKDSKSLSLPILRPAGTGPPALERVDAQSRRESLDILAPGRRRKNMSEFLGEASIPGQEPPTPSSCSLPSGSSGSTNTGDSWKNRAASRFSGFFSSGPSTSAFGREVDKMEQLEGKLHTYSLFGLPRLPRGLRFDHDSWEEEYDEDEDEDNACLRLEDSWRELIDGHEKLTRRQCHQQEAVWELLHTEASYIRKLRVIINLFLCCLLNLQESGLLCEVEAERLFSNIPEIAQLHRRLWASVMAPVLEKARRTRALLQPGDFLKGFKMFGSLFKPYIRYCMEEEGCMEYMRGLLRDNDLFRAYITWAEKHPQCQRLKLSDMLAKPHQRLTKYPLLLKSVLRKTEEPRAKEAVVAMIGSVERFIHHVNACMRQRQERQRLAAVVSRIDAYEVVESSSDEVDKLLKEFLHLDLTAPIPGASPEETRQLLLEGSLRMKEGKDSKMDVYCFLFTDLLLVTKAVKKAERTRVIRPPLLVDKIVCRELRDPGSFLLIYLNEFHSAVGAYTFQASGQALCRGWVDTIYNAQNQLQQLRAQEPPGSQQPLQSLEEEEDEQEEEEEEEEEEEEGEDSGTSAASSPTIMRKSSGSPDSQHCASDGSTETLAMVVVEPGDTLSSPEFDSGPFSSQSDETSLSTTASSATPTSELLPLGPVDGRSCSMDSAYGTLSPTSLQDFVAPGPMAELVPRAPESPRVPSPPPSPRLRRRTPVQLLSCPPHLLKSKSEASLLQLLAGAGTHGTPSAPSRSLSELCLAVPAPGIRTQGSPQEAGPSWDCRGAPSPGSGPGLVGCLAGEPAGSHRKRCGDLPSGASPRVQPEPPPGVSAQHRKLTLAQLYRIRTTLLLNSTLTASEV

SEQ ID NO: 33641 - protein, 1364 aa, Homo sapiens
  ENSP00000330278
MAELKVEAPASVDWQKRCLTLETQLFRFRLQASKIRELLADKMQELEQRLLEAEQRAENAETQVGVMEEKVKLSNLKNVDSEGSLHRKYQELLKAIKGKDELISQLEAQLEKQKQMRAEEAKTVQEKAAKIKEWVTLKLAKLEMENQHLKSHNQRLVEQVGSLQDALEAIQIAPSRKLLVPPYGAAEQDSVPSEPGIQPMGQDSGSQAQGLKAAVLAPSPGALQSKDSVSEAASPLEDSSSSTVHSGETVEAKPLQPHLGRESPPHQPCMKLLTFRCSSASWGEGLVTAQRGMLPGTKTSAREGGPGSSLTLPKVRAPGTPRDSIQLAKRHHSQPQVGHGHFGRVVNIETEAFSALHPSGLPELESRARSREEPEKMEMEEPPPAGKNEERESPKALGAELEEVELGNKPPTPPLHQFSSWESRIYAVATSGMRLSDMSPRSNTACCASSPPALVSPGSFSGLVYKNVTVPVYTALKGRATQISNMPFMDESSGSDDDCSSQASFRISVPSSESRKTSGLGSPRAIKRGVSMSSLSSEGDYAIPPDACSLDSDYSEPEHKLQRTSSYSTDGLGLGGESLEKSGYLLKMGSQVKTWKRRWFVLRQGQIMYYKSPSDVIRKPQGQVDLNSRCQIVRGEGSQTFQLISEKKTYYLTADSPSLLEEWIRVLQSLLKVQATGPPALLRGGTKPTVKGWLTKVKHGHSKVVWCALVGKIFYYYRSHEDKRPLGCLPVRDAHIEEVDRSCDSDEDYEAGGTRRLLSSHCTLVIHPTEHSPTYLLIGTKHEKDTWLYHLTVAAGGSSAKVGTAYEQLIGKLMDGEGDPDSPLWRHPMLCYSKDGLYASLTTLPSEALQTEALKLFKSCQLFINVPVEAASVDYHVSLAQTALQVCLVHPELQSEIYCQLMKQTSCRPPQKYSLMQCWQLLALCAPLFLPQHHFLWYVKQQLQRHADPRSETGQYATYCQRAVERTLRTGEREARPSRMEVVSILLRNPFHHSLPFSIPVHFTNGTYHVVGFDGSSTVDEFLQRLNQEIGMRKPSHSGFALFTDDPSGRDLEHCLQGSVKICDAISKWEQAMKELHPGKSEGGTRVVKLMYKNRLYFRSQVKGETDRERLLLASQTSREIVAGRFPINKELALEMAALMAQVEYGDLEKPALPGPGGTSPAKAQHLLQQVLDRFHPRRYRHGAPAEQLRHLADMLTTKWATLQGCSPPECIRIYLTVARKWPFFGAKLFAAQPAQLSSKENALVWIAVNEDGVSILDHNTMQVHITYPYSSVTTFGGCRDDFMLVIRSIPDKSSGKSHIEKLIFRMAAPKIAEATFIMASYMNHCTTTVNPPTNPPGACQLWELDGRQFFSSVSCATKGPTLL

SEQ ID NO: 33642 - protein, 182 aa, Homo sapiens
  ENSP00000452988
  MOD_RES (1)..(1): Any amino acid
XLFLPQHHFLWYVKQQLQRHADPRSETGQYATYCQRAVERTLRTGEREARPSRMEVVSILLRNPFHHSLPFSIPVHFTNGTYHVVGFDGSSTVDEFLQRLNQEIGMRKPSHSGFALFTDDPSGRDLEHCLQGSVKICDAISKWEQAMKELHPGKSEGCTFAVKSKGRRTENGCSLPLKPVER

SEQ ID NO: 33643 - protein, 34 aa, Homo sapiens
  ENSP00000453343
  MOD_RES (1)..(1): Any amino acid
XFAAQPAQLSSKENALVWIAVNEDGVSILDHNTM

SEQ ID NO: 33644 - protein, 81 aa, Homo sapiens
  ENSP00000453699
  MOD_RES (1)..(1): Any amino acid
XLVIRSIPDKSSGKSHIEKLIFRMAAPKIAEATFIMASYMNHCTTTVNPPTNPPGACQLWELDGRQFFSSVSCATKGPTLL

SEQ ID NO: 33645 - protein, 1493 aa, Homo sapiens
  ENSP00000282406
MAELSEPEGPVDWKERCVALESQLMKFRVQASKIRELLAEKMQQLERQVIDAERQAEKAFQQVQVMEDKLKAANIQTSESETRLYNKCQDLESLIQEKDDVIQNLELQLEEQKQIRIQEAKIIEEKAAKIKEWVTVKLNELELENQNLRLINQNQTEEIRTMQSKLQEVQGKKSSTVSTLKLSEGQRLSSLTFGCFLSRARSPPQVVKSEEMSKISSKEPEFTEGKDMEEMEIPEKSVDNQVLENNRGQRTLHQTPCGSEQNRKTRTSFATDGGISQNSGAPVSDWSSDEEDGSKGRSKSRCTSTLSSHTSEEGVQCSRMGSEMYLTASDDSSSIFEEETFGIKRPEHKKLYSWQQEAQWKALNSPLGKGNSELSKKEQDSSSDELNKKFQSQRLDYSSSSSEANTPSPILTPALMPKHPNSLSGKGTQLVPSSHLPPPKLRIPNVFSISVALAKRHLSQPQLSSDRMFGTNRNAISMIRPLRPQETDLDLVDGDSTEVLENMDTSCDDGLFSYDSLDSPNSDDQEHCDSAKKVAYSKPPTPPLHRFPSWESRIYAVAKSGIRMSEAFNMESVNKNSAATLSYTTSGLYTSLIYKNMTTPVYTTLKGKATQISSSPFLDDSSGSEEEDSSRSSSRTSESDSRSRSGPGSPRAMKRGVSLSSVASESDYAIPPDAYSTDTEYSQPEQKLPKTCSSSSDNGKNEPLEKSGYLLKMSGKVKSWKRRWFVLKGGELLYYKSPSDVIRKPQGHIELSASCSILRGDNKQTVQLTTEKHTYYLTADSPNILEEWIKVLQNVLRVQAANPLSLQPEGKPTMKGLLTKVKHGYSKRVWCTLIGKTLYYFRSQEDKFPLGQIKLWEAKVEEVDRSCDSDEDYEASGRSLLSTHYTIVIHPKDQGPTYLLIGSKHEKDTWLYHLTVAAGSNNVNVGSEFEQLVCKLLNIDGEPSSQIWRHPTLCHSKEGIISPLTTLPSEALQTEAIKLFKTCQLFINAAVDSPAIDYHISLAQSALQICLTHPELQNEICCQLIKQTRRRQPQNQPGPLQGWQLLALCVGLFLPHHPFLWLLRLHLKRNADSRTEFGKYAIYCQRCVERTQQNGDREARPSRMEILSTLLRNPYHHSLPFSIPVHFMNGIYQVVGFDASTTVEEFLNTLNQDTGMRKPAQSGFALFTDDPSGRDLEHCLQGNIKICDIISKWEQASKEQQPGKCEGTRTVRLTYKNRLYFSVQARGETDREKLLLMYQTNDQIINGLFPLNKDLALEMAALLSQVEIGDFERPFSTPAGHVTNQCKVNQTLKQVIEKFYPKRYRDGCSEEQLRQLCQRLSTRWMALRGHSAADCVRIYLTVARKWPFFGAKLFLAKPITPSSLGSTFLWLAVHEDGLSLLEYNSMRLIVSYVYKSLMTFGGYQDDFMVVINNTHSKDKPTEKLLFAMAKPKILEITLLIASYINNFHQQKAAFHHLSAPALLSAQTRGPQARMMGSQPLLSSSRPTKGPTLL

SEQ ID NO: 33646 - protein, 89 aa, Homo sapiens
  ENSP00000427746
MAELSEPEGPVDWKERCVALESQLMKFRVQASKIRELLAEKMQQLERQVIDAERQAEKAFQQTESCSVAQAGVQWRDLGLLQPPPPGFK

SEQ ID NO: 33647 - protein, 88 aa, Homo sapiens
  ENSP00000430377
SKEQQPGKCEGTRTVRLTYKNRLYFSVQARGETDREKLLLMYQTNDQIINGLFPLNKDLALEMAALLSQAALPATFNQMDGPPGTQCC

SEQ ID NO: 33648 - protein, 490 aa, Homo sapiens
  ENSP00000326706
MEEEGVKEAGEKPRGAQMVDKAGWIKKSSGGLLGFWKDRYLLLCQAQLLVYENEDDQKCVETVELGSYEKCQDLRALLKRKHRFILLRSPGNKVSDIKFQAPTGEEKESWIKALNEGINRGKNKAFDEVKVDKSCALEHVTRDRVRGGQRRRPPTRVHLKEVASAASDGLLRLDLDVPDSGPPVFAPSNHVSEAQPRETPRPLMPPTKPFLAPETTSPGDRVETPVGERAPTPVSASSEVSPESQEDSETPAEEDSGSEQPPNSVLPDKLKVSWENPSPQEAPAAESAEPSQAPCSETSEAAPREGGKPPTPPPKILSEKLKASMGEMQASGPPAPGTVQVSVNGMDDSPEPAKPSQAEGTPGTPPKDATTSTALPPWDLPPQFHPRCSSLGDLLGEGPRHPLQPRERLYRAQLEVKVASEQTEKLLNKVLGSEPAPVSAETLLSQAVEQLRQATQVLQEMRDLGELSQEAPGLREKRKELVTLYRRSAP

SEQ ID NO: 33649 - protein, 440 aa, Homo sapiens
  ENSP00000483505
MEEEDDQKCVETVELGSYEKCQDLRALLKRKHRFILLRSPGNKVSDIKFQAPTGEEKESWIKALNEGINRGKNKAFDEVKVDKSCALEHVTRDRVRGGQRRRPPTRVHLKEVASAASDGLLRLDLDVPDSGPPVFAPSNHVSEAQPRETPRPLMPPTKPFLAPETTSPGDRVETPVGERAPTPVSASSEVSPESQEDSETPAEEDSGSEQPPNSVLPDKLKVSWENPSPQEAPAAESAEPSQAPCSETSEAAPREGGKPPTPPPKILSEKLKASMGEMQASGPPAPGTVQVSVNGMDDSPEPAKPSQAEGTPGTPPKDATTSTALPPWDLPPQFHPRCSSLGDLLGEGPRHPLQPRERLYRAQLEVKVASEQTEKLLNKVLGSEPAPVSAETLLSQAVEQLRQATQVLQEMRDLGELSQEAPGLREKRKELVTLYRRSAP

SEQ ID NO: 33650 - protein, 685 aa, Homo sapiens
  ENSP00000274289
MELLRTITYQPAASTKMCEQALGKGCGADSKKKRPPQPPEESQPPQSQAQVPPAAPHHHHHHSHSGPEISRIIVDPTTGKRYCRGKVLGKGGFAKCYEMTDLTNNKVYAAKIIPHSRVAKPHQREKIDKEIELHRILHHKHVVQFYHYFEDKENIYILLEYCSRRSMAHILKARKVLTEPEVRYYLRQIVSGLKYLHEQEILHRDLKLGNFFINEAMELKVGDFGLAARLEPLEHRRRTICGTPNYLSPEVLNKQGHGCESDIWALGCVMYTMLLGRPPFETTNLKETYRCIREARYTMPSSLLAPAKHLIASMLSKNPEDRPSLDDIIRHDFFLQGFTPDRLSSSCCHTVPDFHLSSPAKNFFKKAAAALFGGKKDKARYIDTHNRVSKEDEDIYKLRHDLKKTSITQQPSKHRTDEELQPPTTTVARSGTPAVENKQQIGDAIRMIVRGTLGSCSSSSECLEDSTMGSVADTVARVLRGCLENMPEADCIPKEQLSTSFQWVTKWVDYSNKYGFGYQLSDHTVGVLFNNGAHMSLLPDKKTVHYYAELGQCSVFPATDAPEQFISQVTVLKYFSHYMEENLMDGGDLPSVTDIRRPRLYLLQWLKSDKALMMLFNDGTFQVNFYHDHTKIIICSQNEEYLLTYINEDRISTTFRLTTLLMSGCSSELKNRMEYALNMLLQRCN

SEQ ID NO: 33651 - protein, 671 aa, Homo sapiens
  ENSP00000478685
MELLRTITYQPAASTKMCEQALGKGCGADSKKKRPPQPPEESQPPQSQAQVPPAISRIIVDPTTGKRYCRGKVLGKGGFAKCYEMTDLTNNKVYAAKIIPHSRVAKPHQREKIDKEIELHRILHHKHVVQFYHYFEDKENIYILLEYCSRRSMAHILKARKVLTEPEVRYYLRQIVSGLKYLHEQEILHRDLKLGNFFINEAMELKVGDFGLAARLEPLEHRRRTICGTPNYLSPEVLNKQGHGCESDIWALGCVMYTMLLGRPPFETTNLKETYRCIREARYTMPSSLLAPAKHLIASMLSKNPEDRPSLDDIIRHDFFLQGFTPDRLSSSCCHTVPDFHLSSPAKNFFKKAAAALFGGKKDKARYIDTHNRVSKEDEDIYKLRHDLKKTSITQQPSKHRTDEELQPPTTTVARSGTPAVENKQQIGDAIRMIVRGTLGSCSSSSECLEDSTMGSVADTVARVLRGCLENMPEADCIPKEQLSTSFQWVTKWVDYSNKYGFGYQLSDHTVGVLFNNGAHMSLLPDKKTVHYYAELGQCSVFPATDAPEQFISQVTVLKYFSHYMEENLMDGGDLPSVTDIRRPRLYLLQWLKSDKALMMLFNDGTFQVNFYHDHTKIIICSQNEEYLLTYINEDRISTTFRLTTLLMSGCSSELKNRMEYALNMLLQRCN

SEQ ID NO: 33652 - protein, 336 aa, Homo sapiens
  ENSP00000468376
MYTVLTGTPPFMASPLSEMYQNIREGHYPEPAHLSANARRLIVHLLAPNPAERPSLDHLLQDDFFTQGFTPDRLPAHSCHSPPIFAIPPPLGRIFRKVGQRLLTQCRPPCPFTPKEASGPGEGGPDPDSMEWDGESSLSAKEVPCLEGPIHLVAQGTLQSDLAGPEGSRRPEVEAALRHLQLCLDVGPPATQDPLGEQQPILWAPKWVDYSSKYGFGYQLLDGGRTGRHPHGPATPRREGTLPTPVPPAGPGLCLLRFLASEHALLLLFSNGMVQVSFSGVPAQLVLSGEGEGLQLTLWEQGSPGTSYSLDVPRSHGCAPTTGQHLHHALRMLQSI

SEQ ID NO: 33653 - protein, 304 aa, Homo sapiens
  ENSP00000493341
MYTVLTGTPPFMASPLSEMYQNIREGHYPEPAHLSANARRLIVHLLAPNPAERPSLDHLLQDDFFTQGFTPDRLPAHSCHSPPIFAIPPPLGRIFRKVGQRLLTQCRPPCPFTPKEASGPGEGGPDPDSMEWDGESSLSAKEVPCLEGPIHLVAQGTLQSDLAGPEGSRRPEVEAALRHLQLCLDVGPPATQDPLGEQQPILWAPKWVDYSSKYGFGYQLLDGGRTGRHPHGPATPRRPSVLHAQLREAGSLRPEGCARPAGRQAGRAAALCRLPAAAAAGGGDPPHTCATCWTRPLPPALPGL

SEQ ID NO: 33654 - protein, 336 aa, Homo sapiens; identical to SEQ ID NO: 33652
  ENSP00000466248

SEQ ID NO: 33655 - protein, 299 aa, Homo sapiens
  ENSP00000465896
MYTVLTGTPPFMASPLSEMYQNIREGHYPEPAHLSANARRLIVHLLAPNPAERPSLDHLLQDDFFTQGFTPDRLPAHSCHSPPIFAIPPPLGRIFRKVGQRLLTQCRPPCPFTPKEASGPGEGGPDPDSMEWDGESSLSAKEVPCLEGPIHLVAQGTLQSDLAGPEGSRRPEVEAALRHLQLCLDVGPPATQDPLGEQQPILWAPKWVDYSSKYGFGYQLLDGGRTGRHPHGPATPRRVSFSGVPAQLVLSGEGEGLQLTLWEQGSPGTSYSLDVPRSHGCAPTTGQHLHHALRMLQSI

SEQ ID NO: 33656 - protein, 161 aa, Homo sapiens
  ENSP00000481720
MAEFPSKVSTRTSSPAQGAEASVSALRPDLGFVRSRLGALMLLQLVLGLLVWALIADTPYHLYPAYGWVMFVAVFLWLVTIVLFNLYLFQLHMKLYMVPWPLVLMIFNISATVLYITAFIACSAAVDLTSLRGTRPYNQRAAASVLVTSRRPQLDCRRCLL

SEQ ID NO: 33657 - protein, 182 aa, Homo sapiens
  ENSP00000219207
MAEFPSKVSTRTSSPAQGAEASVSALRPDLGFVRSRLGALMLLQLVLGLLVWALIADTPYHLYPAYGWVMFVAVFLWLVTIVLFNLYLFQLHMKLYMVPWPLVLMIFNISATVLYITAFIACSAAVDLTSLRGTRPYNQRAAASFFACLVMIAYGVSAFFSYQAWRGVGSNAATSQMAGGYA

SEQ ID NO: 33658 - protein, 124 aa, Homo sapiens
  ENSP00000454656
MAEFPSKVSTRTSSPAQGAEASVSALRPDLGFVRSRLGALMLLQLLMIFNISATVLYITAFIACSAAVDLTSLRGTRPYNQRAAASFFACLVMIAYGVSAFFSYQAWRGVGSNAATSQMAGGYA

SEQ ID NO: 33659 - protein, 91 aa, Homo sapiens
  ENSP00000463575
MFVAVFLWLVTIVLFNLYLFQLHMKLYMVPWPLVLMIFNISATVLYITAFIACSAAVDLTSLRGTRPYNQRAAASFFACLVMIAYGVSAFF

SEQ ID NO: 33660 - protein, 418 aa, Homo sapiens
  ENSP00000419354
MLENHILHKRIYILTFFSQQIFILCHAHFIFFFTVRDFCRQDEKCDYYFSVDADVVLTNPRTLKILIEQNRKIIAPLVTRHGKLWSNFWGALSPDGYYARSEDYVDIVQGNRVGVWNVPYMANVYLIKGKTLRSEMNERNYFVRDKLDPDMALCRNAREMTLQREKDSPTPETFQMLSPPKGVFMYISNRHEFGRLLSTANYNTSHYNNDLWQIFENPVDWKEKYINRDYSKIFTENIVEQPCPDVFWFPIFSEKACDELVEEMEHYGKWSGGKHHDSRISGGYENVPTDDIHMKQVDLENVWLHFIREFIAPVTLKVFAGYYTKGFALLNFVVKYSPERQRSLRPHHDASTFTINIALNNVGEDFQGGGCKFLRYNCSIESPRKGWSFMHPGRLTHLHEGLPVKNGTRYIAVSFIDP

SEQ ID NO: 33661 - protein, 758 aa, Homo sapiens
  ENSP00000282903
MGGCTVKPQLLLLALVLHPWNPCLGADSEKPSSIPTDKLLVITVATKESDGFHRFMQSAKYFNYTVKVLGQGEEWRGGDGINSIGGGQKVRLMKEVMEHYADQDDLVVMFTECFDVIFAGGPEEVLKKFQKANHKVVFAADGILWPDKRLADKYPVVHIGKRYLNSGGFIGYAPYVNRIVQQWNLQDNDDDQLFYTKVYIDPLKREAINITLDHKCKIFQTLNGAVDEVVLKFENGKARAKNTFYETLPVAINGNGPTKILLNYFGNYVPNSWTQDNGCTLCEFDTVDLSAVDVHPNVSIGVFIEQPTPFLPRFLDILLTLDYPKEALKLFIHNKEVYHEKDIKVFFDKAKHEIKTIKIVGPEENLSQAEARNMGMDFCRQDEKCDYYFSVDADVVLTNPRTLKILIEQNRKIIAPLVTRHGKLWSNFWGALSPDGYYARSEDYVDIVQGNRVGVWNVPYMANVYLIKGKTLRSEMNERNYFVRDKLDPDMALCRNAREMTLQREKDSPTPETFQMLSPPKGVFMYISNRHEFGRLLSTANYNTSHYNNDLWQIFENPVDWKEKYINRDYSKIFTENIVEQPCPDVFWFPIFSEKACDELVEEMEHYGKWSGGKHHDSRISGGYENVPTDDIHMKQVDLENVWLHFIREFIAPVTLKVFAGYYTKGFALLNFVVKYSPERQRSLRPHHDASTFTINIALNNVGEDFQGGGCKFLRYNCSIESPRKGWSFMHPGRLTHLHEGLPVKNGTRYIAVSFIDP

SEQ ID NO: 33662 - protein, 737 aa, Homo sapiens
  ENSP00000353170
MGGCTVKPQLLLLALVLHPWNPCLGADSEKPSSIPTDKLLVITVATKESDGFHRFMQSAKYFNYTVKVLGQGEEWRGGDGINSIGGGQKVRLMKEVMEHYADQDDLVVMFTECFDVIFAGGPEEVLKKFQKANHKVVFAADGILWPDKRLADKYPVVHIGKRYLNSGGFIGYAPYVNRIVQQWNLQDNDDDQLFYTKVYIDPLKREAINITLDHKCKIFQTLNGAVDEVVLKFENGKARAKNTFYETLPVAINGNGPTKILLNYFGNYVPNSWTQDNGCTLCEFDTVDLSAVDVHPNVSIGVFIEQPTPFLPRFLDILLTLDYPKEALKLFIHNKEVYHEKDIKVFFDKAKHEIKTIKIVGPEENLSQAEARNMGMDFCRQDEKCDYYFSVDADVVLTNPRTLKILIEQNRKIIAPLVTRHGKLWSNFWGALSPDGYYARSEDYVDIVQGNRVGVWNVPYMANVYLIKGKTLRSEMNERNYFVRDKLDPDMALCRNAREMGVFMYISNRHEFGRLLSTANYNTSHYNNDLWQIFENPVDWKEKYINRDYSKIFTENIVEQPCPDVFWFPIFSEKACDELVEEMEHYGKWSGGKHHDSRISGGYENVPTDDIHMKQVDLENVWLHFIREFIAPVTLKVFAGYYTKGFALLNFVVKYSPERQRSLRPHHDASTFTINIALNNVGEDFQGGGCKFLRYNCSIESPRKGWSFMHPGRLTHLHEGLPVKNGTRYIAVSFIDP

SEQ ID NO: 33663 - protein, 703 aa, Homo sapiens
  ENSP00000420094
MQSAKYFNYTVKVLGQGEEWRGGDGINSIGGGQKVRLMKEVMEHYADQDDLVVMFTECFDVIFAGGPEEVLKKFQKANHKVVFAADGILWPDKRLADKYPVVHIGKRYLNSGGFIGYAPYVNRIVQQWNLQDNDDDQLFYTKVYIDPLKREAINITLDHKCKIFQTLNGAVDEVVLKFENGKARAKNTFYETLPVAINGNGPTKILLNYFGNYVPNSWTQDNGCTLCEFDTVDLSAVDVHPNVSIGVFIEQPTPFLPRFLDILLTLDYPKEALKLFIHNKEVYHEKDIKVFFDKAKHEIKTIKIVGPEENLSQAEARNMGMDFCRQDEKCDYYFSVDADVVLTNPRTLKILIEQNRKIIAPLVTRHGKLWSNFWGALSPDGYYARSEDYVDIVQGNRVGVWNVPYMANVYLIKGKTLRSEMNERNYFVRDKLDPDMALCRNAREMTLQREKDSPTPETFQMLSPPKGVFMYISNRHEFGRLLSTANYNTSHYNNDLWQIFENPVDWKEKYINRDYSKIFTENIVEQPCPDVFWFPIFSEKACDELVEEMEHYGKWSGGKHHDSRISGGYENVPTDDIHMKQVDLENVWLHFIREFIAPVTLKVFAGYYTKGFALLNFVVKYSPERQRSLRPHHDASTFTINIALNNVGEDFQGGGCKFLRYNCSIESPRKGWSFMHPGRLTHLHEGLPVKNGTRYIAVSFIDP

SEQ ID NO: 33664 - protein, 229 aa, Homo sapiens
  ENSP00000419963
MTRFGVRLYKLLVITVATKESDGFHRFMQSAKYFNYTVKVLGQGEEWRGGDGINSIGGGQKVRLMKEVMEHYADQDDLVVMFTECFDVIFAGGPEEVLKKFQKANHKVVFAADGILWPDKRLADKYPVVHIGKRYLNSGGFIGYAPYVNRIVQQWNLQDNDDDQLFYTKVYIDPLKREAINITLDHKCKIFQTLNGAVDEVVLKFENGKARAKNTFYETLPVAINGNGP

SEQ ID NO: 33665 - protein, 98 aa, Homo sapiens
  ENSP00000419880
MGGCTVKPQLLLLALVLHPWNPCLGADSEKPSSIPTDKLLVITVATKESDGFHRFMQSAKYFNYTVKKEGSVSQVFSTNKRRTRRYLGPWSRRRMERW

SEQ ID NO: 33666 - protein, 122 aa, Homo sapiens
  ENSP00000403335
MGLLECCARCLVGAPFASLVATGLCFFGVALFCGCGHEALTGTEKLIETYFSKNYQDYEYLINVIHAFQYVIYGTASFFFLYGALLLAEGFYTTGAVRQIFGDYKTTICGKGLSATVTGGQK

SEQ ID NO: 33667 - protein, 136 aa, Homo sapiens
  ENSP00000480409
MGLLECCARCLVGAPFASLVATGLCFFGVALFCGCGHEALTGTEKLIETYFSKNYQDYEYLINVIHAFQYVIYGTASFFFLYGALLLAEGFYTTGAVRQIFGDYKTTICGKGLSATVTGGQKGRGSRGQHQAHSLE

SEQ ID NO: 33668 - protein, 136 aa, Homo sapiens; identical to SEQ ID NO: 33667
  ENSP00000409802

SEQ ID NO: 33669 - protein, 127 aa, Homo sapiens
  ENSP00000413931
MGLLECCARCLVGAPFASLVATGLCFFGVALFCGCGHEALTGTEKLIETYFSKNYQDYEYLINVIHAFQYVIYGTASFFFLYGALLLAEGFYTTGAVRQIFGDYKTTICGKGLSATVTGGQKGRGSR

SEQ ID NO: 33670 - protein, 100 aa, Homo sapiens
  ENSP00000393391
MGLLECCARCLVGAPFASLVATGLCFFGVALFCGCGHEALTGTEKLIETYFSKNYQDYEYLINVIHAFQYVIYGTASFFFLYGALLLAEGFYTTGAVRQI

SEQ ID NO: 33671 - protein, 111 aa, Homo sapiens
  ENSP00000391853
MGLLECCARCLVGAPFASLVATGLCFFGVALFCGCGHEALTGTEKLIETYFSKNYQDYEYLINVIHAFQYVIYGTASFFFLYGALLLAEGFYTTGAVRQIFGDYKTTICGK

SEQ ID NO: 33672 - protein, 277 aa, Homo sapiens
  ENSP00000484450
MGLLECCARCLVGAPFASLVATGLCFFGVALFCGCGHEALTGTEKLIETYFSKNYQDYEYLINVIHAFQYVIYGTASFFFLYGALLLAEGFYTTGAVRQIFGDYKTTICGKGLSATVTGGQKGRGSRGQHQAHSLERVCHCLGKWLGHPDKFVGITYALTVVWLLVFACSAVPVYIYFNTWTTCQSIAFPSKTSASIGSLCADARMYGVLPWNAFPGKVCGSNLLSICKTAEFQMTFHLFIAAFVGAAATLVSLLTFMIAATYNFAVLKLMGRGTKF

SEQ ID NO: 33673 - protein, 242 aa, Homo sapiens
  ENSP00000477619
MGLLECCARCLVGAPFASLVATGLCFFGVALFCGCGHEALTGTEKLIETYFSKNYQDYEYLINVIHAFQYVIYGTASFFFLYGALLLAEGFYTTGAVRQIFGDYKTTICGKGLSATFVGITYALTVVWLLVFACSAVPVYIYFNTWTTCQSIAFPSKTSASIGSLCADARMYGVLPWNAFPGKVCGSNLLSICKTAEFQMTFHLFIAAFVGAAATLVSLLTFMIAATYNFAVLKLMGRGTKF

SEQ ID NO: 33674 - protein, 277 aa, Homo sapiens; identical to SEQ ID NO: 33672
  ENSP00000481006

SEQ ID NO: 33675 - protein, 309 aa, Homo sapiens
  ENSP00000329697
MGVARGPGSRGQHPPPRQQEVCAEGPRARLHPAPPGLGASLPFAILTLVNAPYKRGFYCGDDSIRYPYRPDTITHGLMAGVTITATVILVSAGEAYLVYTDRLYSRSDFNNYVAAVYKVLGTFLFGAAVSQSLTDLAKYMIGRLRPNFLAVCDPDWSRVNCSVYVQLEKVCRGNPADVTEARLSFYSGHSSFGMYCMVFLALYVQARLCWKWARLLRPTVQFFLVAFALYVGYTRVSDYKHHWSDVLVGLLQGALVAALTVCYISDFFKARPPQHCLKEEELERKPSLSLTLTLGEADHNHYGYPHSSS

SEQ ID NO: 33676 - protein, 288 aa, Homo sapiens
  ENSP00000388565
MQRRWVFVLLDVLCLLVASLPFAILTLVNAPYKRGFYCGDDSIRYPYRPDTITHGLMAGVTITATVILVSAGEAYLVYTDRLYSRSDFNNYVAAVYKVLGTFLFGAAVSQSLTDLAKYMIGRLRPNFLAVCDPDWSRVNCSVYVQLEKVCRGNPADVTEARLSFYSGHSSFGMYCMVFLALYVQARLCWKWARLLRPTVQFFLVAFALYVGYTRVSDYKHHWSDVLVGLLQGALVAALTVCYISDFFKARPPQHCLKEEELERKPSLSLTLTLGEADHNHYGYPHSSS

SEQ ID NO: 33677 - protein, 232 aa, Homo sapiens
  ENSP00000269812
MAGVTITATVILVSAGEAYLVYTDRLYSRSDFNNYVAAVYKVLGTFLFGAAVSQSLTDLAKYMIGRLRPNFLAVCDPDWSRVNCSVYVQLEKVCRGNPADVTEARLSFYSGHSSFGMYCMVFLALYVQARLCWKWARLLRPTVQFFLVAFALYVGYTRVSDYKHHWSDVLVGLLQGALVAALTVCYISDFFKARPPQHCLKEEELERKPSLSLTLTLGEADHNHYGYPHSSS

SEQ ID NO: 33678 - protein, 208 aa, Homo sapiens
  ENSP00000488312
MAGVTITATVILVSAGEAYLVYTDRLYSRSDFNNYVAAVYKVLGTFLFGAAVSQSLTDLAKYMIGRLRPNFLAVCDPDWSRVNCSVYVQLEKVCRGNPADVTEARLSFYSGHSSFGMYCMVFLALYVQARLCWKWARLLRPTVQFFLVAFALYVGYTRVSDYKHHWSDVLVGLLQGALVAALTVCYISDFFKARPPQHCLKEEELERK

SEQ ID NO: 33679 - protein, 136 aa, Homo sapiens
  ENSP00000466947
  MOD_RES (1)..(1): Any amino acid
XVSQSLTDLAKYMIGRLRPNFLAVCDPDWSRVNCSVYVQLEKVCRGNPADVTEARLSFYSGHSSFGMYCMVFLALYVQARLCWKWARLLRPTVQFFLVAFALYVGYTRVSDYKHHWSDVLVGLLQGALVAALTVSF

SEQ ID NO: 33680 - protein, 178 aa, Homo sapiens
  ENSP00000466545
MQRRWVFVLLDVLCLLVGFSSPPASLPFAILTLVNAPYKRGFYCGDDSIRYPYRPDTITHGLMAGVTITATVILVSAGEAYLVYTDRLYSRSDFNNYVAAVYKVLGTFLFGAAVSQSLTDLAKYMIGRLRPNFLAVCDPDWSRVNCSVYVQLEKVCRGNPADVTEARLSFYSGHSSFG

SEQ ID NO: 33681 - protein, 311 aa, Homo sapiens
  ENSP00000360296
MQNYKYDKAIVPESKNGGSPALNNNPRRSGSKRVLLICLDLFCLFMAGLPFLIIETSTIKPYHRGFYCNDESIKYPLKTGETINDAVLCAVGIVIAILAIITGEFYRIYYLKKSRSTIQNPYVAALYKQVGCFLFGCAISQSFTDIAKVSIGRLRPHFLSVCNPDFSQINCSEGYIQNYRCRGDDSKVQEARKSFFSGHASFSMYTMLYLVLYLQARFTWRGARLLRPLLQFTLIMMAFYTGLSRVSDHKHHPSDVLAGFAQGALVACCIVFFVSDLFKTKTTLSLPAPAIRKEILSPVDIIDRNNHHNMM

SEQ ID NO: 33682 - protein, 267 aa, Homo sapiens
  ENSP00000407979
MRELAIEIGVRALLFGVFVFTEFLDPFQRVIQPEEIWLYKNPLVQSDNIPTRLMFAISFLTPLAVICVVKIIRRTDKTEIKEAFLAVSLALALNGVCTNTIKLIVGRPRPDFFYRCFPDGVMNSEMHCTGDPDLVSEGRKSFPSIHSSFAFSGLGFTTFYLAGKLHCFTESGRGKSWRLCAAILPLYCAMMIALSRMCDYKHHWQDSFVGGVIGLIFAYICYRQHYPPLANTACHKPYVSLRVPASLKKEERPTADSAPSLPLEGIT

SEQ ID NO: 33683 - protein, 261 aa, Homo sapiens
  ENSP00000358069
MHGIGPSGSFTEFLDPFQRVIQPEEIWLYKNPLVQSDNIPTRLMFAISFLTPLAVICVVKIIRRTDKTEIKEAFLAVSLALALNGVCTNTIKLIVGRPRPDFFYRCFPDGVMNSEMHCTGDPDLVSEGRKSFPSIHSSFAFSGLGFTTFYLAGKLHCFTESGRGKSWRLCAAILPLYCAMMIALSRMCDYKHHWQDSFVGGVIGLIFAYICYRQHYPPLANTACHKPYVSLRVPASLKKEERPTADSAPSLPLEGITEGPV

SEQ ID NO: 33684 - protein, 271 aa, Homo sapiens
  ENSP00000381302
MRELAIEIGVRALLFGVFVFTEFLDPFQRVIQPEEIWLYKNPLVQSDNIPTRLMFAISFLTPLAVICVVKIIRRTDKTEIKEAFLAVSLALALNGVCTNTIKLIVGRPRPDFFYRCFPDGVMNSEMHCTGDPDLVSEGRKSFPSIHSSFAFSGLGFTTFYLAGKLHCFTESGRGKSWRLCAAILPLYCAMMIALSRMCDYKHHWQDSFVGGVIGLIFAYICYRQHYPPLANTACHKPYVSLRVPASLKKEERPTADSAPSLPLEGITEGPV

SEQ ID NO: 33685 - protein, 325 aa, Homo sapiens
  ENSP00000364008
MAVGNNTQRSYSIIPCFIFVELVIMAGTVLLAYYFECTDTFQVHIQGFFCQDGDLMKPYPGTEEESFITPLVLYCVLAATPTAIIFIGEISMYFIKSTRESLIAQEKTILTGECCYLNPLLRRIIRFTGVFAFGLFATDIFVNAGQVVTGHLTPYFLTVCKPNYTSADCQAHHQFINNGNICTGDLEVIEKARRSFPSKHAALSIYSALYATMYITSTIKTKSSRLAKPVLCLGTLCTAFLTGLNRVSEYRNHCSDVIAGFILGTAVALFLGMCVVHNFKGTQGSPSKPKPEDPRGVPLMAFPRIESPLETLSAQNHSASMTEVT

SEQ ID NO: 33686 - protein, 103 aa, Homo sapiens
  ENSP00000410223
MAVGNNTQRSYSIIPCFIFVELVIMAGTVLLAYYFECTDTFQVHIQGFFCQDGDLMKPYPGTEEESFITPLVLYCVLAATPTAIIFIGEISMYFIKSTRESLI

SEQ ID NO: 33687 - protein, 325 aa, Homo sapiens; identical to SEQ ID NO: 33685
  ENSP00000378496

SEQ ID NO: 33688 - protein, 325 aa, Homo sapiens; identical to SEQ ID NO: 33685
  ENSP00000478338

SEQ ID NO: 33689 - protein, 103 aa, Homo sapiens; identical to SEQ ID NO: 33686
  ENSP00000488301

SEQ ID NO: 33690 - protein, 325 aa, Homo sapiens; identical to SEQ ID NO: 33685
  ENSP00000477959

SEQ ID NO: 33691 - protein, 228 aa, Homo sapiens
  ENSP00000488839
MLYFQLVIMAGTVLLAYYFECTDTFQVHIQGFFCQDGDLMKPYPGTEEESFITPLVLYCVLAATPTAIIFIGEISMYFIKSTRESLIAQEKTILTGECCYLNPLLRRIIRFTGVFAFGLFATDIFVNAGQVVTGHLTPYFLTVCKPNYTSADCQAHHQFINNGNICTGDLEVIEKARRSFPSKHAALSIYSALYATMYITSTIKTKSSRLAKPVLCLGTLCTAFLTGL

SEQ ID NO: 33692 - protein, 763 aa, Homo sapiens
  ENSP00000359204
MQRAGSSGGRGECDISGAGRLGLEEAARLSCAVHTSPGGGRRPGQAAGMSAKERPKGKVIKDSVTLLPCFYFVELPILASSVVSLYFLELTDVFKPVHSGFSCYDRSLSMPYIEPTQEAIPFLMLLSLAFAGPAITIMVGEGILYCCLSKRRNGVGLEPNINAGGCNFNSFLRRAVRFVGVHVFGLCSTALITDIIQLSTGYQAPYFLTVCKPNYTSLNVSCKENSYIVEDICSGSDLTVINSGRKSFPSQHATLAAFAAVYVSMYFNSTLTDSSKLLKPLLVFTFIICGIICGLTRITQYKNHPVDVYCGFLIGGGIALYLGLYAVGNFLPSDESMFQHRDALRSLTDLNQDPNRLLSAKNGSSSDGIAHTEGILNRNHRDASSLTNLKRANADVEIITPRSPMGKENMVTFSNTLPRANTPSVEDPVRRNASIHASMDSARSKQLLTQWKNKNESRKLSLQVIEPEPGQSPPRSIEMRSSSEPSRVGVNGDHHGPGNQYLKIQPGAVPGCNNSMPGGPRVSIQSRPGSSQLVHIPEETQENISTSPKSSSARAKWLKAAEKTVACNRSNSQPRIMQVIAMSKQQGVLQSSPKNTEGSTVSCTGSIRYKTLTDHEPSGIVRVEAHPENNRPIIQIPSTEGEGSGSWKWKAPEKGSLRQTYELNDLNRDSESCESLKDSFGSGDRKRSNIDSNEHHHHGITTIRVTPVEGSEIGSETLSISSSRDSTLRRKGNIILIPERSNSPENTRNIFYKGTSPTRAYKD

SEQ ID NO: 33693 - protein, 605 aa, Homo sapiens
  ENSP00000359203
MNMFDADTTTNLVTISFILPIGVHVFGLCSTALITDIIQLSTGYQAPYFLTVCKPNYTSLNVSCKENSYIVEDICSGSDLTVINSGRKSFPSQHATLAAFAAVYVSMYFNSTLTDSSKLLKPLLVFTFIICGIICGLTRITQYKNHPVDVYCGFLIGGGIALYLGLYAVGNFLPSDESMFQHRDALRSLTDLNQDPNRLLSAKNGSSSDGIAHTEGILNRNHRDASSLTNLKRANADVEIITPRSPMGKENMVTFSNTLPRANTPSVEDPVRRNASIHASMDSARSKQLLTQWKNKNESRKLSLQVIEPEPGQSPPRSIEMRSSSEPSRVGVNGDHHGPGNQYLKIQPGAVPGCNNSMPGGPRVSIQSRPGSSQLVHIPEETQENISTSPKSSSARAKWLKAAEKTVACNRSNSQPRIMQVIAMSKQQGVLQSSPKNTEGSTVSCTGSIRYKTLTDHEPSGIVRVEAHPENNRPIIQIPSTEGEGSGSWKWKAPEKGSLRQTYELNDLNRDSESCESLKDSFGSGDRKRSNIDSNEHHHHGITTIRVTPVEGSEIGSETLSISSSRDSTLRRKGNIILIPERSNSPENTRNIFYKGTSPTRAYKD

SEQ ID NO: 33694 - protein, 705 aa, Homo sapiens
  ENSP00000394913
MQRAGSSGGRGECDISGAGRLGLEEAARLSCAVHTSPGGGRRPGQAAGMSAKERPKGKVIKDSVTLLPCFYFVELPILASSVVSLYFLELTDVFKPVHSGFSCYDRSLSMPYIEPTQEAIPFLMLLSLAFAGPAITIMVGEGILYCCLSKRRNGVGLEPNINAGGCNFNSFLRRAVRFVGVHVFGLCSTALITDIIQLSTGYQAPYFLTVCKPNYTSLNVSCKENSYIVEDICSGSDLTVINSGRKSFPSQHATLAAFAAVYVSGLYAVGNFLPSDESMFQHRDALRSLTDLNQDPNRLLSAKNGSSSDGIAHTEGILNRNHRDASSLTNLKRANADVEIITPRSPMGKENMVTFSNTLPRANTPSVEDPVRRNASIHASMDSARSKQLLTQWKNKNESRKLSLQVIEPEPGQSPPRSIEMRSSSEPSRVGVNGDHHGPGNQYLKIQPGAVPGCNNSMPGGPRVSIQSRPGSSQLVHIPEETQENISTSPKSSSARAKWLKAAEKTVACNRSNSQPRIMQVIAMSKQQGVLQSSPKNTEGSTVSCTGSIRYKTLTDHEPSGIVRVEAHPENNRPIIQIPSTEGEGSGSWKWKAPEKGSLRQTYELNDLNRDSESCESLKDSFGSGDRKRSNIDSNEHHHHGITTIRVTPVEGSEIGSETLSISSSRDSTLRRKGNIILIPERSNSPENTRNIFYKGTSPTRAYKD

SEQ ID NO: 33695 - protein, 629 aa, Homo sapiens
  ENSP00000387890
MENSTTTISREELEELQEAFNKIDIDNSGYVSDYELQDLFKEASLPLPGYKVREIVEKILSVADSNKDGKISFEEFVSLMQELKSKDISKTFRKIINKREGITAIGGTSTISSEGTQHSYSEEEKVAFVNWINKALENDPDCKHLIPMNPNDDSLFKSLADGILLCKMINLSEPDTIDERAINKKKLTPFTISENLNLALNSASAIGCTVVNIGASDLKEGKPHLVLGLLWQIIKVGLFADIEISRNEALIALLNEGEELEELMKLSPEELLLRWVNYHLTNAGWHTISNFSQDIKDSRAYFHLLNQIAPKGGEDGPAIAIDLSGINETNDLKRAGLMLQEADKLGCKQFVTPADVVSGNPKLNLAFVANLFNTYPCLHKPNNNDIDMNLLEGESKEERTFRNWMNSLGVNPYINHLYSDLADALVIFQLYEMIRVPVNWSHVNKPPYPALGGNMKKIENCNYAVELGKNKAKFSLVGIAGQDLNEGNSTLTLALVWQLMRRYTLNVLSDLGEGEKVNDEIIIKWVNQTLKSANKKTSISSFKDKSISTSLPVLDLIDAIAPNAVRQEMIRRENLSDEDKLNNAKYAISVARKIGARIYALPDDLVEVKPKMVMTVFACLMGKGLNRIK

SEQ ID NO: 33696 - protein, 33 aa, Homo sapiens
  ENSP00000419893
MENSTTTISREELEELQEAFNKIDIDNSGYVSD

SEQ ID NO: 33697 - protein, 119 aa, Homo sapiens
  ENSP00000417311
MENSTTTISREELEELQEAFNKIDIDNSGYVSDYELQDLFKEASLPLPGYKVREIVEKILSVADSNKDGKISFEEFVSLMQELKSKDISKTFRKIINKREGITAIGGTSTISSEGTQHS

SEQ ID NO: 33698 - protein, 58 aa, Homo sapiens
  ENSP00000419531
MENSTTTISREELEELQEAFNKIDIDNSGYVSDYELQDLFKEASLPLPGYKVREIVEK

SEQ ID NO: 33699 - protein, 266 aa, Homo sapiens
  ENSP00000417481
MQELKSKDISKTFRKIINKREGITAIGGTSTISSEGTQHSYSEEEKVAFVNWINKALENDPDCKHLIPMNPNDDSLFKSLADGILLCKMINLSEPDTIDERAINKKKLTPFTISENLNLALNSASAIGCTVVNIGASDLKEGKPHLVLGLLWQIIKVGLFADIEISRNEALIALLNEGEELEELMKLSPEELLLRWVNYHLTNAGWHTISNFSQDIKDSRAYFHLLNQIAPKGGEDGPAIAIDLSGINETNDLKRAGLMLQEADKL

SEQ ID NO: 33700 - protein, 54 aa, Homo sapiens
  ENSP00000419271
MENSTTTISREELEELQEAFNKIDIDNSGYVSDYELQDLFKEASLPLPGYKVRE

SEQ ID NO: 33701 - protein, 120 aa, Homo sapiens
  ENSP00000418880
MENSTTTISREELEELQEAFNKIDIDNSGYVSDYELQDLFKEASLPLPGYKVREIVEKILSVADSNKDGKISFEEFVSLMQELKSKDISKTFRKIINKREGITAIGGTSTISSEGTQHSY

SEQ ID NO: 33702 - protein, 629 aa, Homo sapiens; identical to SEQ ID NO: 33695
  ENSP00000336831

SEQ ID NO: 33703 - protein, 52 aa, Homo sapiens
  ENSP00000417491
MENSTTTISREELEELQEAFNKIDIDNSGYVSDYELQDLFKEASLPLPGYKV

SEQ ID NO: 33704 - protein, 629 aa, Homo sapiens; identical to SEQ ID NO: 33695
  ENSP00000418700

SEQ ID NO: 33705 - protein, 318 aa, Homo sapiens
  ENSP00000345494
MDKQNSQMNASHPETNLPVGYPPQYPPTAFQGPPGYSGYPGPQVSYPPPPAGHSGPGPAGFPVPNQPVYNQPVYNQPVGAAGVPWMPAPQPPLNCPPGLEYLSQIDQILIHQQIELLEVLTGFETNNKYEIKNSFGQRVYFAAEDTDCCTRNCCGPSRPFTLRIIDNMGQEVITLERPLRCSSCCCPCCLQEIEIQAPPGVPIGYVIQTWHPCLPKFTIQNEKREDVLKISGPCVVCSCCGDVDFEIKSLDEQCVVGKISKHWTGILREAFTDADNFGIQFPLDLDVKMKAVMIGACFLIDFMFFESTGSQEQKSGVW

SEQ ID NO: 33706 - protein, 41 aa, Homo sapiens
  ENSP00000419680
MDKQNSQMNASHPETNLPVGYPPQYPPTAFQDRSDTDSSAN

SEQ ID NO: 33707 - protein, 41 aa, Homo sapiens; identical to SEQ ID NO: 33706
  ENSP00000419228

SEQ ID NO: 33708 - protein, 311 aa, Homo sapiens
  ENSP00000417792
MNASHPETNLPVGYPPQYPPTAFQGPPGYSGYPGPQVSYPPPPAGHSGPGPAGFPVPNQPVYNQPVYNQPVGAAGVPWMPAPQPPLNCPPGLEYLSQIDQILIHQQIELLEVLTGFETNNKYEIKNSFGQRVYFAAEDTDCCTRNCCGPSRPFTLRIIDNMGQEVITLERPLRCSSCCCPCCLQEIEIQAPPGVPIGYVIQTWHPCLPKFTIQNEKREDVLKISGPCVVCSCCGDVDFEIKSLDEQCVVGKISKHWTGILREAFTDADNFGIQFPLDLDVKMKAVMIGACFLIDFMFFESTGSQEQKSGVW

SEQ ID NO: 33709 - protein, 41 aa, Homo sapiens; identical to SEQ ID NO: 33706
  ENSP00000417469

SEQ ID NO: 33710 - protein, 237 aa, Homo sapiens
  ENSP00000411675
MLLTRKQTCQLGILLSIHRQHSKIDQILIHQQIELLEVLTGFETNNKYEIKNSFGQRVYFAAEDTDCCTRNCCGPSRPFTLRIIDNMGQEVITLERPLRCSSCCCPCCLQEIEIQAPPGVPIGYVIQTWHPCLPKFTIQNEKREDVLKISGPCVVCSCCGDVDFEIKSLDEQCVVGKISKHWTGILREAFTDADNFGIQFPLDLDVKMKAVMIGACFLIDFMFFESTGSQEQKSGVW

SEQ ID NO: 33711 - protein, 41 aa, Homo sapiens; identical to SEQ ID NO: 33706
  ENSP00000418654

SEQ ID NO: 33712 - protein, 41 aa, Homo sapiens; identical to SEQ ID NO: 33706
  ENSP00000417733

SEQ ID NO: 33713 - protein, 171 aa, Homo sapiens
  ENSP00000420006
  MOD_RES (1)..(1): Any amino acid
XGFPVPNQPVYNQPVYNQPVGAAGVPWMPAPQPPLNCPPGLEYLSQIDQILIHQQIELLEEIQAPPGVPIGYVIQTWHPCLPKFTIQNEKREDVLKISGPCVVCSCCGDVDFEIKSLDEQCVVGKISKHWTGILREAFTDADNFGIQFPLDLDVKMKAVMIGACFLIDFMF

SEQ ID NO: 33714 - protein, 41 aa, Homo sapiens; identical to SEQ ID NO: 33706
  ENSP00000417588

SEQ ID NO: 33715 - protein, 248 aa, Homo sapiens
  ENSP00000418103
MDKQNSQMNASHPETNLPVGYPPQYPPTAFQGPPGYSGYPGPQVSYPPPPAGHSGPGPAGFPVPNQPVYNQPVYNQPVGAAGVPWMPAPQPPLNCPPGLEYLSQIDQILIHQQIELLEAEDTDCCTRNCCGPSRPFTLRIIDNMGQEVITLERPLRCSSCCCPCCLQEIEIQAPPGVPIGYVIQTWHPCLPKFTIQNEKREDVLKISGPCVVCSCCGDVDFEIKSLDEQCVVGKISKHWTGILREAFT

SEQ ID NO: 33716 - protein, 171 aa, Homo sapiens
  ENSP00000418550
MLLTRKQTCQLGILLSIHRQHSKIDQILIHQQIELLEVLTGFETNNKYEIKNSFGQRVYFAAEDTDCCTRNCCGPSRPFTLRIIDNMGQEVITLERPLRCSSCCCPCCLQEIEIQAPPGVPIGYVIQTWHPCLPKFTIQNEKREDVLKISGPCVVCSCCGDVDFEIKSLDE

SEQ ID NO: 33717 - protein, 249 aa, Homo sapiens
  ENSP00000420523
MDKQNSQMNASHPETNLPVGYPPQYPPTAFQGPPGYSGYPGPQVSYPPPPAGHSGPGPAGFPVPNQPVYNQPVYNQPVGAAGVPWMPAPQPPLNCPPGLEYLSQIDQILIHQQIELLEVLTGFETNNKYEIKNSFGQRVYFAAEDTDCCTRNCCGPSRPFTLRIIDNMGQEVITLERPLRCSSCCCPCCLQEIEIQAPPGVPIGYVIQTWHPCLPKFTIQNEKREDVLKISGPCVVCSCCGDVDFEIKS

SEQ ID NO: 33718 - protein, 329 aa, Homo sapiens
  ENSP00000347038
MSGVVPTAPEQPAGEMENQTKPPDPRPDAPPEYNSHFLPGPPGTAVPPPTGYPGGLPMGYYSPQQPSTFPLYQPVGGIHPVRYQPGKYPMPNQSVPITWMPGPTPMANCPPGLEYLVQLDNIHVLQHFEPLEMMTCFETNNRYDIKNNSDQMVYIVTEDTDDFTRNAYRTLRPFVLRVTDCMGREIMTMQRPFRCTCCCFCCPSARQELEVQCPPGVTIGFVAEHWNLCRAVYSIQNEKKENVMRVRGPCSTYGCGSDSVFEVKSLDGISNIGSIIRKWNGLLSAMADADHFDIHFPLDLDVKMKAMIFGACFLIDFMYFERSPPQRSR

SEQ ID NO: 33719 - protein, 224 aa, Homo sapiens
  ENSP00000415605
MENQTKPPDPRPDAPPEYNSHFLPGPPGTAVPPPTGYPGGLPMGYYSPQQPSTFPLYQPVGGIHPVRYQPGKYPMPNQSVPITWMPGPTPMANCPPGLEYLVQLEVQCPPGVTIGFVAEHWNLCRAVYSIQNEKKENVMRVRGPCSTYGCGSDSVFEVKSLDGISNIGSIIRKWNGLLSAMADADHFDIHFPLDLDVKMKAMIFGACFLIDFMYFERSPPQRSR

SEQ ID NO: 33720 - protein, 329 aa, Homo sapiens; identical to SEQ ID NO: 33718
  ENSP00000399315

SEQ ID NO: 33721 - protein, 329 aa, Homo sapiens; identical to SEQ ID NO: 33718
  ENSP00000419040

SEQ ID NO: 33722 - protein, 262 aa, Homo sapiens
  ENSP00000417896
MSGVVPTAPEQPAGEMENQTKPPDPRPDAPPEYNSHFLPGPPGTAVPPPTGYPGGLPMGYYSPQQPSTFPLYQPVGGIHPVRYQPGKYPMPNQSVPITWMPGPTPMANCPPGLEYLVQLDNIHVLQHFEPLEMMTCFETNNRYDIKNNSDQMVYIVTEDTDDFTRNAYRTLRPFVLRVTDCMGREIMTMQRPFRCTCCCFCCPSARQELEVQCPPGVTIGFVAEHWNLCRAVYSIQNEKKENVMRVRGPCSTYGCGSDSVFE

SEQ ID NO: 33723 - protein, 147 aa, Homo sapiens
  ENSP00000420385
MSGVVPTAPEQPAGEMENQTKPPDPRPDAPPEYNSHFLPGPPGTAVPPPTGYPGGLPMGYYSPQQPSTFPLYQPVGGIHPVRYQPGKYPMPNQSVPITWMPGPTPMANCPPGLEYLVQLEVQCPPGVTIGFVAEHWNLCRAVYSIQN

SEQ ID NO: 33724 - protein, 208 aa, Homo sapiens
  ENSP00000418173
MSGVVPTAPEQPAGEMENQTKPPDPRPDAPPEYNSHFLPGPPGTAVPPPTGYPGGLPMGYYSPQQPSTFPLYQPVGGIHPVRYQPGKYPMPNQSVPITWMPGPTPMANCPPGLEYLVQLDNIHVLQHFEPLEMMTCFETNNRYDIKNNSDQMVYIVTEDTDDFTRNAYRTLRPFVLRVTDCMGREIMTMQRPFRCTCCCFCCPSARQE

SEQ ID NO: 33725 - protein, 142 aa, Homo sapiens
  ENSP00000418419
MSGVVPTAPEQPAGEMENQTKPPDPRPDAPPEYNSHFLPGPPGTAVPPPTGYPGGLPMGYYSPQQPSTFPLYQPVGGIHPVRYQPGKYPMPNQSVPITWMPGPTPMANCPPGLEYLVQLDNIHVLQHFEPLEMMTCFETNNR

SEQ ID NO: 33726 - protein, 97 aa, Homo sapiens
  ENSP00000417248
MSGVVPTAPEQPAGEMENQTKPPDPRPDAPPEYNSHFLPGPPGTAVPPPTGYPGGLPMGYYSPQQPSTFPLYQPVGGIHPVRYQPGKYPMPNQSVPI

SEQ ID NO: 33727 - protein, 239 aa, Homo sapiens
  ENSP00000372561
MSGVVPTAPEQPAGEMENQTKPPDPRPDAPPEYNSHFLPGPPGTAVPPPTGYPGGLPMGYYSPQQPSTFPLYQPVGGIHPVRYQPGKYPMPNQSVPITWMPGPTPMANCPPGLEYLVQLEVQCPPGVTIGFVAEHWNLCRAVYSIQNEKKENVMRVRGPCSTYGCGSDSVFEVKSLDGISNIGSIIRKWNGLLSAMADADHFDIHFPLDLDVKMKAMIFGACFLIDFMYFERSPPQRSR

SEQ ID NO: 33728 - protein, 441 aa, Homo sapiens
  ENSP00000335290
MALFGALFLALLAGAHAEFPGCKIRVTSKALELVKQEGLRFLEQELETITIPDLRGKEGHFYYNISEVKVTELQLTSSELDFQPQQELMLQITNASLGLRFRRQLLYWFLKVYDFLSTFITSGMRFLLNQQICPVLYHAGTVLLNSLLDTVPVRSSVDELVGIDYSLMKDPVASTSNLDMDFRGAFFPLTERNWSLPNRAVEPQLQEEERMVYVAFSEFFFDSAMESYFRAGALQLLLVGDKVPHDLDMLLRATYFGSIVLLSPAVIDSPLKLELRVLAPPRCTIKPSGTTISVTASVTIALVPPDQPEVQLSSMTMDARLSAKMALRGKALRTQLDLRRFRIYSNHSALESLALIPLQAPLKTMLQIGVMPMLNERTWRGVQIPLPEGINFVHEVVTNHAGFLTIGADLHFAKGLREVIEKNRPADVRASTAPTPSTAAV

SEQ ID NO: 33729 - protein, 405 aa, Homo sapiens
  ENSP00000361497
MLQITNASLGLRFRRQLLYWFFYDGGYINASAEGVSIRTGLELSRDPAGRMKVSNVSCQASVSRMHAAFGGTFKKVYDFLSTFITSGMRFLLNQQICPVLYHAGTVLLNSLLDTVPVRSSVDELVGIDYSLMKDPVASTSNLDMDFRGAFFPLTERNWSLPNRAVEPQLQEEERMVYVAFSEFFFDSAMESYFRAGALQLLLVGDKVPHDLDMLLRATYFGSIVLLSPAVIDSPLKLELRVLAPPRCTIKPSGTTISVTASVTIALVPPDQPEVQLSSMTMDARLSAKMALRGKALRTQLDLRRFRIYSNHSALESLALIPLQAPLKTMLQIGVMPMLNERTWRGVQIPLPEGINFVHEVVTNHAGFLTIGADLHFAKGLREVIEKNRPADVRASTAPTPSTAAV

SEQ ID NO: 33730 - protein, 493 aa, Homo sapiens
  ENSP00000361508
MALFGALFLALLAGAHAEFPGCKIRVTSKALELVKQEGLRFLEQELETITIPDLRGKEGHFYYNISEVKVTELQLTSSELDFQPQQELMLQITNASLGLRFRRQLLYWFFYDGGYINASAEGVSIRTGLELSRDPAGRMKVSNVSCQASVSRMHAAFGGTFKKVYDFLSTFITSGMRFLLNQQICPVLYHAGTVLLNSLLDTVPVRSSVDELVGIDYSLMKDPVASTSNLDMDFRGAFFPLTERNWSLPNRAVEPQLQEEERMVYVAFSEFFFDSAMESYFRAGALQLLLVGDKVPHDLDMLLRATYFGSIVLLSPAVIDSPLKLELRVLAPPRCTIKPSGTTISVTASVTIALVPPDQPEVQLSSMTMDARLSAKMALRGKALRTQLDLRRFRIYSNHSALESLALIPLQAPLKTMLQIGVMPMLNERTWRGVQIPLPEGINFVHEVVTNHAGFLTIGADLHFAKGLREVIEKNRPADVRASTAPTPSTAAV

SEQ ID NO: 33731 - protein, 493 aa, Homo sapiens; identical to SEQ ID NO: 33730
  ENSP00000417138

SEQ ID NO: 33732 - protein, 398 aa, Homo sapiens
  ENSP00000411671
MALFGALFLALLAGAHAEFPGCKIRVTSKALELVKQEGLRFLEQELETITIPDLRGKEGHFYYNISEKVYDFLSTFITSGMRFLLNQQICPVLYHAGTVLLNSLLDTVPVRSSVDELVGIDYSLMKDPVASTSNLDMDFRGAFFPLTERNWSLPNRAVEPQLQEEERMVYVAFSEFFFDSAMESYFRAGALQLLLVGDKVPHDLDMLLRATYFGSIVLLSPAVIDSPLKLELRVLAPPRCTIKPSGTTISVTASVTIALVPPDQPEVQLSSMTMDARLSAKMALRGKALRTQLDLRRFRIYSNHSALESLALIPLQAPLKTMLQIGVMPMLNERTWRGVQIPLPEGINFVHEVVTNHAGFLTIGADLHFAKGLREVIEKNRPADVRASTAPTPSTAAV

SEQ ID NO: 33733 - protein, 500 aa, Homo sapiens
  ENSP00000323927
MRGELWLLVLVLREAARALSPQPGAGHDEGPGSGWAAKGTVRGWNRRARESPGHVSEPDRTQLSQDLGGGTLAMDTLPDNRTRVVEDNHSYYVSRLYGPSEPHSRELWVDVAEANRSQVKIHTILSNTHRQASRVVLSFDFPFYGHPLRQITIATGGFIFMGDVIHRMLTATQYVAPLMANFNPGYSDNSTVVYFDNGTVFVVQWDHVYLQGWEDKGSFTFQAALHHDGRIVFAYKEIPMSVPEISSSQHPVKTGLSDAFMILNPSPDVPESRRRSIFEYHRIELDPSKVTSMSAVEFTPLPTCLQHRSCDACMSSDLTFNCSWCHVLQRCSSGFDRYRQEWMDYGCAQEAEGRMCEDFQDEDHDSASPDTSFSPYDGDLTTTSSSLFIDSLTTEDDTKLNPYAGGDGLQNNLSPKTKGTPVHLGTIVGIVLAVLLVAAIILAGIYINGHPTSNAALFFIERRPHHWPAMKFRSHPDHSTYAEVEPSGHEKEGFMEAEQC

SEQ ID NO: 33734 - protein, 337 aa, Homo sapiens
  ENSP00000462089
MRGELWLLVLVLREAARALSPQPGAGHDEGPGSGWAAKGTVRGWNRRARESPGHVSEPDRTQLSQDLGGGTLAMDTLPDNRTRVVEDNHSYYVSRLYGPSEPHSRELWVDVAEANRSQVKIHTILSNTHRQASRVVLSFDFPFYGHPLRQITIATGGFIFMGDVIHRMLTATQYVAPLMANFNPGYSDNSTVVYFDNGTVFVVQWDHVYLQGWEDKGSFTFQAALHHDGRIVFAYKEIPMSVPEISSSQHPVKTGLSDAFMILNPSPDVPESRRRSIFEYHRIELDPSKVTSMSAVEFTPLPTCLQHRSCDACMSSDLTFNCSWCHVLQSRDEVSPC

SEQ ID NO: 33735 - protein, 460 aa, Homo sapiens
  ENSP00000409687
MALSVRTLPLRGFLVPRPQPTRSQDAPSPRLPLSSAPAPCRHKNEEDNHSYYVSRLYGPSEPHSRELWVDVAEANRSQVKIHTILSNTHRQASRVVLSFDFPFYGHPLRQITIATGGFIFMGDVIHRMLTATQYVAPLMANFNPGYSDNSTVVYFDNGTVFVVQWDHVYLQGWEDKGSFTFQAALHHDGRIVFAYKEIPMSVPEISSSQHPVKTGLSDAFMILNPSPDVPESRRRSIFEYHRIELDPSKVTSMSAVEFTPLPTCLQHRSCDACMSSDLTFNCSWCHVLQRCSSGFDRYRQEWMDYGCAQEAEGRMCEDFQDEDHDSASPDTSFSPYDGDLTTTSSSLFIDSLTTEDDTKLNPYAGGDGLQNNLSPKTKGTPVHLGTIVGIVLAVLLVAAIILAGIYINGHPTSNAALFFIERRPHHWPAMKFRSHPDHSTYAEVEPSGHEKEGFMEAEQC

SEQ ID NO: 33736 - protein, 182 aa, Homo sapiens
  ENSP00000464353
QGWEDKGSFTFQAALHHDGRIVFAYKEIPMSVPEISSSQHPVKTGLSDAFMILNPSPDVPESRRRSIFEYHRIELDPSKVTSMSAVEFTPLPTCLQHRSCDACMSSDLTFNCSWCHVLQRSLNNQDENTCSSGFDRYRQEWMDYGCAQEAEGRMCEDFQDEDHDSASPDTSFSPYDGDLTTT

SEQ ID NO: 33737 - protein, 99 aa, Homo sapiens
  ENSP00000462241
MDTLPDNRTRVVVWEGTGSTGSAWELVGNVECRSPQTCRIRIRFPGGQPQLLCVPSLWPQRAPQPGTVGRCGRGQPEPSEDPHNTLQHPPAGFESGLVL

SEQ ID NO: 33738 - protein, 222 aa, Homo sapiens
  ENSP00000393227
MDTLPDNRTRVVEDNHSYYVSRLYGPSEPHSRELWVDVAEANRSQVKIHTILSNTHRQASRVVLSFDFPFYGHPLRQITIATGGFIFMGDVIHRMLTATQYVAPLMANFNPGYSDNSTVVYFDNGTVFVVQWDHVYLQGWEDKGSFTFQAALHHDGRIVFAYKEIPMSVPEISSSQHPVKTGLSDAFMILNPSPDVPESRRRSIFEYHRIELDPSKVTSMSA

SEQ ID NO: 33739 - protein, 124 aa, Homo sapiens
  ENSP00000416819
MDTLPDNRTRVVEDNHSYYVSRLYGPSEPHSRELWVDVAEANRSQVKIHTILSNTHRQASRVVLSFDFPFYGHPLRQITIATGGFIFMGDVIHRMLTATQYVAPLMANFNPGYSDNSTVVYFDN

SEQ ID NO: 33740 - protein, 98 aa, Homo sapiens
  ENSP00000464029
MDTLPDNRTRVVEDNHSYYVSRLYGPSEPHSRELWVDVAEANRSQVKIHTILSNTHRQASRVVLSFDFPFYGHPLRQITIATGGFIFMGDVIHRMLTA

SEQ ID NO: 33741 - protein, 480 aa, Homo sapiens
  ENSP00000366450
MARFPKADLAAAGVMLLCHFFTDQFQFADGKPGDQILDWQYGVTQAFPHTEEEVEVDSHAYSHRWKRNLDFLKAVDTNRASVGQDSPEPRSFTDLLLDDGQDNNTQIERVNLSFDFPFYGHFLREITVATGGFIYTGEVVHRMLTATQYIAPLMANFDPSVSRNSTVRYFDNGTALVVQWDHVHLQDNYNLGSFTFQATLLMDGRIIFGYKEIPVLVTQISSTNHPVKVGLSDAFVVVHRIQQIPNVRRRTIYEYHRVELQMSKITNISAVEMTPLPTCLQFNRCGPCVSSQIGFNCSWCSKLQRCSSGFDRHRQDWVDSGCPEESKEKMCENTEPVETSSRTTTTVGATTTQFRVLTTTRRAVTSQFPTSLPTEDDTKIALHLKDNGASTDDSAAEKKGGTLHAGLIIGILILVLIVATAILVTVYMYHHPTSAASIFFIERRPSRWPAMKFRRGSGHPAYAEVEPVGEKEGFIVSEQC

SEQ ID NO: 33742 - protein, 529 aa, Homo sapiens
  ENSP00000366460
MARFPKADLAAAGVMLLCHFFTDQFQFADGKPGDQILDWQYGVTQAFPHTEEEVEVDSHAYSHRWKRNLDFLKAVDTNRASVGQDSPEPRSFTDLLLDDGQDNNTQIEEDTDHNYYISRIYGPSDSASRDLWVNIDQMEKDKVKIHGILSNTHRQAARVNLSFDFPFYGHFLREITVATGGFIYTGEVVHRMLTATQYIAPLMANFDPSVSRNSTVRYFDNGTALVVQWDHVHLQDNYNLGSFTFQATLLMDGRIIFGYKEIPVLVTQISSTNHPVKVGLSDAFVVVHRIQQIPNVRRRTIYEYHRVELQMSKITNISAVEMTPLPTCLQFNRCGPCVSSQIGFNCSWCSKLQRCSSGFDRHRQDWVDSGCPEESKEKMCENTEPVETSSRTTTTVGATTTQFRVLTTTRRAVTSQFPTSLPTEDDTKIALHLKDNGASTDDSAAEKKGGTLHAGLIIGILILVLIVATAILVTVYMYHHPTSAASIFFIERRPSRWPAMKFRRGSGHPAYAEVEPVGEKEGFIVSEQC

SEQ ID NO: 33743 - protein, 1896 aa, Homo sapiens
  ENSP00000377061
MPLPPRSLQVLLLLLLLLLLLPGMWAEAGLPRAGGGSQPPFRTFSASDWGLTHLVVHEQTGEVYVGAVNRIYKLSGNLTLLRAHVTGPVEDNEKCYPPPSVQSCPHGLGSTDNVNKLLLLDYAANRLLACGSASQGICQFLRLDDLFKLGEPHHRKEHYLSSVQEAGSMAGVLIAGPPGQGQAKLFVGTPIDGKSEYFPTLSSRRLMANEEDADMFGFVYQDEFVSSQLKIPSDTLSKFPAFDIYYVYSFRSEQFVYYLTLQLDTQLTSPDAAGEHFFTSKIVRLCVDDPKFYSYVEFPIGCEQAGVEYRLVQDAYLSRPGRALAHQLGLAEDEDVLFTVFAQGQKNRVKPPKESALCLFTLRAIKEKIKERIQSCYRGEGKLSLPWLLNKELGCINSPLQIDDDFCGQDFNQPLGGTVTIEGTPLFVDKDDGLTAVAAYDYRGRTVVFAGTRSGRIRKILVDLSNPGGRPALAYESVVAQEGSPILRDLVLSPNHQYLYAMTEKQVTRVPVESCVQYTSCELCLGSRDPHCGWCVLHSICSRRDACERADEPQRFAADLLQCVQLTVQPRNVSVTMSQVPLVLQAWNVPDLSAGVNCSFEDFTESESVLEDGRIHCRSPSAREVAPITRGQGDQRVVKLYLKSKETGKKFASVDFVFYNCSVHQSCLSCVNGSFPCHWCKYRHVCTHNVADCAFLEGRVNVSEDCPQILPSTQIYVPVGVVKPITLAARNLPQPQSGQRGYECLFHIPGSPARVTALRFNSSSLQCQNSSYSYEGNDVSDLPVNLSVVWNGNFVIDNPQNIQAHLYKCPALRESCGLCLKADPRFECGWCVAERRCSLRHHCAADTPASWMHARHGSSRCTDPKILKLSPETGPRQGGTRLTITGENLGLRFEDVRLGVRVGKVLCSPVESEYISAEQIVCEIGDASSVRAHDALVEVCVRDCSPHYRALSPKRFTFVTPTFYRVSPSRGPLSGGTWIGIEGSHLNAGSDVAVSVGGRPCSFSWRNSREIRCLTPPGQSPGSAPIIININRAQLTNPEVKYNYTEDPTILRIDPEWSINSGGTLLTVTGTNLATVREPRIRAKYGGIERENGCLVYNDTTMVCRAPSVANPVRSPPELGERPDELGFVMDNVRSLLVLNSTSFLYYPDPVLEPLSPTGLLELKPSSPLILKGRNLLPPAPGNSRLNYTVLIGSTPCTLTVSETQLLCEAPNLTGQHKVTVRAGGFEFSPGTLQVYSDSLLTLPAIVGIGGGGGLLLLVIVAVLIAYKRKSRDADRTLKRLQLQMDNLESRVALECKEAFAELQTDIHELTNDLDGAGIPFLDYRTYAMRVLFPGIEDHPVLKEMEVQANVEKSLTLFGQLLTKKHFLLTFIRTLEAQRSFSMRDRGNVASLIMTALQGEMEYATGVLKQLLSDLIEKNLESKNHPKLLLRRTESVAEKMLTNWFTFLLYKFLKECAGEPLFMLYCAIKQQMEKGPIDAITGEARYSLSEDKLIRQQIDYKTLTLNCVNPENENAPEVPVKGLDCDTVTQAKEKLLDAAYKGVPYSQRPKAADMDLEWRQGRMARIILQDEDVTTKIDNDWKRLNTLAHYQVTDGSSVALVPKQTSAYNISNSSTFTKSLSRYESMLRTASSPDSLRSRTPMITPDLESGTKLWHLVKNHDHLDQREGDRGSKMVSEIYLTRLLATKGTLQKFVDDLFETIFSTAHRGSALPLAIKYMFDFLDEQADKHQIHDADVRHTWKSNCLPLRFWVNVIKNPQFVFDIHKNSITDACLSVVAQTFMDSCSTSEHKLGKDSPSNKLLYAKDIPNYKSWVERYYADIAKMPAISDQDMSAYLAEQSRLHLSQFNSMSALHEIYSYITKYKDEILAALEKDEQARRQRLRSKLEQVVDTMALSS

SEQ ID NO: 33744 - protein, 1894 aa, Homo sapiens
  ENSP00000352882
MKAMPWNWTCLLSHLLMVGMGSSTLLTRQPAPLSQKQRSFVTFRGEPAEGFNHLVVDERTGHIYLGAVNRIYKLSSDLKVLVTHETGPDEDNPKCYPPRIVQTCNEPLTTTNNVNKMLLIDYKENRLIACGSLYQGICKLLRLEDLFKLGEPYHKKEHYLSGVNESGSVFGVIVSYSNLDDKLFIATAVDGKPEYFPTISSRKLTKNSEADGMFAYVFHDEFVASMIKIPSDTFTIIPDFDIYYVYGFSSGNFVYFLTLQPEMVSPPGSTTKEQVYTSKLVRLCKEDTAFNSYVEVPIGCERSGVEYRLLQAAYLSKAGAVLGRTLGVHPDDDLLFTVFSKGQKRKMKSLDESALCIFILKQINDRIKERLQSCYRGEGTLDLAWLKVKDIPCSSALLTIDDNFCGLDMNAPLGVSDMVRGIPVFTEDRDRMTSVIAYVYKNHSLAFVGTKSGKLKKIRVDGPRGNALQYETVQVVDPGPVLRDMAFSKDHEQLYIMSERQLTRVPVESCGQYQSCGECLGSGDPHCGWCVLHNTCTRKERCERSKEPRRFASEMKQCVRLTVHPNNISVSQYNVLLVLETYNVPELSAGVNCTFEDLSEMDGLVVGNQIQCYSPAAKEVPRIITENGDHHVVQLQLKSKETGMTFASTSFVFYNCSVHNSCLSCVESPYRCHWCKYRHVCTHDPKTCSFQEGRVKLPEDCPQLLRVDKILVPVEVIKPITLKAKNLPQPQSGQRGYECILNIQGSEQRVPALRFNSSSVQCQNTSYSYEGMEINNLPVELTVVWNGHFNIDNPAQNKVHLYKCGAMRESCGLCLKADPDFACGWCQGPGQCTLRQHCPAQESQWLELSGAKSKCTNPRITEIIPVTGPREGGTKVTIRGENLGLEFRDIASHVKVAGVECSPLVDGYIPAEQIVCEMGEAKPSQHAGFVEICVAVCRPEFMARSSQLYYFMTLTLSDLKPSRGPMSGGTQVTITGTNLNAGSNVVVMFGKQPCLFHRRSPSYIVCNTTSSDEVLEMKVSVQVDRAKIHQDLVFQYVEDPTIVRIEPEWSIVSGNTPIAVWGTHLDLIQNPQIRAKHGGKEHINICEVLNATEMTCQAPALALGPDHQSDLTERPEEFGFILDNVQSLLILNKTNFTYYPNPVFEAFGPSGILELKPGTPIILKGKNLIPPVAGGNVKLNYTVLVGEKPCTVTVSDVQLLCESPNLIGRHKVMARVGGMEYSPGMVYIAPDSPLSLPAIVSIAVAGGLLIIFIVAVLIAYKRKSRESDLTLKRLQMQMDNLESRVALECKEAFAELQTDIHELTSDLDGAGIPFLDYRTYTMRVLFPGIEDHPVLRDLEVPGYRQERVEKGLKLFAQLINNKVFLLSFIRTLESQRSFSMRDRGNVASLIMTVLQSKLEYATDVLKQLLADLIDKNLESKNHPKLLLRRTESVAEKMLTNWFTFLLYKFLKECAGEPLFSLFCAIKQQMEKGPIDAITGEARYSLSEDKLIRQQIDYKTLVLSCVSPDNANSPEVPVKILNCDTITQVKEKILDAIFKNVPCSHRPKAADMDLEWRQGSGARMILQDEDITTKIENDWKRLNTLAHYQVPDGSVVALVSKQVTAYNAVNNSTVSRTSASKYENMIRYTGSPDSLRSRTPMITPDLESGVKMWHLVKNHEHGDQKEGDRGSKMVSEIYLTRLLATKGTLQKFVDDLFETIFSTAHRGSALPLAIKYMFDFLDEQADKHGIHDPHVRHTWKSNCLPLRFWVNMIKNPQFVFDIHKNSITDACLSVVAQTFMDSCSTSEHRLGKDSPSNKLLYAKDIPSYKNWVERYYSDIGKMPAISDQDMNAYLAEQSRMHMNEFNTMSALSEIFSYVGKYSEEILGPLDHDDQCGKQKLAYKLEQVITLMSLDS

SEQ ID NO: 33745 - protein, 492 aa, Homo sapiens
  ENSP00000392772
MKAMPWNWTCLLSHLLMVGMGSSTLLTRQPAPLSQKQRSFVTFRGEPAEGFNHLVVDERTGHIYLGAVNRIYKLSSDLKVLVTHETGPDEDNPKCYPPRIVQTCNEPLTTTNNVNKMLLIDYKENRLIACGSLYQGICKLLRLEDLFKLGEPYHKKEHYLSGVNESGSVFGVIVSYSNLDDKLFIATAVDGKPEYFPTISSRKLTKNSEADGMFAYVFHDEFVASMIKIPSDTFTIIPDFDIYYVYGFSSGNFVYFLTLQPEMVSPPGSTTKEQVYTSKLVRLCKEDTAFNSYVEVPIGCERSGVEYRLLQAAYLSKAGAVLGRTLGVHPDDDLLFTVFSKGQKRKMKSLDESALCIFILKQINDRIKERLQSCYRGEGTLDLAWLKVKDIPCSSALLTIDDNFCGLDMNAPLGVSDMVRGIPVFTEDRDRMTSVIAYVYKNHSLAFVGTKSGKLKKMPGTSLCPTLELQTGPRSHRATVTLELLFSSCSSN

SEQ ID NO: 33746 - protein, 522 aa, Homo sapiens
  ENSP00000367800
MKAMPWNWTCLLSHLLMVGMGSSTLLTRQPAPLSQKQRSFVTFRGEPAEGFNHLVVDERTGHIYLGAVNRIYKLSSDLKVLVTHETGPDEDNPKCYPPRIVQTCNEPLTTTNNVNKMLLIDYKENRLIACGSLYQGICKLLRLEDLFKLGEPYHKKEHYLSGVNESGSVFGVIVSYSNLDDKLFIATAVDGKPEYFPTISSRKLTKNSEADGMFAYVFHDEFVASMIKIPSDTFTIIPDFDIYYVYGFSSGNFVYFLTLQPEMVSPPGSTTKEQVYTSKLVRLCKEDTAFNSYVEVPIGCERSGVEYRLLQAAYLSKAGAVLGRTLGVHPDDDLLFTVFSKGQKRKMKSLDESALCIFILKQINDRIKERLQSCYRGEGTLDLAWLKVKDIPCSSALLTIDDNFCGLDMNAPLGVSDMVRGIPVFTEDRDRMTSVIAYVYKNHSLAFVGTKSGKLKKSFGTGPQGGITQEWIGVEGDPPGANIASQEQMLCVYLQCSSHKAISDQRVQPLLCCFLNVPGNSS

SEQ ID NO: 33747 - protein, 1894 aa, Homo sapiens; identical to SEQ ID NO: 33744
  ENSP00000323194

SEQ ID NO: 33748 - protein, 2135 aa, Homo sapiens
  ENSP00000296440
MPALGPALLQALWAGWVLTLQPLPPTAFTPNGTYLQHLARDPTSGTLYLGATNFLFQLSPGLQLEATVSTGPVLDSRDCLPPVMPDECPQAQPTNNPNQLLLVSPGALVVCGSVHQGVCEQRRLGQLEQLLLRPERPGDTQYVAANDPAVSTVGLVAQGLAGEPLLFVGRGYTSRGVGGGIPPITTRALWPPDPQAAFSYEETAKLAVGRLSEYSHHFVSAFARGASAYFLFLRRDLQAQSRAFRAYVSRVCLRDQHYYSYVELPLACEGGRYGLIQAAAVATSREVAHGEVLFAAFSSAAPPTVGRPPSAAAGASGASALCAFPLDEVDRLANRTRDACYTREGRAEDGTEVAYIEYDVNSDCAQLPVDTLDAYPCGSDHTPSPMASRVPLEATPILEWPGIQLTAVAVTMEDGHTIAFLGDSQGQLHRVYLGPGSDGHPYSTQSIQQGSAVSRDLTFDGTFEHLYVMTQSTLLKVPVASCAQHLDCASCLAHRDPYCGWCVLLGRCSRRSECSRGQGPEQWLWSFQPELGCLQVAAMSPANISREETREVFLSVPDLPPLWPGESYSCHFGEHQSPALLTGSGVMCPSPDPSEAPVLPRGADYVSVSVELRFGAVVIAKTSLSFYDCVAVTELRPSAQCQACVSSRWGCNWCVWQHLCTHKASCDAGPMVASHQSPLVSPDPPARGGPSPSPPTAPKALATPAPDTLPVEPGAPSTATASDISPGASPSLLSPWGPWAGSGSISSPGSTGSPLHEEPSPPSPQNGPGTAVPAPTDFRPSATPEDLLASPLSPSEVAAVPPADPGPEALHPTVPLDLPPATVPATTFPGAMGSVKPALDWLTREGGELPEADEWTGGDAPAFSTSTLLSGDGDSAELEGPPAPLILPSSLDYQYDTPGLWELEEATLGASSCPCVESVQGSTLMPVHVEREIRLLGRNLHLFQDGPGDNECVMELEGLEVVVEARVECEPPPDTQCHVTCQQHQLSYEALQPELRVGLFLRRAGRLRVDSAEGLHVVLYDCSVGHGDCSRCQTAMPQYGCVWCEGERPRCVTREACGEAEAVATQCPAPLIHSVEPLTGPVDGGTRVTIRGSNLGQHVQDVLGMVTVAGVPCAVDAQEYEVSSSLVCITGASGEEVAGATAVEVPGRGRGVSEHDFAYQDPKVHSIFPARGPRAGGTRLTLNGSKLLTGRLEDIRVVVGDQPCHLLPEQQSEQLRCETSPRPTPATLPVAVWFGATERRLQRGQFKYTLDPNITSAGPTKSFLSGGREICVRGQNLDVVQTPRIRVTVVSRMLQPSQGLGRRRRVVPETACSLGPSCSSQQFEEPCHVNSSQLITCRTPALPGLPEDPWVRVEFILDNLVFDFATLNPTPFSYEADPTLQPLNPEDPTMPFRHKPGSVFSVEGENLDLAMSKEEVVAMIGDGPCVVKTLTRHHLYCEPPVEQPLPRHHALREAPDSLPEFTVQMGNLRFSLGHVQYDGESPGAFPVAAQVGLGVGTSLLALGVIIIVLMYRRKSKQALRDYKKVQIQLENLESSVRDRCKKEFTDLMTEMTDLTSDLLGSGIPFLDYKVYAERIFFPGHRESPLHRDLGVPESRRPTVEQGLGQLSNLLNSKLFLTKFIHTLESQRTFSARDRAYVASLLTVALHGKLEYFTDILRTLLSDLVAQYVAKNPKLMLRRTETVVEKLLTNWMSICLYTFVRDSVGEPLYMLFRGIKHQVDKGPVDSVTGKAKYTLNDNRLLREDVEYRPLTLNALLAVGPGAGEAQGVPVKVLDCDTISQAKEKMLDQLYKGVPLTQRPDPRTLDVEWRSGVAGHLILSDEDVTSEVQGLWRRLNTLQHYKVPDGATVALVPCLTKHVLRENQDYVPGERTPMLEDVDEGGIRPWHLVKPSDEPEPPRPRRGSLRGGERERAKAIPEIYLTRLLSMKGTLQKFVDDLFQVILSTSRPVPLAVKYFFDLLDEQAQQHGISDQDTIHIWKTNSLPLRFWINIIKNPQFVFDVQTSDNMDAVLLVIAQTFMDACTLADHKLGRDSPINKLLYARDIPRYKRMVERYYADIRQTVPASDQEMNSVLAELSWNYSGDLGARVALHELYKYINKYYDQIITALEEDGTAQKMQLGYRLQQIAAAVENKVTDL

SEQ ID NO: 33749 - protein, 2135 aa, Homo sapiens; identical to SEQ ID NO: 33748
  ENSP00000351338

SEQ ID NO: 33750 - protein, 1952 aa, Homo sapiens
  ENSP00000414199
MPALGPALLQALWAGWVLTLQPLPPTAFTPNGTYLQHLARDPTSGTLYLGATNFLFQLSPGLQLEATVSTGPVLDSRDCLPPVMPDECPQAQPTNNPNQLLLVSPGALVVCGSVHQGVCEQRRLGQLEQLLLRPERPGDTQYVAANDPAVSTVGLVAQGLAGEPLLFVGRGYTSRGVGGGIPPITTRALWPPDPQAAFSYEETAKLAVGRLSEYSHHFVSAFARGASAYFLFLRRDLQAQSRAFRAYVSRVCLRDQHYYSYVELPLACEGGRYGLIQAAAVATSREVAHGEVLFAAFSSAAPPTVGRPPSAAAGASGASALCAFPLDEVDRLANRTRDACYTREGRAEDGTEVAYIEYDVNSDCAQLPVDTLDAYPCGSDHTPSPMASRVPLEATPILEWPGIQLTAVAVTMEDGHTIAFLGDSQGQLHRVYLGPGSDGHPYSTQSIQQGSAVSRDLTFDGTFEHLYVMTQSTLLKVPVASCAQHLDCASCLAHRDPYCGWCVLLGRCSRRSECSRGQGPEQWLWSFQPELGCLQVAAMSPANISREETREVFLSVPDLPPLWPGESYSCHFGEHQSPALLTGSGVMCPSPDPSEAPVLPRGADYVSVSVELRFGAVVIAKTSLSFYDCVAVTELRPSAQCQACVSSRWGCNWCVWQHLCTHKASCDAGPMVASHQSPLVSPDPPARGDGDSAELEGPPAPLILPSSLDYQYDTPGLWELEEATLGASSCPCVESVQGSTLMPVHVEREIRLLGRNLHLFQDGPGDNECVMELEGLEVVVEARVECEPPPDTQCHVTCQQHQLSYEALQPELRVGLFLRRAGRLRVDSAEGLHVVLYDCSVGHGDCSRCQTAMPQYGCVWCEGERPRCVTREACGEAEAVATQCPAPLIHSVEPLTGPVDGGTRVTIRGSNLGQHVQDVLGMVTVAGVPCAVDAQEYEVSSSLVCITGASGEEVAGATAVEVPGRGRGVSEHDFAYQDPKVHSIFPARGPRAGGTRLTLNGSKLLTGRLEDIRVVVGDQPCHLLPEQQSEQLRCETSPRPTPATLPVAVWFGATERRLQRGQFKYTLDPNITSAGPTKSFLSGGREICVRGQNLDVVQTPRIRVTVVSRMLQPSQGLGRRRRVVPETACSLGPSCSSQQFEEPCHVNSSQLITCRTPALPGLPEDPWVRVEFILDNLVFDFATLNPTPFSYEADPTLQPLNPEDPTMPFRHKPGSVFSVEGENLDLAMSKEEVVAMIGDGPCVVKTLTRHHLYCEPPVEQPLPRHHALREAPDSLPEFTVQMGNLRFSLGHVQYDGESPGAFPVAAQVGLGVGTSLLALGVIIIVLMYRRKSKQALRDYKKVQIQLENLESSVRDRCKKEFTDLMTEMTDLTSDLLGSGIPFLDYKVYAERIFFPGHRESPLHRDLGVPESRRPTVEQGLGQLSNLLNSKLFLTKFIHTLESQRTFSARDRAYVASLLTVALHGKLEYFTDILRTLLSDLVAQYVAKNPKLMLRRTETVVEKLLTNWMSICLYTFVRDSVGEPLYMLFRGIKHQVDKGPVDSVTGKAKYTLNDNRLLREDVEYRPLTLNALLAVGPGAGEAQGVPVKVLDCDTISQAKEKMLDQLYKGVPLTQRPDPRTLDVEWRSGVAGHLILSDEDVTSEVQGLWRRLNTLQHYKVPDGATVALVPCLTKHVLRENQDYVPGERTPMLEDVDEGGIRPWHLVKPSDEPEPPRPRRGSLRGGERERAKAIPEIYLTRLLSMKGTLQKFVDDLFQVILSTSRPVPLAVKYFFDLLDEQAQQHGISDQDTIHIWKTNSLPLRFWINIIKNPQFVFDVQTSDNMDAVLLVIAQTFMDACTLADHKLGRDSPINKLLYARDIPRYKRMVERYYADIRQTVPASDQEMNSVLAELSWNYSGDLGARVALHELYKYINKYYDQIITALEEDGTAQKMQLGYRLQQIAAAVENKVTDL

SEQ ID NO: 33751 - protein, 729 aa, Homo sapiens
  ENSP00000395987
MPALGPALLQALWAGWVLTLQPLPPTAFTPNGTYLQHLARDPTSGTLYLGATNFLFQLSPGLQLEATVSTGPVLDSRDCLPPVMPDECPQAQPTNNPNQLLLVSPGALVVCGSVHQGVCEQRRLGQLEQLLLRPERPGDTQYVAANDPAVSTVGLVAQGLAGEPLLFVGRGYTSRGVGGGIPPITTRALWPPDPQAAFSYEETAKLAVGRLSEYSHHFVSAFARGASAYFLFLRRDLQAQSRAFRAYVSRVCLRDQHYYSYVELPLACEGGRYGLIQAAAVATSREVAHGEVLFAAFSSAAPPTVGRPPSAAAGASGASALCAFPLDEVDRLANRTRDACYTREGRAEDGTEVAYIEYDVNSDCAQLPVDTLDAYPCGSDHTPSPMASRVPLEATPILEWPGIQLTAVAVTMEDGHTIAFLGDSQGQLHRVYLGPGSDGHPYSTQSIQQGSAVSRDLTFDGTFEHLYVMTQSTLLKVPVASCAQHLDCASCLAHRDPYCGWCVLLGRCSRRSECSRGQGPEQWLWSFQPELGCLQVAAMSPANISREETREVFLSVPDLPPLWPGESYSCHFGEHQSPALLTGSGVMCPSPDPSEAPVLPRGADYVSVSVELRFGAVVIAKTSLSFYDCVAVTELRPSAQCQACVSSRWGCNWCVWQHLCTHKASCDAGPMVASHQVMETQQSLRALPPPSSSRPASTTSMTPPGSGSWKRRPWGQAPAPVWRAFRAPR

SEQ ID NO: 33752 - protein, 1909 aa, Homo sapiens
  ENSP00000355378
MCHAAQETPLLHHFMAPVMARWPPFGLCLLLLLLSPPPLPLTGAHRFSAPNTTLNHLALAPGRGTLYVGAVNRLFQLSPELQLEAVAVTGPVIDSPDCVPFRDPAECPQAQLTDNANQLLLVSSRAQELVACGQVRQGVCETRRLGDVAEVLYQAEDPGDGQFVAANTPGVATVGLVVPLPGRDLLLVARGLAGKLSAGVPPLAIRQLAGSQPFSSEGLGRLVVGDFSDYNNSYVGAFADARSAYFVFRRRGARAQAEYRSYVARVCLGDTNLYSYVEVPLACQGQGLIQAAFLAPGTLLGVFAAGPRGTQAALCAFPMVELGASMEQARRLCYTAGGRGPSGAEEATVEYGVTSRCVTLPLDSPESYPCGDEHTPSPIAGRQPLEVQPLLKLGQPVSAVAALQADGHMIAFLGDTQGQLYKVFLHGSQGQVYHSQQVGPPGSAISPDLLLDSSGSHLYVLTAHQVDRIPVAACPQFPDCASCLQAQDPLCGWCVLQGRCTRKGQCGRAGQLNQWLWSYEEDSHCLHIQSLLPGHHPRQEQGQVTLSVPRLPILDADEYFHCAFGDYDSLAHVEGPHVACVTPPQDQVPLNPPGTDHVTVPLALMFEDVTVAATNFSFYDCSAVQALEAAAPCRACVGSIWRCHWCPQSSHCVYGEHCPEGERTIYSAQEVDIQVRGPGACPQVEGLAGPHLVPVGWESHLALRVRNLQHFRGLPASFHCWLELPGELRGLPATLEETAGDSGLIHCQAHQFYPSMSQRELPVPIYVTQGEAQRLDNTHALYVILYDCAMGHPDCSHCQAANRSLGCLWCADGQPACRYGPLCPPGAVELLCPAPSIDAVEPLTGPPEGGLALTILGSNLGRAFADVQYAVSVASRPCNPEPSLYRTSARIVCVTSPAPNGTTGPVRVAIKSQPPGISSQHFTYQDPVLLSLSPRWGPQAGGTQLTIRGQHLQTGGNTSAFVGGQPCPILEPVCPEAIVCRTRPQAAPGEAAVLVVFGHAQRTLLASPFRYTANPQLVAAEPSASFRGGGRLIRVRGTGLDVVQRPLLSVWLEADAEVQASRAQPQDPQPRRSCGAPAADPQACIQLGGGLLQCSTVCSVNSSSLLLCRSPAVPDRAHPQRVFFTLDNVQVDFASASGGQGFLYQPNPRLAPLSREGPARPYRLKPGHVLDVEGEGLNLGISKEEVRVHIGRGECLVKTLTRTHLYCEPPAHAPQPANGSGLPQFVVQMGNVQLALGPVQYEAEPPLSAFPVEAQAGVGMGAAVLIAAVLLLTLMYRHKSKQALRDYQKVLVQLESLETGVGDQCRKEFTDLMTEMTDLSSDLEGSGIPFLDYRTYAERAFFPGHGGCPLQPKPEGPGEDGHCATVRQGLTQLSNLLNSKLFLLTLIHTLEEQPSFSQRDRCHVASLLSLALHGKLEYLTDIMRTLLGDLAAHYVHRNPKLMLRRTETMVEKLLTNWLSICLYAFLREVAGEPLYMLFRAIQYQVDKGPVDAVTGKAKRTLNDSRLLREDVEFQPLTLMVLVGPGAGGAAGSSEMQRVPARVLDTDTITQVKEKVLDQVYKGTPFSQRPSVHALDLEWRSGLAGHLTLSDEDLTSVTQNHWKRLNTLQHYKVPDGATVGLVPQLHRGSTISQSLAQRCPLGENIPTLEDGEEGGVCLWHLVKATEEPEGAKVRCSSLREREPARAKAIPEIYLTRLLSMKGTLQKFVDDTFQAILSVNRPIPIAVKYLFDLLDELAEKHGIEDPGTLHIWKTNSLLLRFWVNALKNPQLIFDVRVSDNVDAILAVIAQTFIDSCTTSEHKVGRDSPVNKLLYAREIPRYKQMVERYYADIRQSSPASYQEMNSALAELSGNYTSAPHCLEALQELYNHIHRYYDQIISALEEDPVGQKLQLACRLQQVAALVENKVTDL

SEQ ID NO: 33753 - protein, 258 aa, Homo sapiens
  ENSP00000391650
  MOD_RES (1)..(1): Any amino acid
XSLETGVGDQCRKEFTDLMTEMTDLSSDLEGSGIPFLDYRTYAERAFFPGHGGCPLQPKPEGPGEDGHCATVRQGLTQLSNLLNSKLFLLTLIHTLEEQPSFSQRDRCHVASLLSLALHGKLEYLTDIMRTLLGDLAAHYVHRNPKLMLRRTETMVEKLLTNWLSICLYAFLREVAGEPLYMLFRAIQYQVDKGPVDAVTEWRSGLAGHLTLSDEDLTSVTQNHWKRLNTLQHYKVPDGATVGLVPQLHRGSTISQSL

SEQ ID NO: 33754 - protein, 163 aa, Homo sapiens
  ENSP00000396048
  MOD_RES (1)..(1): Any amino acid
XKRTLNDSRLLREDVEFQPLTLMVLVGPGAGGAAGSSEMQRVPARVLDTDTITQVKEKVLDQVYKGTPFSQRPSVHALDLEWRSGLAGHLTLSDEDLTSVTQNHWKRLNTLQHYKVPDGATVGLVPQLHRGSTISQSLAQRCPLGESESLGPDLGPLESRLGR

SEQ ID NO: 33755 - protein, 175 aa, Homo sapiens
  ENSP00000412454
  MOD_RES (1)..(1): Any amino acid
XASQGTLQKFVDDTFQAILSVNRPIPIAVKYLFDLLDELAEKHGIEDPGTLHIWKTNSLLLRFWVNALKNPQLIFDVRVSDNVDAILAVIAQTFIDSCTTSEHKVGRVRAVPAAAAGRGLRRKGLWGKPRGLCTELWVGSGSIMGAPSPPSSCLAPPLPPEQDSPVNKLLYAREI

SEQ ID NO: 33756 - protein, 1932 aa, Homo sapiens
  ENSP00000442736
MELTPASSLTCSLLSPRLPGSFPQLRRVPPCSRPWLPKAPVMARWPPFGLCLLLLLLSPPPLPLTGAHRFSAPNTTLNHLALAPGRGTLYVGAVNRLFQLSPELQLEAVAVTGPVIDSPDCVPFRDPAECPQAQLTDNANQLLLVSSRAQELVACGQVRQGVCETRRLGDVAEVLYQAEDPGDGQFVAANTPGVATVGLVVPLPGRDLLLVARGLAGKLSAGVPPLAIRQLAGSQPFSSEGLGRLVVGDFSDYNNSYVGAFADARSAYFVFRRRGARAQAEYRSYVARVCLGDTNLYSYVEVPLACQGQGLIQAAFLAPGTLLGVFAAGPRGTQAALCAFPMVELGASMEQARRLCYTAGGRGPSGAEEATVEYGVTSRCVTLPLDSPESYPCGDEHTPSPIAGRQPLEVQPLLKLGQPVSAVAALQADGHMIAFLGDTQGQLYKVFLHGSQGQVYHSQQVGPPGSAISPDLLLDSSGSHLYVLTAHQVDRIPVAACPQFPDCASCLQAQDPLCGWCVLQGRCTRKGQCGRAGQLNQWLWSYEEDSHCLHIQSLLPGHHPRQEQGQVTLSVPRLPILDADEYFHCAFGDYDSLAHVEGPHVACVTPPQDQVPLNPPGTDHVTVPLALMFEDVTVAATNFSFYDCSAVQALEAAAPCRACVGSIWRCHWCPQSSHCVYGEHCPEGERTIYSAQEVDIQVRGPGACPQVEGLAGPHLVPVGWESHLALRVRNLQHFRGLPASFHCWLELPGELRGLPATLEETAGDSGLIHCQAHQFYPSMSQRELPVPIYVTQGEAQRLDNTHALYVILYDCAMGHPDCSHCQAANRSLGCLWCADGQPACRYGPLCPPGAVELLCPAPSIDAVEPLTGPPEGGLALTILGSNLGRAFADVQYAVSVASRPCNPEPSLYRTSARIVCVTSPAPNGTTGPVRVAIKSQPPGISSQHFTYQDPVLLSLSPRWGPQAGGTQLTIRGQHLQTGGNTSAFVGGQPCPILEPVCPEAIVCRTRPQAAPGEAAVLVVFGHAQRTLLASPFRYTANPQLVAAEPSASFRGGGRLIRVRGTGLDVVQRPLLSVWLEADAEVQASRAQPQDPQPRRSCGAPAADPQACIQLGGGLLQCSTVCSVNSSSLLLCRSPAVPDRAHPQRVFFTLDNVQVDFASASGGQGFLYQPNPRLAPLSREGPARPYRLKPGHVLDVEGEGLNLGISKEEVRVHIGRGECLVKTLTRTHLYCEPPAHAPQPANGSGLPQFVVQMGNVQLALGPVQYEAEPPLSAFPVEAQAGVGMGAAVLIAAVLLLTLMYRHKSKQALRDYQKVLVQLESLETGVGDQCRKEFTDLMTEMTDLSSDLEGSGIPFLDYRTYAERAFFPGHGGCPLQPKPEGPGEDGHCATVRQGLTQLSNLLNSKLFLLTLIHTLEEQPSFSQRDRCHVASLLSLALHGKLEYLTDIMRTLLGDLAAHYVHRNPKLMLRRTETMVEKLLTNWLSICLYAFLREVAGEPLYMLFRAIQYQVDKGPVDAVTGKAKRTLNDSRLLREDVEFQPLTLMVLVGPGAGGAAGSSEMQRVPARVLDTDTITQVKEKVLDQVYKGTPFSQRPSVHALDLEWRSGLAGHLTLSDEDLTSVTQNHWKRLNTLQHYKVPDGATVGLVPQLHRGSTISQSLAQRCPLGENIPTLEDGEEGGVCLWHLVKATEEPEGAKVRCSSLREREPARAKAIPEIYLTRLLSMKGTLQKFVDDTFQAILSVNRPIPIAVKYLFDLLDELAEKHGIEDPGTLHIWKTNSLLLRFWVNALKNPQLIFDVRVSDNVDAILAVIAQTFIDSCTTSEHKVGRDSPVNKLLYAREIPRYKQMVERYYADIRQSSPASYQEMNSALAELSGNYTSAPHCLEALQELYNHIHRYYDQIISALEEDPVGQKLQLACRLQQVAALVENKVTDL

SEQ ID NO: 33757 - protein, 1568 aa, Homo sapiens
  ENSP00000258526
MEVSRRKAPPRPPRPAAPLPLLAYLLALAAPGRGADEPVWRSEQAIGAIAASQEDGVFVASGSCLDQLDYSLEHSLSRLYRDQAGNCTEPVSLAPPARPRPGSSFSKLLLPYREGAAGLGGLLLTGWTFDRGACEVRPLGNLSRNSLRNGTEVVSCHPQGSTAGVVYRAGRNNRWYLAVAATYVLPEPETASRCNPAASDHDTAIALKDTEGRSLATQELGRLKLCEGAGSLHFVDAFLWNGSIYFPYYPYNYTSGAATGWPSMARIAQSTEVLFQGQASLDCGHGHPDGRRLLLSSSLVEALDVWAGVFSAAAGEGQERRSPTTTALCLFRMSEIQARAKRVSWDFKTAESHCKEGDQPERVQPIASSTLIHSDLTSVYGTVVMNRTVLFLGTGDGQLLKVILGENLTSNCPEVIYEIKEETPVFYKLVPDPVKNIYIYLTAGKEVRRIRVANCNKHKSCSECLTATDPHCGWCHSLQRCTFQGDCVHSENLENWLDISSGAKKCPKIQIIRSSKEKTTVTMVGSFSPRHSKCMVKNVDSSRELCQNKSQPNRTCTCSIPTRATYKDVSVVNVMFSFGSWNLSDRFNFTNCSSLKECPACVETGCAWCKSARRCIHPFTACDPSDYERNQEQCPVAVEKTSGGGRPKENKGNRTNQALQVFYIKSIEPQKVSTLGKSNVIVTGANFTRASNITMILKGTSTCDKDVIQVSHVLNDTHMKFSLPSSRKEMKDVCIQFDGGNCSSVGSLSYIALPHCSLIFPATTWISGGQNITMMGRNFDVIDNLIISHELKGNINVSEYCVATYCGFLAPSLKSSKVRTNVTVKLRVQDTYLDCGTLQYREDPRFTGYRVESEVDTELEVKIQKENDNFNISKKDIEITLFHGENGQLNCSFENITRNQDLTTILCKIKGIKTASTIANSSKKVRVKLGNLELYVEQESVPSTWYFLIVLPVLLVIVIFAAVGVTRHKSKELSRKQSQQLELLESELRKEIRDGFAELQMDKLDVVDSFGTVPFLDYKHFALRTFFPESGGFTHIFTEDMHNRDANDKNESLTALDALICNKSFLVTVIHTLEKQKNFSVKDRCLFASFLTIALQTKLVYLTSILEVLTRDLMEQCSNMQPKLMLRRTESVVEKLLTNWMSVCLSGFLRETVGEPFYLLVTTLNQKINKGPVDVITCKALYTLNEDWLLWQVPEFSTVALNVVFEKIPENESADVCRNISVNVLDCDTIGQAKEKIFQAFLSKNGSPYGLQLNEIGLELQMGTRQKELLDIDSSSVILEDGITKLNTIGHYEISNGSTIKVFKKIANFTSDVEYSDDHCHLILPDSEAFQDVQGKRHRGKHKFKVKEMYLTKLLSTKVAIHSVLEKLFRSIWSLPNSRAPFAIKYFFDFLDAQAENKKITDPDVVHIWKTNSLPLRFWVNILKNPQFVFDIKKTPHIDGCLSVIAQAFMDAFSLTEQQLGKEAPTNKLLYAKDIPTYKEEVKSYYKAIRDLPPLSSSEMEEFLTQESKKHENEFNEEVALTEIYKYIVKYFDEILNKLERERGLEEAQKQLLHVKVLFDEKKKCKWM

SEQ ID NO: 33758 - protein, 109 aa, Homo sapiens
  ENSP00000447843
MNRTVLFLGTGDGQLLKVILGENLTSNCPEVIYEIKEETPVFYKLVPDPVKNIYIYLTAGKEVRRIRVANCNKHKSCSECLTATDPHCGWCHSLQRCTFQGDCVHSENL

SEQ ID NO: 33759 - protein, 416 aa, Homo sapiens
  ENSP00000446781
MTAVGVTRHKSKELSRKQSQQLELLESELRKEIRDGFAELQMDKLDVVDSFGTVPFLDYKHFALRTFFPESGGFTHIFTEDMHNRDANDKNESLTALDALICNKSFLVTVIHTLEKQKNFSVKDRCLFASFLTIALQTKLVYLTSILEVLTRDLMEQCSNMQPKLMLRRTESVVEKLLTNWMSVCLSGFLRETVGEPFYLLVTTLNQKINKGPVDVITCKALYTLNEDWLLWQVPEFSTVALNVVFEKIPENESADVCRNISVNVLDCDTIGQAKEKIFQAFLSKNGSPYGLQLNEIGLELQMGTRQKELLDIDSSSVILEDGITKLNTIGHYEISNGSTIKVFKKIANFTSDVEYSDDHCHLILPDSEAFQDVQGKRHRGKHKFKVKEMYLTKLLSTKPSSSLLGKHPEEPSVCL

SEQ ID NO: 33760 - protein, 103 aa, Homo sapiens
  ENSP00000447625
MQHLCLLAAVGVTRHKSKELSRKQSQQLELLESELRKEIRDGFAELQMDKLDVVDSFGTVPFLDYKHFALRTFFPENRDANDKNESLTALDALICNKSFLVTV

SEQ ID NO: 33761 - protein, 615 aa, Homo sapiens
  ENSP00000446720
MQHLCLLAAVGVTRHKSKELSRKQSQQLELLESELRKEIRDGFAELQMDKLDVVDSFGTVPFLDYKHFALRTFFPESGGFTHIFTEDMHNRDANDKNESLTALDALICNKSFLVTVIHTLEKQKNFSVKDRCLFASFLTIALQTKLVYLTSILEVLTRDLMEQCSNMQPKLMLRRTESVVEKLLTNWMSVCLSGFLRETVGEPFYLLVTTLNQKINKGPVDVITCKALYTLNEDWLLWQVPEFSTVALNVVFEKIPENESADVCRNISVNVLDCDTIGQAKEKIFQAFLSKNGSPYGLQLNEIGLELQMGTRQKELLDIDSSSVILEDGITKLNTIGHYEISNGSTIKVFKKIANFTSDVEYSDDHCHLILPDSEAFQDVQGKRHRGKHKFKVKEMYLTKLLSTKVAIHSVLEKLFRSIWSLPNSRAPFAIKYFFDFLDAQAENKKITDPDVVHIWKTNSLPLRFWVNILKNPQFVFDIKKTPHIDGCLSVIAQAFMDAFSLTEQQLGKEAPTNKLLYAKDIPTYKEEVKSYYKAIRDLPPLSSSEMEEFLTQESKKHENEFNEEVALTEIYKYIVKYFDEILNKLERERGLEEAQKQLLHVKVLFDEKKKCKWM

SEQ ID NO: 33762 - protein, 307 aa, Homo sapiens
  ENSP00000439225
MGTRQKELLDIDSSSVILEDGITKLNTIGHYEISNGSTIKVFKKIANFTSDVEYSDDHCHLILPDSEAFQDVQGKRHRGKHKFKVKEMYLTKLLSTKVAIHSVLEKLFRSIWSLPNSRAPFAIKYFFDFLDAQAENKKITDPDVVHIWKTNSLPLRFWVNILKNPQFVFDIKKTPHIDGCLSVIAQAFMDAFSLTEQQLGKEAPTNKLLYAKDIPTYKEEVKSYYKAIRDLPPLSSSEMEEFLTQESKKHENEFNEEVALTEIYKYIVKYFDEILNKLERERGLEEAQKQLLHVKVLFDEKKKCKWM

SEQ ID NO: 33763 - protein, 668 aa, Homo sapiens
  ENSP00000402758
MDLVLKRCLLHLAVIGALLAVGATKVPRNQDWLGVSRQLRTKAWNRQLYPEWTEAQRLDCWRGGQVSLKVSNDGPTLIGANASFSIALNFPGSQKVLPDGQVIWVNNTIINGSQVWGGQPVYPQETDDACIFPDGGPCPSGSWSQKRSFVYVWKTWGQYWQVLGGPVSGLSIGTGRAMLGTHTMEVTVYHRRGSRSYVPLAHSSSAFTITDQVPFSVSVSQLRALDGGNKHFLRNQPLTFALQLHDPSGYLAEADLSYTWDFGDSSGTLISRALVVTHTYLEPGPVTAQVVLQAAIPLTSCGSSPVPGTTDGHRPTAEAPNTTAGQVPTTEVVGTTPGQAPTAEPSGTTSVQVPTTEVISTAPVQMPTAESTGMTPEKVPVSEVMGTTLAEMSTPEATGMTPAEVSIVVLSGTTAAQVTTTEWVETTARELPIPEPEGPDASSIMSTESITGSLGPLLDGTATLRLVKRQVPLDCVLYRYGSFSVTLDIVQGIESAEILQAVPSGEGDAFELTVSCQGGLPKEACMEISSPGCQPPAQRLCQPVLPSPACQLVLHQILKGGSGTYCLNVSLADTNSLAVVSTQLIMPVPGILLTGQEAGLGQVPLIVGILLVLMAVVLASLIYRRRLMKQDFSVPQLPHSSSHWLRLPRIFCSCPIGENSPLLSGQQV

SEQ ID NO: 33764 - protein, 661 aa, Homo sapiens
  ENSP00000449690
MDLVLKRCLLHLAVIGALLAVGATKVPRNQDWLGVSRQLRTKAWNRQLYPEWTEAQRLDCWRGGQVSLKVSNDGPTLIGANASFSIALNFPGSQKVLPDGQVIWVNNTIINGSQVWGGQPVYPQETDDACIFPDGGPCPSGSWSQKRSFVYVWKTWGQYWQVLGGPVSGLSIGTGRAMLGTHTMEVTVYHRRGSRSYVPLAHSSSAFTITDQVPFSVSVSQLRALDGGNKHFLRNQPLTFALQLHDPSGYLAEADLSYTWDFGDSSGTLISRALVVTHTYLEPGPVTAQVVLQAAIPLTSCGSSPVPGTTDGHRPTAEAPNTTAGQVPTTEVVGTTPGQAPTAEPSGTTSVQVPTTEVISTAPVQMPTAESTGMTPEKVPVSEVMGTTLAEMSTPEATGMTPAEVSIVVLSGTTAAQVTTTEWVETTARELPIPEPEGPDASSIMSTESITGSLGPLLDGTATLRLVKRQVPLDCVLYRYGSFSVTLDIVQGIESAEILQAVPSGEGDAFELTVSCQGGLPKEACMEISSPGCQPPAQRLCQPVLPSPACQLVLHQILKGGSGTYCLNVSLADTNSLAVVSTQLIMPGQEAGLGQVPLIVGILLVLMAVVLASLIYRRRLMKQDFSVPQLPHSSSHWLRLPRIFCSCPIGENSPLLSGQQV

SEQ ID NO: 33765 - protein, 575 aa, Homo sapiens
  ENSP00000450036
MDLVLKRCLLHLAVIGALLAVGATKGSQVWGGQPVYPQETDDACIFPDGGPCPSGSWSQKRSFVYVWKTWGQYWQVLGGPVSGLSIGTGRAMLGTHTMEVTVYHRRGSRSYVPLAHSSSAFTITDQVPFSVSVSQLRALDGGNKHFLRNQPLTFALQLHDPSGYLAEADLSYTWDFGDSSGTLISRALVVTHTYLEPGPVTAQVVLQAAIPLTSCGSSPVPGTTDGHRPTAEAPNTTAGQVPTTEVVGTTPGQAPTAEPSGTTSVQVPTTEVISTAPVQMPTAESTGMTPEKVPVSEVMGTTLAEMSTPEATGMTPAEVSIVVLSGTTAAQVTTTEWVETTARELPIPEPEGPDASSIMSTESITGSLGPLLDGTATLRLVKRQVPLDCVLYRYGSFSVTLDIVQGIESAEILQAVPSGEGDAFELTVSCQGGLPKEACMEISSPGCQPPAQRLCQPVLPSPACQLVLHQILKGGSGTYCLNVSLADTNSLAVVSTQLIMPGQEAGLGQVPLIVGILLVLMAVVLASLIYRRRLMKQDFSVPQLPHSSSHWLRLPRIFCSCPIGENSPLLSGQQV

SEQ ID NO: 33766 - protein, 661 aa, Homo sapiens; identical to SEQ ID NO: 33764
  ENSP00000448828

SEQ ID NO: 33767 - protein, 661 aa, Homo sapiens; identical to SEQ ID NO: 33764
  ENSP00000447374

SEQ ID NO: 33768 - protein, 290 aa, Homo sapiens
  ENSP00000448029
MDLVLKRCLLHLAVIGALLAVGATKGGQVSLKVSNDGPTLIGANASFSIALNFPGSQKVLPDGQVIWVNNTIINGSQVWGGQPVYPQETDDACIFPDGGPCPSGSWSQKRSFVYVWKTWEGIESAEILQAVPSGEGDAFELTVSCQGGLPKEACMEISSPGCQPPAQRLCQPVLPSPACQLVLHQILKGGSGTYCLNVSLADTNSLAVVSTQLIMPGQEAGLGQVPLIVGILLVLMAVVLASLIYRRRLMKQDFSVPQLPHSSSHWLRLPRIFCSCPIGENSPLLSGQQV

SEQ ID NO: 33769 - protein, 452 aa, Homo sapiens
  ENSP00000449520
  MOD_RES (1)..(1): Any amino acid
XQVWGGQPVYPQETDDACIFPDGGPCPSGSWSQKRSFVYVWKTWGQYWQVLGGPVSGLSIGTGRAMLGTHTMEVTVYHRRGSRSYVPLAHSSSAFTITDQVPFSVSVSQLRALDGGNKHFLRNQPLTFALQLHDPSGYLAEADLSYTWDFGDSSGTLISRALVVTHTYLEPGPVTAQVVLQAAIPLTSCGSSPVPGTTDGHRPTAEAPNTTAGQVPTTEVVGTTPGQAPTAEPSGTTSVQVPTTEVISTAPVQMPTAESTAAQVTTTEWVETTARELPIPEPEGPDASSIMSTESITGSLGPLLDGTATLRLVKRQVPLDCVLYRYGSFSVTLDIVQGIESAEILQAVPSGEGDAFELTVSCQGGLPKEACMEISSPGCQPPAQRLCQPVLPSPACQLVLHQILKGGSGTYCLNVSLADTNSLAVVSTQLIMPVPGILLTGQEAGLGQVPLI

SEQ ID NO: 33770 - protein, 296 aa, Homo sapiens
  ENSP00000447732
MDLVLKRCLLHLAVIGALLAVGATKVPRNQDWLGVSRQLRTKAWNRQLYPEWTEAQRLDCWRGGQVSLKVSNDGPTLIGANASFSIALNFPGSQKVLPDGQVIWVNNTIINGSQVWGGQPVYPQETDDACIFPDGGPCPSGSWSQKRSFVYVWKTWVPGTTDGHRPTAEAPNTTAGQVPTTEVVGTTPGQAPTAEPSGTTSVQVPTTEVISTAPVQMPTAESTAAQVTTTEWVETTARELPIPEPEGPDASSIMSTESITGSLGPLLDGTATLRLVKRQVPLDCVLYRYGSFSVTL

SEQ ID NO: 33771 - protein, 344 aa, Homo sapiens
  ENSP00000448849
MDLVLKRCLLHLAVIGALLAVGATKVPRNQDWLGVSRQLRTKAWNRQLYPEWTEAQRLDCWRGGQVSLKVSNDGPTLIGANASFSIALNFPGSQKVLPDGQVIWVNNTIINGSQVWGGQPVYPQETDDACIFPDGGPCPSGSWSQKRSFVYVWKTWDQVPFSVSVSQLRALDGGNKHFLRNQPLTFALQLHDPSGYLAEADLSYTWDFGDSSGTLISRALVVTHTYLEPGPVTAQVVLQAAIPLTSCGSSPVPGTTDGHRPTAEAPNTTAGQVPTTEVVGTTPGQAPTAEPSGTTSVQVPTTEVISTAPVQMPTAESTGMTPEKVPVSEVMGTTLAEMSTPEAT

SEQ ID NO: 33772 - protein, 299 aa, Homo sapiens
  ENSP00000446662
MDLVLKRCLLHLAVIGALLAVGATKVPRNQDWLGVSRQLRTKAWNRQLYPEWTEAQRLDCWRGSQVWGGQPVYPQETDDACIFPDGGPCPSGSWSQKRSFVYVWKTWGQYWQVLGGPVSGLSIGTGRAMLGTHTMEVTVYHRRGSRSYVPLAHSSSAFTITDQVPFSVSVSQLRALDGGNKHFLRNQPLTFALQLHDPSGYLAEADLSYTWDFGDSSGTLISRALVVTHTYLEPGPVTAQVVLQAAIPLTSCGSSPVPGTTDGHRPTAEAPNTTAGQVPTTEVVGTTPGQAPTAEPSGT

SEQ ID NO: 33773 - protein, 151 aa, Homo sapiens
  ENSP00000446633
MDLVLKRCLLHLAVIGALLAVGATKVPRNQDWLGVSRQLRTKAWNRQLYPEWTEAQRLDCWRGGQVSLKVSNDGPTLIGANASFSIALNFPGSQKVLPDGQVIWVNNTIINGSQVWGGQPVYPQETDDACIFPDGGPCPSGSWSQKRSFVY

SEQ ID NO: 33774 - protein, 134 aa, Homo sapiens
  ENSP00000448871
MGKEEIPRPTLTSVKTLLYTKEFPQTVKVPRNQDWLGVSRQLRTKAWNRQLYPEWTEAQRLDCWRGGQVSLKVSNDGPTLIGANASFSIALNFPGSQKVLPDGQVIWVNNTIINGSQVWGGQPVYPQETDDACI

SEQ ID NO: 33775 - protein, 287 aa, Homo sapiens
  ENSP00000345826
MHRLMGVNSTAAAAAGQPNVSCTCNCKRSLFQSMEITELEFVQIIIIVVVMMVMVVVITCLLSHYKLSARSFISRHSQGRRREDALSSEGCLWPSESTVSGNGIPEPQVYAPPRPTDRLAVPPFAQRERFHRFQPTYPYLQHEIDLPPTISLSDGEEPPPYQGPCTLQLRDPEQQLELNRESVRAPPNRTIFDSDLMDSARLGGPCPPSSNSGISATCYGSGGRMEGPPPTYSEVIGHYPGSSFQHQQSSGPPSLLEGTRLHHTHIAPLESAAIWSKEKDKQKGHPL

SEQ ID NO: 33776 - protein, 237 aa, Homo sapiens
  ENSP00000379161
MMVMVVVITCLLSHYKLSARSFISRHSQGRRREDALSSEGCLWPSESTVSGNGIPEPQVYAPPRPTDRLAVPPFAQRERFHRFQPTYPYLQHEIDLPPTISLSDGEEPPPYQGPCTLQLRDPEQQLELNRESVRAPPNRTIFDSDLMDSARLGGPCPPSSNSGISATCYGSGGRMEGPPPTYSEVIGHYPGSSFQHQQSSGPPSLLEGTRLHHTHIAPLESAAIWSKEKDKQKGHPL

SEQ ID NO: 33777 - protein, 252 aa, Homo sapiens
  ENSP00000344014
MAELEFVQIIIIVVVMMVMVVVITCLLSHYKLSARSFISRHSQGRRREDALSSEGCLWPSESTVSGNGIPEPQVYAPPRPTDRLAVPPFAQRERFHRFQPTYPYLQHEIDLPPTISLSDGEEPPPYQGPCTLQLRDPEQQLELNRESVRAPPNRTIFDSDLMDSARLGGPCPPSSNSGISATCYGSGGRMEGPPPTYSEVIGHYPGSSFQHQQSSGPPSLLEGTRLHHTHIAPLESAAIWSKEKDKQKGHPL

SEQ ID NO: 33778 - protein, 237 aa, Homo sapiens; identical to SEQ ID NO: 33776
  ENSP00000379159

SEQ ID NO: 33779 - protein, 208 aa, Homo sapiens
  ENSP00000401506
MPAIPAHGAELEFVQIIIIVVVMMVMVVVITCLLSHYKLSARSFISRHSQGRRREDALSSEGCLWPSESTVSGNGIPEPQVYAPPRPTDRLAVPPFAQRERFHRFQPTYPYLQHEIDLPPTISLSDGEEPPPYQGPCTLQLRDPEQQLELNRESVRAPPNRTIFDSDLMDSARLGGPCPPSSNSGISATCYGSGGRMEGPPPTYSEVI

SEQ ID NO: 33780 - protein, 227 aa, Homo sapiens
  ENSP00000379164
MHRLMGVNSTAAAAAGQPNVSCTCNCKRSLFQSMEISCHGFPVCKSHQHQEWKSLCWSLRSPGGASSITGFGSMKVTNPAMNLPECQWLRIQKAELEFVQIIIIVVVMMVMVVVITCLLSHYKLSARSFISRHSQGRRREDALSSEGCLWPSESTVSGNGIPEPQVYAPPRPTDRLAVPPFAQRERFHRFQPTYPYLQHEIDLPPTISLSDGEEPPPYQGPCTLQLR

SEQ ID NO: 33781 - protein, 237 aa, Homo sapiens; identical to SEQ ID NO: 33776
  ENSP00000265626

SEQ ID NO: 33782 - protein, 132 aa, Homo sapiens
  ENSP00000256103
MSNKFLGTWKLVSSENFDDYMKALGVGLATRKLGNLAKPTVIISKKGDIITIRTESTFKNTEISFKLGQEFEETTADNRKTKSIVTLQRGSLNQVQRWDGKETTIKRKLVNGKMVAECKMKGVVCTRIYEKV

SEQ ID NO: 33783 - protein, 60 aa, Homo sapiens
  ENSP00000429917
MSNKFLGTWKLVSSENFDDYMKALEHRNPAERITESSAEMGWQRDNHKEKASEWENGSGM

SEQ ID NO: 33784 - protein, 160 aa, Homo sapiens
  ENSP00000379269
MLLLLLSIIVLHVAVLVLLFVSTIVSQWIVGNGHATDLWQNCSTSSSGNVHHCFSSSPNEWLQSVQATMILSIIFSILSLFLFFCQLFTLTKGGRFYITGIFQILAGLCVMSAAAIYTVRHPEWHLNSDYSYGFAYILAWVAFPLALLSGVIYVILRKRE

SEQ ID NO: 33785 - protein, 160 aa, Homo sapiens; identical to SEQ ID NO: 33784
  ENSP00000308937

SEQ ID NO: 33786 - protein, 161 aa, Homo sapiens [sequence omitted]

SEQ ID NO: 33787 - protein, 118 aa, Homo sapiens
  ENSP00000379268
MLLLLLSIIVLHVAVLVLLFVSTIVSQWIVGNGHATDLWQNCSTSSSGNVHHCFSSSPNEWLQSVQATMILSIIFSILSLFLFFCQLFTLTKGGRFYITGIFQILAESNSSQMCGYRD

SEQ ID NO: 33788 - protein, 51 aa, Homo sapiens
  ENSP00000464468
MAAVCPGHHDPVDHLQHSVSVPVLLPTLHPHQGGQVLHHWNLPNSCWSVRD

SEQ ID NO: 33789 - protein, 125 aa, Homo sapiens
  ENSP00000409824
MLLLLLSIIVLHVAVLVLLFVSTIVSQWIVGNGHATDLWQNCSTSSSGNVHHCFSSSPNEWLQSVQATMILSIIFSILSLFLFFCQLFTLTKGGRFYITGIFQILAGKLWMVKSMWKRGASKSAE

SEQ ID NO: 33790 - protein, 160 aa, Homo sapiens; identical to SEQ ID NO: 33784
  ENSP00000484631

SEQ ID NO: 33791 - protein, 192 aa, Homo sapiens
  ENSP00000357452
MAPLGGAPRLVLLFSGKRKSGKDFVTEALQSRLGADVCAVLRLSGPLKEQYAQEHGLNFQRLLDTSTYKEAFRKDMIRWGEEKRQADPGFFCRKIVEGISQPIWLVSDTRRVSDIQWFREAYGAVTQTVRVVALEQSRQQRGWVFTPGVDDAESECGLDNFGDFDWVIENHGVEQRLEEQLENLIEFIRSRL

SEQ ID NO: 33792 - protein, 465 aa, Homo sapiens
  ENSP00000358223
MLPLWTLSLLLGAVAGKEVCYERLGCFSDDSPWSGITERPLHILPWSPKDVNTRFLLYTNENPNNFQEVAADSSSISGSNFKTNRKTRFIIHGFIDKGEENWLANVCKNLFKVESVNCICVDWKGGSRTGYTQASQNIRIVGAEVAYFVEFLQSAFGYSPSNVHVIGHSLGAHAAGEAGRRTNGTIGRITGLDPAEPCFQGTPELVRLDPSDAKFVDVIHTDGAPIVPNLGFGMSQVVGHLDFFPNGGVEMPGCKKNILSQIVDIDGIWEGTRDFAACNHLRSYKYYTDSIVNPDGFAGFPCASYNVFTANKCFPCPSGGCPQMGHYADRYPGKTNDVGQKFYLDTGDASNFARWRYKVSVTLSGKKVTGHILVSLFGNKGNSKQYEIFKGTLKPDSTHSNEFDSDVDVGDLQMVKFIWYNNVINPTLPRVGASKIIVETNVGKQFNFCSPETVREEVLLTLTPC

SEQ ID NO: 33793 - protein, 364 aa, Homo sapiens
  ENSP00000429344
MALALLEDWCRIMSVDEQKSLMVTGIPADFEEAEIQEVLQETLKSLGRYRLLGKIFRKQENANAVLLELLEDTDVSAIPSEVQGKGGVWKVIFKTPNQDTEFLERLNLFLEKEGQTVSGMFRALGQEGVSPATVPCISPELLAHLLGQAMAHAPQPLLPMRYRKLRVFSGSAVPAPEEESFEVWLEQATEIVKEWPVTEAEKKRWLAESLRGPALDLMHIVQADNPSISVEECLEAFKQVFGSLESRRTAQVRYLKTYQEEGEKVSAYVLRLETLLRRAVEKRAIPRRIADQVRLEQVMAGATLNQMLWCRLRELKDQGPPPSFLELMKVIREEEEEEASFENESIEEPEERDGYGRWNHEGDD

SEQ ID NO: 33794 - protein, 93 aa, Homo sapiens
  ENSP00000450663
MENGYTYEDYKNTAEWLLSHTKHRPQVAIICGSGLGGLTDKLTQAQIFDYGEIPNFPRSTVPGHAGRLVFGFLNGRACVMMQGRFHMYEGYPL

SEQ ID NO: 33795 - protein, 289 aa, Homo sapiens
  ENSP00000354532
MENGYTYEDYKNTAEWLLSHTKHRPQVAIICGSGLGGLTDKLTQAQIFDYGEIPNFPRSTVPGHAGRLVFGFLNGRACVMMQGRFHMYEGYPLWKVTFPVRVFHLLGVDTLVVTNAAGGLNPKFEVGDIMLIRDHINLPGFSGQNPLRGPNDERFGDRFPAMSDAYDRTMRQRALSTWKQMGEQRELQEGTYVMVAGPSFETVAECRVLQKLGADAVGMSTVPEVIVARHCGLRVFGFSLITNKVIMDYESLEKANHEEVLAAGKQAAQKLEQFVSILMASIPLPDKAS

SEQ ID NO: 33796 - protein, 221 aa, Homo sapiens
  ENSP00000452421
MQRGLALSLVSGARRQSHAAASAGRDARGNRAGVAPPEQEGDRYTYEDYKNTAEWLLSHTKHRPQVAIICGSGLGGLTDKLTQAQIFDYGEIPNFPRSTVPGHAGRLVFGFLNGRACVMMQGRFHMYEGYPLWKVTFPVRVFHLLGVDTLVVTNAAGGLNPKFEVGDIMLIRDHINLPGFSGQNPLRGPNDERFGDRFPAMSDAYDRTMRQRALSTWKQMG

SEQ ID NO: 33797 - protein, 61 aa, Homo sapiens
  ENSP00000451108
MMQGRFHMYEGYPLWKVTFPVRVFHLLGVDTLVVTNAAGGLNPKFEVGDIMLIRDHINLPG

SEQ ID NO: 33798 - protein, 481 aa, Homo sapiens
  ENSP00000216180
MYDAERGWSLSFAGCGFLGFYHVGATRCLSEHAPHLLRDARMLFGASAGALHCVGVLSGIPLEQTLQVLSDLVRKARSRNIGIFHPSFNLSKFLRQGLCKCLPANVHQLISGKIGISLTRVSDGENVLVSDFRSKDEVVDALVCSCFIPFYSGLIPPSFRGVRYVDGGVSDNVPFIDAKTTITVSPFYGEYDICPKVKSTNFLHVDITKLSLRLCTGNLYLLSRAFVPPDLKVLGEICLRGYLDAFRFLEEKGICNRPQPGLKSSSEGMDPEVAMPSWANMSLDSSPESAALAVRLEGDELLDHLRLSILPWDESILDTLSPRLATALSEEMKDKGGYMSKICNLLPIRIMSYVMLPCTLPVESAIAIVQRLVTWLPDMPDDVLWLQWVTSQVFTRVLMCLLPASRSQMPVSSQQASPCTPEQDWPCWTPCSPKGCPAETKAEATPRSILRSSLNFFLGNKVPAGAEGLSTFPSFSLEKSL

SEQ ID NO: 33799 - protein, 120 aa, Homo sapiens
  ENSP00000384668
MYDAERGWSLSFAGCGFLGFYHVGATRCLSEHAPHLLRDARMLFGASAGALHCVGVLSGIPLDSAGPLRSCAEGQESEHWHLPSILQLKQVPPTGSLQMPPGQCPPAHLRQNRHLSYQSV

SEQ ID NO: 33800 - protein, 477 aa, Homo sapiens
  ENSP00000397987
MYDAERGWSLSFAGCGFLGFYHVGATRCLSEHAPHLLRDARMLFGASAGALHCVGVLSEQTLQVLSDLVRKARSRNIGIFHPSFNLSKFLRQGLCKCLPANVHQLISGKIGISLTRVSDGENVLVSDFRSKDEVVDALVCSCFIPFYSGLIPPSFRGVRYVDGGVSDNVPFIDAKTTITVSPFYGEYDICPKVKSTNFLHVDITKLSLRLCTGNLYLLSRAFVPPDLKVLGEICLRGYLDAFRFLEEKGICNRPQPGLKSSSEGMDPEVAMPSWANMSLDSSPESAALAVRLEGDELLDHLRLSILPWDESILDTLSPRLATALSEEMKDKGGYMSKICNLLPIRIMSYVMLPCTLPVESAIAIVQRLVTWLPDMPDDVLWLQWVTSQVFTRVLMCLLPASRSQMPVSSQQASPCTPEQDWPCWTPCSPKGCPAETKAEATPRSILRSSLNFFLGNKVPAGAEGLSTFPSFSLEKSL

SEQ ID NO: 33801 - protein, 720 aa, Homo sapiens
  ENSP00000394988
MSINLTVDIYIYLLSNARSVCGKQRSKQLYFLFSPKHYWRISHISLQRGFHTNIIRCKWTKSEAHSCSKHCYSPSNHGLHIGILKLSTSAPKGLTKVNICMSRIKSTLNSVSKAVFGNQNEMISRLAQFKPSSQILRKVSDSGWLKQKNIKQAIKSLKKYSDKSAEKSPFPEEKSHIIDKEEDIGKRSLFHYTSSITTKFGDSFYFLSNHINSYFKRKEKMSQQKENEHFRDKSELEDKKVEEGKLRSPDPGILAYKPGSESVHTVDKPTSPSAIPDVLQVSTKQSIANFLSRPTEGVQALVGGYIGGLVPKLKYDSKSQSEEQEEPAKTDQAVSKDRNAEEKKRLSLQREKIIARVSIDNRTRALVQALRRTTDPKLCITRVEELTFHLLEFPEGKGVAVKERIIPYLLRLRQIKDETLQAAVREILALIGYVDPVKGRGIRILSIDGGGTRGVVALQTLRKLVELTQKPVHQLFDYICGVSTGAILAFMLGLFHMPLDECEELYRKLGSDVFSQNVIVGTVKMSWSHAFYDSQTWENILKDRMGSALMIETARNPTCPKVAADGGLLLNNPSALAMHECKCLWPDVPLECIVSLGTGRYESDVRNTVTYTSLKTKLSNVINSATDTEEVHIMLDGLLPPDTYFRFNPVMCENIPLDESRNEKLDQLQLEGLKYIERNEQKMKKVAKILSQEKTTLQKINDWIKLKTDMYEGLPFFSKL

SEQ ID NO: 33802 - protein, 782 aa, Homo sapiens
  ENSP00000257694
MSINLTVDIYIYLLSNARSVCGKQRSKQLYFLFSPKHYWRISHISLQRGFHTNIIRCKWTKSEAHSCSKHCYSPSNHGLHIGILKLSTSAPKGLTKVNICMSRIKSTLNSVSKAVFGNQNEMISRLAQFKPSSQILRKVSDSGWLKQKNIKQAIKSLKKYSDKSAEKSPFPEEKSHIIDKEEDIGKRSLFHYTSSITTKFGDSFYFLSNHINSYFKRKEKMSQQKENEHFRDKSELEDKKVEEGKLRSPDPGILAYKPGSESVHTVDKPTSPSAIPDVLQVSTKQSIANFLSRPTEGVQALVGGYIGGLVPKLKYDSKSQSEEQEEPAKTDQAVSKDRNAEEKKRLSLQREKIIARVSIDNRTRALVQALRRTTDPKLCITRVEELTFHLLEFPEGKGVAVKERIIPYLLRLRQIKDETLQAAVREILALIGYVDPVKGRGIRILSIDGGGTRGVVALQTLRKLVELTQKPVHQLFDYICGVSTGAILAFMLGLFHMPLDECEELYRKLGSDVFSQNVIVGTVKMSWSHAFYDSQTWENILKDRMGSALMIETARNPTCPKVAAVSTIVNRGITPKAFVFRNYGHFPGINSHYLGGCQYKMWQAIRASSAAPGYFAEYALGNDLHQDGGLLLNNPSALAMHECKCLWPDVPLECIVSLGTGRYESDVRNTVTYTSLKTKLSNVINSATDTEEVHIMLDGLLPPDTYFRFNPVMCENIPLDESRNEKLDQLQLEGLKYIERNEQKMKKVAKILSQEKTTLQKINDWIKLKTDMYEGLPFFSKL

SEQ ID NO: 33803 - protein, 782 aa, Homo sapiens; identical to SEQ ID NO: 33802
  ENSP00000410804

SEQ ID NO: 33804 - protein, 682 aa, Homo sapiens
  ENSP00000387789
MSRIKSTLNSVSKAVFGNQNEMISRLAQFKPSSQILRKVSDSGWLKQKNIKQAIKSLKKYSDKSAEKSPFPEEKSHIIDKEEDIGKRSLFHYTSSITTKFGDSFYFLSNHINSYFKRKEKMSQQKENEHFRDKSELEDKKVEEGKLRSPDPGILAYKPGSESVHTVDKPTSPSAIPDVLQVSTKQSIANFLSRPTEGVQALVGGYIGGLVPKLKYDSKSQSEEQEEPAKTDQAVSKDRNAEEKKRLSLQREKIIARVSIDNRTRALVQALRRTTDPKLCITRVEELTFHLLEFPEGKGVAVKERIIPYLLRLRQIKDETLQAAVREILALIGYVDPVKGRGIRILSIDGGGTRGVVALQTLRKLVELTQKPVHQLFDYICGVSTGAILAFMLGLFHMPLDECEELYRKLGSDVFSQNVIVGTVKMSWSHAFYDSQTWENILKDRMGSALMIETARNPTCPKVAAVSTIVNRGITPKAFVFRNYGHFPGINSHYLGGCQYKMWQAIRASSAAPGYFAEYALGNDLHQDGGLLLNNPSALAMHECKCLWPDVPLECIVSLGTGRYESDVRNTVTYTSLKTKLSNVINSATDTEEVHIMLDGLLPPDTYFRFNPVMCENIPLDESRNEKLDQLQLEGLKYIERNEQKMKKVAKILSQEKTTLQKINDWIKLKTDMYEGLPFFSKL

SEQ ID NO: 33805 - protein, 782 aa, Homo sapiens; identical to SEQ ID NO: 33802
  ENSP00000406779

SEQ ID NO: 33806 - protein, 639 aa, Homo sapiens
  ENSP00000402274
MSRIKSTLNSVSKAVFGNQNEMISRLAQFKPSSQILRKVSDSGWLKQKNIKQAIKSLKKYSDKSAEKSPFPEEKSHIIDKEEDIGKRSLFHYTSSITTKFGDSFYFLSNHINSYFKRKEKMSQQKENEHFRDKSELEDKKVEEGKLRSPDPGILAYKPGSESVHTVDKPTSPSAIPDVLQVSTKQSIANFLSRPTEGVQALVGGYIGGLVPKLKYDSKSQSEEQEEPAKTDQAVSKDRNAEEKKRLSLQREKIIARVSIDNRTRALVQALRRTTDPKLCITRVEELTFHLLEFPEGKGVAVKERIIPYLLRLRQIKDETLQAAVREILALIGYVDPVKGRGIRILSIDGGGTRGVVALQTLRKLVELTQKPVHQLFDYICGVSTGAILAFMLGLFHMPLDECEELYRKLGSDVFSQNVIVGTVKMSWSHAFYDSQTWENILKDRMGSALMIETARNPTCPKVAAVSTIVNRGITPKAFVFRNYGHFPGINSHYLGGCQYKMWQAIRASSAAPGYFAEYALGNDLHQDGGLLLNNPSALAMHECKCLWPDVPLECIVSLGTGRYESDVRNTVTYTSLKTKLSNVINSATDTEEVHIMLDGLLPPDTYFRFNPVMCENIPLDESRNEKLDQLQLEGLKYIE

SEQ ID NO: 33807 - protein, 192 aa, Homo sapiens
  ENSP00000406033
MSINLTVDIYIYLLSNARSVCGKQRSKQLYFLFSPKHYWRISHISLQRGFHTNIIRCKWTKSEAHSCSKHCYSPSNHGLHIGILKLSTSAPKGLTKVNICMSRIKSTLNSVSKAVFGNQNEMISRLAQFKPSSQILRKVSDSGWLKQKNIKQAIKSLKKYSDKSAEKSPFPEEKSHIIDKEEDIGKRSLFHY

SEQ ID NO: 33808 - protein, 55 aa, Homo sapiens
  ENSP00000391872
MSINLTVDIYIYLLSNARSVCGKQRSKQLYFLFSPKHYWRISHISLQRGFHTNII

SEQ ID NO: 33809 - protein, 566 aa, Homo sapiens
  ENSP00000461879
MHGGGPPSGDSACPLRTIKRVQFGVLSPDELKRMSVTEGGIKYPETTEGGRPKLGGLMDPRQGVIERTGRCQTCAGNMTECPGHFGHIELAKPVFHVGFLVKTMKVLRCVCFFCSKLLVDSNNPKIKDILAKSKGQPKKRLTHVYDLCKGKNICEGGEEMDNKFGVEQPEGDEDLTKEKGHGGCGRYQPRIRRSGLELYAEWKHVNEDSQEKKILLSPERVHEIFKRISDEECFVLGMEPRYARPEWMIVTVLPVPPLSVRPAVVMQGSARNQDDLTHKLADIVKINNQLRRNEQNGAAAHVIAEDVKLLQFHVATMVDNELPGLPRAMQKSGRPLKSLKQRLKGKEGRVRGNLMGKRVDFSARTVITPDPNLSIDQVGVPRSIAANMTFAEIVTPFNIDRLQELVRRGNSQYPGAKYIIRDNGDRIDLRFHPKPSDLHLQTGYKVERHMCDGDIVIFNRQPTLHKMSMMGHRVRILPWSTFRLNLSVTTPYNADFDGDEMNLHLPQSLETRAEIQELAMVPRMIVTPQSNRPVMGIVQDTLTAVRKFTKRDVFLERVCGPNGNLA

SEQ ID NO: 33810 - protein, 128 aa, Homo sapiens
  ENSP00000419082
MNAPPAFESFLLFEGEKQLLKDPQVLFAGYKVPHPLEHKIIIRVQTTPDYSPQEAFTNAITDLISELSLLEERFRVRAGPGGADGVGWTLARVPRPGTALACFFGGPQGEAAVMEEQGLPPQAPGHVD

SEQ ID NO: 33811 - protein, 158 aa, Homo sapiens
  ENSP00000419145
MNAPPAFESFLLFEGEKITINKDTKVPNACLFTINKEDHTLGNIIKSQLLKDPQVLFAGYKVPHPLEHKIIIRVQTTPDYSPQEAFTNAITDLISELSLLEERFRVRAGPGGADGVGWTLARVPRPGTALACFFGGPQGEAAVMEEQGLPPQAPGHVD

SEQ ID NO: 33812 - protein, 115 aa, Homo sapiens
  ENSP00000368645
MNAPPAFESFLLFEGEKITINKDTKVPNACLFTINKEDHTLGNIIKSQLLKDPQVLFAGYKVPHPLEHKIIIRVQTTPDYSPQEAFTNAITDLISELSLLEERFRTCLLPLRLLP

SEQ ID NO: 33813 - protein, 116 aa, Homo sapiens
  ENSP00000419146
MNAPPAFESFLLFEGEKITINKDTKVPNACLFTINKEDHTLGNIIKSRACFPFAFCRDCQFPEASPATLPVQPAELCPRAHQLCAPALKRHLGGEAHPVHLHAGAASRPVQQPQHL

SEQ ID NO: 33814 - protein, 115 aa, Homo sapiens; identical to SEQ ID NO: 33812
  ENSP00000425877

SEQ ID NO: 33815 - protein, 274 aa, Homo sapiens
  ENSP00000421085
MNAPPAFESFLLFEGEKITINKDTKVPNACLFTINKEDHTLGNIIKSRACFPFAFCRDCQFPEASPATLPVQPAELLAWKSPCATGKDINKHQEVSKSTRSHRHHVDIHLPVFPGKILLNCAALAKRAAPEHISYVPQLSNDTLAGRLTLSTFTLEQPLGQFSSHNISDLDTIWLVVALSNATQSFTAPRTNQDIPAPANFSQRGYYLTLRANRVLYQTRGQLHVLRVGNDTHCQPTKIGCNHPLPGPGPYRVKFLVMNDEGPVAETKWSSDTR

SEQ ID NO: 33816 - protein, 76 aa, Homo sapiens
  ENSP00000426619
MNAPPAFESFLLFEGEKITINKDTKVPNACLFTINKEDHTLGNIIKSRACFPFAFCRDCQFPEASPATLPVQPAEL

SEQ ID NO: 33817 - protein, 115 aa, Homo sapiens; identical to SEQ ID NO: 33812
  ENSP00000477228

SEQ ID NO: 33818 - protein, 76 aa, Homo sapiens; identical to SEQ ID NO: 33816
  ENSP00000422109

SEQ ID NO: 33819 - protein, 115 aa, Homo sapiens; identical to SEQ ID NO: 33812
  ENSP00000483328

SEQ ID NO: 33820 - protein, 73 aa, Homo sapiens
  ENSP00000421950
MNAPPAFESFLLFEGEKITINKDTKVPNACLFTINKEDHTLGNIIKSLECNGTILLTATSASRVQVILLLQPS

SEQ ID NO: 33821 - protein, 158 aa, Homo sapiens; identical to SEQ ID NO: 33811
  ENSP00000482932

SEQ ID NO: 33822 - protein, 219 aa, Homo sapiens
  ENSP00000414515
MGRLVAVGLLGIALALLGERLLALRNRLKASREVESVDLPHCHLIKGIEAGSEDIDILPNGLAFFSVGLKFPGLHSFAPDKPGGILMMDLKEEKPRARELRISRGFDLASFNPHGISTFIDNDDTVYLFVVNHPEFKNTVEIFKFEEAENSLLHLKTVKHELLPSVNDITAVGPAHFYATNDHYFSDPFLKYLETYLNLHWANVVYYSPNEVKVVYLCC

SEQ ID NO: 33823 - protein, 342 aa, Homo sapiens
  ENSP00000404622
MGRLVAVGLLGIALALLGERLLALRNRLKASREVESVDLPHCHLIKGIEAGSEDIDILPNGLAFFSVGLKFPGLHSFAPDKPGGILMMDLKEEKPRARELRISRGFDLASFNPHGISTFIDNEFKNTVEIFKFEEAENSLLHLKTVKHELLPSVNDITAVGPAHFYATNDHYFSDPFLKYLETYLNLHWANVVYYSPNEVKVVAEGFDSANGINISPDDKYIYVADILAHEIHVLEKHTNMNLTQLKVLELDTLVDNLSIDPSSGDIWVGCHPNGQKLFVYDPNNPPSSEVLRIQNILSEKPTVTTVYANNGSVLQGSSVASVYDGKLLIGTLYHRALYCEL

SEQ ID NO: 33824 - protein, 354 aa, Homo sapiens
  ENSP00000222572
MGRLVAVGLLGIALALLGERLLALRNRLKASREVESVDLPHCHLIKGIEAGSEDIDILPNGLAFFSVGLKFPGLHSFAPDKPGGILMMDLKEEKPRARELRISRGFDLASFNPHGISTFIDNDDTVYLFVVNHPEFKNTVEIFKFEEAENSLLHLKTVKHELLPSVNDITAVGPAHFYATNDHYFSDPFLKYLETYLNLHWANVVYYSPNEVKVVAEGFDSANGINISPDDKYIYVADILAHEIHVLEKHTNMNLTQLKVLELDTLVDNLSIDPSSGDIWVGCHPNGQKLFVYDPNNPPSSEVLRIQNILSEKPTVTTVYANNGSVLQGSSVASVYDGKLLIGTLYHRALYCEL

SEQ ID NO: 33825 - protein, 375 aa, Homo sapiens
  ENSP00000488378
MAPPTELLARPERGSAPGSRAMGRLVAVGLLGIALALLGERLLALRNRLKASREVESVDLPHCHLIKGIEAGSEDIDILPNGLAFFSVGLKFPGLHSFAPDKPGGILMMDLKEEKPRARELRISRGFDLASFNPHGISTFIDNDDTVYLFVVNHPEFKNTVEIFKFEEAENSLLHLKTVKHELLPSVNDITAVGPAHFYATNDHYFSDPFLKYLETYLNLHWANVVYYSPNEVKVVAEGFDSANGINISPDDKYIYVADILAHEIHVLEKHTNMNLTQLKVLELDTLVDNLSIDPSSGDIWVGCHPNGQKLFVYDPNNPPSSEVLRIQNILSEKPTVTTVYANNGSVLQGSSVASVYDGKLLIGTLYHRALYCEL

SEQ ID NO: 33826 - protein, 122 aa, Homo sapiens
  ENSP00000488874
  MOD_RES (1)..(1): Any amino acid
XENSLLHLKTVKHELLPSVNDITAVGPAHFYATNDHYFSDPFLKYLETYLNLHWANVVYYSPNEVKVVAEGFDSANGINISPDDKYIYVADILAHEIHVLEKHTNMNLTQLKILTISHLEGT

SEQ ID NO: 33827 - protein, 50 aa, Homo sapiens
  ENSP00000405211
MGRLVAVGLLGIALALLGERLLALRNRLKASREVESVDLPHCHLIKGIVW

SEQ ID NO: 33828 - protein, 113 aa, Homo sapiens
  ENSP00000488550
MMDLKEEKPRARELRISRGFDLASFNPHGISTFIDNDDTVYLFVVNHPEFKNTVEIFKFEEAENSLLHLKTVKHELLPSVNDITAVGPAHFYATNDHYFSDPFLKYLETYLNL

SEQ ID NO: 33829 - protein, 84 aa, Homo sapiens
  ENSP00000488462
MGRLVAVGLLGIALALLGERLLALRNRLKASREVESVDLPHCHLIKGIEAGSEDIDILPNGLAFFSVVSVFFLPQIQQRRYKGI

SEQ ID NO: 33830 - protein, 69 aa, Homo sapiens
  ENSP00000488826
MMDLKEEKPRARELRISRGFDLASFNPHGISTFIDNDDTVYLFVVNHPEFKNTVEIFKFEEAENSLLHL

SEQ ID NO: 33831 - protein, 84 aa, Homo sapiens; identical to SEQ ID NO: 33829
  ENSP00000487898

SEQ ID NO: 33832 - protein, 53 aa, Homo sapiens
  ENSP00000488822
MMDLKEEKPRARELRISRGFDLASFNPHGISTFIDNDDTVYLFVVNHPEFKNT

SEQ ID NO: 33833 - protein, 32 aa, Homo sapiens
  ENSP00000487703
MMDLKEEKPRARELRISRGFDLASFNPHGIST

SEQ ID NO: 33834 - protein, 354 aa, Homo sapiens; identical to SEQ ID NO: 33824
  ENSP00000488838

SEQ ID NO: 33835 - protein, 140 aa, Homo sapiens
  ENSP00000395813
MINMGDSHVDTSSTVSEAVAEEVSLFSMTDMILFSLIVGLLTYWFLFRKKKEEVPEFTKIQTLTSSVRESSFVEKMKKTGRNIIVFYGSQTGTAEEFANRLSKDAHRYGMRGMSADPEEYDLADLSSLPEIDNALVVFCM

SEQ ID NO: 33836 - protein, 188 aa, Homo sapiens
  ENSP00000390540
MINMGDSHVDTSSTVSEAVAEEVSLFSMTDMILFSLIVGLLTYWFLFRKKKEEVPEFTKIQTLTSSVRESSFVEKMKKTGRNIIVFYGSQTGTAEEFANRLSKDAHRYGMRGMSADPEEYDLADLSSLPEIDNALVVFCMATYGEGDPTDNAQDFYDWLQETDVDLSGVKFAVFGLGNKTYEHFNAMG

SEQ ID NO: 33837 - protein, 680 aa, Homo sapiens
  ENSP00000419970
MINMGDSHVDTSSTVSEAVAEEVSLFSMTDMILFSLIVGLLTYWFLFRKKKEEVPEFTKIQTLTSSVRESSFVEKMKKTGRNIIVFYGSQTGTAEEFANRLSKDAHRYGMRGMSADPEEYDLADLSSLPEIDNALVVFCMATYGEGDPTDNAQDFYDWLQETDVDLSGVKFAVFGLGNKTYEHFNAMGKYVDKRLEQLGAQRIFELGLGDDDGNLEEDFITWREQFWPAVCEHFGVEATGEESSIRQYELVVHTDIDAAKVYMGEMGRLKSYENQKPPFDAKNPFLAAVTTNRKLNQGTERHLMHLELDISDSKIRYESGDHVAVYPANDSALVNQLGKILGADLDVVMSLNNLDEESNKKHPFPCPTSYRTALTYYLDITNPPRTNVLYELAQYASEPSEQELLRKMASSSGEGKELYLSWVVEARRHILAILQDCPSLRPPIDHLCELLPRLQARYYSIASSSKVHPNSVHICAVVVEYETKAGRINKGVATNWLRAKEPAGENGGRALVPMFVRKSQFRLPFKATTPVIMVGPGTGVAPFIGFIQERAWLRQQGKEVGETLLYYGCRRSDEDYLYREELAQFHRDGALTQLNVAFSREQSHKVYVQHLLKQDREHLWKLIEGGAHIYVCGDARNMARDVQNTFYDIVAELGAMEHAQAVDYIKKLMTKGRYSLDVWS

SEQ ID NO: 33838 - protein, 101 aa, Homo sapiens
  ENSP00000399409
MINMGDSHVDTSSTVSEAVAEEVSLFSMTDMILFSLIVGLLTYWFLFRKKKEEVPEFTKIQTLTSSVRESSFVEKMKKTVSFLHVFTLLRKPRPRWACNQV

SEQ ID NO: 33839 - protein, 39 aa, Homo sapiens
  ENSP00000409881
MINMGDSHVDTSSTVSEAVAEEVSLFSMTDMILFSLIVG

SEQ ID NO: 33840 - protein, 633 aa, Homo sapiens
  ENSP00000378355
MINMGDSHVDTSSTVSEAVAEEVSLFSMTDMILFSLIVGLLTYWFLFRKKKEEVPEFTKIQTLTSSVRESSFVEKMKKTGRNIIVFYGSQTGTAEEFANRLSKDAHRYGMRGMSADPEEYDLADLSSLPEIDNALVVFCMATYGEGDPTDNAQDFYDWLQETDVDLSGVKFAVFGLGNKTYEHFNAMGKYVDKRLEQLGAQRIFELGLGDDDGNLEEDFITWREQFWPAVCEHFGVEATGEESSIRQYELVVHTDIDAAKVYMGEMGRLKSYENQKPPFDAKNPFLAAVTTNRKLNQGTERHLMHLELDISDSKIRYESGDHVAVYPANDSALVNQLGKILGADLDVVMSLNNLDEESNKKHPFPCPTSYRTALTYYLDITNPPRTNVLYELAQYASEPSEQELLRKMASSSGEGKELYLSWVVEARRHILAILQDCPSLRPPIDHLCELLPRLQARYYSIASSSKVHPNSVHICAVVVEYETKAGRINKGVATNWLRAKEPAGENGGRALVPMFVRKSQFRLPFKATTPVIMVGPGTGVAPFIGFIQERAWLRQQGKEVGETLLYYGCRRSDEDYLYREELAQFHRDGALTQLNVAFSREQSHKVYVQHLLKQDREHLWKLIEGGAHIYVCG

SEQ ID NO: 33841 - protein, 146 aa, Homo sapiens
  ENSP00000409238
MINMGDSHVDTSSTVSEAVAEEVSLFSMTDMILFSLIVGLLTYWFLFRKKKEEVPEFTKIQTLTSSVRESSFVEKMKKTGRNIIVFYGSQTGTAEEFANRLSKDAHRYGMRGMSADPEEYDLADLSSLPEIDNALVVFCMATYGEG

SEQ ID NO: 33842 - protein, 172 aa, Homo sapiens
  ENSP00000399327
MINMGDSHVDTSSTVSEAVAEEVSLFSMTDMILFSLIVGLLTYWFLFRKKKEEVPEFTKIQTLTSSVRESSFVEKMKKTGRNIIVFYGSQTGTAEEFANRLSKDAHRYGMRGMSADPEEYDLADLSSLPEIDNALVVFCMATYGEGDPTDNAQDFYDWLQETDVDLSGVKFA

SEQ ID NO: 33843 - protein, 166 aa, Homo sapiens
  ENSP00000389409
MINMGDSHVDTSSTVSEAVAEEVSLFSMTDMILFSLIVGLLTYWFLFRKKKEEVPEFTKIQTLTSSVRESSFVEKMKKTGRNIIVFYGSQTGTAEEFANRLSKDAHRYGMRGMSADPEEYDLADLSSLPEIDNALVVFCMATYGEGDPTDNAQDFYDWLQETDVDL

SEQ ID NO: 33844 - protein, 62 aa, Homo sapiens
  ENSP00000399556
MINMGDSHVDTSSTVSEAVAEEVSLFSMTDMILFSLIVGLLTYWFLFRKKKEEVPEFTKIQT

SEQ ID NO: 33845 - protein, 62 aa, Homo sapiens; identical to SEQ ID NO: 33844
  ENSP00000389719

SEQ ID NO: 33846 - protein, 211 aa, Homo sapiens
  ENSP00000404731
MINMGDSHVDTSSTVSEAVAEEVSLFSMTDMILFSLIVGLLTYWFLFRKKKEEVPEFTKIQTLTSSVRESSFVEKMKKTGRNIIVFYGSQTGTAEEFANRLSKDAHRYGMRGMSADPEEYDLADLSSLPEIDNALVVFCMATYGEGDPTDNAQDFYDWLQETDVDLSGVKFAVFGLGNKTYEHFNAMGKCGQGVHGGDGPAEELREPEAPL

SEQ ID NO: 33847 - protein, 189 aa, Homo sapiens
  ENSP00000414263
MINMGDSHVDTSSTVSEAVAEEVSLFSMTDMILFSLIVGLLTYWFLFRKKKEEVPEFTKIQTLTSSVRESSFVEKMKKTGRNIIVFYGSQTGTAEEFANRLSKDAHRYGMRGMSADPEEYDLADLSSLPEIDNALVVFCMATYGEGDPTDNAQDFYDWLQETDVDLSGVKFALGGGLHHLARAVLAGRV

SEQ ID NO: 33848 - protein, 725 aa, Homo sapiens
  ENSP00000393527
  MOD_RES (1)..(1): Any amino acid
XTDMILFSLIVGLLTYWFLFRKKKEEVPEFTKIQTLTSSVRESSFVEKMKKTGRNIIVFYGSQTGTAEEFANRLSKDAHRYGMRGMSADPEEYDLADLSSLPEIDNALVVFCMATYGEGDPTDNAQDFYDWLQETDVDLSGVKFAVSHPETAMGSRWPAVPPWGLQIHVSERQPSRPPPCPQQPGQATCETLSSAPDPSTTRMSPPCPQPQSAPGGIGCWRLKVFGLGNKTYEHFNAMGKYVDKRLEQLGAQRIFELGLGDDDGNLEEDFITWREQFWPAVCEHFGVEATGEESSIRQYELVVHTDIDAAKVYMGEMGRLKSYENQKPPFDAKNPFLAAVTTNRKLNQGTERHLMHLELDISDSKIRYESGDHVAVYPANDSALVNQLGKILGADLDVVMSLNNLDEESNKKHPFPCPTSYRTALTYYLDITNPPRTNVLYELAQYASEPSEQELLRKMASSSGEGKELYLSWVVEARRHILAILQDCPSLRPPIDHLCELLPRLQARYYSIASSSKVHPNSVHICAVVVEYETKAGRINKGVATNWLRAKEPAGENGGRALVPMFVRKSQFRLPFKATTPVIMVGPGTGVAPFIGFIQERAWLRQQGKEVGETLLYYGCRRSDEDYLYREELAQFHRDGALTQLNVAFSREQSHKVYVQHLLKQDREHLWKLIEGGAHIYVCGTPSSCPGMHGTWPGMCRTPSTTSWLSSGPWSTRRRWTTSRN

SEQ ID NO: 33849 - protein, 108 aa, Homo sapiens
  ENSP00000400964
MGCTYSSPPEEPALRRTSSVRESSFVEKMKKTGRNIIVFYGSQTGTAEEFANRLSKDAHRYGMRGMSADPEEYDLADLSSLPEIDNALVVFCMATYGEGDPTDNAQDF

SEQ ID NO: 33850 - protein, 54 aa, Homo sapiens
  ENSP00000403494
MRLPGVNSKDLLCQREQLCGKDEENGEEHHRVLRLPDGDCRGVCQPPVQGRPPL

SEQ ID NO: 33851 - protein, 418 aa, Homo sapiens
  ENSP00000412490
MGEMGRLKSYENQKPPFDAKNPFLAAVTTNRKLNQGTERHLMHLELDISDSKIRYESGDHVAVYPANDSALVNQLGKILGADLDVVMSLNNLDEESNKKHPFPCPTSYRTALTYYLDITNPPRTNVLYELAQYASEPSEQELLRKMASSSGEGKELYLSWVVEARRHILAILQDCPSLRPPIDHLCELLPRLQARYYSIASSSKVHPNSVHICAVVVEYETKAGRINKGVATNWLRAKEPAGENGGRALVPMFVRKSQFRLPFKATTPVIMVGPGTGVAPFIGFIQERAWLRQQGKEVGETLLYYGCRRSDEDYLYREELAQFHRDGALTQLNVAFSREQSHKVYVQHLLKQDREHLWKLIEGGAHIYVCGDARNMARDVQNTFYDIVAELGAMEHAQAVDYIKKLMTKGRYSLDVWS

SEQ ID NO: 33852 - protein, 443 aa, Homo sapiens
  ENSP00000329170
MATAASNHYSLLTSSASIVHAEPPGGMQQGAGGYREAQSLVQGDYGALQSNGHPLSHAHQWITALSHGGGGGGGGGGGGGGGGGGGGGDGSPWSTSPLGQPDIKPSVVVQQGGRGDELHGPGALQQQHQQQQQQQQQQQQQQQQQQQQQRPPHLVHHAANHHPGPGAWRSAAAAAHLPPSMGASNGGLLYSQPSFTVNGMLGAGGQPAGLHHHGLRDAHDEPHHADHHPHPHSHPHQQPPPPPPPQGPPGHPGAHHDPHSDEDTPTSDDLEQFAKQFKQRRIKLGFTQADVGLALGTLYGNVFSQTTICRFEALQLSFKNMCKLKPLLNKWLEEADSSSGSPTSIDKIAAQGRKRKKRTSIEVSVKGALESHFLKCPKPSAQEITSLADSLQLEKEVVRVWFCNRRQKEKRMTPPGGTLPGAEDVYGGSRDTPPHHGVQTPVQ

SEQ ID NO: 33853 - protein, 477 aa, Homo sapiens
  ENSP00000380205
MTMVDTEMPFWPTNFGISSVDLSVMEDHSHSFDIKPFTTVDFSSISTPHYEDIPFTRTDPVVADYKYDLKLQEYQSAIKVEPASPPYYSEKTQLYNKPHEEPSNSLMAIECRVCGDKASGFHYGVHACEGCKGFFRRTIRLKLIYDRCDLNCRIHKKSRNKCQYCRFQKCLAVGMSHNAIRFGRMPQAEKEKLLAEISSDIDQLNPESADLRALAKHLYDSYIKSFPLTKAKARAILTGKTTDKSPFVIYDMNSLMMGEDKIKFKHITPLQEQSKEVAIRIFQGCQFRSVEAVQEITEYAKSIPGFVNLDLNDQVTLLKYGVHEIIYTMLASLMNKDGVLISEGQGFMTREFLKSLRKPFGDFMEPKFEFAVKFNALELDDSDLAIFIAVIILSGDRPGLLNVKPIEDIQDNLLQALELQLKLNHPESSQLFAKLLQKMTDLRQIVTEHVQLLQVIKKTETDMSLHPLLQEIYKDLY

SEQ ID NO: 33854 - protein, 132 aa, Homo sapiens
  ENSP00000380224
MTMVDTEMPFWPTNFGISSVDLSVMEDHSHSFDIKPFTTVDFSSISTPHYEDIPFTRTDPVVADYKYDLKLQEYQSAIKVEPASPPYYSEKTQLYNKPHEEPSNSLMAIECRVCGDKASGFHYGVHACEGCK

SEQ ID NO: 33855 - protein, 477 aa, Homo sapiens; identical to SEQ ID NO: 33853
  ENSP00000312472

SEQ ID NO: 33856 - protein, 477 aa, Homo sapiens; identical to SEQ ID NO: 33853
  ENSP00000380210

SEQ ID NO: 33857 - protein, 43 aa, Homo sapiens
  ENSP00000411931
MTMVDTEMPFWPTNFGISSVDLSVMEDHSHSFDIKPFTTVDFS

SEQ ID NO: 33858 - protein, 477 aa, Homo sapiens; identical to SEQ ID NO: 33853
  ENSP00000380207

SEQ ID NO: 33859 - protein, 483 aa, Homo sapiens
  ENSP00000380221
MKGFSEMTMVDTEMPFWPTNFGISSVDLSVMEDHSHSFDIKPFTTVDFSSISTPHYEDIPFTRTDPVVADYKYDLKLQEYQSAIKVEPASPPYYSEKTQLYNKPHEEPSNSLMAIECRVCGDKASGFHYGVHACEGCKGFFRRTIRLKLIYDRCDLNCRIHKKSRNKCQYCRFQKCLAVGMSHNAIRFGRMPQAEKEKLLAEISSDIDQLNPESADLRALAKHLYDSYIKSFPLTKAKARAILTGKTTDKSPFVIYDMNSLMMGEDKIKFKHITPLQEQSKEVAIRIFQGCQFRSVEAVQEITEYAKSIPGFVNLDLNDQVTLLKYGVHEIIYTMLASLMNKDGVLISEGQGFMTREFLKSLRKPFGDFMEPKFEFAVKFNALELDDSDLAIFIAVIILSGDRPGLLNVKPIEDIQDNLLQALELQLKLNHPESSQLFAKLLQKMTDLRQIVTEHVQLLQVIKKTETDMSLHPLLQEIYKDLY

SEQ ID NO: 33860 - protein, 99 aa, Homo sapiens
  ENSP00000392285
MTMVDTEMPFWPTNFGISSVDLSVMEDHSHSFDIKPFTTVDFSSISTPHYEDIPFTRTDPVVADYKYDLKLQEYQSAIKVEPASPPYYSEKTQLYNKPH

SEQ ID NO: 33861 - protein, 250 aa, Homo sapiens
  ENSP00000380196
MTMVDTEMPFWPTNFGISSVDLSVMEDHSHSFDIKPFTTVDFSSISTPHYEDIPFTRTDPVVADYKYDLKLQEYQSAIKVEPASPPYYSEKTQLYNKPHEEPSNSLMAIECRVCGDKASGFHYGVHACEGCKGFFRRTIRLKLIYDRCDLNCRIHKKSRNKCQYCRFQKCLAVGMSHNAIRFGRMPQAEKEKLLAEISSDIDQLNPESADLRALAKHLYDSYIKSFPLTKAKARAILTGKTTDKSTAQVC

SEQ ID NO: 33862 - protein, 505 aa, Homo sapiens
  ENSP00000287820
MGETLGDSPIDPESDSFTDTLSANISQEMTMVDTEMPFWPTNFGISSVDLSVMEDHSHSFDIKPFTTVDFSSISTPHYEDIPFTRTDPVVADYKYDLKLQEYQSAIKVEPASPPYYSEKTQLYNKPHEEPSNSLMAIECRVCGDKASGFHYGVHACEGCKGFFRRTIRLKLIYDRCDLNCRIHKKSRNKCQYCRFQKCLAVGMSHNAIRFGRMPQAEKEKLLAEISSDIDQLNPESADLRALAKHLYDSYIKSFPLTKAKARAILTGKTTDKSPFVIYDMNSLMMGEDKIKFKHITPLQEQSKEVAIRIFQGCQFRSVEAVQEITEYAKSIPGFVNLDLNDQVTLLKYGVHEIIYTMLASLMNKDGVLISEGQGFMTREFLKSLRKPFGDFMEPKFEFAVKFNALELDDSDLAIFIAVIILSGDRPGLLNVKPIEDIQDNLLQALELQLKLNHPESSQLFAKLLQKMTDLRQIVTEHVQLLQVIKKTETDMSLHPLLQEIYKDLY

SEQ ID NO: 33863 - protein, 40 aa, Homo sapiens
  ENSP00000380218
MGETLGDSPIDPESDSFTDTLSANISQVFQDDSCLWMSLS

SEQ ID NO: 33864 - protein, 186 aa, Homo sapiens
  ENSP00000380195
MTMVDTEMPFWPTNFGISSVDLSVMEDHSHSFDIKPFTTVDFSSISTPHYEDIPFTRTDPVVADYKYDLKLQEYQSAIKVEPASPPYYSEKTQLYNKPHEEPSNSLMAIECRVCGDKASGFHYGVHACEGCKGFFRRTIRLKLIYDRCDLNCRIHKKSRNKCQYCRFQKCLAVGMSHNEELQKDSY

SEQ ID NO: 33865 - protein, 1186 aa, Homo sapiens
  ENSP00000356209
MCEVMPTINEGDRLGPPHGADADANFEQLMVNMLDEREKLLESLRESQETLAATQSRLQDAIHERDQLQRHLNSALPQEFATLTRELSMCREQLLEREEEISELKAERNNTRLLLEHLECLVSRHERSLRMTVVKRQAQSPSGVSSEVEVLKALKSLFEHHKALDEKVRERLRAALERVTTLEEQLAGAHQQVSALQQGAGVRDGAAEEEGTVELGPKRLWKEDTGRVEELQELLEKQNFELSQARERLVTLTTTVTELEEDLGTARRDLIKSEELSSKHQRDLREALAQKEDMEERITTLEKRYLAAQREATSIHDLNDKLENELANKESLHRQCEEKARHLQELLEVAEQKLQQTMRKAETLPEVEAELAQRIAALTKAEERHGNIEEHLRQLEGQLEEKNQELARVRQREKMNEDHNKRLSDTVDRLLSESNERLQLHLKERMAALEEKGRLSEEIEKLRQEVDQLKGRGGPFVDGVHSRSHMGSAADVRFSLGTTTHAPPGVHRRYSALREESAKDWETSPLPGMLAPAAGPAFDSDPEISDVDEDEPGGLVGSADVVSPSGHSDAQTLAMMLQEQLDAINEEIRMIQEEKESTELRAEEIETRVTSGSMEALNLKQLRKRGSIPTSLTALSLASASPPLSGRSTPKLTSRSAAQDLDRMGVMTLPSDLRKHRRKLLSPVSREENREDKATIKCETSPPSSPRTLRLEKLGHPALSQEEGKSALEDQGSNPSSSNSSQDSLHKGAKRKGIKSSIGRLFGKKEKGRLIQLSRDGATGHVLLTDSEFSMQEPMVPAKLGTQAEKDRRLKKKHQLLEDARRKGMPFAQWDGPTVVSWLELWVGMPAWYVAACRANVKSGAIMSALSDTEIQREIGISNALHRLKLRLAIQEMVSLTSPSAPPTSRTSSGNVWVTHEEMETLETSTKTDSEEGSWAQTLAYGDMNHEWIGNEWLPSLGLPQYRSYFMECLVDARMLDHLTKKDLRVHLKMVDSFHRTSLQYGIMCLKRLNYDRKELEKRREESQHEIKDVLVWTNDQVVHWVQSIGLRDYAGNLHESGVHGALLALDENFDHNTLALILQIPTQNTQARQVMEREFNNLLALGTDRKLDDGDDKVFRRAPSWRKRFRPREHHGRGGMLSASAETLPAGFRVSTLGTLQPPPAPPKKIMPEAHSHYLYGHMLSAFRD

SEQ ID NO: 33866 - protein, 1185 aa, Homo sapiens
  ENSP00000402576
MCEVMPTINEGDRLGPPHGADADANFEQLMVNMLDEREKLLESLRESQETLAATQSRLQDAIHERDQLQRHLNSALPQEFATLTRELSMCREQLLEREEEISELKAERNNTRLLLEHLECLVSRHERSLRMTVVKRQAQSPSGVSSEVEVLKALKSLFEHHKALDEKVRERLRAALERVTTLEEQLAGAHQQVSALQQGAGVRDGAAEEEGTVELGPKRLWKEDTGRVEELQELLEKQNFELSQARERLVTLTTTVTELEEDLGTARRDLIKSEELSSKHQRDLREALAQKEDMEERITTLEKRYLAAQREATSIHDLNDKLENELANKESLHRQCEEKARHLQELLEVAEQKLQQTMRKAETLPEVEAELAQRIAALTKAEERHGNIEEHLRQLEGQLEEKNQELARTAVQVRQREKMNEDHNKRLSDTVDRLLSESNERLQLHLKERMAALEEKNTLIQELESSQRQIEEQHHHKGRLSEEIEKLRQEVDQLKGRGGPFVDGVHSRSHMGSAADVRFSLGTTTHAPPGVHRRYSALREESAKLALPLTVTLRSPTWMRMSQGVCCNLEYHSSGTLCGSSGPLPVPEMIQEEKESTELRAEEIETRVTSGSMEALNLKQLRKRGSIPTSLTALSLASASPPLSGRSTPKLTSRSAAQDLDRMGVMTLPSDLRKHRRKLLSPVSREENREDKATIKCETSPPSSPRTLRLEKLGHPALSQEEGKSALEDQGSNPSSSNSSQDSLHKGAKRKGIKSSIGRLFGKKEKGRLIQLSRDGATGHVLLTDSEFSMQEPMVPAKLGTQAEKDRRLKKKHQLLEDARRKGMPFAQWDGPTVVSWLELWVGMPAWYVAACRANVKSGAIMSALSDTEIQREIGISNALHRLKLRLAIQEMVSLTSPSAPPTSRTSSGNVWVTHEEMETLETSTKTDSEEGSWAQTLAYGDMNHEWIGNEWLPSLGLPQYRSYFMECLVDARMLDHLTKKDLRVHLKMVDSFHRTSLQYGIMCLKRLNYDRKELEKRREESQHEIKDVLVWTNDQVVHWVQSIGLRDYAGNLHESGVHGALLALDENFDHNTLALILQIPTQNTQARQVMEREFNNLLALGTDRKLDDGDDKVFRRAPSWRKRFRPREHHGRGGMLSASAETLPAGFRVSTLGTLQPPPAPPKKIMPEAHSHYLYGHMLSAFRD

SEQ ID NO: 33867 - protein, 953 aa, Homo sapiens
  ENSP00000470427
  MOD_RES (1)..(1): Any amino acid
XVTELEEDLGTARRDLIKSEELSSKHQRDLREALAQKEDMEERITTLEKRYLAAQREATSIHDLNDKLENELANKESLHRQCEEKARHLQELLEVAEQKLQQTMRKAETLPEVEAELAQRIAALTKAEERHGNIEEHLRQLEGQLEEKNQELARVRQREKMNEDHNKRLSDTVDRLLSESNERLQLHLKERMAALEEKNTLIQELESSQRQIEEQHHHKGRLSEEIEKLRQEVDQLKGRGGPFVDGVHSRSHMGSAADVRFSLGTTTHAPPGVHRRYSALREESAKDWETSPLPGMLAPAAGPAFDSDPEISDVDEDEPGGLVGSADVVSPSGHSDAQTLAMMLQEQLDAINEEIRMIQEEKESTELRAEEIETRVTSGSMEALNLKQLRKRGSIPTSLTALSLASASPPLSGRSTPKLTSRSAAQDLDRMGVMTLPSDLRKHRRKLLSPVSREENREDKATIKCETSPPSSPRTLRLEKLGHPALSQEEGKSALEDQGSNPSSSNSSQDSLHKGAKRKGIKSSIGRLFGKKEKGRLIQLSRDGATGHVLLTDSEFSMQEPMVPAKLGTQAEKDRRLKKKHQLLEDARRKGMPFAQWDGPTVVSWLELWVGMPAWYVAACRANVKSGAIMSALSDTEIQREIGISNALHRLKLRLAIQEMVSLTSPSAPPTSRTSSGNVWVTHEEMETLETSTKTDSEEGSWAQTLAYGDMNHEWIGNEWLPSLGLPQYRSYFMECLVDARMLDHLTKKDLRVHLKMVDSFHRTSLQYGIMCLKRLNYDRKELEKRREESQHEIKDVLVWTNDQVVHWVQSIGLRDYAGNLHESGVHGALLALDENFDHNTLALILQIPTQNTQARQVMEREFNNLLALGTDRKLDDGDDKVFRRAPSWRKRFRPREHHGRGGMLSASAETLPAGFRVSTLGTLQPPPAPPKKIMPEAHSHYLYGHMLSAFRD

SEQ ID NO: 33868 - protein, 701 aa, Homo sapiens
  ENSP00000272198
MGSAADVRFSLGTTTHAPPGVHRRYSALREESAKDWETSPLPGMLAPAAGPAFDSDPEISDVDEDEPGGLVGSADVVSPSGHSDAQTLAMMLQEQLDAINEEIRMIQEEKESTELRAEEIETRVTSGSMEALNLKQLRKRGSIPTSLTALSLASASPPLSGRSTPKLTSRSAAQDLDRMGVMTLPSDLRKHRRKLLSPVSREENREDKATIKCETSPPSSPRTLRLEKLGHPALSQEEGKSALEDQGSNPSSSNSSQDSLHKGAKRKGIKSSIGRLFGKKEKGRLIQLSRDGATGHVLLTDSEFSMQEPMVPAKLGTQAEKDRRLKKKHQLLEDARRKGMPFAQWDGPTVVSWLELWVGMPAWYVAACRANVKSGAIMSALSDTEIQREIGISNALHRLKLRLAIQEMVSLTSPSAPPTSRTSSGNVWVTHEEMETLETSTKTDSEEGSWAQTLAYGDMNHEWIGNEWLPSLGLPQYRSYFMECLVDARMLDHLTKKDLRVHLKMVDSFHRTSLQYGIMCLKRLNYDRKELEKRREESQHEIKDVLVWTNDQVVHWVQSIGLRDYAGNLHESGVHGALLALDENFDHNTLALILQIPTQNTQARQVMEREFNNLLALGTDRKLDDGDDKVFRRAPSWRKRFRPREHHGRGGMLSASAETLPAGFRVSTLGTLQPPPAPPKKIMPEAHSHYLYGHMLSAFRD

SEQ ID NO: 33869 - protein, 692 aa, Homo sapiens
  ENSP00000471264
MGSAADVRFSLGTTTHAPPGVHRRYSALREESAKDWETSPLPGMLAPAAGPAFDSDPEISDVDEDEPGGLVGSADVVSPSGHSDAQTLAMMLQEQLDAINEEIRMIQEEKESTELRAEEIETRVTSGSMEALNLKQLRKRGSIPTSLTALSLASASPPLSGRSTPKLTSRSAAQDLDRMGVMTLPSDLRKHRRKLLSPVSREENREDKATIKCETSPPSSPRTLRLEKLGHPALSQEEGKSALEDQGSNPSSSNSSQDSLHKGAKRKGIKSSIGRLFGKKEKGRLIQLSRDGATGHVLLTDSEFSMQEPMVPAKLGTQAEKDRRLKKKHQLLEDARRKGMPFAQWDGPTVVSWLELWVGMPAWYVAACRANVKSGAIMSALSDTEIQREIGISNALHRLKLRLAIQEMVSLTSPSAPPTSRTSSGNVWVTHEEMETLETSTKTTLAYGDMNHEWIGNEWLPSLGLPQYRSYFMECLVDARMLDHLTKKDLRVHLKMVDSFHRTSLQYGIMCLKRLNYDRKELEKRREESQHEIKDVLVWTNDQVVHWVQSIGLRDYAGNLHESGVHGALLALDENFDHNTLALILQIPTQNTQARQVMEREFNNLLALGTDRKLDDGDDKVFRRAPSWRKRFRPREHHGRGGMLSASAETLPAGFRVSTLGTLQPPPAPPKKIMPEAHSHYLYGHMLSAFRD

SEQ ID NO: 33870 - protein, 191 aa, Homo sapiens
  ENSP00000472251
  MOD_RES (1)..(1): Any amino acid
XAKDWETSPLPGMLAPAAGPAFDSDPEISDVDEDEPGGLVGSADVVSPSGHSDAQTLAMMLQEQLDAINEEIRMIQEEKESTELRAEEIETRVTSGSMEALNLKQLRKRGSIPTSLTALSLASASPPLSGRSTPKLTSRSAAQDLDRMGVMTLPSDLRKHRRKLLDAAAREAWPPSPEPGRRQECLGGSGQ

SEQ ID NO: 33871 - protein, 692 aa, Homo sapiens; identical to SEQ ID NO: 33869
  ENSP00000295706

SEQ ID NO: 33872 - protein, 18 aa, Homo sapiens
  ENSP00000442462
MLQQELLSRTSLETQKLD

SEQ ID NO: 33873 - protein, 281 aa, Homo sapiens
  ENSP00000445822
MMSDASDMLAAALEQMDGIIAGSKALEYSNGIFDCQSPTSPFMGSLRALHLVEDLRGLLEMMETDEKEGLRCQIPDSTAETLVEWLQSQMTNGHLPGNGDVYQERLARLENDKESLVLQVSVLTDQVEAQGEKIRDLEFCLEEHREKVNATEEMLQQELLSRTSLETQKLDLMAEISNLKLKLTAVEKDRLDYEDKFRDTEGLIQEINDLRLKVSEMDSERLQYEKKLKSTKDELASLKEQLEEKESEVKRLQEKLVCKMKGEGVEIVDRDENFKKKLKEK

SEQ ID NO: 33874 - protein, 109 aa, Homo sapiens
  ENSP00000438036
MMSDASDMLAAALEQMDGIIAGSKALEYSNGIFDCQSPTSPFMGSLRALHLVEDLRGLLEMMETDEKEGLRCQIPDSTAETLVEWLQSQMVGSACSKFCYKSFVAYSKI

SEQ ID NO: 33875 - protein, 744 aa, Homo sapiens
  ENSP00000444304
MAEISNLKLKLTAVEKDRLDYEDKFRDTEGLIQEINDLRLKVSEMDSERLQYEKKLKSTKSLMAKLSSMKIKVGQMQYEKQRMEQKWESLKDELASLKEQLEEKESEVKRLQEKLVCKMKGEGVEIVDRDIEVQKMKKAVESLMAANEEKDRKIEDLRQCLNRYKKMQDTVVLAQGKKGKDGEYEELLNSSSISSLLDAQGFSDLEKSPSPTPVMGSPSCDPFNTSVPEEFHTTILQVSIPSLLPATVSMETSEKSKLTPKPETSFEENDGNIILGATVDTQLCDKLLTSSLQKSSSLGNLKKETSDGEKETIQKTSEDRAPAESRPFGTLPPRPPGQDTSMDDNPFGTRKVRSSFGRGFFKIKSNKRTASAPNLAETEKETAEHLDLAGASSRPKDSQRNSPFQIPPPSPDSKKKSRGIMKLFGKLRRSQSTTFNPDDMSEPEFKRGGTRATAGPRLGWSRDLGQSNSDLDMPFAKWTKEQVCNWLMEQGLGSYLNSGKHWIASGQTLLQASQQDLEKELGIKHSLHRKKLQLALQALGSEEETNHGKLDFNWVTRWLDDIGLPQYKTQFDEGRVDGRMLHYMTVDDLLSLKVVSVLHHLSIKRAIQVLRINNFEPNCLRRRPSDENTIAPSEVQKWTNHRVMEWLRSVDLAEYAPNLRGSGVHGGLMVLEPRFNVETMAQLLNIPPNKTLLRRHLATHFNLLIGAEAQHQKRDAMELPDYVLLTATAKVKPKKLAFSNFGNL

SEQ ID NO: 33876 - protein, 858 aa, Homo sapiens
  ENSP00000445425
MLQQELLSRTSLETQKLDLMAEISNLKLKLTAVEKDRLDYEDKFRDTEGLIQEINDLRLKVSEMDSERLQYEKKLKSTKSLMAKLSSMKIKVGQMQYEKQRMEQKWESLKDELASLKEQLEEKESEVKRLQEKLVCKMKGEGVEIVDRDIEVQKMKKAVESLMAANEEKDRKIEDLRQCLNRYKKMQDTVVLAQGKDGEYEELLNSSSISSLLDAQGFSDLEKSPSPTPVMGSPSCDPFNTSVPEEFHTTILQVSIPSLLPATVSMETSEKSKLTPKPETSFEENDGNIILGATVDTQLCDKLLTSSLQKSSSLGNLKKETSDGEKETIQKTSEDRAPAESRPFGTLPPRPPGQDTSMDDNPFGTRKVRSSFGRGFFKIKSNKRTASAPNLAETEKETAEHLDLAGASSRPKDSQRNSPFQIPPPSPDSKKKSRGIMKLFGKLRRSQSTTFNPDDMSEPEFKRGGTRATAGPRLGWSRDLGQSNSDLDMPFAKWTKEQVCNWLMEQGLGSYLNSGKHWIASGQTLLQASQQDLEKELGIKHSLHRKKLQLALQALGSEEETNHGKLDFNWVTRWLDDIGLPQYKTQFDEGRVDGRMLHYMTVDDLLSLKVVSVLHHLSIKRAIQVLRINNFEPNCLRRRPSDENTIAPSEVQKWTNHRVMEWLRSVDLAEYAPNLRGSGVHGGLMVLEPRFNVETMAQLLNIPPNKTLLRRHLATHFNLLIGAEAQHQKRDAMELPDYVLLTATAKVKPKKLAFSNFGNLRKKKQEDGEEYVCPMELGQASGSASKKGFKPGLDMRLYEEDDLDRLEQMEDSEGTVRQIGAFSEGINNLTHMLKEDDMFKDFAARSPSASITDEDSNV

SEQ ID NO: 33877 - protein, 1011 aa, Homo sapiens
  ENSP00000314724
MMSDASDMLAAALEQMDGIIAGSKALEYSNGIFDCQSPTSPFMGSLRALHLVEDLRGLLEMMETDEKEGLRCQIPDSTAETLVEWLQSQMTNGHLPGNGDVYQERLARLENDKESLVLQVSVLTDQVEAQGEKIRDLEFCLEEHREKVNATEEMLQQELLSRTSLETQKLDLMAEISNLKLKLTAVEKDRLDYEDKFRDTEGLIQEINDLRLKVSEMDSERLQYEKKLKSTKSLMAKLSSMKIKVGQMQYEKQRMEQKWESLKDELASLKEQLEEKESEVKRLQEKLVCKMKGEGVEIVDRDIEVQKMKKAVESLMAANEEKDRKIEDLRQCLNRYKKMQDTVVLAQGKDGEYEELLNSSSISSLLDAQGFSDLEKSPSPTPVMGSPSCDPFNTSVPEEFHTTILQVSIPSLLPATVSMETSEKSKLTPKPETSFEENDGNIILGATVDTQLCDKLLTSSLQKSSSLGNLKKETSDGEKETIQKTSEDRAPAESRPFGTLPPRPPGQDTSMDDNPFGTRKVRSSFGRGFFKIKSNKRTASAPNLAETEKETAEHLDLAGASSRPKDSQRNSPFQIPPPSPDSKKKSRGIMKLFGKLRRSQSTTFNPDDMSEPEFKRGGTRATAGPRLGWSRDLGQSNSDLDMPFAKWTKEQVCNWLMEQGLGSYLNSGKHWIASGQTLLQASQQDLEKELGIKHSLHRKKLQLALQALGSEEETNHGKLDFNWVTRWLDDIGLPQYKTQFDEGRVDGRMLHYMTVDDLLSLKVVSVLHHLSIKRAIQVLRINNFEPNCLRRRPSDENTIAPSEVQKWTNHRVMEWLRSVDLAEYAPNLRGSGVHGGLMVLEPRFNVETMAQLLNIPPNKTLLRRHLATHFNLLIGAEAQHQKRDAMELPDYVLLTATAKVKPKKLAFSNFGNLRKKKQEDGEEYVCPMELGQASGSASKKGFKPGLDMRLYEEDDLDRLEQMEDSEGTVRQIGAFSEGINNLTHMLKEDDMFKDFAARSPSASITDEDSNV

SEQ ID NO: 33878 - protein, 170 aa, Homo sapiens
  ENSP00000444046
MMSDASDMLAAALEQMDGIIAGSKALEYSNGIFDCQSPTSPFMGSLRALHLVEDLRGLLEMMETDEKEGLRCQIPDSTAETLVEWLQSQMTNGHLPGNGDVYQERLARLENDKESLVLQVSVLTDQVEAQGEKIRDLEFCLEEHREKVNATEEMLQQVCAEARTKMGFPC

SEQ ID NO: 33879 - protein, 980 aa, Homo sapiens
  ENSP00000443442
MMSDASDMLAAALEQMDGIIAGSKALEYSNGIFDCQSPTSPFMGSLRALHLVEDLRGLLEMMETDEKEGLRCQIPDSTAETLVEWLQSQMTNGHLPGNGDVYQERLARLENDKESLVLQVSVLTDQVEAQGEKIRDLEFCLEEHREKVNATEEMLQQELLSRTSLETQKLDLMAEISNLKLKLTAVEKDRLDYEDKFRDTEGLIQEINDLRLKVSEMDSERLQYEKKLKSTKDELASLKEQLEEKESEVKRLQEKLVCKMKGEGVEIVDRDIEVQKMKKAVESLMAANEEKDRKIEDLRQCLNRYKKMQDTVVLAQGKDGEYEELLNSSSISSLLDAQGFSDLEKSPSPTPVMGSPSCDPFNTSVPEEFHTTILQVSIPSLLPATVSMETSEKSKLTPKPETSFEENDGNIILGATVDTQLCDKLLTSSLQKSSSLGNLKKETSDGEKETIQKTSEDRAPAESRPFGTLPPRPPGQDTSMDDNPFGTRKVRSSFGRGFFKIKSNKRTASAPNLAETEKETAEHLDLAGASSRPKDSQRNSPFQIPPPSPDSKKKSRGIMKLFGKLRRSQSTTFNPDDMSEPEFKRGGTRATAGPRLGWSRDLGQSNSDLDMPFAKWTKEQVCNWLMEQGLGSYLNSGKHWIASGQTLLQASQQDLEKELGIKHSLHRKKLQLALQALGSEEETNHGKLDFNWVTRWLDDIGLPQYKTQFDEGRVDGRMLHYMTVDDLLSLKVVSVLHHLSIKRAIQVLRINNFEPNCLRRRPSDENTIAPSEVQKWTNHRVMEWLRSVDLAEYAPNLRGSGVHGGLMVLEPRFNVETMAQLLNIPPNKTLLRRHLATHFNLLIGAEAQHQKRDAMELPDYVLLTATAKVKPKKLAFSNFGNLRKKKQEDGEEYVCPMELGQASGSASKKGFKPGLDMRLYEEDDLDRLEQMEDSEGTVRQIGAFSEGINNLTHMLKEDDMFKDFAARSPSASITDEDSNV

SEQ ID NO: 33880 - protein, 1005 aa, Homo sapiens
  ENSP00000228425
MMSDASDMLAAALEQMDGIIAGSKALEYSNGIFDCQSPTSPFMGSLRALHLVEDLRGLLEMMETDEKEGLRCQIPDSTAETLVEWLQSQMTNGHLPGNGDVYQERLARLENDKESLVLQVSVLTDQVEAQGEKIRDLEFCLEEHREKVNATEEMLQQELLSRTSLETQKLDLMAEISNLKLKLTAVEKDRLDYEDKFRDTEGLIQEINDLRLKVSEMDSERLQYEKKLKSTKDELASLKEQLEEKESEVKRLQEKLVCKMKGEGVEIVDRDENFKKKLKEKNIEVQKMKKAVESLMAANEEKDRKIEDLRQCLNRYKKMQDTVVLAQGKKGKDGEYEELLNSSSISSLLDAQGFSDLEKSPSPTPVMGSPSCDPFNTSVPEEFHTTILQVSIPSLLPATVSMETSEKSKLTPKPETSFEENDGNIILGATVDTQLCDKLLTSSLQKSSSLGNLKKETSDGEKETIQKTSEDRAPAESRPFGTLPPRPPGQDTSMDDNPFGTRKVRSSFGRGFFKIKSNKRTASAPNLDRKRSASAPTLAETEKETAEHLDLAGASSRPKDSQRNSPFQIPPPSPDSKKKSRGIMKLFGKLRRSQSTTFNPDDMSEPEFKRGGTRATAGPRLGWSRDLGQSNSDLDMPFAKWTKEQVCNWLMEQGLGSYLNSGKHWIASGQTLLQASQQDLEKELGIKHSLHRKKLQLALQALGSEEETNHGKLDFNWVTRWLDDIGLPQYKTQFDEGRVDGRMLHYMTVDDLLSLKVVSVLHHLSIKRAIQVLRINNFEPNCLRRRPSDENTIAPSEVQKWTNHRVMEWLRSVDLAEYAPNLRGSGVHGGLMVLEPRFNVETMAQLLNIPPNKTLLRRHLATHFNLLIGAEAQHQKRDAMELPDYVLLTATAKVKPKKLAFSNFGNLRKKKQEDGEEYVCPMELGQASGSASKKGFKPGLDMRLYEEDDLDRLEQMEDSEGTVRQIGAFSEGINNLTHMLKEDDMFKDFAARSPSASITDEDSNV

SEQ ID NO: 33881 - protein, 86 aa, Homo sapiens
  ENSP00000437438
MMSDASDMLAAALEQMDGIIAGSKALEYSNGIFDCQSPTSPFMGSLRALHLVEDLRGLLEMMETDEKEGLRCQIPDSTAETLVEWL

SEQ ID NO: 33882 - protein, 152 aa, Homo sapiens
  ENSP00000445132
MHLGWNLPLTNNKMMSDASDMLAAALEQMDGIIAGSKALEYSNGIFDCQSPTSPFMGSLRALHLVEDLRGLLEMMETDEKEGLRCQIPDSTAETLVEWLQSQMTNGHLPGNGDVYQERLARLENDKESLVLQVSVLTDQVEAQGEKIRDLEF

SEQ ID NO: 33883 - protein, 205 aa, Homo sapiens
  ENSP00000443324
NEEKDRKIEDLRQCLNRYKKMQDTVVLAQGKKGKDGEYEELLNSSSISSLLDAQGFSDLEKSPSPTPVMGSPSCDPFNTSVPEEFHTTILQVSIPSLLPATVSMETSEKSKLTPKPETSFEENDGNIILGATVDTQLCDKLLTSSLQKSSSLGNLKKETSDGDRAPAESRPFGTLPPRPPGQDTSMDDNPFGTRKVRSSFGRGFF

SEQ ID NO: 33884 - protein, 86 aa, Homo sapiens
  ENSP00000479763
DRAPAESRPFGTLPPRPPGQDTSMDDNPFGTRKVRSSFGRGFFKIKSNKRTASAPNLGTYDQNAFALILPQGGKEQCLPFPYSFIH

SEQ ID NO: 33885 - protein, 242 aa, Homo sapiens
  ENSP00000438174
  MOD_RES (1)..(1): Any amino acid
XDIGLPQYKTQFDEGRVDGRMLHYMTVNTIAPSEVQKWTNHRVMEWLRSVDLAEYAPNLRGSGVHGGLMVLEPRFNVETMAQLLNIPPNKTLLRRHLATHFNLLIGAEAQHQKRDAMELPDYVLLTATAKVKPKKLAFSNFGNLRKKKQEDGEEYVCPMELGQASGSASKKGFKPGLDMRLYEEDDLDRLEQMEDSEGTVRQIGAFSEGINNLTHMLKEDDMFKDFAARSPSASITDEDSNV

SEQ ID NO: 33886 - protein, 89 aa, Homo sapiens
  ENSP00000434641
MASDASHALEAALEQMDGIIAGTKTGADLSDGTCEPGLASPASYMNPFPVLHLIEDLRLALEMLELPQERAALLSQIPGPTAAYIKEWF

SEQ ID NO: 33887 - protein, 89 aa, Homo sapiens; identical to SEQ ID NO: 33886
  ENSP00000431724

SEQ ID NO: 33888 - protein, 876 aa, Homo sapiens
  ENSP00000299492
MASDASHALEAALEQMDGIIAGTKTGADLSDGTCEPGLASPASYMNPFPVLHLIEDLRLALEMLELPQERAALLSQIPGPTAAYIKEWFEESLSQVNHHSAASNETYQERLARLEGDKESLILQVSVLTDQVEAQGEKIRDLEVCLEGHQVKLNAAEEMLQQELLSRTSLETQKLDLMTEVSELKLKLVGMEKEQREQEEKQRKAEELLQELRHLKIKVEELENERNQYEWKLKATKAEVAQLQEQVALKDAEIERLHSQLSRTAALHSESHTERDQEIQRLKMGMETLLLANEDKDRRIEELTGLLNQYRKVKEIVMVTQGPSERTLSINEEEPEGGFSKWNATNKDPEELFKQEMPPRCSSPTVGPPPLPQKSLETRAQKKLSCSLEDLRSESVDKCMDGNQPFPVLEPKDSPFLAEHKYPTLPGKLSGATPNGEAAKSPPTICQPDATGSSLLRLRDTESGWDDTAVVNDLSSTSSGTESGPQSPLTPDGKRNPKGIKKFWGKIRRTQSGNFYTDTLGMAEFRRGGLRATAGPRLSRTRDSKGQKSDANAPFAQWSTERVCAWLEDFGLAQYVIFARQWVSSGHTLLTATPQDMEKELGIKHPLHRKKLVLAVKAINTKQEEKSALLDHIWVTRWLDDIGLPQYKDQFHESRVDRRMLQYLTVNDLLFLKVTSQLHHLSIKCAIHVLHVNKFNPHCLHRRPADESNLSPSEVVQWSNHRVMEWLRSVDLAEYAPNLRGSGVHGGLIILEPRFTGDTLAMLLNIPPQKTLLRRHLTTKFNALIGPEAEQEKREKMASPAYTPLTTTAKVRPRKLGFSHFGNIRKKKFDESTDYICPMEPSDGVSDSHRVYSGYRGLSPLDAPELDGLDQVGQIS

SEQ ID NO: 33889 - protein, 170 aa, Homo sapiens
  ENSP00000434981
MASDASHALEAALEQMDGIIAGTKTGADLSDGTCEPGLASPASYMNPFPVLHLIEDLRLALEMLELPQERAALLSQIPGPTAAYIKEWFEESLSQVNHHSAASNETYQERLARLEGDKESLILQVSVLTDQVEAQGEKIRDLEVCLEGHQVKLNAAEEMLQQELLSRTSL

SEQ ID NO: 33890 - protein, 70 aa, Homo sapiens
  ENSP00000433026
MASDASHALEAALEQMDGIIAGTKTGADLSDGTCEPGLASPASYMNPFPVLHLIEDLRLALEMLELPQER

SEQ ID NO: 33891 - protein, 136 aa, Homo sapiens
  ENSP00000433917
  MOD_RES (1)..(1): Any amino acid
XPFPVLHLIEDLRLALEMLELPQERAALLSQIPGPTAAYIKEWFEESLSQVNHHSAASNETYQERLARLEGDKESLILQVSVLTDQVEAQGEKIRDLEVCLEGHQVKLNAAEEMLQQICNLVLRFCMLNIIFFPFK

SEQ ID NO: 33892 - protein, 155 aa, Homo sapiens
  ENSP00000435794
MLQQELLSRTSLETQKLDLMTEVSELKLKLVGMEKEQREQEEKQRKAEELLQELRHLKIKVEELENERNQYEWKLKATKAEVAQLQEQVALKDAEIERLHSQLSRTAALHSESHTERDQEIQRLKMGMETLLLANEDKDRRIEELTGLLNQYRKV

SEQ ID NO: 33893 - protein, 718 aa, Homo sapiens
  ENSP00000436498
MLQQELLSRTSLETQKLDLMTEVSELKLKLVGMEKEQREQEEKQRKAEELLQELRHLKIKVEELENERNQYEWKLKATKAEVAQLQEQVALKDAEIERLHSQLSRTAALHSESHTERDQEIQRLKMGMETLLLANEDKDRRIEELTGLLNQYRKVKEIVMVTQGPSERTLSINEEEPEGGFSKWNATNKDPEELFKQEMPPRCSSPTVGPPPLPQKSLETRAQKKLSCSLEDLRSESVDKCMDGNQPFPVLEPKDSPFLAEHKYPTLPGKLSGATPNGEAAKSPPTICQPDATGSSLLRLRDTESGWDDTAVVNDLSSTSSGTESGPQSPLTPDGKRNPKGIKKFWGKIRRTQSGNFYTDTLGMAEFRRGGLRATAGPRLSRTRDSKGQKSDANAPFAQWSTERVCAWLEDFGLAQYVIFARQWVSSGHTLLTATPQDMEKELGIKHPLHRKKLVLAVKAINTKQEEKSALLDHIWVTRWLDDIGLPQYKDQFHESRVDRRMLQYLTVNDLLFLKVTSQLHHLSIKCAIHVLHVNKFNPHCLHRRPADESNLSPSEVVQWSNHRVMEWLRSVDLAEYAPNLRGSGVHGGLIILEPRFTGDTLAMLLNIPPQKTLLRRHLTTKFNALIGPEAEQEKREKMASPAYTPLTTTAKVRPRKLGFSHFGNIRKKKFDESTDYICPMEPSDGVSDSHRVYSGYRGLSPLDAPELDGLDQVGQIS

SEQ ID NO: 33894 - protein, 86 aa, Homo sapiens
  ENSP00000433839
MLQQELLSRTSLETQKLDLMTEVSELKLKLVGMEKEQREQEEKQRKAEELLQELRHLKIKVEELENERNQYEWKLKATKAEVAQLQ

SEQ ID NO: 33895 - protein, 764 aa, Homo sapiens
  ENSP00000435469
MSSEQWPRLPGKVSVLTDQVEAQGEKIRDLEVCLEGHQVKLNAAEEMLQQELLSRTSLETQKLDLMTEVSELKLKLVGMEKEQREQEEKQRKAEELLQELRHLKIKVEELENERNQYEWKLKATKAEVAQLQEQVALKDAEIERLHSQLSRTAALHSESHTERDQEIQRLKMGMETLLLANEDKDRRIEELTGLLNQYRKVKEIVMVTQGPSERTLSINEEEPEGGFSKWNATNKDPEELFKQEMPPRCSSPTVGPPPLPQKSLETRAQKKLSCSLEDLRSESVDKCMDGNQPFPVLEPKDSPFLAEHKYPTLPGKLSGATPNGEAAKSPPTICQPDATGSSLLRLRDTESGWDDTAVVNDLSSTSSGTESGPQSPLTPDGKRNPKGIKKFWGKIRRTQSGNFYTDTLGMAEFRRGGLRATAGPRLSRTRDSKGQKSDANAPFAQWSTERVCAWLEDFGLAQYVIFARQWVSSGHTLLTATPQDMEKELGIKHPLHRKKLVLAVKAINTKQEEKSALLDHIWVTRWLDDIGLPQYKDQFHESRVDRRMLQYLTVNDLLFLKVTSQLHHLSIKCAIHVLHVNKFNPHCLHRRPADESNLSPSEVVQWSNHRVMEWLRSVDLAEYAPNLRGSGVHGGLIILEPRFTGDTLAMLLNIPPQKTLLRRHLTTKFNALIGPEAEQEKREKMASPAYTPLTTTAKVRPRKLGFSHFGNIRKKKFDESTDYICPMEPSDGVSDSHRVYSGYRGLSPLDAPELDGLDQVGQIS

SEQ ID NO: 33896 - protein, 733 aa, Homo sapiens
  ENSP00000437321
MGKLITRMWKLLRRRSAPKELLSRTSLETQKLDLMTEVSELKLKLVGMEKEQREQEEKQRKAEELLQELRHLKIKVEELENERNQYEWKLKATKAEVAQLQEQVALKDAEIERLHSQLSRTAALHSESHTERDQEIQRLKMGMETLLLANEDKDRRIEELTGLLNQYRKVKEIVMVTQGPSERTLSINEEEPEGGFSKWNATNKDPEELFKQEMPPRCSSPTVGPPPLPQKSLETRAQKKLSCSLEDLRSESVDKCMDGNQPFPVLEPKDSPFLAEHKYPTLPGKLSGATPNGEAAKSPPTICQPDATGSSLLRLRDTESGWDDTAVVNDLSSTSSGTESGPQSPLTPDGKRNPKGIKKFWGKIRRTQSGNFYTDTLGMAEFRRGGLRATAGPRLSRTRDSKGQKSDANAPFAQWSTERVCAWLEDFGLAQYVIFARQWVSSGHTLLTATPQDMEKELGIKHPLHRKKLVLAVKAINTKQEEKSALLDHIWVTRWLDDIGLPQYKDQFHESRVDRRMLQYLTVNDLLFLKVTSQLHHLSIKCAIHVLHVNKFNPHCLHRRPADESNLSPSEVVQWSNHRVMEWLRSVDLAEYAPNLRGSGVHGGLIILEPRFTGDTLAMLLNIPPQKTLLRRHLTTKFNALIGPEAEQEKREKMASPAYTPLTTTAKVRPRKLGFSHFGNIRKKKFDESTDYICPMEPSDGVSDSHRVYSGYRGLSPLDAPELDGLDQVGQIS

SEQ ID NO: 33897 - protein, 225 aa, Homo sapiens
  ENSP00000433713
  MOD_RES (1)..(1): Any amino acid
XGPSERTLSINEEEPEGGFSKWNATNKDPEELFKQEMPPRCSSPTVGPPPLPQKSLETRAQKKLSCSLEDLRSESVDKCMDGNQPFPVLEPKDSPFLAEHKYPTLPGKLSGATPNGEAAKSPPTICQPDATGSSLLRLNRGRSVSAPVLGDTESGWDDTAVVNDLSSTSSGTESGPQSPLTPDGKRNPKGIKKFWGKIRRTQSGNFYTDTLGMAEFRRGGLRATA

SEQ ID NO: 33898 - protein, 181 aa, Homo sapiens
  ENSP00000436739
MPPRCSSPTVGPPPLPQKSLETRAQKKLSCSLEDLRSESVDKCMDGNQPFPVLEPKDSPFLAEHKYPTLPGKLSGATPNGEAAKSPPTICQPDATGSSLLRLNRGRSVSAPVLGTVPIPGDTESGWDDTAVVNDLSSTSSGTESGPQSPLTPDGKRNPKGIKKFWGKIRRTQSGNFYTDTL

SEQ ID NO: 33899 - protein, 149 aa, Homo sapiens
  ENSP00000436489
  MOD_RES (1)..(1): Any amino acid
XKTLLRRHLTTKFNALIGPEAEQEKREKMASPAYTPLTTTAKVRPRKLGFSHFGNIRKKKFDESTDYICPMEPSDGVSDSHRVYSGYRGLSPLDAPELDGLDQHQWKHMNFDAGPETMDTPTRLSSQAPPTLQLREKLKCLRPVDHSLG

SEQ ID NO: 33900 - protein, 755 aa, Homo sapiens
  ENSP00000312411
MAGCIPEEKTYRRFLELFLGEFRGPCGGGEPEPEPEPEPEPEPESEPEPEPELVEAEAAEASVEEPGEEAATVAATEEGDQEQDPEPEEEAAVEGEEEEEGAATAAAAPGHSAVPPPPPQLPPLPPLPRPLSERITREEVEGESLDLCLQQLYKYNCPSFLAAALARATSDEVLQSDLSAHYIPKETDGTEGTVEIETVKLARSVFSKLHEICCSWVKDFPLRRRPQLYYETSIHAIKNMRRKMEDKHVCIPDFNMLFNLEDQEEQAYFAVFDGHGGVDAAIYASIHLHVNLVRQEMFPHDPAEALCRAFRVTDERFVQKAARESLRCGTTGVVTFIRGNMLHVAWVGDSQVMLVRKGQAVELMKPHKPDREDEKQRIEALGGCVVWFGAWRVNGSLSVSRAIGDAEHKPYICGDADSASTVLDGTEDYLILACDGFYDTVNPDEAVKVVSDHLKENNGDSSMVAHKLVASARDAGSSDNITVIVVFLRDMNKAVNVSEESDWTENSFQGGQEDGGDDKENHGECKRPWPQHQCSAPADLGYDGRVDSFTDRTSLSPGSQINVLEDPGYLDLTQIEASKPHSAQFLLPVEMFGPGAPKKANLINELMMEKKSVQSSLPEWSGAGEFPTAFNLGSTGEQIYRMQSLSPVCSGLENEQFKSPGNRVSRLSHLRHHYSKKWHRFRFNPKFYSFLSAQEPSHKIGTSLSSLTGSGKRNRIRSSLPWRQNSWKGYSENMRKLRKTHDIPCPDLPWSYKIE

SEQ ID NO: 33901 - protein, 514 aa, Homo sapiens
  ENSP00000228705
MLTRVKSAVANFMGGIMAGSSGSEHGGGSCGGSDLPLRFPYGRPEFLGLSQDEVECSADHIARPILILKETRRLPWATGYAEVINAGKSTHNEDQASCEVLTVKKKAGAVTSTPNRNSSKRRSSLPNGEGLQLKENSESEGVSCHYWSLFDGHAGSGAAVVASRLLQHHITEQLQDIVDILKNSAVLPPTCLGEEPENTPANSRTLTRAASLRGGVGAPGSPSTPPTRFFTEKKIPHECLVIGALESAFKEMDLQIERERSSYNISGGCTALIVICLLGKLYVANAGDSRAIIIRNGEIIPMSSEFTPETERQRLQYLAFMQPHLLGNEFTHLEFPRRVQRKELGKKMLYRDFNMTGWAYKTIEDEDLKFPLIYGEGKKARVMATIGVTRGLGDHDLKVHDSNIYIKPFLSSAPEVRIYDLSKYDHGSDDVLILATDGLWDVLSNEEVAEAITQFLPNCDPDDPHRYTLAAQDLVMRARGVLKDRGWRISNDRLGSGDDISVYVIPLIHGNKLS

SEQ ID NO: 33902 - protein, 298 aa, Homo sapiens
  ENSP00000474405
  MOD_RES (1)..(1): Any amino acid
XGAPPPRPKSPDLPNAASAPPAAAPEAPRSPPAKAGSGSATPAKAVEARASFSRPTFLQLSPGGLRRADDHAGRAVQSPPDTGRRLPWSTGYAEVINAGKSRHNEDQACCEVVYVEGRRSVTGVPREPSRGQGLCFYYWGLFDGHAGGGAAEMASRLLHRHIREQLKDLVEILQDPSPPPLCLPTTPGTPDSSDPSHLLGPQSCWSSQKEVSHESLVVGAVENAFQLMQDEQMARERRGHQVEGGCCALVVIYLLGKVYVANAGDSRAIIVRNGEIIPMSREFTPETERQRLQLLGLL

SEQ ID NO: 33903 - protein, 505 aa, Homo sapiens
  ENSP00000308926
MLNRVRSAVAHLVSSGGAPPPRPKSPDLPNAASAPPAAAPEAPRSPPAKAGSGSATPAKAVEARASFSRPTFLQLSPGGLRRADDHAGRAVQSPPDTGRRLPWSTGYAEVINAGKSRHNEDQACCEVVYVEGRRSVTGVPREPSRGQGLCFYYWGLFDGHAGGGAAEMASRLLHRHIREQLKDLVEILQDPSPPPLCLPTTPGTPDSSDPSHLLGPQSCWSSQKEVSHESLVVGAVENAFQLMDEQMARERRGHQVEGGCCALVVIYLLGKVYVANAGDSRAIIVRNGEIIPMSREFTPETERQRLQLLGFLKPELLGSEFTHLEFPRRVLPKELGQRMLYRDQNMTGWAYKKIELEDLRFPLVCGEGKKARVMATIGVTRGLGDHSLKVCSSTLPIKPFLSCFPEVRVYDLTQYEHCPDDVLVLGTDGLWDVTTDCEVAATVDRVLSAYEPNDHSRYTALAQALVLGARGTPRDRGWRLPNNKLGSGDDISVFVIPLGGPGSYS

SEQ ID NO: 33904 - protein, 299 aa, Homo sapiens
  ENSP00000475711
MASRLLHRHIREQLKDLKEVSHESLVVGAVENAFQLMDEQMARERRGHQVEGGCCALVVIYLLGKVYVANAGDSRAIIVRNGEIIPMSREFTPETERQRLQLLGFLKPELLGSEFTHLEFPRRVLPKELGQRMLYRDQNMTGWAYKKIELEDLRFPLVCGEGKKARVMATIGVTRGLGDHSLKVCSSTLPIKPFLSCFPEVRVYDLTQYEHCPDDVLVLGTDGLWDVTTDCEVAATVDRVLSAYEPNDHSRYTALAQALVLGARGTPRDRGWRLPNNKLGSGDDISVFVIPLGGPGSYS

SEQ ID NO: 33905 - protein, 150 aa, Homo sapiens
  ENSP00000474145
MLNRVRSAVAHLVSSGGAPPPRPKSPDLPNAASAPPAAAPEAPRSPPAKAGSGSATPAKAVEARASFSRPTFLQLSPGGLRRADDHAGRAVQSPPDTGRRLPWSTGYAETLFCPRARRAESPAKDELASSPSRPGSLKAKGHQCWQESAQ

SEQ ID NO: 33906 - protein, 74 aa, Homo sapiens
  ENSP00000397132
MGRRSSKCCCIYEKPRAFGESSTESDEEEEEGCGHTHCVRGHRKGRRRATLGPTPTTPPQPPDPSQPPPGPMQH

SEQ ID NO: 33907 - protein, 126 aa, Homo sapiens
  ENSP00000403557
MAEAGAGLSETVTETTVTVTTEPENRSLTIKLRKRKPEKKVEWTSDTVDNEHMGRRSSKCCCIYEKPRAFGESSTESDEEEEEGCGHTHCVRGHRKGRRRATLGPTPTTPPQPPDPSQPPPGPMQH

SEQ ID NO: 33908 - protein, 74 aa, Homo sapiens; identical to SEQ ID NO: 33906
  ENSP00000390917

SEQ ID NO: 33909 - protein, 74 aa, Homo sapiens; identical to SEQ ID NO: 33906
  ENSP00000411976

SEQ ID NO: 33910 - protein, 74 aa, Homo sapiens; identical to SEQ ID NO: 33906
  ENSP00000396522

SEQ ID NO: 33911 - protein, 74 aa, Homo sapiens; identical to SEQ ID NO: 33906
  ENSP00000399723

SEQ ID NO: 33912 - protein, 74 aa, Homo sapiens; identical to SEQ ID NO: 33906
  ENSP00000392044

SEQ ID NO: 33913 - protein, 126 aa, Homo sapiens; identical to SEQ ID NO: 33907
  ENSP00000394056

SEQ ID NO: 33914 - protein, 74 aa, Homo sapiens; identical to SEQ ID NO: 33906
  ENSP00000400763

SEQ ID NO: 33915 - protein, 74 aa, Homo sapiens; identical to SEQ ID NO: 33906
  ENSP00000404824

SEQ ID NO: 33916 - protein, 74 aa, Homo sapiens; identical to SEQ ID NO: 33906
  ENSP00000399965

SEQ ID NO: 33917 - protein, 74 aa, Homo sapiens; identical to SEQ ID NO: 33906
  ENSP00000392260

SEQ ID NO: 33918 - protein, 74 aa, Homo sapiens; identical to SEQ ID NO: 33906
  ENSP00000411693

SEQ ID NO: 33919 - protein, 126 aa, Homo sapiens; identical to SEQ ID NO: 33907
  ENSP00000411038

SEQ ID NO: 33920 - protein, 74 aa, Homo sapiens; identical to SEQ ID NO: 33906
  ENSP00000408173

SEQ ID NO: 33921 - protein, 74 aa, Homo sapiens; identical to SEQ ID NO: 33906
  ENSP00000416038

SEQ ID NO: 33922 - protein, 74 aa, Homo sapiens; identical to SEQ ID NO: 33906
  ENSP00000415651

SEQ ID NO: 33923 - protein, 74 aa, Homo sapiens; identical to SEQ ID NO: 33906
  ENSP00000399167

SEQ ID NO: 33924 - protein, 126 aa, Homo sapiens; identical to SEQ ID NO: 33907
  ENSP00000414808

SEQ ID NO: 33925 - protein, 74 aa, Homo sapiens; identical to SEQ ID NO: 33906
  ENSP00000414471

SEQ ID NO: 33926 - protein, 74 aa, Homo sapiens; identical to SEQ ID NO: 33906
  ENSP00000406410

SEQ ID NO: 33927 - protein, 74 aa, Homo sapiens; identical to SEQ ID NO: 33906
  ENSP00000391581

SEQ ID NO: 33928 - protein, 74 aa, Homo sapiens; identical to SEQ ID NO: 33906
  ENSP00000401267

SEQ ID NO: 33929 - protein, 74 aa, Homo sapiens; identical to SEQ ID NO: 33906
  ENSP00000390548

SEQ ID NO: 33930 - protein, 74 aa, Homo sapiens; identical to SEQ ID NO: 33906
  ENSP00000365964

SEQ ID NO: 33931 - protein, 126 aa, Homo sapiens; identical to SEQ ID NO: 33907
  ENSP00000365963

SEQ ID NO: 33932 - protein, 74 aa, Homo sapiens; identical to SEQ ID NO: 33906
  ENSP00000365960

SEQ ID NO: 33933 - protein, 74 aa, Homo sapiens; identical to SEQ ID NO: 33906
  ENSP00000365956

SEQ ID NO: 33934 - protein, 74 aa, Homo sapiens; identical to SEQ ID NO: 33906
  ENSP00000365954

SEQ ID NO: 33935 - protein, 74 aa, Homo sapiens; identical to SEQ ID NO: 33906
  ENSP00000365949

SEQ ID NO: 33936 - protein, 74 aa, Homo sapiens; identical to SEQ ID NO: 33906
  ENSP00000399222

SEQ ID NO: 33937 - protein, 126 aa, Homo sapiens; identical to SEQ ID NO: 33907
  ENSP00000412297

SEQ ID NO: 33938 - protein, 74 aa, Homo sapiens; identical to SEQ ID NO: 33906
  ENSP00000412526

SEQ ID NO: 33939 - protein, 74 aa, Homo sapiens; identical to SEQ ID NO: 33906
  ENSP00000400589

SEQ ID NO: 33940 - protein, 74 aa, Homo sapiens; identical to SEQ ID NO: 33906
  ENSP00000406648

SEQ ID NO: 33941 - protein, 74 aa, Homo sapiens; identical to SEQ ID NO: 33906
  ENSP00000409066

SEQ ID NO: 33942 - protein, 74 aa, Homo sapiens; identical to SEQ ID NO: 33906
  ENSP00000383499

SEQ ID NO: 33943 - protein, 126 aa, Homo sapiens; identical to SEQ ID NO: 33907
  ENSP00000373107

SEQ ID NO: 33944 - protein, 74 aa, Homo sapiens; identical to SEQ ID NO: 33906
  ENSP00000383498

SEQ ID NO: 33945 - protein, 74 aa, Homo sapiens; identical to SEQ ID NO: 33906
  ENSP00000383497

SEQ ID NO: 33946 - protein, 74 aa, Homo sapiens; identical to SEQ ID NO: 33906
  ENSP00000383496

SEQ ID NO: 33947 - protein, 74 aa, Homo sapiens; identical to SEQ ID NO: 33906
  ENSP00000383495

SEQ ID NO: 33948 - protein, 74 aa, Homo sapiens; identical to SEQ ID NO: 33906
  ENSP00000404779

SEQ ID NO: 33949 - protein, 74 aa, Homo sapiens; identical to SEQ ID NO: 33906
  ENSP00000398205

SEQ ID NO: 33950 - protein, 126 aa, Homo sapiens; identical to SEQ ID NO: 33907
  ENSP00000407981

SEQ ID NO: 33951 - protein, 74 aa, Homo sapiens; identical to SEQ ID NO: 33906
  ENSP00000410429

SEQ ID NO: 33952 - protein, 74 aa, Homo sapiens; identical to SEQ ID NO: 33906
  ENSP00000403611

SEQ ID NO: 33953 - protein, 74 aa, Homo sapiens; identical to SEQ ID NO: 33906
  ENSP00000388044

SEQ ID NO: 33954 - protein, 77 aa, Homo sapiens
  ENSP00000465811
MPDEINIDELLELESEEERSRKIQGLLKSCGKPVEDFIQELLAKLQGLHRQPGLRQPSPSHDGSLSPLQDRARTAHP

SEQ ID NO: 33955 - protein, 123 aa, Homo sapiens
  ENSP00000466572
MAAQRLGKRVLSKLQSPSRARGPGGSPGGLQKRHARVTVKYDRRELQRRLDVEKWIDGRLEELYRGMEADMPDEINIDELLELESEEERSRKIQPPPGPGPDCSPLTLLHSPCPPDAAQLACV

SEQ ID NO: 33956 - protein, 120 aa, Homo sapiens
  ENSP00000301243
MAAQRLGKRVLSKLQSPSRARGPGGSPGGLQKRHARVTVKYDRRELQRRLDVEKWIDGRLEELYRGMGLLKSCGKPVEDFIQELLAKLQGLHRQPGLRQPSPSHDGSLSPLQDRARTAHP

SEQ ID NO: 33957 - protein, 147 aa, Homo sapiens
  ENSP00000301242
MAAQRLGKRVLSKLQSPSRARGPGGSPGGLQKRHARVTVKYDRRELQRRLDVEKWIDGRLEELYRGMEADMPDEINIDELLELESEEERSRKIQGLLKSCGKPVEDFIQELLAKLQGLHRQPGLRQPSPSHDGSLSPLQDRARTAHP

SEQ ID NO: 33958 - protein, 121 aa, Homo sapiens
  ENSP00000465104
MAAQRLGKRVLSKLQSPSRARGPGGSPGGLQKRHARVTVKYDRRELQRRLDVEKWIDGRLEELYRGMEADMPDEINIDELLELESEEERSRKIQGLLKSCGKPVEVSFLSLILSLFWPQVL

SEQ ID NO: 33959 - protein, 674 aa, Homo sapiens
  ENSP00000200453
MAPGQAPHQATPWRDAHPFFLLSPVMGLLSRAWSRLRGLGPLEPWLVEAVKGAALVEAGLEGEARTPLAIPHTPWGRRPEEEAEDSGGPGEDRETLGLKTSSSLPEAWGLLDDDDGMYGEREATSVPRGQGSQFADGQRAPLSPSLLIRTLQGSDKNPGEEKAEEEGVAEEEGVNKFSYPPSHRECCPAVEEEDDEEAVKKEAHRTSTSALSPGSKPSTWVSCPGEEENQATEDKRTERSKGARKTSVSPRSSGSDPRSWEYRSGEASEEKEEKAHKETGKGEAAPGPQSSAPAQRPQLKSWWCQPSDEEEGEVKALGAAEKDGEAECPPCIPPPSAFLKAWVYWPGEDTEEEEDEEEDEDSDSGSDEEEGEAEASSSTPATGVFLKSWVYQPGEDTEEEEDEDSDTGSAEDEREAETSASTPPASAFLKAWVYRPGEDTEEEEDEDVDSEDKEDDSEAALGEAESDPHPSHPDQRAHFRGWGYRPGKETEEEEAAEDWGEAEPCPFRVAIYVPGEKPPPPWAPPRLPLRLQRRLKRPETPTHDPDPETPLKARKVRFSEKVTVHFLAVWAGPAQAARQGPWEQLARDRSRFARRITQAQEELSPCLTPAARARAWARLRNPPLAPIPALTQTLPSSSVPSSPVQTTPLSQAVATPSRSSAAAAAALDLSGRRG

SEQ ID NO: 33960 - protein, 258 aa, Homo sapiens
  ENSP00000469239
  MOD_RES (1)..(1): Any amino acid
XDSGSDEEEGEAEASSSTPATGVFLKSWVYQPGEDTEEEEDEDSDTGSAEDEREAETSASTPPASAFLKAWVYRPGEDTEEEEDEDVDSEDKEDDSEAALGEAESDPHPSHPDQRAHFRGWGYRPGKETEEEEAAEDWGEAEPCPFRVAIYVPGEKPPPPWAPPRLPLRLQRRLKRPETPTHDPDPETPLKARKVGAESPDSIFFFFLIELESWAVTQAGVQRHDLGSLPTSAAQVQAILVPQPPEYLGLQAHDTTPS

SEQ ID NO: 33961 - protein, 567 aa, Homo sapiens
  ENSP00000299824
MASHVDLLTELQLLEKVPTLERLRAAQKRRAQQLKKWAQYEQDLQHRKRKHERKRSTGGRRKKVSFEASVALLEASLRNDAEEVRYFLKNKVSPDLCNEDGLTALHQCCIDNFEEIVKLLLSHGANVNAKDNELWTPLHAAATCGHINLVKILVQYGADLLAVNSDGNMPYDLCEDEPTLDVIETCMAYQGITQEKINEMRVAPEQQMIADIHCMIAAGQDLDWIDAQGATLLHIAGANGYLRAAELLLDHGVRVDVKDWDGWEPLHAAAFWGQMQMAELLVSHGASLSARTSMDEMPIDLCEEEEFKVLLLELKHKHDVIMKSQLRHKSSLSRRTSSAGSRGKVVRRASLSDRTNLYRKEYEGEAILWQRSAAEDQRTSTYNGDIRETRTDQENKDPNPRLEKPVLLSEFPTKIPRGELDMPVENGLRAPVSAYQYALANGDVWKVHEVPDYSMAYGNPGVADATPPWSSYKEQSPQTLLELKRQRAAAKLLSHPFLSTHLGSSMARTGESSSEGKAPLIGGRTSPYSSNGTSVYYTVTSGDPPLLKFKAPIEEMEEKVHGCCRIS

SEQ ID NO: 33962 - protein, 525 aa, Homo sapiens
  ENSP00000362428
MASHVDLLTELQLLEKVPTLERLRAAQKRRAQQLKKWAQYEQDLQHRKRKHERKRSTGGRRKKVSFEASVALLEASLRNDAEEVRYFLKNKVSPDLCNEDGLTALHQCCIDNFEEIVKLLLSHGANVNAKDNELWTPLHAAATCGHINLVKILVQYGADLLAVNSDGNMPYDLCEDEPTLDVIETCMAYQGITQEKINEMRVAPEQQMIADIHCMIAAGQDLDWIDAQGATLMQMAELLVSHGASLSARTSMDEMPIDLCEEEEFKVLLLELKHKHDVIMKSQLRHKSSLSRRTSSAGSRGKVVRRASLSDRTNLYRKEYEGEAILWQRSAAEDQRTSTYNGDIRETRTDQENKDPNPRLEKPVLLSEFPTKIPRGELDMPVENGLRAPVSAYQYALANGDVWKVHEVPDYSMAYGNPGVADATPPWSSYKEQSPQTLLELKRQRAAAKLLSHPFLSTHLGSSMARTGESSSEGKAPLIGGRTSPYSSNGTSVYYTVTSGDPPLLKFKAPIEEMEEKVHGCCRIS

SEQ ID NO: 33963 - protein, 155 aa, Homo sapiens
  ENSP00000340125
MMSTEQMQPLELSEDRLDKLDPRCSHLDDLSDQFIKDCDLKKKPRKGKNVQATLNVESDQKKPRRKDTPALHIPPFIPGVFSEHLIKRYDVQERHPKGKMIPVLHNTDLEQKKPRRKDTPALHMSPFAAGVTLLRDERPKAIVEDDEKDGDKIAI

SEQ ID NO: 33964 - protein, 104 aa, Homo sapiens
  ENSP00000386459
MMSTEQMQPLELSEDRLDKLDPRCSHLGVFSEHLIKRYDVQERHPKGKMIPVLHNTDLEQKKPRRKDTPALHMSPFAAGVTLLRDERPKAIVEDDEKDGDKIAI

SEQ ID NO: 33965 - protein, 109 aa, Homo sapiens
  ENSP00000386359
MEPNSPKKIQFAVPVFQSQIAPEAAEQIRKRRPTPASLVILNEHNPPEIDDKRGPNTQGELQNASPKQRKQSVYTPPTIKGVKHLKGQNESAFPEEEEGTNEREEQRDH

SEQ ID NO: 33966 - protein, 116 aa, Homo sapiens
  ENSP00000280295
MEPNSPKKIQFAVPVFQSQIAPEAAEQLGFCRSQIRKRRPTPASLVILNEHNPPEIDDKRGPNTQGELQNASPKQRKQSVYTPPTIKGVKHLKGQNESAFPEEEEGTNEREEQRDH

SEQ ID NO: 33967 - protein, 109 aa, Homo sapiens; identical to SEQ ID NO: 33965
  ENSP00000386778

SEQ ID NO: 33968 - protein, 422 aa, Homo sapiens
  ENSP00000298705
MYRVPEFYARRKRLGGQTPYLMDQLGLRLGMWYWKDETRTLEFRRFAAEDSVQWLLKHHPHFTPAAEVKEKGKKGKAVHFAETDGPASDRLTDKRLAAKDDKSAKAVEKRGQQGTITLDDVKFVTLLLLQDTEMQRICSFTTFMRNKNLDNFLMALLYYLSHYLEKNSLEKKPKSYMVGLVEKKEMELVLSELEAAQRYLAQKYCILVLGLAVPDKHHMCCGKEKISDTQKDWKFFESFYTFCTYVAWIVFRRQHLTEIEEEVGRLFRTNMFNIPRRRREDEESGGEKKRMTFVQFRRMMAKRPAIKKAINMRSPVMSTLLPSLREKAQNVFEKKYHQVDVRFPAEMQKHVGTLDSVPMPVVGILGEPRCLFNPHTLHPLDPEENTKSFGRYPSLMENNNMRIQDTLDLVMKTLSSHTSCPK

SEQ ID NO: 33969 - protein, 74 aa, Homo sapiens
  ENSP00000451900
MYRVPEFYARRKRLGGQTPYLMDQLGLRLGMWYWKDETRTLEFRRFAAEDSVQWLLKHHPHAPIPKLAENQQSA

SEQ ID NO: 33970 - protein, 45 aa, Homo sapiens
  ENSP00000435229
MYRVPEFYARRKRLGGQTPYLMDQLGLRLGMWYWKDETRTLEFRR

SEQ ID NO: 33971 - protein, 44 aa, Homo sapiens
  ENSP00000452491
MQRICSFTTFMRNKNLDNFLMALLYYLSHYLEKNSLEKKPKSYM

SEQ ID NO: 33972 - protein, 309 aa, Homo sapiens
  ENSP00000418447
MDEKVFTKELDQWIEQLNECKQLSESQVKSLCEKAKEILTKESNVQEVRCPVTVCGDVHGQFHDLMELFRIGGKSPDTNYLFMGDYVDRGYYSVETVTLLVALKVRYRERITILRGNHESRQITQVYGFYDECLRKYGNANVWKYFTDLFDYLPLTALVDGQIFCLHGGLSPSIDTLDHIRALDRLQEVPHEGPMCDLLWSDPDDRGGWGISPRGAGYTFGQDISETFNHANGLTLVSRAHQLVMEGYNWCHDRNVVTIFSAPNYCYRCGNQAAIMELDDTLKYSFLQFDPAPRRGEPHVTRRTPDYFL

SEQ ID NO: 33973 - protein, 126 aa, Homo sapiens
  ENSP00000430869
MELFRIGGKSPDTNYLFMGDYVDRGYYSVETVTLLVALKVRYRERITILRGNHESRQITQVYGFYDECLRKYGNANVWKYFTDLFDYLPLTALVDGQIFCLHGGLSPSIDTLDHIRALDRLQEVPH

SEQ ID NO: 33974 - protein, 145 aa, Homo sapiens
  ENSP00000428816
MPFNGSDVLNLLFLYPLTSNEAKEILTKESNVQEVRCPVTVCGDVHGQFHDLMELFRIGGKSPDTNYLFMGDYVDRGYYSVETVTLLVALKVRYRERITILRGNHESRQITQVYGFYDECLRKYGNANVWKYFTDLFDYLPLTAL

SEQ ID NO: 33975 - protein, 447 aa, Homo sapiens
  ENSP00000335083
MGLSFFSKHLPIQEGQPWALKTPADIISTVEFNHTGELLATGDKGGRVVIFQREPESKNAPHSQGEYDVYSTFQSHEPEFDYLKSLEIEEKINKIKWLPQQNAAHSLLSTNDKTIKLWKITERDKRPEGYNLKDEEGKLKDLSTVTSLQVPVLKPMDLMVEVSPRRIFANGHTYHINSISVNSDCETYMSADDLRINLWHLAITDRSFNIVDIKPANMEDLTEVITASEFHPHHCNLFVYSSSKGSLRLCDMRAAALCDKHSKLFEEPEDPSNRSFFSEIISSVSDVKFSHSGRYMLTRDYLTVKVWDLNMEARPIETYQVHDYLRSKLCSLYENDCIFDKFECAWNGSDSVIMTGAYNNFFRMFDRNTKRDVTLEASRESSKPRAVLKPRRVCVGGKRRRDDISVDSLDFTKKILHTAWHPAENIIAIAATNNLYIFQDKVNSDMH

SEQ ID NO: 33976 - protein, 440 aa, Homo sapiens
  ENSP00000423649
MREADTLRPPQLMEVSADIISTVEFNHTGELLATGDKGGRVVIFQREPESKNAPHSQGEYDVYSTFQSHEPEFDYLKSLEIEEKINKIKWLPQQNAAHSLLSTNDKTIKLWKITERDKRPEGYNLKDEEGKLKDLSTVTSLQVPVLKPMDLMVEVSPRRIFANGHTYHINSISVNSDCETYMSADDLRINLWHLAITDRSFNIVDIKPANMEDLTEVITASEFHPHHCNLFVYSSSKGSLRLCDMRAAALCDKHSKLFEEPEDPSNRSFFSEIISSVSDVKFSHSGRYMLTRDYLTVKVWDLNMEARPIETYQVHDYLRSKLCSLYENDCIFDKFECAWNGSDSVIMTGAYNNFFRMFDRNTKRDVTLEASRESSKPRAVLKPRRVCVGGKRRRDDISVDSLDFTKKILHTAWHPAENIIAIAATNNLYIFQDKVNSDMH

SEQ ID NO: 33977 - protein, 430 aa, Homo sapiens
  ENSP00000422374
MGKRDTADIISTVEFNHTGELLATGDKGGRVVIFQREPESKNAPHSQGEYDVYSTFQSHEPEFDYLKSLEIEEKINKIKWLPQQNAAHSLLSTNDKTIKLWKITERDKRPEGYNLKDEEGKLKDLSTVTSLQVPVLKPMDLMVEVSPRRIFANGHTYHINSISVNSDCETYMSADDLRINLWHLAITDRSFNIVDIKPANMEDLTEVITASEFHPHHCNLFVYSSSKGSLRLCDMRAAALCDKHSKLFEEPEDPSNRSFFSEIISSVSDVKFSHSGRYMLTRDYLTVKVWDLNMEARPIETYQVHDYLRSKLCSLYENDCIFDKFECAWNGSDSVIMTGAYNNFFRMFDRNTKRDVTLEASRESSKPRAVLKPRRVCVGGKRRRDDISVDSLDFTKKILHTAWHPAENIIAIAATNNLYIFQDKVNSDMH

SEQ ID NO: 33978 - protein, 447 aa, Homo sapiens
  ENSP00000372042
MGEDTDTRKINHSFLRDHSYVTEADIISTVEFNHTGELLATGDKGGRVVIFQREPESKNAPHSQGEYDVYSTFQSHEPEFDYLKSLEIEEKINKIKWLPQQNAAHSLLSTNDKTIKLWKITERDKRPEGYNLKDEEGKLKDLSTVTSLQVPVLKPMDLMVEVSPRRIFANGHTYHINSISVNSDCETYMSADDLRINLWHLAITDRSFNIVDIKPANMEDLTEVITASEFHPHHCNLFVYSSSKGSLRLCDMRAAALCDKHSKLFEEPEDPSNRSFFSEIISSVSDVKFSHSGRYMLTRDYLTVKVWDLNMEARPIETYQVHDYLRSKLCSLYENDCIFDKFECAWNGSDSVIMTGAYNNFFRMFDRNTKRDVTLEASRESSKPRAVLKPRRVCVGGKRRRDDISVDSLDFTKKILHTAWHPAENIIAIAATNNLYIFQDKVNSDMH

SEQ ID NO: 33979 - protein, 440 aa, Homo sapiens; identical to SEQ ID NO: 33976
  ENSP00000425247

SEQ ID NO: 33980 - protein, 42 aa, Homo sapiens
  ENSP00000423650
MGLSFFSKHLPIQEGQPWALKTPADIISTVEFNHTGELLATE

SEQ ID NO: 33981 - protein, 873 aa, Homo sapiens
  ENSP00000305924
MHPPPPAAAMDFSQNSLFGYMEDLQELTIIERPVRRSLKTPEEIERLTVDEDLSDIERAVYLLSAGQDVQGTSVIANLPFLMRQNPTETLRRVLPKVREALHVAGVEMQLTAAMSFLTILQDESVSIHAYTHSFLQVILLHLEHRDTGVSNAWLETLLSVIEVLPKETLRHEILNPLVSKAQLSQTVQSRLVSCKILGKLTNKFDAHTIKREILPLVKSLCQDVEYEVRSCMCRQLENIAQGIGTELTKSVVLPELIELSRDEGSSVRLAAFETLVNLLDIFDTDDRSQTILPLVKSFCEKSFKADESILISLSFHLGKLCHGLYGIFTPDQHLRFLEFYKKLCTLGLQQENGHNENQIPPQILEQEKKYISVRKNCAYNFPAMIVFVDPKNFHMELYSTFFCLCHDPEVPVRYTIAICFYEVSKLLNSGVYLIHKELITLLQDESLEVLDALIDHLPEILELMSTGGESSVQENKLSSLPDLIPALTAAEQRAAASLKWRTHEKLLQKYACLPHVISSDQIYYRFLQRMFTIMMTNNVLPVQKAASRTLCIFLRYNRKQEQRHEVIQKLIEQLGQGKSYWNRLRFLDTCEFIIEIFSKSFFCKYFFLPAIELTHDPVANVRMKLCYLLPKVKSTLKIPADKHLLQQLEMCVRKLLCQEKDKDVLAIVKRTVLELDRMEMSMDAFQKKFYEKDLLDQEKEREELLLLEMEQLEKEKQQNDGRPMSDKMFEKKRRDTKTPTQSLPKNIPISVPGPSSVTPSTSKEIKKSKLIRSQSFNNQAFHAKYGNLEKCASKSSTTGYTTSVSGLGKTSVLSLADDSFRTRNASSVPSSFSPNTPLPSTSRGTGNSVDPKSSGSKDTQPRKATLKSRKSNP

SEQ ID NO: 33982 - protein, 120 aa, Homo sapiens
  ENSP00000330831
MHPPPPAAAMDFSQNSLFGYMEDLQELTIIERPVRRSLKTPEEIERLTVDEDLSDIERAVYLLSAGQDVQGTSVIANLPFLMRQNPTETLRRVLPKVRVHEDAHLFIQRVWISHMFVQRV

SEQ ID NO: 33983 - protein, 57 aa, Homo sapiens
  ENSP00000451543
MRQNPTETLRRVLPKVREALHVAGVEMQLTAAMSFLTILQDESVSIHAYTHSFLQVI

SEQ ID NO: 33984 - protein, 62 aa, Homo sapiens
  ENSP00000452121
MRQNPTETLRRVLPKVRCLPRSMRMHTYLSREYGSHICLSRGCDSVEENTYWKPCMLQEWKC

SEQ ID NO: 33985 - protein, 113 aa, Homo sapiens
  ENSP00000451556
MRQNPTETLRRVLPKVREALHVAGVEMQLTAAMSFLTILQDESVSIHAYTHSFLQVILLHLEHRDTGVSNAWLETLLSVIEVLPKETLRHEILNPLVSKAQLSQTVQSRLVSC

SEQ ID NO: 33986 - protein, 62 aa, Homo sapiens; identical to SEQ ID NO: 33984
  ENSP00000487248

SEQ ID NO: 33987 - protein, 873 aa, Homo sapiens; identical to SEQ ID NO: 33981
  ENSP00000480902

SEQ ID NO: 33988 - protein, 120 aa, Homo sapiens; identical to SEQ ID NO: 33982
  ENSP00000482849

SEQ ID NO: 33989 - protein, 57 aa, Homo sapiens; identical to SEQ ID NO: 33983
  ENSP00000487271

SEQ ID NO: 33990 - protein, 113 aa, Homo sapiens; identical to SEQ ID NO: 33985
  ENSP00000486247

SEQ ID NO: 33991 - protein, 927 aa, Homo sapiens
  ENSP00000352051
MFWKFDLNTTSHVDKLLDKEHVTLQELMDEDDILQECKAQNQKLLDFLCRQQCMEELVSLITQDPPLDMEEKVRFKYPNTACELLTCDVPQISDRLGGDESLLSLLYDFLDHEPPLNPLLASFFSKTIGNLIARKTEQVITFLKKKDKFISLVLKHIGTSALMDLLLRLVSCVEPAGLRQDVLHWLNEEKVIQRLVELIHPSQDEDRQSNASQTLCDIVRLGRDQGSQLQEALEPDPLLTALESQDCVEQLLKNMFDGDRTESCLVSGTQVLLTLLETRRVGTEGLVDSFSQGLERSYAVSSSVLHGIEPRLKDFHQLLLNPPKKKAILTTIGVLEEPLGNARLHGARLMAALLHTNTPSINQELCRLNTMDLLLDLFFKYTWNNFLHFQVELCIAAILSHAAREERTEASGSESRVEPPHENGNRSLETPQPAASLPDNTMVTHLFQKCCLVQRILEAWEANDHTQAAGGMRRGNMGHLTRIANAVVQNLERGPVQTHISEVIRGLPADCRGRWESFVEETLTETNRRNTVDLAFSDYQIQQMTANFVDQFGFNDEEFADQDDNINAPFDRIAEINFNIDADEDSPSAALFEACCSDRIQPFDDDEDEDIWEDSDTRCAARVMARPRFGAPHASESCSKNGPERGGQDGKASLEAHRDAPGAGAPPAPGKKEAPPVEGDSEAGAMWTAVFDEPANSTPTAPGVVRDVGSSVWAAGTSAPEEKGWAKFTDFQPFCCSESGPRCSSPVDTECSHAEGSRSQGPEKAFSPASPCAWNVCVTRKAPLLASDSSSSGGSHSEDGDQKAASAMDAVSRGPGREAPPLPTVARTEEAVGRVGCADSRLLSPACPAPKEVTAAPAVAVPPEATVAITTALSKAGPAIPTPAVSSALAVAVPLGPIMAVTAAPAMVATLGTVTKDGQMPRQKELP

SEQ ID NO: 33992 - protein, 933 aa, Homo sapiens
  ENSP00000379090
MFWKFDLNTTSHVDKLLDKEHVTLQELMDEDDILQECKAQNQKLLDFLCRQQCMEELVSLITQDPPLDMEEKVRFKYPNTACELLTCDVPQISDRLGGDESLLSLLYDFLDHEPPLNPLLASFFSKTIGNLIARKTEQVITFLKKKDKFISLVLKHIGTSALMDLLLRLVSCVEPAGLRQDVLHWLNEEKVIQRLVELIHPSQDEDRQSNASQTLCDIVRLGRDQGSQLQEALEPDPLLTALESRQDCVEQLLKNMFDGDRTESCLVSGTQVLLTLLETRRVGTEGLVDSFSQGLERSYAVSSSVLHGIEPRLKDFHQLLLNPPKKKAILTTIGVLEEPLGNARLHGARLMAALLHTNTPSINQELCRLNTMDLLLDLFFKYTWNNFLHFQVELCIAAILSHAAREERTEASGSESRVEPPHENGNRSLETPQPAASLPDNTMVTHLFQKCCLVQRILEAWEANDHTQAAGGMRRGNMGHLTRIANAVVQNLERGPVQTHISEVIRGLPADCRGRWESFVEETLTETNRRNTVDLAFSDYQIQQMTANFVDQFGFNDEEFADQDDNINAPFDRIAEINFNIDADEDSPSAALFEACCSDRIQPFDDDEDEDIWEDSDTRCAARVMARPRFGAPHASESCSKNGPERGGQDGKASLEAHRDAPGAGAPPAPGKKEAPPVEGDSEGAMWTAVFDEPANSTPTAPGVVRDVGSSVWAAGTSAPEEKGWAKFTDFQPFCCSESGPRCSSPVDTECSHAEGSRSQGPEKAFSPASPCAWNVCVTRKAPLLASDSSSSGGSHSEDGDQKAASAMDAVSRGPGREAPPLPTVARTEEAVGRVGCADSRLLSPACPAPKEVTAAPAVAVPPEATVAITTALSKAGPAIPTPAVSSALAVAVPLGPIMAVTAAPAMVATLGTVTKDGKTDAPPEGAALNGPV

SEQ ID NO: 33993 - protein, 932 aa, Homo sapiens
  ENSP00000379093
MFWKFDLNTTSHVDKLLDKEHVTLQELMDEDDILQECKAQNQKLLDFLCRQQCMEELVSLITQDPPLDMEEKVRFKYPNTACELLTCDVPQISDRLGGDESLLSLLYDFLDHEPPLNPLLASFFSKTIGNLIARKTEQVITFLKKKDKFISLVLKHIGTSALMDLLLRLVSCVEPAGLRQDVLHWLNEEKVIQRLVELIHPSQDEDRQSNASQTLCDIVRLGRDQGSQLQEALEPDPLLTALESQDCVEQLLKNMFDGDRTESCLVSGTQVLLTLLETRRVGTEGLVDSFSQGLERSYAVSSSVLHGIEPRLKDFHQLLLNPPKKKAILTTIGVLEEPLGNARLHGARLMAALLHTNTPSINQELCRLNTMDLLLDLFFKYTWNNFLHFQVELCIAAILSHAAREERTEASGSESRVEPPHENGNRSLETPQPAASLPDNTMVTHLFQKCCLVQRILEAWEANDHTQAAGGMRRGNMGHLTRIANAVVQNLERGPVQTHISEVIRGLPADCRGRWESFVEETLTETNRRNTVDLAFSDYQIQQMTANFVDQFGFNDEEFADQDDNINAPFDRIAEINFNIDADEDSPSAALFEACCSDRIQPFDDDEDEDIWEDSDTRCAARVMARPRFGAPHASESCSKNGPERGGQDGKASLEAHRDAPGAGAPPAPGKKEAPPVEGDSEGAMWTAVFDEPANSTPTAPGVVRDVGSSVWAAGTSAPEEKGWAKFTDFQPFCCSESGPRCSSPVDTECSHAEGSRSQGPEKAFSPASPCAWNVCVTRKAPLLASDSSSSGGSHSEDGDQKAASAMDAVSRGPGREAPPLPTVARTEEAVGRVGCADSRLLSPACPAPKEVTAAPAVAVPPEATVAITTALSKAGPAIPTPAVSSALAVAVPLGPIMAVTAAPAMVATLGTVTKDGKTDAPPEGAALNGPV

SEQ ID NO: 33994 - protein, 966 aa, Homo sapiens
  ENSP00000216061
MFWKFDLNTTSHVDKLLDKEHVTLQELMDEDDILQECKAQNQKLLDFLCRQQCMEELVSLITQDPPLDMEEKVRFKYPNTACELLTCDVPQISDRLGGDESLLSLLYDFLDHEPPLNPLLASFFSKTIGNLIARKTEQVITFLKKKDKFISLVLKHIGTSALMDLLLRLVSCVEPAGLRQDVLHWLNEEKVIQRLVELIHPSQDEDRQSNASQTLCDIVRLGRDQGSQLQEALEPDPLLTALESQDCVEQLLKNMFDGDRTESCLVSGTQVLLTLLETRRVGTEGLVDSFSQGLERSYAVSSSVLHGIEPRLKDFHQLLLNPPKKKAILTTIGVLEEPLGNARLHGARLMAALLHTNTPSINQELCRLNTMDLLLDLFFKYTWNNFLHFQVELCIAAILSHAAREERTEASGSESRVEPPHENGNRSLETPQPAASLPDNTMVTHLFQKCCLVQRILEAWEANDHTQAAGGMRRGNMGHLTRIANAVVQNLERGPVQTHISEVIRGLPADCRGRWESFVEETLTETNRRNTVDLVSTHHLHSSSEDEDIEGAFPNELSLQQAFSDYQIQQMTANFVDQFGFNDEEFADQDDNINAPFDRIAEINFNIDADEDSPSAALFEACCSDRIQPFDDDEDEDIWEDSDTRCAARVMARPRFGAPHASESCSKNGPERGGQDGKASLEAHRDAPGAGAPPAPGKKEAPPVEGDSEGAMWTAVFDEPANSTPTAPGVVRDVGSSVWAAGTSAPEEKGWAKFTDFQPFCCSESGPRCSSPVDTECSHAEGSRSQGPEKASQASYFAVSPASPCAWNVCVTRKAPLLASDSSSSGGSHSEDGDQKAASAMDAVSRGPGREAPPLPTVARTEEAVGRVGCADSRLLSPACPAPKEVTAAPAVAVPPEATVAITTALSKAGPAIPTPAVSSALAVAVPLGPIMAVTAAPAMVATLGTVTKDGKTDAPPEGAALNGPV

SEQ ID NO: 33995 - protein, 685 aa, Homo sapiens
  ENSP00000384532
  MOD_RES (1)..(1): Any amino acid
XLETRRVGTEGLVDSFSQGLERSYAVSSSVLHGIEPRLKDFHQLLLNPPKKKAILTTIGVLEEPLGNARLHGARLMAALLHTNTPSINQELCRLNTMDLLLDLFFKYTWNNFLHFQVELCIAAILSHAAREERTEASGSESRVEPPHENGNRSLETPQPAASLPDNTMVTHLFQKCCLVQRILEAWEANDHTQAAGGMRRGNMGHLTRIANAVVQNLERGPVQTHISEVIRGLPADCRGRWESFVEETLTETNRRNTVDLVSTHHLHSSSEDEDIEGAFPNELSLQQAFSDYQIQQMTANFVDQFGFNDEEFADQDDNINAPFDRIAEINFNIDADEDSPSAALFEACCSDRIQPFDDDEDEDIWEDSDTRCAARVMARPRFGAPHASESCSKNGPERGGQDGKASLEAHRDAPGAGAPPAPGKKEAPPVEGDSEGAMWTAVFDEPANSTPTAPGVVRDVGSSVWAAGTSAPEEKGWAKFTDFQPFCCSESGPRCSSPVDTECSHAEGSRSQGPEKAFSPASPCAWNVCVTRKAPLLASDSSSSGGSHSEDGDQKAASAMDAVSRGPGREAPPLPTVARTEEAVGRVGCADSRLLSPACPAPKEVTAAPAVAVPPEATVAITTALSKAGPAIPTPAVSSALAVAVPLGPIMAVTAAPAMVATLGTVTKDGKTDAPPEGAALNGPV

SEQ ID NO: 33996 - protein, 562 aa, Homo sapiens
  ENSP00000391595
  MOD_RES (1)..(1): Any amino acid
XLLLDLFFKYTWNNFLHFQVELCIAAILSHAAREERTEASGSESRVEPPHENGNRSLETPQPAASLPDNTMVTHLFQKCCLVQRILEAWEANDHTQAAGGMRRGNMGHLTRIANAVVQNLERGPVQTHISEVIRGLPADCRGRWESFVEETLTETNRRNTVDLAFSDYQIQQMTANFVDQFGFNDEEFADQDDNINAPFDRIAEINFNIDADEDSPSAALFEACCSDRIQPFDDDEDEDIWEDSDTRCAARVMARPRFGAPHASESCSKNGPERGGQDGKASLEAHRDAPGAGAPPAPGKKEAPPVEGDSEAGAMWTAVFDEPANSTPTAPGVVRDVGSSVWAAGTSAPEEKGWAKFTDFQPFCCSESGPRCSSPVDTECSHAEGSRSQGPEKAFSPASPCAWNVCVTRKAPLLASDSSSSGGSHSEDGDQKAASAMDAVSRGPGREAPPLPTVARTEEAVGRVGCADSRLLSPACPAPKEVTAAPAVAVPPEATVAITTALSKAGPAIPTPAVSSALAVAVPLGPIMAVTAAPAMVATLGTVTKDGKTDAPPEGAALNGPV

SEQ ID NO: 33997 - protein, 959 aa, Homo sapiens
  ENSP00000478417
MFWKFDLNTTSHVDKLLDKEHVTLQELMDEDDILQECKAQNQKLLDFLCRQQCMEELVSLITQDPPLDMEEKVRFKYPNTACELLTCDVPQISDRLGGDESLLSLLYDFLDHEPPLNPLLASFFSKTIGNLIARKTEQVITFLKKKDKFISLVLKHIGTSALMDLLLRLVSCVEPAGLRQDVLHWLNEEKVIQRLVELIHPSQDEDRQSNASQTLCDIVRLGRDQGSQLQEALEPDPLLTALESQDCVEQLLKNMFDGDRTESCLVSGTQVLLTLLETRRVGTEGLVDSFSQGLERSYAVSSSVLHGIEPRLKDFHQLLLNPPKKKAILTTIGVLEEPLGNARLHGARLMAALLHTNTPSINQELCRLNTMDLLLDLFFKYTWNNFLHFQVELCIAAILSHAAREERTEASGSESRVEPPHENGNRSLETPQPAASLPDNTMVTHLFQKCCLVQRILEAWEANDHTQAAGGMRRGNMGHLTRIANAVVQNLERGPVQTHISEVIRGLPADCRGRWESFVEETLTETNRRNTVDLVSTHHLHSSSEDEDIEGAFPNELSLQQAFSDYQIQQMTANFVDQFGFNDEEFADQDDNINAPFDRIAEINFNIDADEDSPSAALFEACCSDRIQPFDDDEDEDIWEDSDTRCAARVMARPRFGAPHASESCSKNGPERGGQDGKASLEAHRDAPGAGAPPAPGKKEAPPVEGDSEGAMWTAVFDEPANSTPTAPGVVRDVGSSVWAAGTSAPEEKGWAKFTDFQPFCCSESGPRCSSPVDTECSHAEGSRSQGPEKAFSPASPCAWNVCVTRKAPLLASDSSSSGGSHSEDGDQKAASAMDAVSRGPGREAPPLPTVARTEEAVGRVGCADSRLLSPACPAPKEVTAAPAVAVPPEATVAITTALSKAGPAIPTPAVSSALAVAVPLGPIMAVTAAPAMVATLGTVTKDGKTDAPPEGAALNGPV

SEQ ID NO: 33998 - protein, 1406 aa, Homo sapiens
  ENSP00000481109
MHQTLCLNPESLKMSACSDFVEHIWKPGSCKNCFCLRSDHQLVAGPPQPRAGSLPPPPRLPPRPENCRLEDEGVNSSPYSKPTIAVKPTMMSSEASDVWTEANLSAEVSQVIWRRAPGKLPLPKQEDAPVVYLGSFRGVQKPAGPSTSPDGNSRCPPAYTMVGLHNLEPRGERNIAFHPVSFPEEKAVHKEKPSFPYQDRPSTQESFRQKLAAFAGTTSGCHQGPGPLRESLPSEDDSDQRCSPSGDSEGGEYCSILDCCPGSPVAKAASQTAGSRGRHGGRDCSPTCWEQGKCSGPAEQEKRGPSFPKECCSQGPTAHPSCLGPKKLSLTSEAAISSDGLSCGSGSGSGSGASSPFVPHLESDYCSLMKEPAPEKQQDPGCPGVTPSRCLGLTGEPQPPAHPREATQPEPIYAESTKRKKAAPVPSKSQAKIEHAAAAQGQGQVCTGNAWAQKAASGWGRDSPDPTPQVSATITVMAAHPEEDHRTIYLSSPDSAVGVQWPRGPVSQNSEVGEEETSAGQGLSSRESHAHSASESKPKERPAIPPKLSKSSPVGSPVSPSAGGPPVSPLADLSDGSSGGSSIGPQPPSQGPADPAPSCRTNGVAISDPSRCPQPAASSASEQRRPRFQAGTWSRQCRIEEEEEVEQELLSHSWGRETKNGPTDHSNSTTWHRLHPTDGSSGQNSKVGTGMSKSASFAFEFPKDRSGIETFSPPPPPPKSRHLLKMNKSSSDLEKVSQGSAESLSPSFRGVHVSFTTGSTDSLASDSRTCSDGGPSSELAHSPTNSGKKLFAPVPFPSGSTEDVSPSGPQQPPPLPQKKIVSRAASSPDGFFWTQGSPKPGTASPKLNLSHSETNVHDESHFSYSLSPGNRHHPVFSSSDPLEKAFKGSGHWLPAAGLAGNRGGCGSPGLQCKGAPSASSSQLSVSSQASTGSTQLQLHGLLSNISSKEGTYAKLGGLYTQSLARLVAKCEDLFMGGQKKELHFNENNWSLFKLTCNKPCCDSGDAIYYCATCSEDPGSTYAVKICKAPEPKTVSYCSPSVPVHFNIQQDCGHFVASVPSSMLSSPDAPKDPVPALPTHPPAQEQDCVVVITREVPHQTASDFVRDSAASHQAEPEAYERRVCFLLLQLCNGLEHLKEHGIIHRDLCLENLLLVHCTLQAGPGPAPAPAPAPAPAAAAPPCSSAAPPAGGTLSPAAGPASPEGPREKQLPRLIISNFLKAKQKPGGTPNLQQKKSQARLAPEIVSASQYRKFDEFQTGILIYELLHQPNPFEVRAQLRERDYRQEDLPPLPALSLYSPGLQQLAHLLLEADPIKRIRIGEAKRVLQCLLWGPRRELVQQPGTSEEALCGTLHNWIDMKRALMMMKFAEKAVDRRRGVELEDWLCCQYLASAEPGALLQSLKLLQLL

SEQ ID NO: 33999 - protein, 1406 aa, Homo sapiens; identical to SEQ ID NO: 33998
  ENSP00000479068

SEQ ID NO: 34000 - protein, 789 aa, Homo sapiens
  ENSP00000358087
MKMDMEDADMTLWTEAEFEEKCTYIVNDHPWDSGADGGTSVQAEASLPRNLLFKYATNSEEVIGVMSKEYIPKGTRFGPLIGEIYTNDTVPKNANRKYFWRIYSRGELHHFIDGFNEEKSNWMRYVNPAHSPREQNLAACQNGMNIYFYTIKPIPANQELLVWYCRDFAERLHYPYPGELTMMNLTQTQSSLKQPSTEKNELCPKNVPKREYSVKEILKLDSNPSKGKDLYRSNISPLTSEKDLDDFRRRGSPEMPFYPRVVYPIRAPLPEDFLKASLAYGIERPTYITRSPIPSSTTPSPSARSSPDQSLKSSSPHSSPGNTVSPVGPGSQEHRDSYAYLNASYGTEGLGSYPGYAPLPHLPPAFIPSYNAHYPKFLLPPYGMNCNGLSAVSSMNGINNFGLFPRLCPVYSNLLGGGSLPHPMLNPTSLPSSLPSDGARRLLQPEHPREVLVPAPHSAFSFTGAAASMKDKACSPTSGSPTAGTAATAEHVVQPKATSAAMAAPSSDEAMNLIKNKRNMTGYKTLPYPLKKQNGKIKYECNVCAKTFGQLSNLKVHLRVHSGERPFKCQTCNKGFTQLAHLQKHYLVHTGEKPHECQVCHKRFSSTSNLKTHLRLHSGEKPYQCKVCPAKFTQFVHLKLHKRLHTRERPHKCSQCHKNYIHLCSLKVHLKGNCAAAPAPGLPLEDLTRINEEIEKFDISDNADRLEDVEDDISVISVVEKEILAVVRKEKEETGLKVSLQRNMGNGLLSSGCSLYESSDLPLMKLPPSNPLPLVPVKVKQETVEPMDP

SEQ ID NO: 34001 - protein, 825 aa, Homo sapiens
  ENSP00000358092
MLDICLEKRVGTTLAAPKCNSSTVRFQGLAEGTKGTMKMDMEDADMTLWTEAEFEEKCTYIVNDHPWDSGADGGTSVQAEASLPRNLLFKYATNSEEVIGVMSKEYIPKGTRFGPLIGEIYTNDTVPKNANRKYFWRIYSRGELHHFIDGFNEEKSNWMRYVNPAHSPREQNLAACQNGMNIYFYTIKPIPANQELLVWYCRDFAERLHYPYPGELTMMNLTQTQSSLKQPSTEKNELCPKNVPKREYSVKEILKLDSNPSKGKDLYRSNISPLTSEKDLDDFRRRGSPEMPFYPRVVYPIRAPLPEDFLKASLAYGIERPTYITRSPIPSSTTPSPSARSSPDQSLKSSSPHSSPGNTVSPVGPGSQEHRDSYAYLNASYGTEGLGSYPGYAPLPHLPPAFIPSYNAHYPKFLLPPYGMNCNGLSAVSSMNGINNFGLFPRLCPVYSNLLGGGSLPHPMLNPTSLPSSLPSDGARRLLQPEHPREVLVPAPHSAFSFTGAAASMKDKACSPTSGSPTAGTAATAEHVVQPKATSAAMAAPSSDEAMNLIKNKRNMTGYKTLPYPLKKQNGKIKYECNVCAKTFGQLSNLKVHLRVHSGERPFKCQTCNKGFTQLAHLQKHYLVHTGEKPHECQVCHKRFSSTSNLKTHLRLHSGEKPYQCKVCPAKFTQFVHLKLHKRLHTRERPHKCSQCHKNYIHLCSLKVHLKGNCAAAPAPGLPLEDLTRINEEIEKFDISDNADRLEDVEDDISVISVVEKEILAVVRKEKEETGLKVSLQRNMGNGLLSSGCSLYESSDLPLMKLPPSNPLPLVPVKVKQETVEPMDP

SEQ ID NO: 34002 - protein, 63 aa, Homo sapiens
  ENSP00000395566
MKMDMEDADMTLWTEAEFEEKCTYIVNDHPWDSGADGGTSVQAEASLPRNLLFKYATNSEEVI

SEQ ID NO: 34003 - protein, 171 aa, Homo sapiens
  ENSP00000399772
MAGEVHLCPTQCFHKKIYSRGELHHFIDGFNEEKSNWMRYVNPAHSPREQNLAACQNGMNIYFYTIKPIPANQELLVWYCRDFAERLHYPYPGELTMMNLTQTQSSLKQPSTEKNELCPKNVPKREYSVKEILKLDSNPSKGKDLYRSNISPLTSEKDLDDFRRRGSPEMP

SEQ ID NO: 34004 - protein, 691 aa, Homo sapiens
  ENSP00000358085
MEKIYSRGELHHFIDGFNEEKSNWMRYVNPAHSPREQNLAACQNGMNIYFYTIKPIPANQELLVWYCRDFAERLHYPYPGELTMMNLTQTQSSLKQPSTEKNELCPKNVPKREYSVKEILKLDSNPSKGKDLYRSNISPLTSEKDLDDFRRRGSPEMPFYPRVVYPIRAPLPEDFLKASLAYGIERPTYITRSPIPSSTTPSPSARSSPDQSLKSSSPHSSPGNTVSPVGPGSQEHRDSYAYLNASYGTEGLGSYPGYAPLPHLPPAFIPSYNAHYPKFLLPPYGMNCNGLSAVSSMNGINNFGLFPRLCPVYSNLLGGGSLPHPMLNPTSLPSSLPSDGARRLLQPEHPREVLVPAPHSAFSFTGAAASMKDKACSPTSGSPTAGTAATAEHVVQPKATSAAMAAPSSDEAMNLIKNKRNMTGYKTLPYPLKKQNGKIKYECNVCAKTFGQLSNLKVHLRVHSGERPFKCQTCNKGFTQLAHLQKHYLVHTGEKPHECQVCHKRFSSTSNLKTHLRLHSGEKPYQCKVCPAKFTQFVHLKLHKRLHTRERPHKCSQCHKNYIHLCSLKVHLKGNCAAAPAPGLPLEDLTRINEEIEKFDISDNADRLEDVEDDISVISVVEKEILAVVRKEKEETGLKVSLQRNMGNGLLSSGCSLYESSDLPLMKLPPSNPLPLVPVKVKQETVEPMDP

SEQ ID NO: 34005 - protein, 689 aa, Homo sapiens
  ENSP00000423985
MEDTGIQRGIWDGDAKAVQQCLTDIFTSVYTTCDIPENAIFGPCVLSHTSLYDSIAFIALKSTDKRTVPYIFRVDTSAANGSSEGLMWLRLVQSARDKEEQNLEAYIKNGQLFYRSLRRIAKDEELLVWYGKELTELLLLCPSRSHNKMNGSSPYTCLECSQRFQFEFPYVAHLRFRCPKRLHSADISPQDEQGGGVGTKDHGGGGGGGKDQQQQQQEAPLGPGPKFCKAGPLHHYPSPSPESSNPSAAAGGSSAKPSTDFHNLARELENSRGGSSCSPAQSLSSGSGSGGGGGHQEAELSPDGIATGGGKGKRKFPEEAAEGGGGAGLVGGRGRFVERPLPASKEDLVCTPQQYRASGSYFGLEENGRLFAPPSPETGEAKRSAFVEVKKAARAASLQEEGTADGAGVASEDQDAGGGGGSSTPAAASPVGAEKLLAPRPGGPLPSRLEGGSPARGSAFTSVPQLGSAGSTSGGGGTGAGAAGGAGGGQGAASDERKSAFSQPARSFSQLSPLVLGQKLGALEPCHPADGVGPTRLYPAAADPLAVKLQGAADLNGGCGSLPSGGGGLPKQSPFLYATAFWPKSSAAAAAAAAAAAAGPLQLQLPSALTLLPPSFTSLCLPAQNWCAKCNASFRMTSDLVYHMRSHHKKEYAMEPLVKRRREEKLKCPICNESFRERHHLSRHMTSHN

SEQ ID NO: 34006 - protein, 427 aa, Homo sapiens
  ENSP00000425149
MEDTGIQRGIWDGDAKAVQQCLTDIFTSVYTTCDIPENAIFGPCVLSHTSLYDSIAFIALKSTDKRTVPYIFRVDTSAANGSSEGLMWLRLVQSARDKEEQNLEAYIKNGQLFYRSLRRIAKDEELLVWYGKELTELLLLCPSRSHNKMNGSSPYTCLECSQRFQFEFPYVAHLRFRCPKRLHSADISPQDEQGGGVGTKDHGGGGGGGKDQQQQQQEAPLGPGPKFCKAGPLHHYPSPSPESSNPSAAAGGSSAKPSTDFHNLARELENSRGGSSCSPAQSLSSGSGSGGGGGHQEAELSPDGIATGGGKGKRKFPEEAAEGGGGAGLVGGRGRFVERPLPASKEDLVCTPQQYRASGSYFGLEENGRLFAPPSPETGEAKRSAFVEVKKAARAASLQEEGTADGAGVASEDQDAGGGGGSSTPAA

SEQ ID NO: 34007 - protein, 689 aa, Homo sapiens; identical to SEQ ID NO: 34005
  ENSP00000406998

SEQ ID NO: 34008 - protein, 689 aa, Homo sapiens; identical to SEQ ID NO: 34005
  ENSP00000339764

SEQ ID NO: 34009 - protein, 382 aa, Homo sapiens
  ENSP00000343924
MRSPLCWLLPLLILASVAQGQPTRRPRPGTGPGRRPRPRPRPTPSFPQPDEPAEPTDLPPPLPPGPPSIFPDCPRECYCPPDFPSALYCDSRNLRKVPVIPPRIHYLYLQNNFITELPVESFQNATGLRWINLDNNRIRKIDQRVLEKLPGLVFLYMEKNQLEEVPSALPRNLEQLRLSQNHISRIPPGVFSKLENLLLLDLQHNRLSDGVFKPDTFHGLKNLMQLNLAHNILRKMPPRVPTAIHQLYLDSNKIETIPNGYFKSFPNLAFIRLNYNKLTDRGLPKNSFNISNLLVLHLSHNRISSVPAINNRLEHLYLNNNSIEKINGTQICPNDLVAFHDFSSDLENVPHLRYLRLDGNYLKPPIPLDLMMCFRLLQSVVI

SEQ ID NO: 34010 - protein, 883 aa, Homo sapiens
  ENSP00000434632
  MOD_RES (1)..(1): Any amino acid
XPFSEVESILNQSFCSRRPLRLLVATKAKEIIKIPDQPDTLCFQIRGAAPPYVYAVGRGSEAMAAGLCAGQCILKVNGSNVMNDGAPEVLEHFQAFRSRREEALGLYQWIYHTHEDAQEARASQEASTEDPSGEQAQEEDQADSAFPLLSLGPRLSLCEDSPMVTLTVDNVHLEHGVVYEYVSTAGVRCHVLEKIVEPRGCFGLTAKILEAFAANDSVFVENCRRLMALSSAIVTMPHFEFRNICDTKLESIGQRIACYQEFAAQLKSRVSPPFKQAPLEPHPLCGLDFCPTNCHINLMEVSYPKTTPSVGRSFSIRFGRKPSLIGLDPEQGHLNPMSYTQHCITTMAAPSWKCLPAAEGDPQGQGLHDGSFGPASGTLGQEDRGLSFLLKQEDREIQDAYLQLFTKLDVALKEMKQYVTQINRLLSTITEPTSGGSCDASLAEEASSLPLVSEESEMDRSDHGGIKKVCFKVAEEDQEDSGHDTMSYRDSYSECNSNRDSVLSYTSVRSNSSYLGSDEMGSGDELPCDMRIPSDKQDKLHGCLEHLFNQVDSINALLKGPVMSRAFEETKHFPMNHSLQEFKQKEECTIRGRSLIQISIQEDPWNLPNSIKTLVDNIQRYVEDGKNQLLLALLKCTDTELQLRRDAIFCQALVAAVCTFSKQLLAALGYRYNNNGEYEESSRDASRKWLEQVAATGVLLHCQSLLSPATVKEERTMLEDIWVTLSELDNVTFSFKQLDENYVANTNVFYHIEGSRQALKVIFYLDSYHFSKLPSRLEGGASLRLHTALFTKGELQAWGREDHGGRAKATKHTGSQPPARPRHLPSQCWRTWRGCLLQAARPRRICSRTSTRSPWRKFSSITANSGHFTWSGLTCPRMPAPRR

SEQ ID NO: 34011 - protein, 1659 aa, Homo sapiens
  ENSP00000361009
MEAPSGSEPGGDGAGDCAHPDPRAPGAAAPSSGPGPCAAARESERQLRLRLCVLNEILGTERDYVGTLRFLQSAFLHRIRQNVADSVEKGLTEENVKVLFSNIEDILEVHKDFLAALEYCLHPEPQSQHELGNVFLKFKDKFCVYEEYCSNHEKALRLLVELNKIPTVRAFLLSCMLLGGRKTTDIPLEGYLLSPIQRICKYPLLLKELAKRTPGKHPDHPAVQSALQAMKTVCSNINETKRQMEKLEALEQLQSHIEGWEGSNLTDICTQLLLQGTLLKISAGNIQERAFFLFDNLLVYCKRKSRVTGSKKSTKRTKSINGSLYIFRGRINTEVMEVENVEDGTADYHSNGYTVTNGWKIHNTAKNKWFVCMAKTAEEKQKWLDAIIREREQRESLKLGMERDAYVMIAEKGEKLYHMMMNKKVNLIKDRRRKLSTVPKCFLGNEFVAWLLEIGEISKTEEGVNLGQALLENGIIHHVSDKHQFKNEQVMYRFRYDDGTYKARSELEDIMSKGVRLYCRLHSLYTPVIKDRDYHLKTYKSVLPGSKLVDWLLAQGDCQTREEAVALGVGLCNNGFMHHVLEKSEFRDESQYFRFHADEEMEGTSSKNKQLRNDFKLVENILAKRLLILPQEEDYGFDIEEKNKAVVVKSVQRGSLAEVAGLQVGRKIYSINEDLVFLRPFSEVESILNQSFCSRRPLRLLVATKAKEIIKIPDQPDTLCFQIRGAAPPYVYAVGRGSEAMAAGLCAGQCILKVNGSNVMNDGAPEVLEHFQAFRSRREEALGLYQWIYHTHEDAQEARASQEASTEDPSGEQAQEEDQADSAFPLLSLGPRLSLCEDSPMVTLTVDNVHLEHGVVYEYVSTAGVRCHVLEKIVEPRGCFGLTAKILEAFAANDSVFVENCRRLMALSSAIVTMPHFEFRNICDTKLESIGQRIACYQEFAAQLKSRVSPPFKQAPLEPHPLCGLDFCPTNCHINLMEVSYPKTTPSVGRSFSIRFGRKPSLIGLDPEQGHLNPMSYTQHCITTMAAPSWKCLPAAEGDPQGQGLHDGSFGPASGTLGQEDRGLSFLLKQEDREIQDAYLQLFTKLDVALKEMKQYVTQINRLLSTITEPTSGGSCDASLAEEASSLPLVSEESEMDRSDHGGIKKVCFKVAEEDQEDSGHDTMSYRDSYSECNSNRDSVLSYTSVRSNSSYLGSDEMGSGDELPCDMRIPSDKQDKLHGCLEHLFNQVDSINALLKGPVMSRAFEETKHFPMNHSLQEFKQKEECTIRGRSLIQISIQEDPWNLPNSIKTLVDNIQRYVEDGKNQLLLALLKCTDTELQLRRDAIFCQALVAAVCTFSKQLLAALGYRYNNNGEYEESSRDASRKWLEQVAATGVLLHCQSLLSPATVKEERTMLEDIWVTLSELDNVTFSFKQLDENYVANTNVFYHIEGSRQALKVIFYLDSYHFSKLPSRLEGGASLRLHTALFTKVLENVEGLPSPGSQAAEDLQQDINAQSLEKVQQYYRKLRAFYLERSNLPTDASTTAVKIDQLIRPINALDELCRLMKSFVHPKPGAAGSVGAGLIPISSELCYRLGACQMVMCGTGMQRSTLSVSLEQAAILARSHGLLPKCIMQATDIMRKQGPRVEILAKNLRVKDQMPQGAPRLYRLCQPPVDGDL

SEQ ID NO: 34012 - protein, 12 aa, Homo sapiens
  ENSP00000481444
EDGTGSPSPSLA

SEQ ID NO: 34013 - protein, 1606 aa, Homo sapiens
  ENSP00000288368
MSEDSRGDSRAESAKDLEKQLRLRVCVLSELQKTERDYVGTLEFLVSAFLHRMNQCAASKVDKNVTEETVKMLFSNIEDILAVHKEFLKVVEECLHPEPNAQQEVGTCFLHFKDKFRIYDEYCSNHEKAQKLLLELNKIRTIRTFLLNCMLLGGRKNTDVPLEGYLVTPIQRICKYPLILKELLKRTPRKHSDYAAVMEALQAMKAVCSNINEAKRQMEKLEVLEEWQSHIEGWEGSNITDTCTEMLMCGVLLKISSGNIQERVFFLFDNLLVYCKRKHRRLKNSKASTDGHRYLFRGRINTEVMEVENVDDGTADFHSSGHIVVNGWKIHNTAKNKWFVCMAKTPEEKHEWFEAILKERERRKGLKLGMEQDTWVMISEQGEKLYKMMCRQGNLIKDRKRKLTTFPKCFLGSEFVSWLLEIGEIHRPEEGVHLGQALLENGIIHHVTDKHQFKPEQMLYRFRYDDGTFYPRNEMQDVISKGVRLYCRLHSLFTPVIRDKDYHLRTYKSVVMANKLIDWLIAQGDCRTREEAMIFGVGLCDNGFMHHVLEKSEFKDEPLLFRFFSDEEMEGSNMKHRLMKHDLKVVENVIAKSLLIKSNEGSYGFGLEDKNKVPIIKLVEKGSNAEMAGMEVGKKIFAINGDLVFMRPFNEVDCFLKSCLNSRKPLRVLVSTKPRETVKIPDSADGLGFQIRGFGPSVVHAVGRGTVAAAAGLHPGQCIIKVNGINVSKETHASVIAHVTACRKYRRPTKQDSIQWVYNSIESAQEDLQKSHSKPPGDEAGDAFDCKVEEVIDKFNTMAIIDGKKEHVSLTVDNVHLEYGVVYEYDSTAGIKCNVVEKMIEPKGFFSLTAKILEALAKSDEHFVQNCTSLNSLNEVIPTDLQSKFSALCSERIEHLCQRISSYKKFSRVLKNRAWPTFKQAKSKISPLHSSDFCPTNCHVNVMEVSYPKTSTSLGSAFGVQLDSRKHNSHDKENKSSEQGKLSPMVYIQHTITTMAAPSGLSLGQQDGHGLRYLLKEEDLETQDIYQKLLGKLQTALKEVEMCVCQIDDLLSSITYSPKLERKTSEGIIPTDSDNEKGERNSKRVCFNVAGDEQEDSGHDTISNRDSYSDCNSNRNSIASFTSICSSQCSSYFHSDEMDSGDELPLSVRISHDKQDKIHSCLEHLFSQVDSITNLLKGQAVVRAFDQTKYLTPGRGLQEFQQEMEPKLSCPKRLRLHIKQDPWNLPSSVRTLAQNIRKFVEEVKCRLLLALLEYSDSETQLRRDMVFCQTLVATVCAFSEQLMAALNQMFDNSKENEMETWEASRRWLDQIANAGVLFHFQSLLSPNLTDEQAMLEDTLVALFDLEKVSFYFKPSEEEPLVANVPLTYQAEGSRQALKVYFYIDSYHFEQLPQRLKNGGGFKIHPVLFAQALESMEGYYYRDNVSVEEFQAQINAASLEKVKQYNQKLRAFYLDKSNSPPNSTSKAAYVDKLMRPLNALDELYRLVASFIRSKRTAACANTACSASGVGLLSVSSELCNRLGACHIIMCSSGVHRCTLSVTLEQAIILARSHGLPPRYIMQATDVMRKQGARVQNTAKNLGVRDRTPQSAPRLYKLCEPPPPAGEE

SEQ ID NO: 34014 - protein, 831 aa, Homo sapiens
  ENSP00000345064
MPLEMEPKMSKLAFGCQRSSTSDDDSGCALEEYAWVPPGLRPEQIQLYFACLPEEKVPYVNSPGEKHRIKQLLYQLPPHDNEVRYCQSLSEEEKKELQVFSAQRKKEALGRGTIKLLSRAVMHAVCEQCGLKINGGEVAVFASRAGPGVCWHPSCFVCFTCNELLVDLIYFYQDGKIHCGRHHAELLKPRCSACDEIIFADECTEAEGRHWHMKHFCCLECETVLGGQRYIMKDGRPFCCGCFESLYAEYCETCGEHIGVDHAQMTYDGQHWHATEACFSCAQCKASLLGCPFLPKQGQIYCSKTCSLGEDVHASDSSDSAFQSARSRDSRRSVRMGKSSRSADQCRQSLLLSPALNYKFPGLSGNADDTLSRKLDDLSLSRQGTSFASEEFWKGRVEQETPEDPEEWADHEDYMTQLLLKFGDKSLFQPQPNEMDIRASEHWISDNMVKSKTELKQNNQSLASKKYQSDMYWAQSQDGLGDSAYGSHPGPASSRRLQELELDHGASGYNHDETQWYEDSLECLSDLKPEQSVRDSMDSLALSNITGASVDGENKPRPSLYSLQNFEEMETEDCEKMSNMGTLNSSMLHRSAESLKSLSSELCPEKILPEEKPVHLPVLRRSKSQSRPQQVKFSDDVIDNGNYDIEIRQPPMSERTRRRVYNFEERGSRSHHHRRRRSRKSRSDNALNLVTERKYSPKDRLRLYTPDNYEKFIQNKSAREIQAYIQNADLYGQYAHATSDYGLQNPGMNRFLGLYGEDDDSWCSSSSSSSDSEEEGYFLGQPIPQPRPQRFAYYTDDLSSPPSALPTPQFGQRTTKSKKKKGHKGKNCIIS

SEQ ID NO: 34015 - protein, 831 aa, Homo sapiens; identical to SEQ ID NO: 34014
  ENSP00000491051

SEQ ID NO: 34016 - protein, 831 aa, Homo sapiens; identical to SEQ ID NO: 34014
  ENSP00000398947

SEQ ID NO: 34017 - protein, 831 aa, Homo sapiens; identical to SEQ ID NO: 34014
  ENSP00000491228

SEQ ID NO: 34018 - protein, 831 aa, Homo sapiens; identical to SEQ ID NO: 34014
  ENSP00000401060

SEQ ID NO: 34019 - protein, 831 aa, Homo sapiens; identical to SEQ ID NO: 34014
  ENSP00000492763

SEQ ID NO: 34020 - protein, 831 aa, Homo sapiens; identical to SEQ ID NO: 34014
  ENSP00000492644

SEQ ID NO: 34021 - protein, 831 aa, Homo sapiens; identical to SEQ ID NO: 34014
  ENSP00000448359

SEQ ID NO: 34022 - protein, 831 aa, Homo sapiens; identical to SEQ ID NO: 34014
  ENSP00000492332

SEQ ID NO: 34023 - protein, 831 aa, Homo sapiens; identical to SEQ ID NO: 34014
  ENSP00000449819

SEQ ID NO: 34024 - protein, 163 aa, Homo sapiens
  ENSP00000447870
MPLEMEPKMSKLAFGCQRSSTSDDDSGCALEEYAWVPPGLRPEQIQLYFACLPEEKVPYVNSPGEKHRIKQLLYQLPPHDNEVRYCQSLSEEEKKELQVFSAQRKKEALGRGTIKLLSRAVMHAVCEQCGLKINGGEVAVFASRAGPGVCWHPSCFVCFTCNE

SEQ ID NO: 34025 - protein, 128 aa, Homo sapiens
  ENSP00000491473
MPLEMEPKMSKLAFGCQRSSTSDDDSGCALEEYAWVPPGLRPEQIQLYFACLPEEKVPYVNSPGEKHRIKQLLYQLPPHDNEVRYCQSLSEEEKKELQVFSAQRKKEALGRGTIKLLSRAVMHAVCEQ

SEQ ID NO: 34026 - protein, 119 aa, Homo sapiens
  ENSP00000446970
MPLEMEPKMSKLAFGCQRSSTSDDDSGCALEEYAWVPPGLRPEQIQLYFACLPEEKVPYVNSPGEKHRIKQLLYQLPPHDNEVRYCQSLSEEEKKELQVFSAQRKKEALGRGTIKLLSR

SEQ ID NO: 34027 - protein, 109 aa, Homo sapiens
  ENSP00000446699
MPLEMEPKMSKLAFGCQRSSTSDDDSGCALEEYAWVPPGLRPEQIQLYFACLPEEKVPYVNSPGEKHRIKQLLYQLPPHDNEVRYCQSLSEEEKKELQVFSAQRKKEAL

SEQ ID NO: 34028 - protein, 109 aa, Homo sapiens; identical to SEQ ID NO: 34027
  ENSP00000492483

SEQ ID NO: 34029 - protein, 153 aa, Homo sapiens
  ENSP00000376848
MLLRDLVLRRGCCWSSLLLHCALHPLWGFVQVTHGEPQKSCSKVTDSCRHVCQCRPPPPLPPPPPPPPPPRLLSAPAPNSTSCPTEESWWSGLVIIIAVCCASLVFLTVLVIICYKAIKRKPLRKDENGTSVAEYPMSASQSNKGVDVNNAVV

SEQ ID NO: 34030 - protein, 124 aa, Homo sapiens
  ENSP00000434370
MLLRDLVLRRGCCWSSLLLHCALHPLWGFVQVTHGEPQKSCSKVTDSCRHVCQCRPPPPLPPPPPPPPPPRLLSAPAPNSTSCPTEESWWSGLVIIIAVCCASLVFLTVLVIICYKAIKRNHAI

SEQ ID NO: 34031 - protein, 153 aa, Homo sapiens; identical to SEQ ID NO: 34029
  ENSP00000376851

SEQ ID NO: 34032 - protein, 124 aa, Homo sapiens; identical to SEQ ID NO: 34030
  ENSP00000320948

SEQ ID NO: 34033 - protein, 153 aa, Homo sapiens; identical to SEQ ID NO: 34029
  ENSP00000486953

SEQ ID NO: 34034 - protein, 124 aa, Homo sapiens; identical to SEQ ID NO: 34030
  ENSP00000486875

SEQ ID NO: 34035 - protein, 124 aa, Homo sapiens; identical to SEQ ID NO: 34030
  ENSP00000479855

SEQ ID NO: 34036 - protein, 153 aa, Homo sapiens; identical to SEQ ID NO: 34029
  ENSP00000479082

SEQ ID NO: 34037 - protein, 569 aa, Homo sapiens
  ENSP00000287878
MGSAVMDTKKKKDVSSPGGSGGKKNASQKRRSLRVHIPDLSSFAMPLLDGDLEGSGKHSSRKVDSPFGPGSPSKGFFSRGPQPRPSSPMSAPVRPKTSPGSPKTVFPFSYQESPPRSPRRMSFSGIFRSSSKESSPNSNPATSPGGIRFFSRSRKTSGLSSSPSTPTQVTKQHTFPLESYKHEPERLENRIYASSSPPDTGQRFCPSSFQSPTRPPLASPTHYAPSKAAALAAALGPAEAGMLEKLEFEDEAVEDSESGVYMRFMRSHKCYDIVPTSSKLVVFDTTLQVKKAFFALVANGVRAAPLWESKKQSFVGMLTITDFINILHRYYKSPMVQIYELEEHKIETWRELYLQETFKPLVNISPDASLFDAVYSLIKNKIHRLPVIDPISGNALYILTHKRILKFLQLFMSDMPKPAFMKQNLDELGIGTYHNIAFIHPDTPIIKALNIFVERRISALPVVDESGKVVDIYSKFDVINLAAEKTYNNLDITVTQALQHRSQYFEGVVKCNKLEILETIVDRIVRAEVHRLVVVNEADSIVGIISLSDILQALILTPAGAKQKETETE

SEQ ID NO: 34038 - protein, 328 aa, Homo sapiens
  ENSP00000387386
MLEKLEFEDEAVEDSESGVYMRFMRSHKCYDIVPTSSKLVVFDTTLQVKKAFFALVANGVRAAPLWESKKQSFVGMLTITDFINILHRYYKSPMVQIYELEEHKIETWRELYLQETFKPLVNISPDASLFDAVYSLIKNKIHRLPVIDPISGNALYILTHKRILKFLQLFMSDMPKPAFMKQNLDELGIGTYHNIAFIHPDTPIIKALNIFVERRISALPVVDESGKVVDIYSKFDVINLAAEKTYNNLDITVTQALQHRSQYFEGVVKCNKLEILETIVDRIVRAEVHRLVVVNEADSIVGIISLSDILQALILTPAGAKQKETETE

SEQ ID NO: 34039 - protein, 445 aa, Homo sapiens
  ENSP00000419577
MKRFGSLRSNKKHKDQNRSTERRQSEPHGLFASGLSSSPSTPTQVTKQHTFPLESYKHEPERLENRIYASSSPPDTGQRFCPSSFQSPTRPPLASPTHYAPSKAAALAAALGPAEAGMLEKLEFEDEAVEDSESGVYMRFMRSHKCYDIVPTSSKLVVFDTTLQVKKAFFALVANGVRAAPLWESKKQSFVGMLTITDFINILHRYYKSPMVQIYELEEHKIETWRELYLQETFKPLVNISPDASLFDAVYSLIKNKIHRLPVIDPISGNALYILTHKRILKFLQLFMSDMPKPAFMKQNLDELGIGTYHNIAFIHPDTPIIKALNIFVERRISALPVVDESGKVVDIYSKFDVINLAAEKTYNNLDITVTQALQHRSQYFEGVVKCNKLEILETIVDRIVRAEVHRLVVVNEADSIVGIISLSDILQALILTPAGAKQKETETE

SEQ ID NO: 34040 - protein, 525 aa, Homo sapiens
  ENSP00000376549
MPLLDGDLEGSGKHSSRKVDSPFGPGSPSKGFFSRGPQPRPSSPMSAPVRPKTSPGSPKTVFPFSYQESPPRSPRRMSFSGIFRSSSKESSPNSNPATSPGGIRFFSRSRKTSGLSSSPSTPTQVTKQHTFPLESYKHEPERLENRIYASSSPPDTGQRFCPSSFQSPTRPPLASPTHYAPSKAAALAAALGPAEAGMLEKLEFEDEAVEDSESGVYMRFMRSHKCYDIVPTSSKLVVFDTTLQVKKAFFALVANGVRAAPLWESKKQSFVGMLTITDFINILHRYYKSPMVQIYELEEHKIETWRELYLQETFKPLVNISPDASLFDAVYSLIKNKIHRLPVIDPISGNALYILTHKRILKFLQLFMSDMPKPAFMKQNLDELGIGTYHNIAFIHPDTPIIKALNIFVERRISALPVVDESGKVVDIYSKFDVINLAAEKTYNNLDITVTQALQHRSQYFEGVVKCNKLEILETIVDRIVRAEVHRLVVVNEADSIVGIISLSDILQALILTPAGAKQKETETE

SEQ ID NO: 34041 - protein, 118 aa, Homo sapiens
  ENSP00000420645
MLTITDFINILHRYYKSPMVQIYELEEHKIETWRELYLQETFKPLVNISPDASLFDAVYSLIKNKIHRLPVIDPISGNALYILTHKRILKFLQLFVHQEDGINYTLYKRCLICQSLPS

SEQ ID NO: 34042 - protein, 229 aa, Homo sapiens
  ENSP00000420783
MGSAVMDTKKKKDVSSPGGSGGKKNASQKRRSLRVHIPDLSSFAMPLLDGDLEGSGKHSSRKVDSPFGPGSPSKGFFSRGPQPRPSSPMSAPVRPKTSPGSPKTVFPFSYQESPPRSPRRMSFSGIFRSSSKESSPNSNPATSPGGIRFFSRSRKTSGLSSSPSTPTQVTKQHTFPLESYKHEPERLENRIYASSSPPDTGQRFCPSSFQSPTRPPLASPTHYAPSKAQ

SEQ ID NO: 34043 - protein, 163 aa, Homo sapiens
  ENSP00000419493
MLEKLEFEDEAVEDSESGVYMRFMRSHKCYDIVPTSSKLVVFDTTLQVKKAFFALVANGVRAAPLWESKKQSFVGMLTITDFINILHRYYKSPMVQIYELEEHKIETWRELYLQETFKPLVNISPDASLFDAVYSLIKNKIHRLPVIDPISGNALYILTHKRI

SEQ ID NO: 34044 - protein, 52 aa, Homo sapiens
  ENSP00000417252
MLEKLEFEDEARCQGALIVCACHHALGGNPESYPQSRPFNHRLVPLSAPVKI

SEQ ID NO: 34045 - protein, 489 aa, Homo sapiens
  ENSP00000233944
MEPGLEHALRRTPSWSSLGGSEHQEMSFLEQENSSSWPSPAVTSSSERIRGKRRAKALRWTRQKSVEEGEPPGQGEGPRSRPAAESTGLEATFPKTTPLAQADPAGVGTPPTGWDCLPSDCTASAAGSSTDDVELATEFPATEAWECELEGLLEERPALCLSPQAPFPKLGWDDELRKPGAQIYMRFMQEHTCYDAMATSSKLVIFDTMLEIKKAFFALVANGVRAAPLWDSKKQSFVGMLTITDFILVLHRYYRSPLVQIYEIEQHKIETWREIYLQGCFKPLVSISPNDSLFEAVYTLIKNRIHRLPVLDPVSGNVLHILTHKRLLKFLHIFGSLLPRPSFLYRTIQDLGIGTFRDLAVVLETAPILTALDIFVDRRVSALPVVNECGQVVGLYSRFDVIHLAAQQTYNHLDMSVGEALRQRTLCLEGVLSCQPHESLGEVIDRIAREQVHRLVLVDETQHLLGVVSLSDILQALVLSPAGIDALGA

SEQ ID NO: 34046 - protein, 489 aa, Homo sapiens; identical to SEQ ID NO: 34045
  ENSP00000436068

SEQ ID NO: 34047 - protein, 353 aa, Homo sapiens
  ENSP00000419272
MEPGLEHALRRTPSWSSLGGSEHQEMSFLEQENSSSWPSPAVTSSSERIRGKRRAKALRWTRQKSVEEGEPPGQGEGPRSRPAAESTGLEATFPKTTPLAQADPAGVGTPPTGWDCLPSDCTASAAGSSTDDVELATEFPATEAWECELEGLLEERPALCLSPQAPFPKLGWDDELRKPGAQIYMRFMQEHTCYDAMATSSKLVIFDTMLEIKKAFFALVANGVRAAPLWDSKKQSFVGMLTITDFILVLHRYYRSPLRSTCKAASSLWSPSLLMIACLKLSTPSSRTGSIACLFLTRCQATYSTSSHTNACSSSCTSLVPCCPGPPSSTALSKIWASAHSETWLWCWRQHPS

SEQ ID NO: 34048 - protein, 100 aa, Homo sapiens
  ENSP00000416100
MEPGLEHALRRTPSWSSLGGSEHQEMSFLEQENSSSWPSPAVTSSSERIRGKRRAKALRWTRQKSVEEGEPPGPRSRPAAESTGLEATFPKTTPLAQADP

SEQ ID NO: 34049 - protein, 489 aa, Homo sapiens; identical to SEQ ID NO: 34045
  ENSP00000397133

SEQ ID NO: 34050 - protein, 671 aa, Homo sapiens
  ENSP00000318315
MADPAAGPPPSEGEESTVRFARKGALRQKNVHEVKNHKFTARFFKQPTFCSHCTDFIWGFGKQGFQCQVCCFVVHKRCHEFVTFSCPGADKGPASDDPRSKHKFKIHTYSSPTFCDHCGSLLYGLIHQGMKCDTCMMNVHKRCVMNVPSLCGTDHTERRGRIYIQAHIDRDVLIVLVRDAKNLVPMDPNGLSDPYVKLKLIPDPKSESKQKTKTIKCSLNPEWNETFRFQLKESDKDRRLSVEIWDWDLTSRNDFMGSLSFGISELQKASVDGWFKLLSQEEGEYFNVPVPPEGSEANEELRQKFERAKISQGTKVPEEKTTNTVSKFDNNGNRDRMKLTDFNFLMVLGKGSFGKVMLSERKGTDELYAVKILKKDVVIQDDDVECTMVEKRVLALPGKPPFLTQLHSCFQTMDRLYFVMEYVNGGDLMYHIQQVGRFKEPHAVFYAAEIAIGLFFLQSKGIIYRDLKLDNVMLDSEGHIKIADFGMCKENIWDGVTTKTFCGTPDYIAPEIIAYQPYGKSVDWWAFGVLLYEMLAGQAPFEGEDEDELFQSIMEHNVAYPKSMSKEAVAICKGLMTKHPGKRLGCGPEGERDIKEHAFFRYIDWEKLERKEIQPPYKPKARDKRDTSNFDKEFTRQPVELTPTDKLFIMNLDQNEFAGFSYTNPEFVINV

SEQ ID NO: 34051 - protein, 673 aa, Homo sapiens
  ENSP00000305355
MADPAAGPPPSEGEESTVRFARKGALRQKNVHEVKNHKFTARFFKQPTFCSHCTDFIWGFGKQGFQCQVCCFVVHKRCHEFVTFSCPGADKGPASDDPRSKHKFKIHTYSSPTFCDHCGSLLYGLIHQGMKCDTCMMNVHKRCVMNVPSLCGTDHTERRGRIYIQAHIDRDVLIVLVRDAKNLVPMDPNGLSDPYVKLKLIPDPKSESKQKTKTIKCSLNPEWNETFRFQLKESDKDRRLSVEIWDWDLTSRNDFMGSLSFGISELQKASVDGWFKLLSQEEGEYFNVPVPPEGSEANEELRQKFERAKISQGTKVPEEKTTNTVSKFDNNGNRDRMKLTDFNFLMVLGKGSFGKVMLSERKGTDELYAVKILKKDVVIQDDDVECTMVEKRVLALPGKPPFLTQLHSCFQTMDRLYFVMEYVNGGDLMYHIQQVGRFKEPHAVFYAAEIAIGLFFLQSKGIIYRDLKLDNVMLDSEGHIKIADFGMCKENIWDGVTTKTFCGTPDYIAPEIIAYQPYGKSVDWWAFGVLLYEMLAGQAPFEGEDEDELFQSIMEHNVAYPKSMSKEAVAICKGLMTKHPGKRLGCGPEGERDIKEHAFFRYIDWEKLERKEIQPPYKPKACGRNAENFDRFFTRHPPVLTPPDQEVIRNIDQSEFEGFSFVNSEFLKPEVKS

SEQ ID NO: 34052 - protein, 57 aa, Homo sapiens
  ENSP00000454428
MADPAAGPPPSEGEESTVRFARKGALRQKNVHEVKNHKFTARFFKQPTFCSHCTDFI

SEQ ID NO: 34053 - protein, 119 aa, Homo sapiens
  ENSP00000459227
MDPNGLSDPYVKLKLIPDPKSESKQKTKTIKCSLNPEWNETFRFQLKESDKDRRLSVEIWDWDLTSRNDFMGSLSFGISELQKASVDGWFKLLSQEEGEYFNVPVPPEGSEANEELRQK

SEQ ID NO: 34054 - protein, 130 aa, Homo sapiens
  ENSP00000457980
MGVMLSERKGTDELYAVKILKKDVVIQDDDVECTMVEKRVLALPGKPPFLTQLHSCFQTMDRLYFVMEYVNGGDLMYHIQQVGRFKEPHAVFYAAEIAIGLFFLQSKGIIYRDLKLDNVMLDSEGHIKIA

SEQ ID NO: 34055 - protein, 122 aa, Homo sapiens
  ENSP00000458564
  MOD_RES (1)..(1): Any amino acid
XSMSKEAVAICKGLMTKHPGKRLGCGPEGERDIKEHAFFRYIDWEKLERKEIQPPYKPKAVSSPFSLTAGYSHTRYSCLCLMFSKCSLRGRRQCVYWNMGVCIHTYAQNHWLLRWTFSIGPA

SEQ ID NO: 34056 - protein, 77 aa, Homo sapiens
  ENSP00000419726
MAPFLRIAFNSYELGSLQAEDEANQPFCAVKMKEALSTERGKTLVQKKPTMYPEWKSTFDAHIYEGRVIQIVLMRAA

SEQ ID NO: 34057 - protein, 676 aa, Homo sapiens
  ENSP00000378217
MAPFLRIAFNSYELGSLQAEDEANQPFCAVKMKEALSTERGKTLVQKKPTMYPEWKSTFDAHIYEGRVIQIVLMRAAEEPVSEVTVGVSVLAERCKKNNGKAEFWLDLQPQAKVLMSVQYFLEDVDCKQSMRSEDEAKFPTMNRRGAIKQAKIHYIKNHEFIATFFGQPTFCSVCKDFVWGLNKQGYKCRQCNAAIHKKCIDKIIGRCTGTAANSRDTIFQKERFNIDMPHRFKVHNYMSPTFCDHCGSLLWGLVKQGLKCEDCGMNVHHKCREKVANLCGINQKLLAEALNQVTQRASRRSDSASSEPVGIYQGFEKKTGVAGEDMQDNSGTYGKIWEGSSKCNINNFIFHKVLGKGSFGKVLLGELKGRGEYFAIKALKKDVVLIDDDVECTMVEKRVLTLAAENPFLTHLICTFQTKDHLFFVMEFLNGGDLMYHIQDKGRFELYRATFYAAEIMCGLQFLHSKGIIYRDLKLDNVLLDRDGHIKIADFGMCKENIFGESRASTFCGTPDYIAPEILQGLKYTFSVDWWSFGVLLYEMLIGQSPFHGDDEDELFESIRVDTPHYPRWITKESKDILEKLFEREPTKRLGVTGNIKIHPFFKTINWTLLEKRRLEPPFRPKVKSPRDYSNFDQEFLNEKARLSYSDKNLIDSMDQSAFAGFSFVNPKFEHLLED

SEQ ID NO: 34058 - protein, 676 aa, Homo sapiens; identical to SEQ ID NO: 34057
  ENSP00000331602

SEQ ID NO: 34059 - protein, 125 aa, Homo sapiens
  ENSP00000418106
MAPFLRIAFNSYELGSLQAEDEANQPFCAVKMKEALSTERGKTLVQKKPTMYPEWKSTFDAHIYEGRVIQIVLMRAAEEPVSEVTVGVSVLAERCKKNNGKAEFWLDLQPQAKVLMSVQYFLEDV

SEQ ID NO: 34060 - protein, 223 aa, Homo sapiens
  ENSP00000419629
MAPFLRIAFNSYELGSLQAEDEANQPFCAVKMKEALSTERGKTLVQKKPTMYPEWKSTFDAHIYEGRVIQIVLMRAAEEPVSEVTVGVSVLAERCKKNNGKAEFWLDLQPQAKVLMSVQYFLEDVDCKQSMRSEDEAKFPTMNRRGAIKQAKIHYIKNHEFIATFFGQPTFCSVCKDFVWGLNKQGYKCRHCGMNVHHKCREKVANLCGINQKLLAEALNQVT

SEQ ID NO: 34061 - protein, 19 aa, Homo sapiens
  ENSP00000471544
MKCSCCEMNVHRRCVRSVP

SEQ ID NO: 34062 - protein, 99 aa, Homo sapiens
  ENSP00000471271
MKCSCCEMNVHRRCVRSVPSLCGVDHTERRGRLQLEIRAPTADEIHVTVGEARNLIPMDPNGLSDPYVKLKLIPDPRNLTKQKTRTVKATLNPVWNETF

SEQ ID NO: 34063 - protein, 697 aa, Homo sapiens
  ENSP00000263431
MAGLGPGVGDSEGGPRPLFCRKGALRQKVVHEVKSHKFTARFFKQPTFCSHCTDFIWGIGKQGLQCQVCSFVVHRRCHEFVTFECPGAGKGPQTDDPRNKHKFRLHSYSSPTFCDHCGSLLYGLVHQGMKCSCCEMNVHRRCVRSVPSLCGVDHTERRGRLQLEIRAPTADEIHVTVGEARNLIPMDPNGLSDPYVKLKLIPDPRNLTKQKTRTVKATLNPVWNETFVFNLKPGDVERRLSVEVWDWDRTSRNDFMGAMSFGVSELLKAPVDGWYKLLNQEEGEYYNVPVADADNCSLLQKFEACNYPLELYERVRMGPSSSPIPSPSPSPTDPKRCFFGASPGRLHISDFSFLMVLGKGSFGKVMLAERRGSDELYAIKILKKDVIVQDDDVDCTLVEKRVLALGGRGPGGRPHFLTQLHSTFQTPDRLYFVMEYVTGGDLMYHIQQLGKFKEPHAAFYAAEIAIGLFFLHNQGIIYRDLKLDNVMLDAEGHIKITDFGMCKENVFPGTTTRTFCGTPDYIAPEIIAYQPYGKSVDWWSFGVLLYEMLAGQPPFDGEDEEELFQAIMEQTVTYPKSLSREAVAICKGFLTKHPGKRLGSGPDGEPTIRAHGFFRWIDWERLERLEIPPPFRPRPCGRSGENFDKFFTRAAPALTPPDRLVLASIDQADFQGFTYVNPDFVHPDARSPTSPVPVPVM

SEQ ID NO: 34064 - protein, 35 aa, Homo sapiens
  ENSP00000387919
MKCSCCEMNVHRRCVRSVPSLCGVDHTERRGRLQL

SEQ ID NO: 34065 - protein, 581 aa, Homo sapiens
  ENSP00000441752
MDTKDMNEFETEGFFALHQRRGAIKQAKVHHVKCHEFTATFFPQPTFCSVCHEFVWGLNKQGYQCRQCNAAIHKKCIDKVIAKCTGSAINSRETMFHKERFKIDMPHRFKVYNYKSPTFCEHCGTLLWGLARQGLKCDACGMNVHHRCQTKVANLCGINQKLMAEALAMIESTQQARCLRDTEQIFREGPVEIGLPCSIKNEARPPCLPTPGKREPQGISWESPLDEVDKMCHLPEPELNKERPSLQIKLKIEDFILHKMLGKGSFGKVFLAEFKKTNQFFAIKALKKDVVLMDDDVECTMVEKRVLSLAWEHPFLTHMFCTFQTKENLFFVMEYLNGGDLMYHIQSCHKFDLSRATFYAAEIILGLQFLHSKGIVYRDLKLDNILLDKDGHIKIADFGMCKENMLGDAKTNTFCGTPDYIAPEILLGQKYNHSVDWWSFGVLLYEMLIGQSPFHGQDEEELFHSIRMDNPFYPRWLEKEAKDLLVKLFVREPEKRLGVRGDIRQHPLFREINWEELERKEIDPPFRPKVKSPFDCSNFDKEFLNEKPRLSFADRALINSMDQNMFRNFSFMNPGMERLIS

SEQ ID NO: 34066 - protein, 706 aa, Homo sapiens
  ENSP00000263125
MSPFLRIGLSNFDCGSCQSCQGEAVNPYCAVLVKEYVESENGQMYIQKKPTMYPPWDSTFDAHINKGRVMQIIVKGKNVDLISETTVELYSLAERCRKNNGKTEIWLELKPQGRMLMNARYFLEMSDTKDMNEFETEGFFALHQRRGAIKQAKVHHVKCHEFTATFFPQPTFCSVCHEFVWGLNKQGYQCRQCNAAIHKKCIDKVIAKCTGSAINSRETMFHKERFKIDMPHRFKVYNYKSPTFCEHCGTLLWGLARQGLKCDACGMNVHHRCQTKVANLCGINQKLMAEALAMIESTQQARCLRDTEQIFREGPVEIGLPCSIKNEARPPCLPTPGKREPQGISWESPLDEVDKMCHLPEPELNKERPSLQIKLKIEDFILHKMLGKGSFGKVFLAEFKKTNQFFAIKALKKDVVLMDDDVECTMVEKRVLSLAWEHPFLTHMFCTFQTKENLFFVMEYLNGGDLMYHIQSCHKFDLSRATFYAAEIILGLQFLHSKGIVYRDLKLDNILLDKDGHIKIADFGMCKENMLGDAKTNTFCGTPDYIAPEILLGQKYNHSVDWWSFGVLLYEMLIGQSPFHGQDEEELFHSIRMDNPFYPRWLEKEAKDLLVKLFVREPEKRLGVRGDIRQHPLFREINWEELERKEIDPPFRPKVKSPFDCSNFDKEFLNEKPRLSFADRALINSMDQNMFRNFSFMNPGMERLIS

SEQ ID NO: 34067 - protein, 670 aa, Homo sapiens [sequence omitted]

SEQ ID NO: 34068 - protein, 643 aa, Homo sapiens
  ENSP00000380361
MSPFLRIGLSNFDCGSCQSCQGEAVNPYCAVLVKEYVESENGQMYIQKKPTMYPPWDSTFDAHINKGRVMQIIVKGKNVDLISETTVELYSLAERCRKNNGKTEIWLELKPQGRMLMNARYFLEMSDTKDMNEFETEGFFALHQRRGAIKQAKVHHVKCHEFTATFFPQPTFCSVCHEFVWGLNKQGYQCRQCNAAIHKKCIDKVIAKCTGSAINSRETMFHKERFKIDMPHRFKVYNYKSPTFCEHCGTLLWGLARQGLKCDACGMNVHHRCQTKVANLCGINQKLMAEALAMIESTQQARCLRDTEQIFREGPVEIGLPCSIKNEARPPCLPTPGKREPQGISWESPLDEVDKMCHLPEPELNKERPSLQIKLKIEDFILHKMLGKGSFGKVFLAEFKKTNQFFAIKALKKDVVLMDDDVECTMVEKRVLSLAWEHPFLTHMFCTFQTKENLFFVMEYLNGGDLMYHIQSCHKFDLSRATFYAAEIILGLQFLHSKGIVYRDLKLDNILLDKDGHIKIADFGMCKENMLGDAKTNTFCGTPDYIAPELFVREPEKRLGVRGDIRQHPLFREINWEELERKEIDPPFRPKVKSPFDCSNFDKEFLNEKPRLSFADRALINSMDQNMFRNFSFMNPGMERLIS

SEQ ID NO: 34069 - protein, 890 aa, Homo sapiens
  ENSP00000368356
MSANNSPPSAQKSVLPTAIPAVLPAASPCSSPKTGLSARLSNGSFSAPSLTNSRGSVHTVSFLLQIGLTRESVTIEAQELSLSAVKDLVCSIVYQKFPECGFFGMYDKILLFRHDMNSENILQLITSADEIHEGDLVEVVLSALATVEDFQIRPHTLYVHSYKAPTFCDYCGEMLWGLVRQGLKCEGCGLNYHKRCAFKIPNNCSGVRKRRLSNVSLPGPGLSVPRPLQPEYVALPSEESHVHQEPSKRIPSWSGRPIWMEKMVMCRVKVPHTFAVHSYTRPTICQYCKRLLKGLFRQGMQCKDCKFNCHKRCASKVPRDCLGEVTFNGEPSSLGTDTDIPMDIDNNDINSDSSRGLDDTEEPSPPEDKMFFLDPSDLDVERDEEAVKTISPSTSNNIPLMRVVQSIKHTKRKSSTMVKEGWMVHYTSRDNLRKRHYWRLDSKCLTLFQNESGSKYYKEIPLSEILRISSPRDFTNISQGSNPHCFEIITDTMVYFVGENNGDSSHNPVLAATGVGLDVAQSWEKAIRQALMPVTPQASVCTSPGQGKDHKDLSTSISVSNCQIQENVDISTVYQIFADEVLGSGQFGIVYGGKHRKTGRDVAIKVIDKMRFPTKQESQLRNEVAILQNLHHPGIVNLECMFETPERVFVVMEKLHGDMLEMILSSEKSRLPERITKFMVTQILVALRNLHFKNIVHCDLKPENVLLASAEPFPQVKLCDFGFARIIGEKSFRRSVVGTPAYLAPEVLRSKGYNRSLDMWSVGVIIYVSLSGTFPFNEDEDINDQIQNAAFMYPPNPWREISGEAIDLINNLLQVKMRKRYSVDKSLSHPWLQDYQTWLDLREFETRIGERYITHESDDARWEIHAYTHNLVYPKHFIMAPNPDDMEEDP

SEQ ID NO: 34070 - protein, 185 aa, Homo sapiens
  ENSP00000399540
  MOD_RES (1)..(1): Any amino acid
XTSISVSNCQIQENVDISTVYQIFADEVLGSGQFGIVYGGKHRKTGRDVAIKVIDKMRFPTKQESQLRNEVAILQILVALRNLHFKNIVHCDLKPENVLLASAEPFPQVKLCDFGFARIIGEKSFRRSVVGTPAYLAPEVLRSKGYNRSLDMWSVGVIIYVSLSGTFPFNEDEDINDQIQNAAFM

SEQ ID NO: 34071 - protein, 172 aa, Homo sapiens
  ENSP00000398743
TDTMVYFVGENNGDSSHNPVLAATGVGLDVAQSWEKAIRQALMPVTPQASVCTSPGQGKDHKDLSTSISVSNCQIQENVDISTVYQIFADEVLGSGQFGIVYGDLSVLRVVTSLEDFLSSEEQRTVRGKHRKTGRDVAIKVIDKMRFPTKQESQLRNEVAILQNLHHPGIVN

SEQ ID NO: 34072 - protein, 181 aa, Homo sapiens
  ENSP00000401839
MYDKILLFRHDMNSENILQLITSADEIHEGDLVEVVLSALATVEDFQIRPHTLYVHSYKAPTFCDYCGEMLWGLVRQGLKCEGCGLNYHKRCAFKIPNNCSGVRKRRLSNVSLPGPGLSVPRPLQPEYVALPSEESHVHQEPSKRIPSWSGRPIWMEKMVMCRVKVPHTFAVHSYTRPTIC

SEQ ID NO: 34073 - protein, 890 aa, Homo sapiens; identical to SEQ ID NO: 34069
  ENSP00000234179

SEQ ID NO: 34074 - protein, 671 aa, Homo sapiens
  ENSP00000363097
MSELEEDFAKILMLKEERIKELEKRLSEKEEEIQELKRKLHKCQSVLPVPSTHIGPRTTRAQGISAEPQTYRSFHDLRQAFRKFTKSERSKDLIKEAILDNDFMKNLELSQIQEIVDCMYPVEYGKDSCIIKEGDVGSLVYVMEDGKVEVTKEGVKLCTMGPGKVFGELAILYNCTRTATVKTLVNVKLWAIDRQCFQTIMMRTGLIKHTEYMEFLKSVPTFQSLPEEILSKLADVLEETHYENGEYIIRQGARGDTFFIISKGTVNVTREDSPSEDPVFLRTLGKGDWFGEKALQGEDVRTANVIAAEAVTCLVIDRDSFKHLIGGLDDVSNKAYEDAEAKAKYEAEAAFFANLKLSDFNIIDTLGVGGFGRVELVQLKSEESKTFAMKILKKRHIVDTRQQEHIRSEKQIMQGAHSDFIVRLYRTFKDSKYLYMLMEACLGGELWTILRDRGSFEDSTTRFYTACVVEAFAYLHSKGIIYRDLKPENLILDHRGYAKLVDFGFAKKIGFGKKTWTFCGTPEYVAPEIILNKGHDISADYWSLGILMYELLTGSPPFSGPDPMKTYNIILRGIDMIEFPKKIAKNAANLIKKLCRDNPSERLGNLKNGVKDIQKHKWFEGFNWEGLRKGTLTPPIIPSVASPTDTSNFDSFPEDNDEPPPDDNSGWDIDF

SEQ ID NO: 34075 - protein, 686 aa, Homo sapiens
  ENSP00000363092
MGTLRDLQYALQEKIEELRQRDALIDELELELDQKDELIQKLQNELDKYRSVIRPATQQAQKQSASTLQGEPRTKRQAISAEPTAFDIQDLSHVTLPFYPKSPQSKDLIKEAILDNDFMKNLELSQIQEIVDCMYPVEYGKDSCIIKEGDVGSLVYVMEDGKVEVTKEGVKLCTMGPGKVFGELAILYNCTRTATVKTLVNVKLWAIDRQCFQTIMMRTGLIKHTEYMEFLKSVPTFQSLPEEILSKLADVLEETHYENGEYIIRQGARGDTFFIISKGTVNVTREDSPSEDPVFLRTLGKGDWFGEKALQGEDVRTANVIAAEAVTCLVIDRDSFKHLIGGLDDVSNKAYEDAEAKAKYEAEAAFFANLKLSDFNIIDTLGVGGFGRVELVQLKSEESKTFAMKILKKRHIVDTRQQEHIRSEKQIMQGAHSDFIVRLYRTFKDSKYLYMLMEACLGGELWTILRDRGSFEDSTTRFYTACVVEAFAYLHSKGIIYRDLKPENLILDHRGYAKLVDFGFAKKIGFGKKTWTFCGTPEYVAPEIILNKGHDISADYWSLGILMYELLTGSPPFSGPDPMKTYNIILRGIDMIEFPKKIAKNAANLIKKLCRDNPSERLGNLKNGVKDIQKHKWFEGFNWEGLRKGTLTPPIIPSVASPTDTSNFDSFPEDNDEPPPDDNSGWDIDF

SEQ ID NO: 34076 - protein, 181 aa, Homo sapiens
  ENSP00000363087
SCIIKEGDVGSLVYVMEDGKVEVTKEGVKLCTMGPGKVFGELAILYNCTRTATVKTLVNVKLWAIDRQCFQTIMMRTGLIKHTEYMEFLKSVPTFQSLPEEILSKLADVLEETHYENGEYIIRQGARGDTFFIISKGTVNVTREDSPSEDPVFLRTLGKGDWFGEKALQGWTWNLFEYVVE

SEQ ID NO: 34077 - protein, 459 aa, Homo sapiens
  ENSP00000384200
MEFLKSVPTFQSLPEEILSKLADVLEETHYENGEYIIRQGARGDTFFIISKGTVNVTREDSPSEDPVFLRTLGKGDWFGEKALQGEDVRTANVIAAEAVTCLVIDRDSFKHLIGGLDDVSNKAYEDAEAKAKYEAEAAFFANLKLSDFNIIDTLGVGGFGRVELVQLKSEESKTFAMKILKKRHIVDTRQQEHIRSEKQIMQGAHSDFIVRLYRTFKDSKYLYMLMEACLGGELWTILRDRGSFEDSTTRFYTACVVEAFAYLHSKGIIYRDLKPENLILDHRGYAKLVDFGFAKKIGFGKKTWTFCGTPEYVAPEIILNKGHDISADYWSLGILMYELLTGSPPFSGPDPMKTYNIILRGIDMIEFPKKIAKNAANLIKKLCRDNPSERLGNLKNGVKDIQKHKWFEGFNWEGLRKGTLTPPIIPSVASPTDTSNFDSFPEDNDEPPPDDNSGWDIDF

SEQ ID NO: 34078 - protein, 762 aa, Homo sapiens
  ENSP00000378945
MGNGSVKPKHSKHPDGHSGNLTTDALRNKVTELERELRRKDAEIQEREYHLKELREQLSKQTVAIAELTEELQNKCIQLNKLQDVVHMQGGSPLQASPDKVPLEVHRKTSGLVSLHSRRGAKAGVSAEPTTRTYDLNKPPEFSFEKARVRKDSSEKKLITDALNKNQFLKRLDPQQIKDMVECMYGRNYQQGSYIIKQGEPGNHIFVLAEGRLEVFQGEKLLSSIPMWTTFGELAILYNCTRTASVKAITNVKTWALDREVFQNIMRRTAQARDEQYRNFLRSVSLLKNLPEDKLTKIIDCLEVEYYDKGDYIIREGEEGSTFFILAKGKVKVTQSTEGHDQPQLIKTLQKGEYFGEKALISDDVRSANIIAEENDVACLVIDRETFNQTVGTFEELQKYLEGYVANLNRDDEKRHAKRSMSNWKLSKALSLEMIQLKEKVARFSSSSPFQNLEIIATLGVGGFGRVELVKVKNENVAFAMKCIRKKHIVDTKQQEHVYSEKRILEELCSPFIVKLYRTFKDNKYVYMLLEACLGGELWSILRDRGSFDEPTSKFCVACVTEAFDYLHRLGIIYRDLKPENLILDAEGYLKLVDFGFAKKIGSGQKTWTFCGTPEYVAPEVILNKGHDFSVDFWSLGILVYELLTGNPPFSGVDQMMTYNLILKGIEKMDFPRKITRRPEDLIRRLCRQNPTERLGNLKNGINDIKKHRWLNGFNWEGLKARSLPSPLQRELKGPIDHSYFDKYPPEKGMPPDELSGWDKDF

SEQ ID NO: 34079 - protein, 733 aa, Homo sapiens
  ENSP00000486129
MGNGSVKPKHSKHPDGHSGNLTTDALRNKVTELERELRRKDAEIQEREYHLKELREQLSKQTVAIAELTEELQNKCIQLNKLQDVVHMQGGSPLQASPDKVPLEVHRKTSGLVSLHSRRGAKAGVSAEPTTRTYDLNKPPEFSFEKARVRKDSSEKKLITDALNKNQFLKRLDPQQIKDMVECMYGRNYQQGSYIIKQGEPGNHIFVLAEGRLEVFQGEKLLSSIPMWTTFGELAILYNCTRTASVKAITNVKTWALDREVFQNIMRRTAQARDEQYRNFLRSVSLLKNLPEDKLTKIIDCLEVEYYDKGDYIIREGEEGSTFFILAKGKVKVTQSTEGHDQPQLIKTLQKGEYFGEKALISDDVRSANIIAEENDVACLVIDRETFNQTVGTFEELQKYLEGYVANLNRDDEKRHAKRSMSNWKLSKALSLEMIQLKEKVKVKNENVAFAMKCIRKKHIVDTKQQEHVYSEKRILEELCSPFIVKLYRTFKDNKYVYMLLEACLGGELWSILRDRGSFDEPTSKFCVACVTEAFDYLHRLGIIYRDLKPENLILDAEGYLKLVDFGFAKKIGSGQKTWTFCGTPEYVAPEVILNKGHDFSVDFWSLGILVYELLTGNPPFSGVDQMMTYNLILKGIEKMDFPRKITRRPEDLIRRLCRQNPTERLGNLKNGINDIKKHRWLNGFNWEGLKARSLPSPLQRELKGPIDHSYFDKYPPEKGMPPDELSGWDKDF

SEQ ID NO: 34080 - protein, 342 aa, Homo sapiens
  ENSP00000439967
MSNWKLSKALSLEMIQLKEKVARFSSSSPFQNLEIIATLGVGGFGRVELVKVKNENVAFAMKCIRKKHIVDTKQQEHVYSEKRILEELCSPFIVKLYRTFKDNKYVYMLLEACLGGELWSILRDRGSFDEPTSKFCVACVTEAFDYLHRLGIIYRDLKPENLILDAEGYLKLVDFGFAKKIGSGQKTWTFCGTPEYVAPEVILNKGHDFSVDFWSLGILVYELLTGNPPFSGVDQMMTYNLILKGIEKMDFPRKITRRPEDLIRRLCRQNPTERLGNLKNGINDIKKHRWLNGFNWEGLKARSLPSPLQRELKGPIDHSYFDKYPPEKGMPPDELSGWDKDF

SEQ ID NO: 34081 - protein, 762 aa, Homo sapiens; identical to SEQ ID NO: 34078
  ENSP00000264399

SEQ ID NO: 34082 - protein, 385 aa, Homo sapiens
  ENSP00000414507
MESLASDGFKLKEVSSVNSPPSQPPQPVVPAKPVQCVHHVSTQPSCPGRGKMSKLLNPEEMTSRDYYFDSYAHFGIHEEMLKDEVRTLTYRNSMYHNKHVFKDKVVLDVGSGTGILSMFAAKAGAKKVFGIECSSISDYSEKIIKANHLDNIITIFKGKVEEVELPVEKVDIIISEWMGYCLFYESMLNTVIFARDKWLKPGGLMFPDRAALYVVAIEDRQYKDFKIHWWENVYGFDMTCIRDVAMKEPLVDIVDPKQVVTNACLIKEVDIYTVKTEELSFTSAFCLQIQRNDYVHALVTYFNIEFTKCHKKMGFSTAPDAPYTHWKQTVFYLEDYLTVRRGEEIYGTISMKPNAKNVRDLDFTVDLDFKGQLCETSVSNDYKMR

SEQ ID NO: 34083 - protein, 394 aa, Homo sapiens
  ENSP00000372067
MGMKHSSRCLLLRRKMAENAAESTEVNSPPSQPPQPVVPAKPVQCVHHVSTQPSCPGRGKMSKLLNPEEMTSRDYYFDSYAHFGIHEEMLKDEVRTLTYRNSMYHNKHVFKDKVVLDVGSGTGILSMFAAKAGAKKVFGIECSSISDYSEKIIKANHLDNIITIFKGKVEEVELPVEKVDIIISEWMGYCLFYESMLNTVIFARDKWLKPGGLMFPDRAALYVVAIEDRQYKDFKIHWWENVYGFDMTCIRDVAMKEPLVDIVDPKQVVTNACLIKEVDIYTVKTEELSFTSAFCLQIQRNDYVHALVTYFNIEFTKCHKKMGFSTAPDAPYTHWKQTVFYLEDYLTVRRGEEIYGTISMKPNAKNVRDLDFTVDLDFKGQLCETSVSNDYKMR

SEQ ID NO: 34084 - protein, 845 aa, Homo sapiens
  ENSP00000314396
MSNSRPRSRRDAGGGAGAAGRDELVSRSLQSAEHCLGVQDFGTAYAHYLLVLSLAPELKHDVKETFQYTLFRWAEELDALSRIQDLLGCYEQALELFPDDEVICNSMGEHLFRMGFRDEAAGYFHKAVKLNPDFSDAKENFYRVANWLVERWHFIMLNDTKRNTIYNAAIQKAVCLGSKSVLDIGAGTGILSMFAKKAGAHSVYACELSKTMYELACDVVAANKMEAGIKLLHTKSLDIEIPKHIPERVSLVVTETVDAGLFGEGIVESLIHAWEHLLLQPKTKGESANCEKYGKVIPASAVIFGMAVECAEIRRHHRVGIKDIAGIHLPTNVKFQSPAYSSVDTEETIEPYTTEKMSRVPGGYLALTECFEIMTVDFNNLQELKSLATKKPDKIGIPVIKEGILDAIMVWFVLQLDDEHSLSTSPSEETCWEQAVYPVQDLADYWIKPGDHVMMEVSCQDCYLRIQSISVLGLECEMDVAKSFTQNKDLLSLGNEAELCSALANLQTSKPDAVEQTCILESTEIALLNNIPYHEGFKMAMSKVLSSLTPEKLYQTMDTHCQNEMSSGTGQSNTVQNILEPFYVLDVSEGFSVLPVIAGTLGQVKPYSSVEKDQHRIALDLISEANHFPKETLEFWLRHVEDESAMLQRPKSDKLWSIIILDVIEPSGLIQQEIMEKAAISRCLLQSGGKIFPQYVLMFGLLVESQTLLEENAVQGTERTLGLNIAPFINQFQVPIRVFLDLSSLPCIPLSKPVELLRLDLMTPYLNTSNREVKVYVCKSGRLTAIPFWYHMYLDEEIRLDTSSEASHWKQAAVVLDNPIQVEMGEELVLSIQHHKSNVSITVKQ

SEQ ID NO: 34085 - protein, 66 aa, Homo sapiens
  ENSP00000426732
MSNSRPRSRRDAGGGAGAAGRDELVSRSLQSAEHCLGVQDFGTAYAHYLLVLSLAPELKHDVKNGL

SEQ ID NO: 34086 - protein, 253 aa, Homo sapiens
  ENSP00000368752
MANLGCWMLVLFVATWSDLGLCKKRPKPGGWNTGGSRYPGQGSPGGNRYPPQGGGGWGQPHGGGWGQPHGGGWGQPHGGGWGQPHGGGWGQGGGTHSQWNKPSKPKTNMKHMAGAAAAGAVVGGLGGYMLGSAMSRPIIHFGSDYEDRYYRENMHRYPNQVYYRPMDEYSNQNNFVHDCVNITIKQHTVTTTTKGENFTETDVKMMERVVEQMCITQYERESQAYYQRGSSMVLFSSPPVILLISFLIFLIVG

SEQ ID NO: 34087 - protein, 253 aa, Homo sapiens; identical to SEQ ID NO: 34086
  ENSP00000399376

SEQ ID NO: 34088 - protein, 249 aa, Homo sapiens
  ENSP00000411599
MANLGCWMLVLFVATWSDLGLCKKRPKPGGWNTGGSRYPGQGSPGGNRYPPQGGGGWGQPHGGGWGQPHGGGWGQPHGGGWGQPHGGGWGQGGGTHSQWNKPSKPKTNMKHMAGAAAAGAVVGGLGGYMLGSAMSRPIIHFGSDYEDRYYRENMHRYPNQVYYRPMDEYSNQNNFVHDCVNITIKQHTVTTTTKGENFTETDVKMMERVVEQMCITQYERESQAYYQRGSSMVLFSSPPVILLISFLIF

SEQ ID NO: 34089 - protein, 217 aa, Homo sapiens
  ENSP00000415284
MANLGCWMLVLFVATWSDLGLCKKRPKPGGWNTGGSRYPGQGSPGGNRYPPQGGGGWGQPHGGGWGQPHGGGWGQPHGGGWGQPHGGGWGQGGGTHSQWNKPSKPKTNMKHMAGAAAAGAVVGGLGGYMLGSAMSRPIIHFGSDYEDRYYRENMHRYPNQVYYRPMDEYSNQNNFVHDCVNITIKQHTVTTTTKGENFTETDVKMMERVVEQMCITQ

SEQ ID NO: 34090 - protein, 238 aa, Homo sapiens
  ENSP00000216968
MLTTLLPILLLSGWAFCSQDASDGLQRLHMLQISYFRDPYHVWYQGNASLGGHLTHVLEGPDTNTTIIQLQPLQEPESWARTQSGLQSYLLQFHGLVRLVHQERTLAFPLTIRCFLGCELPPEGSRAHVFFEVAVNGSSFVSFRPERALWQADTQVTSGVVTFTLQQLNAYNRTRYELREFLEDTCVQYVQKHISAENTKGSQTSRSYTSLVLGVLVGSFIIAGVAVGIFLCTGGRRC

SEQ ID NO: 34091 - protein, 213 aa, Homo sapiens
  ENSP00000489117
  MOD_RES (1)..(1): Any amino acid
XYFRDPYHVWYQGNASLGGHLTHVLEGPDTNTTIIQLQPLQEPESWARTQSGLQSYLLQFHGLVRLVHQERTLAFPLTIRCFLGCELPPEGSRAHVFFEVAVNGSSFVSFRPERALWQADTQVTSGVVTFTLQQLNAYNRTRYELREFLEDTCVQYVQKHISAENTKDNGVGAGSLWPILQRQTESPEAFKRYNQINKSSTIKIQHSILPDLY

SEQ ID NO: 34092 - protein, 34 aa, Homo sapiens
  ENSP00000489456
AYNRTRYELREFLEDTCVQYVQKHISAENTKDLY

SEQ ID NO: 34093 - protein, 492 aa, Homo sapiens
  ENSP00000410805
MKMTFYGHFVAGEDQESIQPLLRHYRAFGVSAILDYGVEEDLSPEEAEHKEMESCTSAAERDGSGTNKRDKQYQAHWAFGDRRNGVISARTYFYANEAKCDSHMETFLRCIEASGRVSDDGFIAIKLTALGRPQFLLQFSEVLAKWRCFFHQMAVEQGQAGLAAMDTKLEVAVLQESVAKLGIASRAEIEDWFTAETLGVSGTMDLLDWSSLIDSRTKLSKHLVVPNAQTGQLEPLLSRFTEEEELQMTRMLQRMDVLAKKATEMGVRLMVDAEQTYFQPAISRLTLEMQRKFNVEKPLIFNTYQCYLKDAYDNVTLDVELARREGWCFGAKLVRGAYLAQERARAAEIGYEDPINPTYEATNAMYHRCLDYVLEELKHNAKAKVMVASHNEDTVRFALRRMEELGLHPADHRVYFGQLLGMCDQISFPLGQAGYPVYKYVPYGPVMEVLPYLSRRALENSSLMKGTHRERQLLWLELLRRLRTGNLFHRPA

SEQ ID NO: 34094 - protein, 492 aa, Homo sapiens; identical to SEQ ID NO: 34093
  ENSP00000334726

SEQ ID NO: 34095 - protein, 600 aa, Homo sapiens
  ENSP00000349577
MALRRALPALRPCIPRFVPLSTAPASREQPAAGPAAVPGGGSATAVRPPVPAVDFGNAQEAYRSRRTWELARSLLVLRLCAWPALLARHEQLLYVSRKLLGQRLFNKLMKMTFYGHFVAGEDQESIQPLLRHYRAFGVSAILDYGVEEDLSPEEAEHKEMESCTSAAERDGSGTNKRDKQYQAHWAFGDRRNGVISARTYFYANEAKCDSHMETFLRCIEASGRVSDDGFIAIKLTALGRPQFLLQFSEVLAKWRCFFHQMAVEQGQAGLAAMDTKLEVAVLQESVAKLGIASRAEIEDWFTAETLGVSGTMDLLDWSSLIDSRTKLSKHLVVPNAQTGQLEPLLSRFTEEEELQMTRMLQRMDVLAKKATEMGVRLMVDAEQTYFQPAISRLTLEMQRKFNVEKPLIFNTYQCYLKDAYDNVTLDVELARREGWCFGAKLVRGAYLAQERARAAEIGYEDPINPTYEATNAMYHRCLDYVLEELKHNAKAKVMVASHNEDTVRFALRRMEELGLHPADHRVYFGQLLGMCDQISFPLGQAGYPVYKYVPYGPVMEVLPYLSRRALENSSLMKGTHRERQLLWLELLRRLRTGNLFHRPA

SEQ ID NO: 34096 - protein, 185 aa, Homo sapiens
  ENSP00000409742
  MOD_RES (1)..(1): Any amino acid
XGARRGLRQRAGGVPQPANLGAGAEPAGAALVRLARAAGAPRAGPAPQLRRGMAVARISGTSNTRPTGPSGTAGMVSSVPAPTSTPMRPSATATWRHSCAASKPQLQFSEVLAKWRCFFHQMAVEQGQAGLAAMDTKLEVAVLQESVAKLGIASRAEIEDWFTAETLGVSGTMDLLDWSSLIDSR

SEQ ID NO: 34097 - protein, 135 aa, Homo sapiens
  ENSP00000396806
MESCTSAAERDGSGTNKRDKQYQAHWAFGDRRNGVISARTYFYANEAKCDSHMETFLRCIEASGRVSDDGFIAIKLTALGRPQFLLQFSEVLAKWRCFFHQMAVEQGQAGLAAMDTKLEVAVLQESVAKLGIASR

SEQ ID NO: 34098 - protein, 164 aa, Homo sapiens
  ENSP00000413941
  MOD_RES (1)..(1): Any amino acid
XRAAPLHSPLRPAVHGAGLPRAARSGPSGRARRWVGHGSAAAGARRGLRQRAGGVPQPANLGAGAEPAGAALVRLARAAGAPRAGPAPQLRRGMAVARISGTSNTRPTGPSGTAGMVSSVPAPTSTPMRPSATATWRHSCAASKPQLQFSEVLAKWRCFFHQMA

SEQ ID NO: 34099 - protein, 600 aa, Homo sapiens; identical to SEQ ID NO: 34095
  ENSP00000480347

SEQ ID NO: 34100 - protein, 230 aa, Homo sapiens
  ENSP00000419517
MPDHDSTALLSRQTKRRRVDIGVKRTVGTASAFFAKARATFFSAMNPQGSEQDVEYSVVQHADGEKSNVLRKLLKRANSYEDAMMPFPGATIISQLLKNNMNKNGGTEPSFQASGLSSTGSEVHQEDICSNSSRDSPPECLSPFGRPTMSQFDMDRLCDEHLRAKRARVENIIRGMSHSPSVALRGNENEREMAPQSVSPRESYRENKRKQKLPQQQQQSFQQLVSARKE

SEQ ID NO: 34101 - protein, 737 aa, Homo sapiens
  ENSP00000355925
MPDHDSTALLSRQTKRRRVDIGVKRTVGTASAFFAKARATFFSAMNPQGSEQDVEYSVVQHADGEKSNVLRKLLKRANSYEDAMMPFPGATIISQLLKNNMNKNGGTEPSFQASGLSSTGSEVHQEDICSNSSRDSPPECLSPFGRPTMSQFDMDRLCDEHLRAKRARVENIIRGMSHSPSVALRGNENEREMAPQSVSPRESYRENKRKQKLPQQQQQSFQQLVSARKEQKREERRQLKQQLEDMQKQLRQLQEKFYQIYDSTDSENDEDGNLSEDSMRSEILDARAQDSVGRSDNEMCELDPGQFIDRARALIREQEMAENKPKREGNNKERDHGPNSLQPEGKHLAETLKQELNTAMSQVVDTVVKVFSAKPSRQVPQVFPPLQIPQARFAVNGENHNFHTANQRLQCFGDVIIPNPLDTFGNVQMASSTDQTEALPLVVRKNSSDQSASGPAAGGHHQPLHQSPLSATTGFTTSTFRHPFPLPLMAYPFQSPLGAPSGSFSGKDRASPESLDLTRDTTSLRTKMSSHHLSHHPCSPAHPPSTAEGLSLSLIKSECGDLQDMSEISPYSGSAMQEGLSPNHLKKAKLMFFYTRYPSSNMLKTYFSDVKFNRCITSQLIKWFSNFREFYYIQMEKYARQAINDGVTSTEELSITRDCELYRALNMHYNKANDFEVPERFLEVAQITLREFFNAIIAGKDVDPSWKKAIYKVICKLDSEVPEIFKSPNCLQELLHE

SEQ ID NO: 34102 - protein, 737 aa, Homo sapiens; identical to SEQ ID NO: 34101
  ENSP00000400694

SEQ ID NO: 34103 - protein, 143 aa, Homo sapiens
  ENSP00000475357
MPDHDSTALLSRQTKRRRVDIGVKRTVGTASAFFAKARATFFSAMNPQGSEQDVEYSVVQHADGEKSNVLRKLLKRANSYEDAMMPFPGATIISQLLKNNMNKNGGTEPSFQASGLSSTGSEVHQEDICSNSSRDSPPECLSP

SEQ ID NO: 34104 - protein, 737 aa, Homo sapiens; identical to SEQ ID NO: 34101
  ENSP00000420283

SEQ ID NO: 34105 - protein, 737 aa, Homo sapiens; identical to SEQ ID NO: 34101
  ENSP00000261454

SEQ ID NO: 34106 - protein, 267 aa, Homo sapiens
  ENSP00000400925
MSSPSLSDLGKREPAAAADERGTQQRRACANATWNSIHNGVIAVFQRKGLPDQELFSLNEGVRQLLKTELGSFFTEYLQNQLLTKGMVILRDKIRFYEGQKLLDSLAETWDFFFSDVLPMLQAIFYPVQGKEPSVRQLALLHFRNAITLSVKLEDALARAHARVPPAIVQMLLVLQGVHESRGVTEDYLRLETLVQKVVSPYLGTYGLHSSEGPFTHSCILEKRLLRRSRSGDVLAKNPVVRSKSYNTPLLNPVQEHEAEGAAAGGT

SEQ ID NO: 34107 - protein, 379 aa, Homo sapiens
  ENSP00000006251
MSSPSLSDLGKREPAAAADERGTQQRRACANATWNSIHNGVIAVFQRKGLPDQELFSLNEGVRQLLKTELGSFFTEYLQNQLLTKGMVILRDKIRFYEGQKLLDSLAETWDFFFSDVLPMLQAIFYPVQGKEPSVRQLALLHFRNAITLSVKLEDALARAHARVPPAIVQMLLVLQGVHESRGVTEDYLRLETLVQKVVSPYLGTYGLHSSEGPFTHSCILEKRLLRRSRSGDVLAKNPVVRSKSYNTPLLNPVQEHEAEGAAAGGTSIRRHSVSEMTSCPEPQGFSDPPGQGPTGTFRSSPAPHSGPCPSRLYPTTQPPEQGLDPTRSSLPRSSPENLVDQILESVDSDSEGIFIDFGRGRGSGMSDLEGSGGRQSVV

SEQ ID NO: 34108 - protein, 411 aa, Homo sapiens
  ENSP00000384848
MVCLELSQREAWGSGSPEKMPAQPEGLYRLKFMSSPSLSDLGKREPAAAADERGTQQRRACANATWNSIHNGVIAVFQRKGLPDQELFSLNEGVRQLLKTELGSFFTEYLQNQLLTKGMVILRDKIRFYEGQKLLDSLAETWDFFFSDVLPMLQAIFYPVQGKEPSVRQLALLHFRNAITLSVKLEDALARAHARVPPAIVQMLLVLQGVHESRGVTEDYLRLETLVQKVVSPYLGTYGLHSSEGPFTHSCILEKRLLRRSRSGDVLAKNPVVRSKSYNTPLLNPVQEHEAEGAAAGGTSIRRHSVSEMTSCPEPQGFSDPPGQGPTGTFRSSPAPHSGPCPSRLYPTTQPPEQGLDPTRSSLPRSSPENLVDQILESVDSDSEGIFIDFGRGRGSGMSDLEGSGGRQSVV

SEQ ID NO: 34109 - protein, 388 aa, Homo sapiens
  ENSP00000337464
MRTLRRLKFMSSPSLSDLGKREPAAAADERGTQQRRACANATWNSIHNGVIAVFQRKGLPDQELFSLNEGVRQLLKTELGSFFTEYLQNQLLTKGMVILRDKIRFYEGQKLLDSLAETWDFFFSDVLPMLQAIFYPVQGKEPSVRQLALLHFRNAITLSVKLEDALARAHARVPPAIVQMLLVLQGVHESRGVTEDYLRLETLVQKVVSPYLGTYGLHSSEGPFTHSCILEKRLLRRSRSGDVLAKNPVVRSKSYNTPLLNPVQEHEAEGAAAGGTSIRRHSVSEMTSCPEPQGFSDPPGQGPTGTFRSSPAPHSGPCPSRLYPTTQPPEQGLDPTRSSLPRSSPENLVDQILESVDSDSEGIFIDFGRGRGSGMSDLEGSGGRQSVV

SEQ ID NO: 34110 - protein, 177 aa, Homo sapiens
  ENSP00000384746
MRTLRRLKFMSSPSLSDLGKREPAAAADERGTQQRRACANATWNSIHNGVIAVFQRKGLPDQELFSLNEGVRQLLKTELGSFFTEYLQNQLLTKGMVILRDKIRFYEGICPRQSGPVVMAPMPTGQKLLDSLAETWDFFFSDVLPMLQAIFYPVQGKEPSVRQLALLHFRNAITLSV

SEQ ID NO: 34111 - protein, 226 aa, Homo sapiens
  ENSP00000410215
MSSPSLSDLGKREPAAAADERGTQQRRACANATWNSIHNGVIAVFQRKGLPDQELFSLNEGVRQLLKTELGSFFTEYLQNQLLTKGMVILRDKIRFYEGQKLLDSLAETWDFFFSDVLPMLQAIFYPVQGKEPSVRQLALLHFRNAITLSVKLEDALARAHARVPPAIVQMLLVLQGVHESRGVTEDYLRLETLVQKVVSPYLGTYGLHSSEGPFTHSCILEKRLL

SEQ ID NO: 34112 - protein, 122 aa, Homo sapiens
  ENSP00000407637
MRTLRRLKFMSSPSLSDLGKREPAAAADERGTQQRRACANATWNSIHNGVIAVFQRKGLPDQELFSLNEGVRQLLKTELGSFFTEYLQNQLLTKGMVILRDKIRFYEEAAGLTGRDLGLLLQ

SEQ ID NO: 34113 - protein, 113 aa, Homo sapiens
  ENSP00000392026
MSSPSLSDLGKREPAAAADERGTQQRRACANATWNSIHNGVIAVFQRKGLPDQELFSLNEGVRQLLKTELGSFFTEYLQNQLLTKGMVILRDKIRFYEEAAGLTGRDLGLLLQ

SEQ ID NO: 34114 - protein, 379 aa, Homo sapiens; identical to SEQ ID NO: 34107
  ENSP00000480357

SEQ ID NO: 34115 - protein, 293 aa, Homo sapiens
  ENSP00000485597
MVILRDKIRFYEGQKLLDSLAETWDFFFSDVLPMLQAIFYPVQGKEPSVRQLALLHFRNAITLSVKLEDALARAHARVPPAIVQMLLVLQGVHESRGVTEDYLRLETLVQKVVSPYLGTYGLHSSEGPFTHSCILEKRLLRRSRSGDVLAKNPVVRSKSYNTPLLNPVQEHEAEGAAAGGTSIRRHSVSEMTSCPEPQGFSDPPGQGPTGTFRSSPAPHSGPCPSRLYPTTQPPEQGLDPTRSSLPRSSPENLVDQILESVDSDSEGIFIDFGRGRGSGMSDLEGSGGRQSVV

SEQ ID NO: 34116 - protein, 293 aa, Homo sapiens; identical to SEQ ID NO: 34115
  ENSP00000479623

SEQ ID NO: 34117 - protein, 368 aa, Homo sapiens
  ENSP00000435050
MTRGFAPILPVEFHKMGSFRRPRPRFMSSPVLSDLPRFQAARQALQLSSSSAWNSVQTAVINVFKGGGLQSNELYALNENIRRLLKSELGSFITDYFQNQLLAKGLFFVEEKIKLCEGENRIEVLAEVWDHFFTETLPTLQAIFYPVQGQELTIRQISLLGFRDLVLLKVKLGDLLLLAQSKLPSSIVQMLLILQSVHEPTGPSESYLQLEELVKQVVSPFLGISGDRSFSGPTYTLARRHSRVRPKVTVLNYASPITAVSRPLNEMVLTPLTEQEGEAYLEKCGSVRRHTVANAHSDIQLLAMATMMHSGLGEEASSENKCLLLPPSFPPPHRQCSSEPNITDNPDGLEEGARGSQEGSELNCASLS

SEQ ID NO: 34118 - protein, 47 aa, Homo sapiens
  ENSP00000433708
MTRGFAPILPVEFHKMGSFRRPRPRFMSSPVLSDLPRFQAARQALQL

SEQ ID NO: 34119 - protein, 83 aa, Homo sapiens
  ENSP00000433893
MTRGFAPILPVEFHKMGSFRRPRPRFMSSPVLSDLPRFQAARQALQLSSSSAWNSVQTAVINVFKGGGLQSNELYALNENIRR

SEQ ID NO: 34120 - protein, 75 aa, Homo sapiens
  ENSP00000431610
MTRGFAPILPVEFHKMGSFRRPRPRFMSSPVLSDLPRFQAARQALQLSSSSAWNSVQTAVINVFKGGGLQSNELY

SEQ ID NO: 34121 - protein, 368 aa, Homo sapiens; identical to SEQ ID NO: 34117
  ENSP00000368144

SEQ ID NO: 34122 - protein, 48 aa, Homo sapiens
  ENSP00000433305
MTRGFAPILPVEFHKMGSFRRPRPRFMSSPVLSDLPRFQAARQALQLS

SEQ ID NO: 34123 - protein, 63 aa, Homo sapiens
  ENSP00000436485
MTRGFAPILPVEFHKMGSFRRPRPRFMSSPVLSDLPRFQAARQALQLSSSSAWNSVQTAVINV

SEQ ID NO: 34124 - protein, 49 aa, Homo sapiens
  ENSP00000431475
MTRGFAPILPVEFHKMGSFRRPRPRFMSSPVLSDLPRFQAARQALQLSS

SEQ ID NO: 34125 - protein, 75 aa, Homo sapiens; identical to SEQ ID NO: 34120
  ENSP00000432203

SEQ ID NO: 34126 - protein, 80 aa, Homo sapiens
  ENSP00000436402
MTRGFAPILPVEFHKMGSFRRPRPRFMSSPVLSDLPRFQAARQALQLSSSSAWNSVQTAVINVFKGGGLQSNELYALNEN

SEQ ID NO: 34127 - protein, 205 aa, Homo sapiens
  ENSP00000435241
MTRGFAPILPVEFHKMGSFRRPRPRFMSSPVLSDLPRFQAARQALQLSSSSAWNSVQTAVINVFKGGGLQSNELYALNENIRRLLKSELGSFITDYFQNQLLAKGLFFVEEKIKLCEGENRIEVLAEVWDHFFTETLPTLQAIFYPVQGQELTIRQISLLGFRDLVLLKVKLGDLLLLAQSKLPSSIVQMLLILQPGGTPGSGPR

SEQ ID NO: 34128 - protein, 445 aa, Homo sapiens
  ENSP00000296666
MMEESGIETTPPGTPPPNPAGLAATAMSSTPVPLAATSSFSSPNVSSMESFPPLAYSTPQPPLPPVRPSAPLPFVPPPAVPSVPPLVTSMPPPVSPSTAAAFGNPPVSHFPPSTSAPNTLLPAPPSGPPISGFSVGSTYDITRGHAGRAPQTPLMPSFSAPSGTGLLPTPITQQASLTSLAQGTGTTSAITFPEEQEDPRITRGQDEASAGGIWGFIKGVAGNPMVKSVLDKTKHSVESMITTLDPGMAPYIKSGGELDIVVTSNKEVKVAAVRDAFQEVFGLAVVVGEAGQSNIAPQPVGYAAGLKGAQERIDSLRRTGVIHEKQTAVSVENFIAELLPDKWFDIGCLVVEDPVHGIHLETFTQATPVPLEFVQQAQSLTPQDYNLRWSGLLVTVGEVLEKSLLNVSRTDWHMAFTGMSRRQMIYSAARAIAGMYKQRLPPRTV

SEQ ID NO: 34129 - protein, 418 aa, Homo sapiens
  ENSP00000392873
MMEESGIETTPPGTPPPNPAGLAATAMSSTPVPLAATSSFSSPNVSSMESFPPLAYSTPQPPLPPVRPSAPLPFVPPPAVPSVPPLVTSMPPPVSPSTAAAFGNPPVSHFPPSTSAPNTLLPAPPSGPPISGFSVGSTYDITRGHAGRAPQTPLMPSFSAPSGTGLLPTPITQQASLTSLAQGTGTTSAITFPEEQEDPRITRGQDEASAGGIWGFIKGVAGNPMVKSVLDKTKHSVESMITTLDPGMAPYIKSGGELDIVVTSNKEVKVAAVRDAFQEVFGLAVVVGEAGQSNIAPQPVGYAAGLKGAQERIDSLRRTGVIHEKQTAVSVENFIAELLPDKWFDIGCLVVEDPVHGIHLETFTQATPVPLEFVQQVGFLLCFFIMLQRNLHYCFQNKNLFGFFVRNMFLILFQSFFF

SEQ ID NO: 34130 - protein, 462 aa, Homo sapiens
  ENSP00000421965
MMEESGIETTPPGTPPPNPAGLAATAMSSTPVPLAATSSFSSPNVSSMESFPPLAYSTPQPPLPPVRPSAPLPFVPPPAVPSVPPLVTSMPPPVSPSTAAAFGNPPVSHFPPSTSAPNTLLPAPPSGPPISGFSVGSTYDITRGHAGRAPQTPLMPSFSAPSGTGLLPTPITQQASLTSLAQGTGTTSAITFPEEQEDPRITRGQDEASAGGIWGFIKGVAGNPMVKSVLDKTKHSVESMITTLDPGMAPYIKSGGELDIVVTSNKEVKVAAVRDAFQEVFGLAVVVGEAGQSNIAPQPVGYAAGLKGAQERIDSLRRTGVIHEKQTAVSVENFIAELLPDKWFDIGCLVVEDPVHGIHLETFTQATPVPLEFVQQAQSLTPQDYNLRWSGLLVTVGEVLEKSLLNVSRTDWHMAFTGMSRRQMIYSAARAIADDYFPRIPKEQWQSMAWLKLEIFLPLVTW

SEQ ID NO: 34131 - protein, 52 aa, Homo sapiens
  ENSP00000411509
MAVFLEAKDAHSVLKRFPRANEFLEELRQGTIERECMEEICSYEEVKEVFEN

SEQ ID NO: 34132 - protein, 102 aa, Homo sapiens
  ENSP00000359379
MAGLSRALSSVFLEAKDAHSVLKRFPRANEFLEELRQGTIERECMEEICSYEEVKEVFENKEKTACTTLGLVLGVGVASGIARTGPGNADQSEARKDTQPKA

SEQ ID NO: 34133 - protein, 231 aa, Homo sapiens
  ENSP00000359378
MAVFLEAKDAHSVLKRFPRANEFLEELRQGTIERECMEEICSYEEVKEVFENKEKTMEFWKGYPNAVYSVRDPSQSSDAMYVVVPLLGVALLIVIALFIIWRCQLQKATRHHPSYAQNRYLASRAGHTLPRVMVYRGTVHSQGEPSGHREAANSPQVVLGPSRGGRTTVRLESTLYLPELSLSRLSSTTPPPSYEEVTAPQESSSEEASVSYSDPPPKYEEIVAANPGADK

SEQ ID NO: 34134 - protein, 91 aa, Homo sapiens
  ENSP00000394121
DPSQSSDAMYVVVPLLGVALLIVIALFIIWRCQLQKATRHHPSYAQNRRCFAVRLAAPSFASKYSNVGAFPFRLWAASLSLARIYLTNIPK

SEQ ID NO: 34135 - protein, 231 aa, Homo sapiens; identical to SEQ ID NO: 34133
  ENSP00000440217

SEQ ID NO: 34136 - protein, 128 aa, Homo sapiens
  ENSP00000489805
MAASSSEISEMKGVEESPKVPGEGPGHSEAETGPPQVLAGVPDQPEAPQPGPNTTAAPVDSGPKAGLAPETTETPAGASETAQATDLSLSPGGESKANCSPEDPCQETVSKPEVSKEATADQGSRLES

SEQ ID NO: 34137 - protein, 106 aa, Homo sapiens
  ENSP00000454634
MAASSSEISEMKGVEESPKVPGEGPGHSEAETGPPQVLAGVPDQPEAPQPGPNTTAAPVDSGPKAGLAPETTETPAGASETAQATDLSLSPGGESKANCSPEDPCQ

SEQ ID NO: 34138 - protein, 340 aa, Homo sapiens
  ENSP00000351608
MAASSSEISEMKGVEESPKVPGEGPGHSEAETGPPQVLAGVPDQPEAPQPGPNTTAAPVDSGPKAGLAPETTETPAGASETAQATDLSLSPGGESKANCSPEDPCQETVSKPEVSKEATADQGSRLESAAPPEPAPEPAPQPDPRPDSQPTPKPALQPELPTQEDPTPEILSESVGEKQENGAVVPLQAGDGEEGPAPEPHSPPSKKSPPANGAPPRVLQQLVEEDRMRRAHSGHPGSPRGSLSRHPSSQLAGPGVEGGEGTQKPRDYIILAILSCFCPMWPVNIVAFAYAVMSRNSLQQGDVDGAQRLGRVAKLLSIVALVGGVLIIIASCVINLGVYK

SEQ ID NO: 34139 - protein, 299 aa, Homo sapiens
  ENSP00000490390
MAASSSEISEMKGVEESPKVPGEGPGHSEAETGPPQVLAGVPDQPEAPQPGPNTTAAPVDSGPKAGLAPETTETPAGASETAQATDLSLSPGGESKANCSPEDPCQETVSKPEVSKEATADQGSRLESAAPPEPAPEPAPQPDPRPDSQPTPKPALQPELPTQEDPTPEILSESVGEKQENGAVVPLQAGDGEEGPAPEPHSPPSKKSPPANGAPPRVLQQLVEEDRMRRAHSGHPGSPRGSLSRHPSSQLAGPGVEGGEGTQKPRDYIILAILSCFCPMWPVNIVAFAYAVMVSPMGP

SEQ ID NO: 34140 - protein, 145 aa, Homo sapiens
  ENSP00000489813
MAASSSEISEMKGVEESPKVPGEGPGHSEAETGPPQVLAGVPDQPEAPQPGPNTTAAPVDSGPKAGLAPETTETPAGASETAQATDLSLSPGGESKANCSPEDPCQETVSKPESRNSLQQGDVDGAQRLGRVAKLLSIVALVGGV

SEQ ID NO: 34141 - protein, 130 aa, Homo sapiens
  ENSP00000490278
MAASSSEISEMKGVEESPKVPGEGPGHSEAETGPPQVLAGVPDQPEAPQPGPNTTAAPVDSGPKAGLAPETTETPAGASETAQATDLSLSPGGESKANCSPEDPCQETVSKPEPMGPPPECCSSWLRRIE

SEQ ID NO: 34142 - protein, 394 aa, Homo sapiens
  ENSP00000456226
MAASSSEISEMKGVEESPKVPGEGPGHSEAETGPPQVLAGVPDQPEAPQPGPNTTAAPVDSGPKAGLAPETTETPAGASETAQATDLSLSPGGESKANCSPEDPCQETVSKPEVSKEATADQGSRLESAAPPEPAPEPAPQPDPRPDSQPTPKPALQPELPTQEDPTPEILSESVGEKQENGAVVPLQAGDGEEGPAPEPHSPPSKKSPPANGAPPRVLQQLVEEDRMRRAHSGHPGSPRGSLSRHPSSQLAGPGVEGGEGTQKPRDYIILAILSCFCPMWPVNIVAFAYAVMSRNSLQQGDVDGAQRLGRVAKLLSIVALVGGVLIIIASCVINLGGEWGLGTGRGGMEGLARAALLTPAPALSCLSSLPLLCLSLSPPPPVCPSLSSPTVYK

SEQ ID NO: 34143 - protein, 155 aa, Homo sapiens
  ENSP00000490207
MAASSSEISEMKGVEESPKVPGEGPGHSEAETGPPQVLAGVPDQPEAPQPGPNTTAAPVDSGPKAGLAPETTETPAGASETAQATDLSLSPGGESKANCSPEDPCQETVSKPEPAAGGRGRGPASGPGSQALKHRGAGGGSPHHHRLLRHQLRRV

SEQ ID NO: 34144 - protein, 287 aa, Homo sapiens
  ENSP00000489669
MAASSSEISEMKGVEESPKVPGEGPGHSEAETGPPQVLAGVPDQPEAPQPGPNTTAAPVDSGPKAGLAPETTETPAGASETAQATDLSLSPGGESKANCSPEDPCQETVSKPEVSKEATADQGSRLESAAPPEPAPEPAPQPDPRPDSQPTPKPALQPELPTQEDPTPEILSESVGEKQENGAVVPLQAGDGEEGPAPEPHSPPSKKSPPANGAPPRVLQQLVEEDRMRRAHSGHPGSPRGIPEQPAAGGRGRGPASGPGSQALKHRGAGGGSPHHHRLLRHQLRRV

SEQ ID NO: 34145 - protein, 299 aa, Homo sapiens; identical to SEQ ID NO: 34139
  ENSP00000300797

SEQ ID NO: 34146 - protein, 286 aa, Homo sapiens
  ENSP00000489782
MAASSSEISEMKGVEESPKVPGEGPGHSEAETGPPQVLAGVPDQPEAPQPGPNTTAAPVDSGPKAGLAPETTETPAGASETAQATDLSLSPGGESKANCSPEDPCQETVSKPEVSKEATADQGSRLESAAPPEPAPEPAPQPDPRPDSQPTPKPALQPELPTQEDPTPEILSESVGEKQENGAVVPLQAGDGEEGPAPEPHSPPSKKSPPANGAPPRVLQQLVEEDRMRRAHSGHPGSPRVPEQPAAGGRGRGPASGPGSQALKHRGAGGGSPHHHRLLRHQLRRV

SEQ ID NO: 34147 - protein, 340 aa, Homo sapiens; identical to SEQ ID NO: 34138
  ENSP00000458291

SEQ ID NO: 34148 - protein, 340 aa, Homo sapiens; identical to SEQ ID NO: 34138
  ENSP00000490826

SEQ ID NO: 34149 - protein, 118 aa, Homo sapiens
  ENSP00000489948
MAASSSEISEMKGVEESPKVPGEGPGHSEAETGPPQVLAGVPDQPEAPQPGPNTTAAPVDSGPKAGLAPETTETPAGASETAQATDLSLSPGGESKANCSPEDPCQETVSKPEVSKEA

SEQ ID NO: 34150 - protein, 33 aa, Homo sapiens
  ENSP00000489935
IIASCVINLGDFSSCWELPWAHPSPGGSPTDGP

SEQ ID NO: 34151 - protein, 429 aa, Homo sapiens
  ENSP00000419296
MARHGCLGLGLFCCVLFAATVGPQPTPSIPGAPATTLTPVPQSEASMLSLNLGLNFKFHLRGPAAVWGSPVTETQPLSLGPGQEPGEEVASGLRTDPLWELLVGSSGNSLTEWGSTEGGSKPRASSLLPESTSRRSGPSDGPTAPYQPRRSTVTWDTALMVTALPSSAPRPHQSELELKFDMALRAGAAPTLGHRTLPLLPSLRASLAEIAGRLGPFGFFGTTLSPLRNFSGLSPPGETTSTSSASGVSGSLGFLGTTLSLPPYSLERKLSSPSPLDPAASLSFASIATTSLDPTVPISGPDDLSPPASLGNPSGQPECGPGSCSVGELPEREGQPPEAPRPLFFLTLEADWAEARARWGLAWEAHVYGRLHRGLPPALPNQPATQHRGGPLQRGPACAWPLPGPCLRGRSAWARTLPHRLAGDRGQGQ

SEQ ID NO: 34152 - protein, 419 aa, Homo sapiens
  ENSP00000417878
  MOD_RES (1)..(1): Any amino acid
XSKPRASSLLPESTSRRSGPSDGPTAPYQPRRSTVTWDTALMVTALPSSAPRPHQSELELKFDMALRAGAAPTLGHRTLPLLPSLRASLAEIAGRLGPFGFFGTTLSPLRNFSGLSPPGETTSTSSASGVSGSLGFLGTTLSLPPYSLERKLSSPILACRRAAGPSSSACPRATRLRCCREAGSLGPQTRSPWGAPSLAGTRSCCSCARWQGQAQTSYSRAEVAGASKARRPTRPRPRLPLPAAITPWTSARPPQSTCDAASRRPSAARPCLRLASSRALPSRTLCLGSDSTAPPRWGPGAGPVRDQGRPLAPLRPRSSPPLGLGPQAAASHLARSADSRGTARPCCCVPAPTGPRAALWSASSVPRGPQEAAPASRPQDPTRPCPHPLATPQSLLLSCRPRRPCCRSSSWTPADRSTS

SEQ ID NO: 34153 - protein, 479 aa, Homo sapiens
  ENSP00000419282
MARHGCLGLGLFCCVLFAATVGPQPTPSIPGAPATTLTPVPQSEASMLSLNLGLNFKFHLRGPAAVWGSPVTETQPLSLGPGQEPGEEVASGLRTDPLWELLVGSSGNSLTEWGSTEGGSKPRASSLLPESTSRRSGPSDGPTAPYQPRRSTVTWDTALMVTALPSSAPRPHQSELELKFDMALRAGAAPTLGHRTLPLLPSLRASLAEIAGRLGPFGFFGTTLSPLRNFSGLSPPGETTSTSSASGVSGSLGFLGTTLSLPPYSLERKLSSPSPLDPAASLSFASIATTSLDPTVPISGPDDLSPPASLGNPSGQPECGPGSCSVGELPEREGQPPEAPRPLFFLTLEADWAEARARWGLAWEAHVYGVGALFGLVALLALLALALLPWRCPPGAPCLALLDLLLLSAGTTRAFPLFYDAYGHRDRLPALAWLLLQDLPLPCLAAGLGLACLLLARPRPPRCPTGLAALLLLGLGLAA

SEQ ID NO: 34154 - protein, 208 aa, Homo sapiens
  ENSP00000420155
MARHGCLGLGLFCCVLFAATVGPQPTPSIPGAPATTLTPVPQSEASMLSLNLGLNFKFHLRGPAAVWGSPVTETQPLSLGPGQEPGEEVASGLRTDPLWELLVGSSGNSLTEWGSTEGGSKPRASSLLPESTSRRSGPSDGPTAPYQPRRSTVTWDTALMVTALPSSAPRPHQSELELKFDMALRAGAAPTLGHRTLPLLPSLRASLA

SEQ ID NO: 34155 - protein, 205 aa, Homo sapiens
  ENSP00000419221
MARHGCLGLGLFCCVLFAATVGPQPTPSIPGAPATTLTPVPQSEASMLSLNLGLNFKFHLRGPAAVWGSPVTETQPLSLGPGQEPGEEVASGLRTDPLWELLVGSSGNSLTEWGSTEGGSKPRASSLLPESTSRRSGPSDGPTAPYQPRRSTVTWDTALMVTALPSSAPRPHQSELELKFDMALRAGAAPTLGHRTLPLLPSLRA

SEQ ID NO: 34156 - protein, 899 aa, Homo sapiens
  ENSP00000445239
MARHGCLGLGLFCCVLFAATVGPQPTPSIPGAPATTLTPVPQSEASMLSLNLGLNFKFHLRGPAAVWGSPVTETQPLSLGPGQEPGEEVASGLRTDPLWELLVGSSGNSLTEWGSTEGGSKPRASSLLPESTSRRSGPSDGPTAPYQPRRSTVTWDTALMVTALPSSAPRPHQSELELKFDMALRAGAAPTLGHRTLPLLPSLRASLAEIAGRLGPFGFFGTTLSPLRNFSGLSPPGETTSTSSASGVSGSLGFLGTTLSLPPYSLERKLSSPSPLDPAASLSFASIATTSLDPTVPISGPDDLSPPASLGNPSGQPECGPGSCSVGELPEREGQPPEAPRPLFFLTLEADWAEARARWGLAWEAHVYGVGALFGLVALLALLALALLPWRCPPGAPCLALLDLLLLSAGTTRAFPLFYDAYGHRDRLPALAWLLLQDLPLPCLAAGLGLACLLLARPRPPRCPTGLAALLLLGLGLAAAAALGSAAHRPLRPLRLASRGLHAFLAAFLSGLLLALSCWGGRRRRAGAPLGGSGFKGATPLPQGRSPFAPRESWRRAARTAPVAGTFGLLSGALQGYEVLHALGYGGQSGLEGPWPWWAFQLGLRLGEVGVALPLALLGLYPALCSPRVPPRCWAKLFRLSPGHAAPLLPGGWVTGPPDKEPLGSAIARGDAELLQLCALAGPGPDLLLQGGGCRGFEGAAANPAPSPASSPCSDYTVDFRPPSPINLRRSIEEALCSEALLAPGLFQGPAFEDALPGLGLYRTASLGTGGRASERSGEASGPAAPPELPSPGAWPAGSSVSSGSFCGLSRDSSSMLLCSSPDRPPRCPLVCVLSPPRPSGSSPSLPASGSYQALSPPSRDSPEPASELQAEEALLQEQFLDACRQIDELSVGSDTIDL

SEQ ID NO: 34157 - protein, 899 aa, Homo sapiens; identical to SEQ ID NO: 34156
  ENSP00000415026

SEQ ID NO: 34158 - protein, 217 aa, Homo sapiens
  ENSP00000356734
MTSSYGHVLERQPALGGRLDSPGNLDTLQAKKNFSVSHLLDLEEAGDMVAAQADENVGEAGRSLLESPGLTSGSDTPQQDNDQLNSEEKKKRKQRRNRTTFNSSQLQALERVFERTHYPDAFVREDLARRVNLTEARVQVWFQNRRAKFRRNERAMLANKNASLLKSYSGDVTAVEQPIVPRPAPRPTDYLSWGTASPYRSSSLPRCCLHEGLHNGF

SEQ ID NO: 34159 - protein, 245 aa, Homo sapiens
  ENSP00000239461
MTSSYGHVLERQPALGGRLDSPGNLDTLQAKKNFSVSHLLDLEEAGDMVAAQADENVGEAGRSLLESPGLTSGSDTPQQDNDQLNSEEKKKRKQRRNRTTFNSSQLQALERVFERTHYPDAFVREDLARRVNLTEARVQVWFQNRRAKFRRNERAMLANKNASLLKSYSGDVTAVEQPIVPRPAPRPTDYLSWGTASPYSAMATYSATCANNSPAQGINMANSIANLRLKAKEYSLQRNQVPTVN

SEQ ID NO: 34160 - protein, 200 aa, Homo sapiens
  ENSP00000450762
MTSSYGHVLERQPALGGRLDSPGNLDTLQAKKNFSVSHLLDLEEAGDMVAAQADENVGEAGRSLLESPGLTSGSDTPQQDNDQLNSEEKKKRKQRRNRTTFNSSQLQALERVFERTHYPDAFVREDLARRVNLTEARVQVWFQNRRAKFRRNERAMLANKNASLLKSYSGDVTAVEQPIVPRPAPRPTDYLSWGTASPYR

SEQ ID NO: 34161 - protein, 352 aa, Homo sapiens
  ENSP00000333003
MLLFSVLLLLSLVTGTQLGPRTPLPEAGVAILGRARGAHRPQPPHPPSPVSECGDRSIFEGRTRYSRITGGMEAEVGEFPWQVSIQARSEPFCGGSILNKWWILTAAHCLYSEELFPEELSVVLGTNDLTSPSMEIKEVASIILHKDFKRANMDNDIALLLLASPIKLDDLKVPICLPTQPGPATWRECWVAGWGQTNAADKNSVKTDLMKAPMVIMDWEECSKMFPKLTKNMLCAGYKNESYDACKGDSGGPLVCTPEPGEKWYQVGIISWGKSCGEKNTPGIYTSLVNYNLWIEKVTQLEGRPFNAEKRRTSVKQKPMGSPVSGVPEPGSPRSWLLLCPLSHVLFRAILY

SEQ ID NO: 34162 - protein, 276 aa, Homo sapiens
  ENSP00000430459
MLLFSVLLLLSLVTGTQLGPRTPLPEAGVAILGRARGAHRPQPPHPPSPVSECGDRSIFEGRTRYSRITGGMEAEVGEFPWQVSIQARSEPFCGGSILNKWWILTAAHCLYSEELFPEELSVVLGTNDLTSPSMEIKEVASIILHKDFKRANMDNDIALLLLASPIKLDDLKVPICLPTQPGPATWRECWVAGWGQTNAADKNSVKTDLMKAPMVIMDWEECSKMFPKLTKNMLCAGYKNESYDACKQSYFPTLQRMNTGSSQTKPPGSHTFHLQN

SEQ ID NO: 34163 - protein, 182 aa, Homo sapiens
  ENSP00000429376
  MOD_RES (1)..(1): Any amino acid
XWKPAPPSPVPSSHWMLTKCFPFSFPLSFFPPECGDRSIFEGRTRYSRITGGMEAEVGEFPWQVSIQARSEPFCGGSILNKWWILTAAHCLYSEELFPEELSVVLGTNDLTSPSMEIKEVASIILHKDFKRANMDNDIALLLLASPIKLDDLKVPICLPTQPGPATWRECWVAGWGQTNAGM

SEQ ID NO: 34164 - protein, 771 aa, Homo sapiens
  ENSP00000274710
MEEDKLLSAVPEEGDATRDPGPEPEEEPGVRNGMASEGLNSSLCSPGHERRGTPADTEEPTKDPDVAFHGLSLGLSLTNGLALGPDLNILEDSAESRPWRAGVLAEGDNASRSLYPDAEDPQLGLDGPGEPDVRDGFSATFEKILESELLRGTQYSSLDSLDGLSLTDESDSCVSFEAPLTPLIQQRARDSPEPGAGLGIGDMAFEGDMGAAGGDGELGSPLRRSISSSRSENVLSRLSLMAMPNGFHEDGPQGPGGDEDDDEEDTDKLLNSASDPSLKDGLSDSDSELSSSEGLEPGSADPLANGCQGVSEAAHRLARRLYHLEGFQRCDVARQLGKNNEFSRLVAGEYLSFFDFSGLTLDGALRTFLKAFPLMGETQERERVLTHFSRRYCQCNPDDSTSEDGIHTLTCALMLLNTDLHGHNIGKKMSCQQFIANLDQLNDGQDFAKDLLKTLYNSIKNEKLEWAIDEDELRKSLSELVDDKFGTGTKKVTRILDGGNPFLDVPQALSATTYKHGVLTRKTHADMDGKRTPRGRRGWKKFYAVLKGTILYLQKDEYRPDKALSEGDLKNAIRVHHALATRASDYSKKSNVLKLKTADWRVFLFQAPSKEEMLSWILRINLVAAIFSAPAFPAAVSSMKKFCRPLLPSCTTRLCQEEQLRSHENKLRQLTAELAEHRCHPVERGIKSKEAEEYRLKEHYLTFEKSRYETYIHLLAMKIKVGSDDLERIEARLATLEGDDPSLRKTHSSPALSQGHVTGSKTTKDATGPDT

SEQ ID NO: 34165 - protein, 310 aa, Homo sapiens
  ENSP00000358920
MEDLEEDVRFIVDETLDFGGLSPSDSREEEDITVLVTPEKPLRRGLSHRSDPNAVAPAPQGVRLSLGPLSPEKLEEILDEANRLAAQLEQCALQDRESAGEGLGPRRVKPSPRRETFVLKDSPVRDLLPTVNSLTRSTPSPSSLTPRLRSNDRKGSVRALRATSGKRPSNMKRESPTCNLFPASKSPASSPLTRSTPPVRGRAGPSGRAAASEETRAAKLRACQPNATHQPECATWQRCPTSGFSVNSKRASKTKHCRTQSAGKWTQGSCFPATKSSCHGCHSQQSAAPQESGSPRTYQVKRSGQQARLQ

SEQ ID NO: 34166 - protein, 333 aa, Homo sapiens
  ENSP00000386323
MEDLEEDVRFIVDETLDFGGLSPSDSREEEDITVLVTPEKPLRRGLSHRSDPNAVAPAPQGVRLSLGPLSPEKLEEILDEANRLAAQLEQCALQDRESAGEGLGPRRVKPSPRRETFVLKDSPVRDLLPTVNSLTRSTPSPSSLTPRLRSNDRKGSVRALRATSGKRPSNMKRESPTCNLFPASKSPASSPLTRSTPPVRGRAGPSGRAAASPPTPIRSVLAPQPSTSNSQRLPRPQGAAAKSSSQLPIPSAIPRPASRMPLTSRSVPPGRGALPPDSLSTRKGLPRPSTAGHRVRESGHKVPVSQRLNLPVMGATRSNLQPPRKVAVPGPTR

SEQ ID NO: 34167 - protein, 333 aa, Homo sapiens; identical to SEQ ID NO: 34166
  ENSP00000358923

SEQ ID NO: 34168 - protein, 363 aa, Homo sapiens
  ENSP00000474667
MEDLEEDVRFIVDETLDFGGLSPSDSREEEDITVLVTPEKPLRRGLSHRSDPNAVAPAPQGVRLSLGPLSPEKLEEILDEANRLAAQLEQCALQDRESAGEGLGPRRVKPSPRRETFVLKDSPVRDLLPTVNSLTRSTPSPSSLTPRLRSNDRKGSVRALRATSGKRPSNMKRESPTCNLFPASKSPASSPLTRSTPPVRGRAGPSGRAAASEETRAAKLRVSGSGEFVGLTLKFLHPSPPGPPTPIRSVLAPQPSTSNSQRLPRPQGAAAKSSSQLPIPSAIPRPASRMPLTSRSVPPGRGALPPDSLSTRKGLPRPSTAGHRVRESGHKVPVSQRLNLPVMGATRSNLQPPRKVAVPGPTR

SEQ ID NO: 34169 - protein, 333 aa, Homo sapiens; identical to SEQ ID NO: 34166
  ENSP00000358919

SEQ ID NO: 34170 - protein, 122 aa, Homo sapiens
  ENSP00000474682
  MOD_RES (1)..(1): Any amino acid
XKGSVRALRATSGKRPSNMKRESPTCNLFPASKSPASSPLTRSTPPVRGRAGPSGRAAASEETRAAKLRGAAAKSSSQLPIPSAIPRPASRMPLTSRSVPPGRGALPPDSLSTRKGLPRPST

SEQ ID NO: 34171 - protein, 231 aa, Homo sapiens
  ENSP00000387791
MEDLEEDVRFIVDETLDFGGLSPSDSREEEDITVLVTPEKPLRRGLSHRSDPNAVAPAPQGVRLSLGPLSPEKLEEILDEANRLAAQLEQCALQDRESAGEGLGPRRVKPSPRRETFVLKDSPVRDLLPTVNSLTRSTPSPSSLTPRLRSNDRKGSVRALRATSGKRPSNMKRESPTCNLFPASKSPASSPLTRSTPPVRGRAGPSGRAAASPPTPIRSVLAPQPSTSNSQ

SEQ ID NO: 34172 - protein, 205 aa, Homo sapiens
  ENSP00000413186
MEDLEEDVRFIVDETLDFGGLSPSDSREEEDITVLVTPEKPLRRGLSHRSDPNAVAPAPQGVRLSLGPLSPEKLEEILDEANRLAAQLEQCALQDRESAGEGLGPRRVKPSPRRETFVLKDSPVRDLLPTVNSLTRSTPSPSSLTPRLRSNDRKGSVRALRATSGKRPSNMKRESPTCNLFPASKSPASSPLTRSTPPVRGRAGP

SEQ ID NO: 34173 - protein, 333 aa, Homo sapiens; identical to SEQ ID NO: 34166
  ENSP00000358925

SEQ ID NO: 34174 - protein, 312 aa, Homo sapiens
  ENSP00000468622
MTRSLFKGNFWSADILSTIGYDNIIQHLNNGRKNCKEFEDFLKERAAIEERYGKDLLNLSRKKPCGQSEINTLKRALEVFKQQVDNVAQCHIQLAQSLREEARKMEEFREKQKLQRKKTELIMDAIHKQKSLQFKKTMDAKKNYEQKCRDKDEAEQAVSRSANLVNPKQQEKLFVKLATSKTAVEDSDKAYMLHIGTLDKVREEWQSEHIKACEAFEAQECERINFFRNALWLHVNQLSQQCVTSDEHPSCMRISTPPRRMQSQQERLQGLTWQGEDPSQFLKAHQMIPITLWLMTTVCSISKINETRAFSG

SEQ ID NO: 34175 - protein, 334 aa, Homo sapiens
  ENSP00000387261
MTRSLFKGNFWSADILSTIGYDNIIQHLNNGRKNCKEFEDFLKERAAIEERYGKDLLNLSRKKPCGQSEINTLKRALEVFKQQVDNVAQCHIQLAQSLREEARKMEEFREKQKLQRKKTELIMDAIHKQKSLQFKKTMDAKKNYEQKCRDKDEAEQAVSRSANLVNPKQQEKLFVKLATSKTAVEDSDKAYMLHIGTLDKVREEWQSEHIKACEAFEAQECERINFFRNALWLHVNQLSQQCVTSDEMYEQVRKSLEMCSIQRDIEYFVNQRKTGQIPPAPIMYENFYSSQKNAVPAGKATGPNLARRGPLPIPKSSPDDPNYSLVDDYSLLYQ

SEQ ID NO: 34176 - protein, 88 aa, Homo sapiens
  ENSP00000413169
  MOD_RES (1)..(1): Any amino acid
XFDFIVRYFFAALTVLTLLGLLHGLVLLPVLLSILGPPPEVIQMYKESPEILSPPAPQGGGLRVGSLQVNISYWKELLWCQDLRPEEI

SEQ ID NO: 34177 - protein, 1203 aa, Homo sapiens
  ENSP00000361266
MTRSPPLRELPPSYTPPARTAAPQILAGSLKAPLWLRAYFQGLLFSLGCGIQRHCGKVLFLGLLAFGALALGLRMAIIETNLEQLWVEVGSRVSQELHYTKEKLGEEAAYTSQMLIQTARQEGENILTPEALGLHLQAALTASKVQVSLYGKSWDLNKICYKSGVPLIENGMIERMIEKLFPCVILTPLDCFWEGAKLQGGSAYLPGRPDIQWTNLDPEQLLEELGPFASLEGFRELLDKAQVGQAYVGRPCLHPDDLHCPPSAPNHHSRQAPNVAHELSGGCHGFSHKFMHWQEELLLGGMARDPQGELLRAEALQSTFLLMSPRQLYEHFRGDYQTHDIGWSEEQASTVLQAWQRRFVQLAQEALPENASQQIHAFSSTTLDDILHAFSEVSAARVVGGYLLMLAYACVTMLRWDCAQSQGSVGLAGVLLVALAVASGLGLCALLGITFNAATTQVLPFLALGIGVDDVFLLAHAFTEALPGTPLQERMGECLQRTGTSVVLTSINNMAAFLMAALVPIPALRAFSLQAAIVVGCTFVAVMLVFPAILSLDLRRRHCQRLDVLCCFSSPCSAQVIQILPQELGDGTVPVGIAHLTATVQAFTHCEASSQHVVTILPPQAHLVPPPSDPLGSELFSPGGSTRDLLGQEEETRQKAACKSLPCARWNLAHFARYQFAPLLLQSHAKAIVLVLFGALLGLSLYGATLVQDGLALTDVVPRGTKEHAFLSAQLRYFSLYEVALVTQGGFDYAHSQRALFDLHQRFSSLKAVLPPPATQAPRTWLHYYRNWLQGIQAAFDQDWASGRITRHSYRNGSEDGALAYKLLIQTGDAQEPLDFSQLTTRKLVDREGLIPPELFYMGLTVWVSSDPLGLAASQANFYPPPPEWLHDKYDTTGENLRIPPAQPLEFAQFPFLLRGLQKTADFVEAIEGARAACAEAGQAGVHAYPSGSPFLFWEQYLGLRRCFLLAVCILLVCTFLVCALLLLNPWTAGLIVLVLAMMTVELFGIMGFLGIKLSAIPVVILVASVGIGVEFTVHVALGFLTTQGSRNLRAAHALEHTFAPVTDGAISTLLGLLMLAGSHFDFIVRYFFAALTVLTLLGLLHGLVLLPVLLSILGPPPEVIQMYKESPEILSPPAPQGGGLRWGASSSLPQSFARVTTSMTVAIHPPPLPGAYIHPAPDEPPWSPAATSSGNLSSRGPGPATG

SEQ ID NO: 34178 - protein, 1146 aa, Homo sapiens
  ENSP00000389703
MTRSPPLRELPPSYTPPARTAAPQILAGSLKAPLWLRAYFQGLLFSLGCGIQRHCGKVLFLGLLAFGALALGLRMAIIETNLEQLWVEVGSRVSQELHYTKEKLGEEAAYTSQMLIQTARQEGENILTPEALGLHLQAALTASKVQVSLYGKSWDLNKICYKSGVPLIENGMIERMIEKLFPCVILTPLDCFWEGAKLQGGSAYLPGRPDIQWTNLDPEQLLEELGPFASLEGFRELLDKAQVGQAYVGRPCLHPDDLHCPPSAPNHHSRQAPNVAHELSGGCHGFSHKFMHWQEELLLGGMARDPQGELLRAEALQSTFLLMSPRQLYEHFRGDYQTHDIGWSEEQASTVLQAWQRRFVQLAQEALPENASQQIHAFSSTTLDDILHAFSEVSAARVVGGYLLMLAYACVTMLRWDCAQSQGSVGLAGVLLVALAVASGLGLCALLGITFNAATTQVLPFLALGIGVDDVFLLAHAFTEALPGTPLQERMGECLQRTGTSVVLTSINNMAAFLMAALVPIPALRAFSLQAAIVVGCTFVAVMLVFPAILSLDLRRRHCQRLDVLCCFSSPCSAQVIQILPQELGDGTVPVGIAHLTATVQAFTHCEASSQHVVTILPPQAHLVPPPSDPLGSELFSPGGSTRDLLGQEEETRQKAACKSLPCARWNLAHFARYQFAPLLLQSHAKAIVLVLFGALLGLSLYGATLVQDGLALTDVVPRGTKEHAFLSAQLRYFSLYEVALVTQGGFDYAHSQRALFDLHQRFSSLKAVLPPPATQAPRTWLHYYRNWLQGIQAAFDQDWASGRITRHSYRNGSEDGALAYKLLIQTGDAQEPLDFSQLTTRKLVDREGLIPPELFYMGLTVWVSSDPLGLAASQANFYPPPPEWLHDKYDTTGENLRIPPAQPLEFAQFPFLLRGLQKTADFVEAIEGARAACAEAGQAGVHAYPSGSPFLFWEQYLGLRRCFLLAVCILLVCTFLVCALLLLNPWTAGLIVLVLAMMTVELFGIMGFLGIKLSAIPVVILVASVGIGVEFTVHVALGFLTTQGSRNLRAAHALEHTFAPVTDGAISTLLGLLMLAGSHFDFIVRYFFAALTVLTLLGLLHGLVLLPVLLSILGPPPEVIQMYKESPEILSPPAPQGGGLRPEEI

SEQ ID NO: 34179 - protein, 888 aa, Homo sapiens
  ENSP00000368666
MLRQVLHRGLRTCFSRLGHFIASHPVFFASAPVLISILLGASFSRYQVEESVEHLLAPQHSLAKIERNLVNSLFPVNRSKHRLYSDLQTPGRYGRVIVTSFQKANMLDQHHTDLILKLHAAVTKIQVPRPGFNYTFAHICILNNDKTCIVDDIVHVLEELKNARATNRTNFAITYPITHLKDGRAVYNGHQLGGVTVHSKDRVKSAEAIQLTYYLQSINSLNDMVAERWESSFCDTVRLFQKSNSKVKMYPYTSSSLREDFQKTSRVSERYLVTSLILVVTMAILCCSMQDCVRSKPWLGLLGLVTISLATLTAAGIINLTGGKYNSTFLGVPFVMLGHGLYGTFEMLSSWRKTREDQHVKERTAAVYADSMLSFSLTTAMYLVTFGIGASPFTNIEAARIFCCNSCIAIFFNYLYVLSFYGSSLVFTGYIENNYQHSIFCRKVPKPEALQEKPAWYRFLLTARFSEDTAEGEEANTYESHLLVCFLKRYYCDWITNTYVKPFVVLFYLIYISFALMGYLQVSEGSDLSNIVATATQTIEYTTAQQKYFSNYSPVIGFYIYESIEYWNTSVQEDVLEYTKGFVRISWFESYLNYLRKLNVSTGLPKKNFTDMLRNSFLKAPQFSHFQEDIIFSKKYNDEVDVVASRMFLVAKTMETNREELYDLLETLRRLSVTSKVKFIVFNPSFVYMDRYASSLGAPLHNSCISALFLLFFSAFLVADSLINVWITLTVVSVEFGVIGFMTLWKVELDCISVLCLIYGINYTIDNCAPMLSTFVLGKDFTRTKWVKNALEVHGVAILQSYLCYIVGLIPLAAVPSNLTCTLFRCLFLIAFVTFFHCFAILPVILTFLPPSKKKRKEKKNPENREEIECVEMVDIDSTRVVDQITTV

SEQ ID NO: 34180 - protein, 103 aa, Homo sapiens
  ENSP00000406663
  MOD_RES (1)..(1): Any amino acid
XERNLVNSLFPVNRSKHRLYSDLQTPGRYGRVIVTSFQKANMLDQHHTDLILKVMDYMGLLKCYPPGGKLEKTNMLKRELQQSMQTPCSPFLSPLPCTWSPLA

SEQ ID NO: 34181 - protein, 846 aa, Homo sapiens
  ENSP00000341914
MCFLRRPGAPASWIWWRMLRQVLRRGLQSFCHRLGLCVSRHPVFFLTVPAVLTITFGLSALNRFQPEGDLERLVAPSHSLAKIERSLASSLFPLDQSKSQLYSDLHTPGRYGRVILLSPTGDNILLQAEGILQTHRAVLEMKDGRNSFIGHQLGGVVEVPNSKDQRVKSARAIQITYYLQTYGSATQDLIGEKWENEFCKLIRKLQEEHQELQLYSLASFSLWRDFHKTSILARSKVLVSLVLILTTATLSSSMKDCLRSKPFLGLLGVLTVCISIITAAGIFFITDGKYNSTLLGIPFFAMGHGTKGVFELLSGWRRTKENLPFKDRIADAYSDVMVTYTMTSSLYFITFGMGASPFTNIEAVKVFCQNMCVSILLNYFYIFSFFGSCLVFAGQLEQNRYHSIFCCKIPSAEYLDRKPVWFQTVMSDGHQQTSHHETNPYQHHFIQHFLREHYNEWITNIYVKPFVVILYLIYASFSFMGCLQISDGANIINLLASDSPSVSYAMVQQKYFSNYSPVIGFYVYEPLEYWNSSVQDDLRRLCSGFTAVSWVEQYYQFLKVSNVSANNKSDFISVLQSSFLKKPEFQHFRNDIIFSKAGDESNIIASRLYLVARTSRDKQKEITEVLEKLRPLSLSKSIRFIVFNPSFVFMDHYSLSVTVPVLIAGFGVLLVLILTFFLVIHPLGNFWLILSVTSIELGVLGLMTLWNVDMDCISILCLIYTLNFAIDHCAPLLFTFVLATEHTRTQCIKSSLQDHGTAILQNVTSFLIGLVPLLFVPSNLTFTLFKCLLLTGGCTLLHCFVILPVFLTFFPPSKKHHKKKKRAKRKEREEIECIEIQENPDHVTTV

SEQ ID NO: 34182 - protein, 311 aa, Homo sapiens
  ENSP00000381722
  MOD_RES (1)..(1): Any amino acid
XCFLRRPGAPASWIWWRMLRQVLRRGLQSFCHRLGLCVSRHPVFFLTVPAVLTITFGLSALNRFQPEGDLERLVAPSHSLAKIERSLASSLFPLDQSKSQLYSDLHTPGRYGRVILLSPTGDNILLQAEGILQTHRAVLEMKDGRNSFIGHQLGGVVEVPNSKDQRVKSARAIQITYYLQTYGSATQDLIGEKWENEFCKLIRKLQEEHQELQLYSLASFSLWRDFHKTSILARSKVLVSLVLILTTATLSSSMKDCLRSKPFLGLLGVLTVCISIITAAGIFFITDGKYNSTLLGIPFFAMGISTEFTSS

SEQ ID NO: 34183 - protein, 349 aa, Homo sapiens
  ENSP00000439485
MSSLSGKVQTVLGLVEPSKLGRTLTHEHLAMTFDCCYCPPPPCQEAISKEPIVMKNLYWIQKNAYSHKENLQLNQETEAIKEELLYFKANGGGALVENTTTGISRDTQTLKRLAEETGVHIISGAGFYVDATHSSETRAMSVEQLTDVLMNEILHGADGTSIKCGIIGEIGCSWPLTESERKVLQATAHAQAQLGCPVIIHPGRSSRAPFQIIRILQEAGADISKTVMSHLDRTILDKKELLEFAQLGCYLEYDLFGTELLHYQLGPDIDMPDDNKRIRRVRLLVEEGCEDRILVAHDIHTKTRLMKYGGHGYSHILTNVVPKMLLRGITENVLDKILIENPKQWLTFK

SEQ ID NO: 34184 - protein, 349 aa, Homo sapiens; identical to SEQ ID NO: 34183
  ENSP00000367239

SEQ ID NO: 34185 - protein, 200 aa, Homo sapiens
  ENSP00000389535
MNEILHGADGTSIKCGIIGEIGCSWPLTESERKVLQATAHAQAQLGCPVIIHPGRSSRAPFQIIRILQEAGADISKTVMSHLDRTILDKKELLEFAQLGCYLEYDLFGTELLHYQLGPDIDMPDDNKRIRRVRLLVEEGCEDRILVAHDIHTKTRLMKYGGHGYSHILTNVVPKMLLRGITENVLDKILIENPKQWLTFK

SEQ ID NO: 34186 - protein, 302 aa, Homo sapiens
  ENSP00000298942
MSSLSGKVQTVLGLVEPSKLGRTLTHEHLAMTFDCCYCPPPPCQEAISKEPIVMKNLYWIQKNAYSHKENLQLNQETEAIKEELLYFKANGGGALVENTTTGISRDTQTLKRLAEETGVHIISGAGFYVDATHSSETRAMSVEQLTDVLMNEILHGADGTSIKCGIIGEIGCSWPLTESERKVLQATAHAQAQLGCPVIIHPGRSSRAPFQIIRILQEAGADISKTVMSHLDRVRLLVEEGCEDRILVAHDIHTKTRLMKYGGHGYSHILTNVVPKMLLRGITENVLDKILIENPKQWLTFK

SEQ ID NO: 34187 - protein, 160 aa, Homo sapiens
  ENSP00000262033
MQPASAKWYDRRDYVFIEFCVEDSKDVNVNFEKSKLTFSCLGGSDNFKHLNEIDLFHCIDPNDSKHKRTDRSILCCLRKGESGQSWPRLTKERAKLNWLSVDFNNWKDWEDDSDEDMSNFDRFSEMMNNMGGDEDVDLPEVDGADDDSQDSDDEKMPDLE

SEQ ID NO: 34188 - protein, 130 aa, Homo sapiens
  ENSP00000405299
MQPASAKWYDRRDYVFIEFCVEDSKDVNVNFEKSKLTFSCLGGSDNFKHLNEIDLFHCIDPNDSKHKRTDRSILCCLRKGESGQSWPRLTKERAKMMNNMGGDEDVDLPEVDGADDDSQDSDDEKMPDLE

SEQ ID NO: 34189 - protein, 127 aa, Homo sapiens
  ENSP00000402385
MQPASAKWYDRRDYVFIEFCVEDSKDVNVNFEKSKLTFSCLGGSDNFKHLNEIDLFHCIDPNLNWLSVDFNNWKDWEDDSDEDMSNFDRFSEMMNNMGGDEDVDLPEVDGADDDSQDSDDEKMPDLE

SEQ ID NO: 34190 - protein, 139 aa, Homo sapiens
  ENSP00000414892
MQPASAKWYDRRDYVFIEFCVEDSKDVNVNFEKSKLTFSCLGGSDNFKHLNEIDLFHCIDPNDSKHKRTDRSILCCLRKGESGQSWPRLTKERAKLNWLSVDFNNWKDWEDDSDEDMSNFDRFSEDSQDSDDEKMPDLE

SEQ ID NO: 34191 - protein, 124 aa, Homo sapiens
  ENSP00000389090
MQPASAKWYDRRDYVFIEFCVEDSKDVNVNFEKSKLTFSCLRKGESGQSWPRLTKERAKLNWLSVDFNNWKDWEDDSDEDMSNFDRFSEMMNNMGGDEDVDLPEVDGADDDSQDSDDEKMPDLE

SEQ ID NO: 34192 - protein, 164 aa, Homo sapiens
  ENSP00000482075
MSLEKQPASAKWYDRRDYVFIEFCVEDSKDVNVNFEKSKLTFSCLGGSDNFKHLNEIDLFHCIDPNDSKHKRTDRSILCCLRKGESGQSWPRLTKERAKLNWLSVDFNNWKDWEDDSDEDMSNFDRFSEMMNNMGGDEDVDLPEVDGADDDSQDSDDEKMPDLE

SEQ ID NO: 34193 - protein, 879 aa, Homo sapiens
  ENSP00000376899
MGRLASRPLLLALLSLALCRGRVVRVPTATLVRVVGTELVIPCNVSDYDGPSEQNFDWSFSSLGSSFVELASTWEVGFPAQLYQERLQRGEILLRRTANDAVELHIKNVQPSDQGHYKCSTPSTDATVQGNYEDTVQVKVLADSLHVGPSARPPPSLSLREGEPFELRCTAASASPLHTHLALLWEVHRGPARRSVLALTHEGRFHPGLGYEQRYHSGDVRLDTVGSDAYRLSVSRALSADQGSYRCIVSEWIAEQGNWQEIQEKAVEVATVVIQPSVLRAAVPKNVSVAEGKELDLTCNITTDRADDVRPEVTWSFSRMPDSTLPGSRVLARLDRDSLVHSSPHVALSHVDARSYHLLVRDVSKENSGYYYCHVSLWAPGHNRSWHKVAEAVSSPAGVGVTWLEPDYQVYLNASKVPGFADDPTELACRVVDTKSGEANVRFTVSWYYRMNRRSDNVVTSELLAVMDGDWTLKYGERSKQRAQDGDFIFSKEHTDTFNFRIQRTTEEDRGNYYCVVSAWTKQRNNSWVKSKDVFSKPVNIFWALEDSVLVVKARQPKPFFAAGNTFEMTCKVSSKNIKSPRYSVLIMAEKPVGDLSSPNETKYIISLDQDSVVKLENWTDASRVDGVVLEKVQEDEFRYRMYQTQVSDAGLYRCMVTAWSPVRGSLWREAATSLSNPIEIDFQTSGPIFNASVHSDTPSVIRGDLIKLFCIITVEGAALDPDDMAFDVSWFAVHSFGLDKAPVLLSSLDRKGIVTTSRRDWKSDLSLERVSVLEFLLQVHGSEDQDFGNYYCSVTPWVKSPTGSWQKEAEIHSKPVFITVKMDVLNAFKYPLLIGVGLSTVIGLLSCLIGYCSSHWCCKKEVQETRRERRRLMSMEMD

SEQ ID NO: 34194 - protein, 1009 aa, Homo sapiens
  ENSP00000380638
MSGVSEPLSRVKLGTLRRPEGPAEPMVVVPVDVEKEDVRILKVCFYSNSFNPGKNFKLVKCTVQTEIREIITSILLSGRIGPNIRLAECYGLRLKHMKSDEIHWLHPQMTVGEVQDKYECLHVEAEWRYDLQIRYLPEDFMESLKEDRTTLLYFYQQLRNDYMQRYASKVSEGMALQLGCLELRRFFKDMPHNALDKKSNFELLEKEVGLDLFFPKQMQENLKPKQFRKMIQQTFQQYASLREEECVMKFFNTLAGFANIDQETYRCELIQGWNITVDLVIGPKGIRQLTSQDAKPTCLAEFKQIRSIRCLPLEEGQAVLQLGIEGAPQALSIKTSSLAEAENMADLIDGYCRLQGEHQGSLIIHPRKDGEKRNSLPQIPMLNLEARRSHLSESCSIESDIYAEIPDETLRRPGGPQYGIAREDVVLNRILGEGFFGEVYEGVYTNHKGEKINVAVKTCKKDCTLDNKEKFMSEAVIMKNLDHPHIVKLIGIIEEEPTWIIMELYPYGELGHYLERNKNSLKVLTLVLYSLQICKAMAYLESINCVHRDIAVRNILVASPECVKLGDFGLSRYIEDEDYYKASVTRLPIKWMSPESINFRRFTTASDVWMFAVCMWEILSFGKQPFFWLENKDVIGVLEKGDRLPKPDLCPPVLYTLMTRCWDYDPSDRPRFTELVCSLSDVYQMEKDIAMEQERNARYRTPKILEPTAFQEPPPKPSRPKYRPPPQTNLLAPKLQFQVPEGLCASSPTLTSPMEYPSPVNSLHTPPLHRHNVFKRHSMREEDFIQPSSREEAQQLWEAEKVKMRQILDKQQKQMVEDYQWLRQEEKSLDPMVYMNDKSPLTPEKEVGYLEFTGPPQKPPRLGAQSIQPTANLDRTDDLVYLNVMELVRAVLELKNELCQLPPEGYVVVVKNVGLTLRKLIGSVDDLLPSLPSSSRTEIEGTQKLLNKDLAELINKMRLAQQNAVTSLSEECKRQMLTASHTLAVDAKNLLDAVDQAKVLANLAHPPAE

SEQ ID NO: 34195 - protein, 68 aa, Homo sapiens
  ENSP00000429694
MSGVSEPLSRVKLGTLRRPEGPAEPMVVVPVDVEKEDVRILKVCFYSNSFNPGKNFKLVKCTVQTEIR

SEQ ID NO: 34196 - protein, 103 aa, Homo sapiens
  ENSP00000430404
MSGVSEPLSRVKLGTLRRPEGPAEPMVVVPVDVEKEDVRILKVCFYSNSFNPGKNFKLVKCTVQTEIREIITSILLSGRIGPNIRLAECYGLRLKHMKSDEIH

SEQ ID NO: 34197 - protein, 1009 aa, Homo sapiens; identical to SEQ ID NO: 34194
  ENSP00000332816

SEQ ID NO: 34198 - protein, 184 aa, Homo sapiens
  ENSP00000428271
MSGVSEPLSRVKLGTLRRPEGPAEPMVVVPVDVEKEDVRILKVCFYSNSFNPGKNFKLVKCTVQTEIREIITSILLSGRIGPNIRLAECYGLRLKHMKSDEIHWLHPQMTVGEVQDKYECLHVEAEWRYDLQIRYLPEDFMESLKEDRTTLLYFYQQLRNDYMQRYASKVSEGMALQLGCLELR

SEQ ID NO: 34199 - protein, 213 aa, Homo sapiens
  ENSP00000416174
MSGVSEPLSRVKLGTLRRPEGPAEPMVVVPVDVEKEDVRILKVCFYSNSFNPGKNFKLVKCTVQTEIREIITSILLSGRIGPNIRLAECYGLRLKHMKSDEIHWLHPQMTVGEVQDKYECLHVEAEWRYDLQIRYLPEDFMESLKEDRTTLLYFYQQLRNDYMQRYASKVSEGMALQLGCLELRRFFKDMPHNALDKKSNFELLEKEVGLDLF

SEQ ID NO: 34200 - protein, 967 aa, Homo sapiens
  ENSP00000427931
MSGVSEPLSRVKLGTLRRPEGPAEPMVVVPVDVEKEDVRILKVCFYSNSFNPGKNFKLVKCTVQTEIREIITSILLSGRIGPNIRLAECYGLRLKHMKSDEIHWLHPQMTVGEVQDKYECLHVEAEWRYDLQIRYLPEDFMESLKEDRTTLLYFYQQLRNDYMQRYASKVSEGMALQLGCLELRRFFKDMPHNALDKKSNFELLEKEVGLDLFFPKQMQENLKPKQFRKMIQQTFQQYASLREEECVMKFFNTLAGFANIDQETYRCELIQGWNITVDLVIGPKGIRQLTSQDAKPTCLAEFKQIRSIRCLPLEEGQAVLQLGIEGAPQALSIKTSSLAEAENMADLIDGYCRLQGEHQGSLIIHPRKDGEKRNSLPQIPMLNLEARRSHLSESCSIESDIYAEIPDETLRRPGGPQYGIAREDVVLNRILGEGFFGEVYEGVYTNHKGEKINVAVKTCKKDCTLDNKEKFMSEAVIMKNLDHPHIVKLIGIIEEEPTWIIMELYPYGELGHYLERNKNSLKVLTLVLYSLQICKAMAYLESINCVHRDIAVRNILVASPECVKLGDFGLSRYIEDEDYYKASVTRLPIKWMSPESINFRRFTTASDVWMFAVCMWEILSFGKQPFFWLENKDVIGVLEKGDRLPKPDLCPPVLYTLMTRCWDYDPSDRPRFTELVCSLSDVYQMEKDIAMEQERNARYRTPKILEPTAFQEPPPKPSRPKYRPPPQTNLLAPKLQFQEEDFIQPSSREEAQQLWEAEKVKMRQILDKQQKQMVEDYQWLRQEEKSLDPMVYMNDKSPLTPEKEVGYLEFTGPPQKPPRLGAQSIQPTANLDRTDDLVYLNVMELVRAVLELKNELCQLPPEGYVVVVKNVGLTLRKLIGSVDDLLPSLPSSSRTEIEGTQKLLNKDLAELINKMRLAQQNAVTSLSEECKRQMLTASHTLAVDAKNLLDAVDQAKVLANLAHPPAE

SEQ ID NO: 34201 - protein, 194 aa, Homo sapiens
  ENSP00000428837
  MOD_RES (1)..(1): Any amino acid
XRKMIQQTFQQYASLREEECVMKFFNTLAGFANIDQETYRCELIQGWNITVDLVIGPKGIRQLTSQDAKPTCLAEFKQIRSIRCLPLEEGQAVLQLGIEGAPQALSIKTSSLAEAENMADLIDGYCRLQDGEKRNSLPQIPMLNLEARRSHLSESCSIESDIYAEIPDETLRRPGGPQYGIAREDVVLNRILGE

SEQ ID NO: 34202 - protein, 967 aa, Homo sapiens; identical to SEQ ID NO: 34200
  ENSP00000391995

SEQ ID NO: 34203 - protein, 1070 aa, Homo sapiens
  ENSP00000230419
MGAARGSPARPRRLPLLSVLLLPLLGGTQTAIVFIKQPSSQDALQGRRALLRCEVEAPGPVHVYWLLDGAPVQDTERRFAQGSSLSFAAVDRLQDSGTFQCVARDDVTGEEARSANASFNIKWIEAGPVVLKHPASEAEIQPQTQVTLRCHIDGHPRPTYQWFRDGTPLSDGQSNHTVSSKERNLTLRPAGPEHSGLYSCCAHSAFGQACSSQNFTLSIADESFARVVLAPQDVVVARYEEAMFHCQFSAQPPPSLQWLFEDETPITNRSRPPHLRRATVFANGSLLLTQVRPRNAGIYRCIGQGQRGPPIILEATLHLAEIEDMPLFEPRVFTAGSEERVTCLPPKGLPEPSVWWEHAGVRLPTHGRVYQKGHELVLANIAESDAGVYTCHAANLAGQRRQDVNITVATVPSWLKKPQDSQLEEGKPGYLDCLTQATPKPTVVWYRNQMLISEDSRFEVFKNGTLRINSVEVYDGTWYRCMSSTPAGSIEAQARVQVLEKLKFTPPPQPQQCMEFDKEATVPCSATGREKPTIKWERADGSSLPEWVTDNAGTLHFARVTRDDAGNYTCIASNGPQGQIRAHVQLTVAVFITFKVEPERTTVYQGHTALLQCEAQGDPKPLIQWKGKDRILDPTKLGPRMHIFQNGSLVIHDVAPEDSGRYTCIAGNSCNIKHTEAPLYVVDKPVPEESEGPGSPPPYKMIQTIGLSVGAAVAYIIAVLGLMFYCKKRCKAKRLQKQPEGEEPEMECLNGGPLQNGQPSAEIQEEVALTSLGSGPAATNKRHSTSDKMHFPRSSLQPITTLGKSEFGEVFLAKAQGLEEGVAETLVLVKSLQSKDEQQQLDFRRELEMFGKLNHANVVRLLGLCREAEPHYMVLEYVDLGDLKQFLRISKSKDEKLKSQPLSTKQKVALCTQVALGMEHLSNNRFVHKDLAARNCLVSAQRQVKVSALGLSKDVYNSEYYHFRQAWVPLRWMSPEAILEGDFSTKSDVWAFGVLMWEVFTHGEMPHGGQADDEVLADLQAGKARLPQPEGCPSKLYRLMQRCWALSPKDRPSFSEIASALGDSTVDSKP

SEQ ID NO: 34204 - protein, 139 aa, Homo sapiens
  ENSP00000417607
MGAARGSPARPRRLPLLSVLLLPLLGGTQTAIVFIKQPSSQDALQGRRALLRCEVEAPGPVHVYWLLDGAPVQDTERRFAQGSSLSFAAVDRLQDSGTFQCVARDDVTGEEARSANASFNIKCESQGGCAQSPCQTLND

SEQ ID NO: 34205 - protein, 157 aa, Homo sapiens
  ENSP00000420322
MGAARGSPARPRRLPLLSVLLLPLLGGTQTAIVFIKQPSSQDALQGRRALLRCEVEAPGPVHVYWLLDGAPVQDTERRFAQGSSLSFAAVDRLQDSGTFQCVARDDVTGEEARSANASFNIKWIEAGPVVLKHPASEAEIQPQTQVTLRCHIDGHPR

SEQ ID NO: 34206 - protein, 459 aa, Homo sapiens
  ENSP00000419037
MGAARGSPARPRRLPLLSVLLLPLLGGTQTAIVFIKQPSSQDALQGRRALLRCEVEAPGPVHVYWLLDGAPVQDTERRFAQGSSLSFAAVDRLQDSGTFQCVARDDVTGEEARSANASFNIKWIEAGPVVLKHPASEAEIQPQTQVTLRCHIDGHPRPTYQWFRDGTPLSDGQSNHTVSSKERNLTLRPAGPEHSGLYSCCAHSAFGQACSSQNFTLSIADESFARVVLAPQDVVVARYEEAMFHCQFSAQPPPSLQWLFEDETPITNRSRPPHLRRATVFANGSLLLTQVRPRNAGIYRCIGQGQRGPPIILEATLHLAEIEDMPLFEPRVFTAGSEERVTCLPPKGLPEPSVWWEHAGVRLPTHGRVYQKGHELVLANIAESDAGVYTCHAANLAGQRRQDVNITVASEHLCPEGQGEVEGNTGLGVMDRGFPGTHLRSSQFWALQAWESVHYWESV

SEQ ID NO: 34207 - protein, 940 aa, Homo sapiens
  ENSP00000325462
MGAARGSPARPRRLPLLSVLLLPLLGGTQTAIVFIKQPSSQDALQGRRALLRCEVEAPGPVHVYWLLDGAPVQDTERRFAQGSSLSFAAVDRLQDSGTFQCVARDDVTGEEARSANASFNIKWIEAGPVVLKHPASEAEIQPQTQVTLRCHIDGHPRPTYQWFRDGTPLSDGQSNHTVSSKERNLTLRPAGPEHSGLYSCCAHSAFGQACSSQNFTLSIADESFARVVLAPQDVVVARYEEAMFHCQFSAQPPPSLQWLFEDETPITNRSRPPHLRRATVFANGSLLLTQVRPRNAGIYRCIGQGQRGPPIILEATLHLAEIEDMPLFEPRVFTAGSEERVTCLPPKGLPEPSVWWEHAGVRLPTHGRVYQKGHELVLANIAESDAGVYTCHAANLAGQRRQDVNITVANGSSLPEWVTDNAGTLHFARVTRDDAGNYTCIASNGPQGQIRAHVQLTVAVFITFKVEPERTTVYQGHTALLQCEAQGDPKPLIQWKGKDRILDPTKLGPRMHIFQNGSLVIHDVAPEDSGRYTCIAGNSCNIKHTEAPLYVVDKPVPEESEGPGSPPPYKMIQTIGLSVGAAVAYIIAVLGLMFYCKKRCKAKRLQKQPEGEEPEMECLNGGPLQNGQPSAEIQEEVALTSLGSGPAATNKRHSTSDKMHFPRSSLQPITTLGKSEFGEVFLAKAQGLEEGVAETLVLVKSLQSKDEQQQLDFRRELEMFGKLNHANVVRLLGLCREAEPHYMVLEYVDLGDLKQFLRISKSKDEKLKSQPLSTKQKVALCTQVALGMEHLSNNRFVHKDLAARNCLVSAQRQVKVSALGLSKDVYNSEYYHFRQAWVPLRWMSPEAILEGDFSTKSDVWAFGVLMWEVFTHGEMPHGGQADDEVLADLQAGKARLPQPEGCPSKLYRLMQRCWALSPKDRPSFSEIASALGDSTVDSKP

SEQ ID NO: 34208 - protein, 1014 aa, Homo sapiens
  ENSP00000326029
MGAARGSPARPRRLPLLSVLLLPLLGGTQTAIVFIKQPSSQDALQGRRALLRCEVEAPGPVHVYWLLDGAPVQDTERRFAQGSSLSFAAVDRLQDSGTFQCVARDDVTGEEARSANASFNIKWIEAGPVVLKHPASEAEIQPQTQVTLRCHIDGHPRPTYQWFRDGTPLSDGQSNHTVSSKERNLTLRPAGPEHSGLYSCCAHSAFGQACSSQNFTLSIADESFARVVLAPQDVVVARYEEAMFHCQFSAQPPPSLQWLFEDETPITNRSRPPHLRRATVFANGSLLLTQVRPRNAGIYRCIGQGQRGPPIILEATLHLAEIEDMPLFEPRVFTAGSEERVTCLPPKGLPEPSVWWEHAGVRLPTHGRVYQKGHELVLANIAESDAGVYTCHAANLAGQRRQDVNITVATVPSWLKKPQDSQLEEGKPGYLDCLTQATPKPTVVWYRNQMLISEDSRFEVFKNGTLRINSVEVYDGTWYRCMSSTPAGSIEAQARVQVLEKLKFTPPPQPQQCMEFDKEATVPCSATGREKPTIKWERADGSSLPEWVTDNAGTLHFARVTRDDAGNYTCIASNGPQGQIRAHVQLTVAVFITFKVEPERTTVYQGHTALLQCEAQGDPKPLIQWKDKPVPEESEGPGSPPPYKMIQTIGLSVGAAVAYIIAVLGLMFYCKKRCKAKRLQKQPEGEEPEMECLNGGPLQNGQPSAEIQEEVALTSLGSGPAATNKRHSTSDKMHFPRSSLQPITTLGKSEFGEVFLAKAQGLEEGVAETLVLVKSLQSKDEQQQLDFRRELEMFGKLNHANVVRLLGLCREAEPHYMVLEYVDLGDLKQFLRISKSKDEKLKSQPLSTKQKVALCTQVALGMEHLSNNRFVHKDLAARNCLVSAQRQVKVSALGLSKDVYNSEYYHFRQAWVPLRWMSPEAILEGDFSTKSDVWAFGVLMWEVFTHGEMPHGGQADDEVLADLQAGKARLPQPEGCPSKLYRLMQRCWALSPKDRPSFSEIASALGDSTVDSKP

SEQ ID NO: 34209 - protein, 1030 aa, Homo sapiens
  ENSP00000325992
MGAARGSPARPRRLPLLSVLLLPLLGGTQTAIVFIKQPSSQDALQGRRALLRCEVEAPGPVHVYWLLDGAPVQDTERRFAQGSSLSFAAVDRLQDSGTFQCVARDDVTGEEARSANASFNIKWIEAGPVVLKHPASEAEIQPQTQVTLRCHIDGHPRPTYQWFRDGTPLSDGQSNHTVSSKERNLTLRPAGPEHSGLYSCCAHSAFGQACSSQNFTLSIADESFARVVLAPQDVVVARYEEAMFHCQFSAQPPPSLQWLFEDETPITNRSRPPHLRRATVFANGSLLLTQVRPRNAGIYRCIGQGQRGPPIILEATLHLAEIEDMPLFEPRVFTAGSEERVTCLPPKGLPEPSVWWEHAGVRLPTHGRVYQKGHELVLANIAESDAGVYTCHAANLAGQRRQDVNITVATVPSWLKKPQDSQLEEGKPGYLDCLTQATPKPTVVWYRNQMLISEDSRFEVFKNGTLRINSVEVYDGTWYRCMSSTPAGSIEAQARVQVLDGSSLPEWVTDNAGTLHFARVTRDDAGNYTCIASNGPQGQIRAHVQLTVAVFITFKVEPERTTVYQGHTALLQCEAQGDPKPLIQWKGKDRILDPTKLGPRMHIFQNGSLVIHDVAPEDSGRYTCIAGNSCNIKHTEAPLYVVDKPVPEESEGPGSPPPYKMIQTIGLSVGAAVAYIIAVLGLMFYCKKRCKAKRLQKQPEGEEPEMECLNGGPLQNGQPSAEIQEEVALTSLGSGPAATNKRHSTSDKMHFPRSSLQPITTLGKSEFGEVFLAKAQGLEEGVAETLVLVKSLQSKDEQQQLDFRRELEMFGKLNHANVVRLLGLCREAEPHYMVLEYVDLGDLKQFLRISKSKDEKLKSQPLSTKQKVALCTQVALGMEHLSNNRFVHKDLAARNCLVSAQRQVKVSALGLSKDVYNSEYYHFRQAWVPLRWMSPEAILEGDFSTKSDVWAFGVLMWEVFTHGEMPHGGQADDEVLADLQAGKARLPQPEGCPSKLYRLMQRCWALSPKDRPSFSEIASALGDSTVDSKP

SEQ ID NO: 34210 - protein, 816 aa, Homo sapiens
  ENSP00000230418
MGAARGSPARPRRLPLLSVLLLPLLGGTQTAIVFIKQPSSQDALQGRRALLRCEVEAPGPVHVYWLLDGAPVQDTERRFAQGSSLSFAAVDRLQDSGTFQCVARDDVTGEEARSANASFNIKWIEAGPVVLKHPASEAEIQPQTQVTLRCHIDGHPRPTYQWFRDGTPLSDGQSNHTVSSKERNLTLRPAGPEHSGLYSCCAHSAFGQACSSQNFTLSIADESFARVVLAPQDVVVARYEEAMFHCQFSAQPPPSLQWLFEDETPITNRSRPPHLRRATVFANGSLLLTQVRPRNAGIYRCIGQGQRGPPIILEATLHLAEIEDMPLFEPRVFTAGSEERVTCLPPKGLPEPSVWWEHAGVRLPTHGRVYQKGHELVLANIAESDAGVYTCHAANLAGQRRQDVNITVATVPSWLKKPQDSQLEEGKPGYLDCLTQATPKPTVVWYRNQMLISEDSRFEVFKNGTLRINSVEVYDGTWYRCMSSTPAGSIEAQARVQVLEKLKFTPPPQPQQCMEFDKEATVPCSATGREKPTIKWERADGSSLPEWVTDNAGTLHFARVTRDDAGNYTCIASNGPQGQIRAHVQLTVAVFITFKVEPERTTVYQGHTALLQCEAQGDPKPLIQWKGKDRILDPTKLGPRMHIFQNGSLVIHDVAPEDSGRYTCIAGNSCNIKHTEAPLYVVDKPVPEESEGPGSPPPYKMIQTIGLSVGAAVAYIIAVLGLMFYCKKRCKAKRLQKQPEGEEPEMECLNGGPLQNGQPSAEIQEEVALTSLGSGPAATNKRHSTSDKMHFPRSSLQPITTLGRPQAVPEDFQEQG

SEQ ID NO: 34211 - protein, 1078 aa, Homo sapiens
  ENSP00000418754
MGSFLSGEKRPSAPTVGSAMEKKEFPTPPGRVGPGTQTAIVFIKQPSSQDALQGRRALLRCEVEAPGPVHVYWLLDGAPVQDTERRFAQGSSLSFAAVDRLQDSGTFQCVARDDVTGEEARSANASFNIKWIEAGPVVLKHPASEAEIQPQTQVTLRCHIDGHPRPTYQWFRDGTPLSDGQSNHTVSSKERNLTLRPAGPEHSGLYSCCAHSAFGQACSSQNFTLSIADESFARVVLAPQDVVVARYEEAMFHCQFSAQPPPSLQWLFEDETPITNRSRPPHLRRATVFANGSLLLTQVRPRNAGIYRCIGQGQRGPPIILEATLHLAEIEDMPLFEPRVFTAGSEERVTCLPPKGLPEPSVWWEHAGVRLPTHGRVYQKGHELVLANIAESDAGVYTCHAANLAGQRRQDVNITVATVPSWLKKPQDSQLEEGKPGYLDCLTQATPKPTVVWYRNQMLISEDSRFEVFKNGTLRINSVEVYDGTWYRCMSSTPAGSIEAQARVQVLEKLKFTPPPQPQQCMEFDKEATVPCSATGREKPTIKWERADGSSLPEWVTDNAGTLHFARVTRDDAGNYTCIASNGPQGQIRAHVQLTVAVFITFKVEPERTTVYQGHTALLQCEAQGDPKPLIQWKGKDRILDPTKLGPRMHIFQNGSLVIHDVAPEDSGRYTCIAGNSCNIKHTEAPLYVVDKPVPEESEGPGSPPPYKMIQTIGLSVGAAVAYIIAVLGLMFYCKKRCKAKRLQKQPEGEEPEMECLNGGPLQNGQPSAEIQEEVALTSLGSGPAATNKRHSTSDKMHFPRSSLQPITTLGKSEFGEVFLAKAQGLEEGVAETLVLVKSLQSKDEQQQLDFRRELEMFGKLNHANVVRLLGLCREAEPHYMVLEYVDLGDLKQFLRISKSKDEKLKSQPLSTKQKVALCTQVALGMEHLSNNRFVHKDLAARNCLVSAQRQVKVSALGLSKDVYNSEYYHFRQAWVPLRWMSPEAILEGDFSTKSDVWAFGVLMWEVFTHGEMPHGGQADDEVLADLQAGKARLPQPEGCPSKLYRLMQRCWALSPKDRPSFSEIASALGDSTVDSKP

SEQ ID NO: 34212 - protein, 269 aa, Homo sapiens
  ENSP00000420165
FSAQPPPSLQWLFEDETPITNRSRPPHLRRATVFANGSLLLTQVRPRNAGIYRCIGQGQRGPPIILEATLHLAEIEDMPLFEPRVFTAGSEERVTCLPPKGLPEPSVWWEHAGVRLPTHGRVYQKGHELVLANIAESDAGVYTCHAANLAGQRRQDVNITVASEHLCPEGQGEVEGNTGLGVMDRGFPAVPSWLKKPQDSQLEEGKPGYLDCLTQATPKPTVVWYRNQMLISEDSRFEVFKNGTLRINSVEVYDGTWYRCMSSTPAGSI

SEQ ID NO: 34213 - protein, 365 aa, Homo sapiens
  ENSP00000420765
  MOD_RES (1)..(1): Any amino acid
XEHAGVRLPTHGRVYQKGHELVLANIAESDAGVYTCHAANLAGQRRQDVNITVATVPSWLKKPQDSQLEEGKPGYLDCLTQATPKPTVVWYRNQMLISEDSRFEVFLAKAQGLEEGVAETLVLVKSLQSKDEQQQLDFRRELEMFGKLNHANVVRLLGLCREAEPHYMVLEYVDLGDLKQFLRISKSKDEKLKSQPLSTKQKVALCTQVALGMEHLSNNRFVHKDLAARNCLVSAQRQVKVSALGLSKDVYNSEYYHFRQAWVPLRWMSPEAILEGDFSTKSDVWAFGVLMWEVFTHGEMPHGGQADDEVLADLQAGKARLPQPEGCPSKLYRLMQRCWALSPKDRPSFSEIASALGDSTVDSKP

SEQ ID NO: 34214 - protein, 25 aa, Homo sapiens
  ENSP00000418545
TEHGTEAIFVAAVGIRPSHHAAAQS

SEQ ID NO: 34215 - protein, 25 aa, Homo sapiens
  ENSP00000419096
TEHGTEAIFVAAVGIRPSHHAAAQS

SEQ ID NO: 34216 - protein, 25 aa, Homo sapiens
  ENSP00000418462
  MOD_RES (1)..(1): Any amino acid
XEHGTEAIFVAAVGIRPSHHAAAQS

SEQ ID NO: 34217 - protein, 257 aa, Homo sapiens
  ENSP00000420186
MVARVSGLIVTLLSSSFPGGPLQNGQPSAEIQEEVALTSLGSGPAATNKRHSTSDKMHFPRSSLQPITTLGKSEFGEVFLAKAQGLEEGVAETLVLVKSLQSKDEQQQLDFRRELEMFGKLNHANVVRLLGLCREAEPHYMVLEYVDLGDLKQFLRISKSKDEKLKSQPLSTKQKVALCTQVALGMEHLSNNRFVHKDLAARNCLVSAQRQVKVSALGLSKDVYNSEYYHFRQAWVPLRWMSPEAILEGDFSTKSDV

SEQ ID NO: 34218 - protein, 84 aa, Homo sapiens
  ENSP00000418386
MVARVSGLIVTLLSSSFPGGPLQNGQPSAEIQEEVALTSLGSGPAATNKRHSTSDKMHFPRSSLQPITTLGRPQAVPEDFQEQG

SEQ ID NO: 34219 - protein, 104 aa, Homo sapiens
  ENSP00000374113
MSEKSVEAAAELSAKDLKEKKEKVEEKASRKERKKEVVEAPVPLVVMVGKACSQPEATPSPGPHRRRRTGLRRKKKKLPRMERRKMKGKKKMRKKKKRMMKGPR

SEQ ID NO: 34220 - protein, 57 aa, Homo sapiens
  ENSP00000442325
MSEKSVEAAAELSAKDLKEKKEKVEEKASRKERKKEVVEAPVPLVVMVGKACSQPEA

SEQ ID NO: 34221 - protein, 102 aa, Homo sapiens
  ENSP00000310088
MSEKSVEAAAELSAKDLKEKKEKVEEKASRKERKKEVVEEEENGAEEEEEETAEDGEEEDEGEEEDEEEEEEDDEGPALKRAAEEEDEADPKRQKTENGASA

SEQ ID NO: 34222 - protein, 102 aa, Homo sapiens; identical to SEQ ID NO: 34221
  ENSP00000478828

SEQ ID NO: 34223 - protein, 168 aa, Homo sapiens
  ENSP00000341170
MQAQQYQQQRRKFAAAFLAFIFILAAVDTAEAGKKEKPEKKVKKSDCGEWQWSVCVPTSGDCGLGTREGTRTGAECKQTMKTQRCKIPCNWKKQFGAECKYQFQAWGECDLNTALKTRTGSLKRALHNAECQKTVTISKPCGKLTKPKPQAESKKKKKEGKKQEKMLD

SEQ ID NO: 34224 - protein, 166 aa, Homo sapiens
  ENSP00000376798
MQAQQYQQQRRKFAAAFLAFIFILAAVDTAEAGKKEKPEKKVKKSDCGEWQWSVCVPTSGDCGLGTREGTRTGAECKQTMKTQRCKIPCNWKKQFGAECKYQFQAWGECDLNTALKTRTGSLKRALHNAECQKTVTISKPCGKLTKPKPQEKGKWRHRSGESLRRW

SEQ ID NO: 34225 - protein, 173 aa, Homo sapiens
  ENSP00000359685
MARMNRPAPVEVTYKNMRFLITHNPTNATLNKFIEELKKYGVTTIVRVCEATYDTTLVEKEGIHVLDWPFDDGAPPSNQIVDDWLSLVKIKFREEPGCCIAVHCVAGLGRAPVLVALALIEGGMKYEDAVQFIRQKRRGAFNSKQLLYLEKYRPKMRLRFKDSNGHRNNCCIQ

SEQ ID NO: 34226 - protein, 44 aa, Homo sapiens
  ENSP00000462406
MIRPQSSMSKHIPQFCGVLGHTFMEFLKGSGDYCQAQHDLYADK

SEQ ID NO: 34227 - protein, 173 aa, Homo sapiens; identical to SEQ ID NO: 34225
  ENSP00000485687

SEQ ID NO: 34228 - protein, 148 aa, Homo sapiens
  ENSP00000487586
MARMNRPAPVEVTYKNMRFLITHNPTNATLNKFIEELKKYGVTTIVRVCEATYDTTLVEKEGIHVLDWPFDDGAPPSNQIVDDWLSLVKIKFREEPGCCIAVHCVAGLGRKRRGAFNSKQLLYLEKYRPKMRLRFKDSNGHRNNCCIQ

SEQ ID NO: 34229 - protein, 173 aa, Homo sapiens
  ENSP00000487595
MARMNRPAPVEVSYKHMRFLITHNPTNATLSTFIEDLKKYGATTVVRVCEVTYDKTPLEKDGITVVDWPFDDGAPPPGKVVEDWLSLVKAKFCEAPGSCVAVHCVAGLGRAPVLVALALIESGMKYEDAIQFIRQKRRGAINSKQLTYLEKYRPKQRLRFKDPHTHKTRCCVM

SEQ ID NO: 34230 - protein, 148 aa, Homo sapiens
  ENSP00000487610
MARMNRPAPVEVSYKHMRFLITHNPTNATLSTFIEDLKKYGATTVVRVCEVTYDKTPLEKDGITVVDWPFDDGAPPPGKVVEDWLSLVKAKFCEAPGSCVAVHCVAGLGRKRRGAINSKQLTYLEKYRPKQRLRFKDPHTHKTRCCVM

SEQ ID NO: 34231 - protein, 70 aa, Homo sapiens
  ENSP00000487861
MARMNRPAPVEVSYKHMRFLITHNPTNATLSTFIEDLKKYGATTVVRVCEVTYDKTPLEKDGITVVDWPF

SEQ ID NO: 34232 - protein, 148 aa, Homo sapiens; identical to SEQ ID NO: 34230
  ENSP00000481205

SEQ ID NO: 34233 - protein, 173 aa, Homo sapiens; identical to SEQ ID NO: 34229
  ENSP00000484500

SEQ ID NO: 34234 - protein, 173 aa, Homo sapiens; identical to SEQ ID NO: 34229
  ENSP00000428976

SEQ ID NO: 34235 - protein, 148 aa, Homo sapiens; identical to SEQ ID NO: 34230
  ENSP00000428758

SEQ ID NO: 34236 - protein, 70 aa, Homo sapiens; identical to SEQ ID NO: 34231
  ENSP00000428725

SEQ ID NO: 34237 - protein, 87 aa, Homo sapiens
  ENSP00000430332
MARMNRPAPVEVSYKHMRFLITHNPTNATLSTFIESGMKYEDAIQFIRQKRRGAINSKQLTYLEKYRPKQRLRFKDPHTHKTRCCVM

SEQ ID NO: 34238 - protein, 173 aa, Homo sapiens; identical to SEQ ID NO: 34229
  ENSP00000332274

SEQ ID NO: 34239 - protein, 148 aa, Homo sapiens; identical to SEQ ID NO: 34230
  ENSP00000331730

SEQ ID NO: 34240 - protein, 1187 aa, Homo sapiens
  ENSP00000355923
MPFGLKLRRTRRYNVLSKNCFVTRIRLLDSNVIECTLSVESTGQECLEAVAQRLELRETHYFGLWFLSKSQQARWVELEKPLKKHLDKFANEPLLFFGVMFYVPNVSWLQQEATRYQYYLQVKKDVLEGRLRCTLDQVIRLAGLAVQADFGDYNQFDSQDFLREYVLFPMDLALEEAVLEELTQKVAQEHKAHSGILPAEAELMYINEVERLDGFGQEIFPVKDNHGNCVHLGIFFMGIFVRNRIGRQAVIYRWNDMGNITHNKSTILVELINKEETALFHTDDIENAKYISRLFATRHKFYKQNKICTEQSNSPPPIRRQPTWSRSSLPRQQPYILPPVHVQCGEHYSETHTSQDSIFHGNEEALYCNSHNSLDLNYLNGTVTNGSVCSVHSVNSLNCSQSFIQASPVSSNLSIPGSDIMRADYIPSHRHSAIIVPSYRPTPDYETVMRQMKRGILHTDSQSQSLRNLNIINTHAYNQPEDLVYSQPEMRERHPYTVPYGPQGVYSNKLVSPSDQRNPKNNVVPSKPGASAISHTVSTPELANMQLQGSHNYSTAHMLKNYLFRPPPPYPRPRPATSTPDLASHRHKYVSGSSPDLVTRKVQLSVKTFQEDSSPVVHQSLQEVSEPLTATKHHGTVNKRHSLEVMNSMVRGMEAMTLKSLHLPMARRNTLREQGPPEEGSGSHEVPQLPQYHHKKTFSDATMLIHSSESEEEEEEAPESVPQIPMLREKMEYSAQLQAALARIPNKPPPEYPGPRKSVSNGALRQDQASLPPAMARARVLRHGPAKAISMSRTDPPAVNGASLGPSISEPDLTSVKERVKKEPVKERPVSEMFSLEDSIIEREMMIRNLEKQKMAGLEAQKRPLMLAALNGLSVARVSGREENRVDATRVPMDERFRTLKKKLEEGMVFTEYEQIPKKKANGIFSTAALPENAERSRIREVVPYEENRVELIPTKENNTGYINASHIKVVVGGAEWHYIATQGPLPHTCHDFWQMVWEQGVNVIAMVTAEEEGGRTKSHRYWPKLGSKHSSATYGKFKVTTKFRTDSVCYATTGLKVKHLLSGQERTVWHLQYTDWPDHGCPEDVQGFLSYLEEIQSVRRHTNSMLEGTKNRHPPIVVHCSAGVGRTGVLILSELMIYCLEHNEKVEVPMMLRLLREQRMFMIQTIAQYKFVYQVLIQFLQNSRLI

SEQ ID NO: 34241 - protein, 211 aa, Homo sapiens
  ENSP00000443330
MPFGLKLRRTRRYNVLSKNCFVTRIRLLDSNVIECTLSVESTGQECLEAVAQRLELRETHYFGLWFLSKSQQARWVELEKPLKKHLDKFANEPLLFFGVMFYVPNVSWLQQEATRYQYYLQVKKDVLEGRLRCTLDQVIRLAGLAVQADFGDYNQFDSQDFLREYVLFPMDLALEEAVLEELTQKVAQEHKAHRTIMETVYTLAFSLWGFS

SEQ ID NO: 34242 - protein, 179 aa, Homo sapiens
  ENSP00000433141
MDQREILQKFLDEAQSKKITKEEFANEFLKLKRQSTKYKADKTYPTTVAEKPKNIKKNRYKDILPYDYSRVELSLITSDEDSSYINANFIKGVYGPKAYIATQGPLSTTLLDFWRMIWEYSVLIIVMACMEYEMGKEAEKRKSDYIIRTLKVKFNSVSVILAHQTSLQNLFSQITPAHF

SEQ ID NO: 34243 - protein, 807 aa, Homo sapiens
  ENSP00000352833
MDQREILQKFLDEAQSKKITKEEFANEFLKLKRQSTKYKADKTYPTTVAEKPKNIKKNRYKDILPYDYSRVELSLITSDEDSSYINANFIKGVYGPKAYIATQGPLSTTLLDFWRMIWEYSVLIIVMACMEYEMGKKKCERYWAEPGEMQLEFGPFSVSCEAEKRKSDYIIRTLKVKFNSETRTIYQFHYKNWPDHDVPSSIDPILELIWDVRCYQEDDSVPICIHCSAGCGRTGVICAIDYTWMLLKDGIIPENFSVFSLIREMRTQRPSLVQTQEQYELVYNAVLELFKRQMDVIRDKHSGTESQAKHCIPEKNHTLQADSYSPNLPKSTTKAAKMMNQQRTKMEIKESSSFDFRTSEISAKEELVLHPAKSSTSFDFLELNYSFDKNADTTMKWQTKAFPIVGEPLQKHQSLDLGSLLFEGCSNSKPVNAAGRYFNSKVPITRTKSTPFELIQQRETKEVDSKENFSYLESQPHDSCFVEMQAQKVMHVSSAELNYSLPYDSKHQIRNASNVKHHDSSALGVYSYIPLVENPYFSSWPPSGTSSKMSLDLPEKQDGTVFPSSLLPTSSTSLFSYYNSHDSLSLNSPTNISSLLNQESAVLATAPRIDDEIPPPLPVWTPESFIVVEEAGEFSPNVPKSLSSAVKVKIGTSLEWGGTSEPKKFDDSVILRPSKSVKLRSPKSELHQDRSSPPPPLPERTLESFFLADEDCMQAQSIETYSTSYPDTMENSTSSKQTLKTPGKSFTRSKSLKILRNMKKSICNSCPPNKPAESVQSNNSSSFLNFGFANRFSKPKGPRNPPPTWNI

SEQ ID NO: 34244 - protein, 752 aa, Homo sapiens
  ENSP00000435176
MDQREILQKFLDEAQSKKITKEEFANEFLKLKRQSTKYKADKTYPTTVAEKPKNIKKNRYKDILPYDYSRVELSLITSDEDSSYINANFIKGVYGPKAYIATQGPLSTTLLDFWRMIWEYSVLIIVMACMEYEMGKKKCERYWAEPGEMQLEFGPFSVSCEAEKRKSDYIIRTLKVKFNSETRTIYQFHYKNWPDHDVPSSIDPILELIWDVRCYQEDDSVPICIHCSAGCGRTGVICAIDYTWMLLKDGSQAKHCIPEKNHTLQADSYSPNLPKSTTKAAKMMNQQRTKMEIKESSSFDFRTSEISAKEELVLHPAKSSTSFDFLELNYSFDKNADTTMKWQTKAFPIVGEPLQKHQSLDLGSLLFEGCSNSKPVNAAGRYFNSKVPITRTKSTPFELIQQRETKEVDSKENFSYLESQPHDSCFVEMQAQKVMHVSSAELNYSLPYDSKHQIRNASNVKHHDSSALGVYSYIPLVENPYFSSWPPSGTSSKMSLDLPEKQDGTVFPSSLLPTSSTSLFSYYNSHDSLSLNSPTNISSLLNQESAVLATAPRIDDEIPPPLPVWTPESFIVVEEAGEFSPNVPKSLSSAVKVKIGTSLEWGGTSEPKKFDDSVILRPSKSVKLRSPKSELHQDRSSPPPPLPERTLESFFLADEDCMQAQSIETYSTSYPDTMENSTSSKQTLKTPGKSFTRSKSLKILRNMKKSICNSCPPNKPAESVQSNNSSSFLNFGFANRFSKPKGPRNPPPTWNI

SEQ ID NO: 34245 - protein, 135 aa, Homo sapiens
  ENSP00000431249
MDQREILQKFLDEAQSKKITKEEFANEFLKLKRQSTKYKADKTYPTTVAEKPKNIKKNRYKDILPYDYSRVELSLITSDEDSSYINANFIKGVYGPKAYIATQGPLSTTLLDFWRMIWEYSVLCWLWKDWCYLCY

SEQ ID NO: 34246 - protein, 795 aa, Homo sapiens
  ENSP00000388229
MDQREILQKFLDEAQSKKITKEEFANEFLKLKRQSTKYKADKTYPTTVAEKPKNIKKNRYKDILPYDYSRVELSLITSDEDSSYINANFIKGVYGPKAYIATQGPLSTTLLDFWRMIWEYSVLIIVMACMEYEMGKKKCERYWAEPGEMQLEFGPFSVSCEAEKRKSDYIIRTLKVKFNSETRTIYQFHYKNWPDHDVPSSIDPILELIWDVRCYQEDDSVPICIHCSAGCGRTGVICAIDYTWMLLKDGIIPENFSVFSLIREMRTQRPSLVQTQEQYELVYNAVLELFKRQMDVIRDKHSGTESQAKHCIPEKNHTLQADSYSPNLPKSTTKAAKMMNQQRTKMEIKESSSFDFRTSEISAKEELVLHPAKSSTSFDFLELNYSFDKNADTTMKWQTKAFPIVGEPLQKHQSLDLGSLLFEGCSNSKPVNAAGRYFNSKVPITRTKSTPFELIQQRETKEVDSKENFSYLESQPHDSCFVEMQAQKVMHVSSAELNYSLPYDSKHQIRNASNVKHHDSSALGVYSYIPLVENPYFSSWPPSGTSSKMSLDLPEKQDGTVFPSSLLPTSSTSLFSYYNSHDSLSLNSPTNISSLLNQESAVLATAPRIDDEIPPPLPVWTPESFIVVEEAGEFSPNVPKSLSSAVKVKIGTSLEWGGTSEPKKFDDSVILRPSKSVKLRSPKSELHQDRSSPPPPLPERTLESFFLADEDCMQAQSIETYSTSYPDTMENSTSSKQTLKTPGKSFTRSKSLKILRNMKKSICNSCPPNKPAESVQSNNSSSFLNFGMCVILLKS

SEQ ID NO: 34247 - protein, 668 aa, Homo sapiens
  ENSP00000432674
MDQREILQKFLDEAQSKKITKEEFANEFLKLKRQSTKYKADKTYPTTVAEKPKNIKKNRYKDILPYDYSRVELSLITSDEDSSYINANFIKGVYGPKAYIATQGPLSTTLLDFWRMIWEYSVLIIPENFSVFSLIREMRTQRPSLVQTQEQYELVYNAVLELFKRQMDVIRDKHSGTESQAKHCIPEKNHTLQADSYSPNLPKSTTKAAKMMNQQRTKMEIKESSSFDFRTSEISAKEELVLHPAKSSTSFDFLELNYSFDKNADTTMKWQTKAFPIVGEPLQKHQSLDLGSLLFEGCSNSKPVNAAGRYFNSKVPITRTKSTPFELIQQRETKEVDSKENFSYLESQPHDSCFVEMQAQKVMHVSSAELNYSLPYDSKHQIRNASNVKHHDSSALGVYSYIPLVENPYFSSWPPSGTSSKMSLDLPEKQDGTVFPSSLLPTSSTSLFSYYNSHDSLSLNSPTNISSLLNQESAVLATAPRIDDEIPPPLPVWTPESFIVVEEAGEFSPNVPKSLSSAVKVKIGTSLEWGGTSEPKKFDDSVILRPSKSVKLRSPKSELHQDRSSPPPPLPERTLESFFLADEDCMQAQSIETYSTSYPDTMENSTSSKQTLKTPGKSFTRSKSLKILRNMKKSICNSCPPNKPAESVQSNNSSSFLNFGMCVILLKS

SEQ ID NO: 34248 - protein, 92 aa, Homo sapiens
  ENSP00000434932
MDQREILQKFLDEAQSKKITKEEFANEFLGLALSPRLECRGLIIAHCRLDFLDSSDPPASASQSAEITTMSHHTWPEKAFWTSLNRSNLLLS

SEQ ID NO: 34249 - protein, 783 aa, Homo sapiens
  ENSP00000439372
MDQREILQKFLDEAQSKKITKEEFANEFLKLKRQSTKYKADKTYPTTVAEKPKNIKKNRYKDILPYDYSRVELSLITSDEDSSYINANFIKGVYGPKAYIATQGPLSTTLLDFWRMIWEYSVLIIVMACMEYEMGKEAEKRKSDYIIRTLKVKFNSETRTIYQFHYKNWPDHDVPSSIDPILELIWDVRCYQEDDSVPICIHCSAGCGRTGVICAIDYTWMLLKDGIIPENFSVFSLIREMRTQRPSLVQTQEQYELVYNAVLELFKRQMDVIRDKHSGTESQAKHCIPEKNHTLQADSYSPNLPKSTTKAAKMMNQQRTKMEIKESSSFDFRTSEISAKEELVLHPAKSSTSFDFLELNYSFDKNADTTMKWQTKAFPIVGEPLQKHQSLDLGSLLFEGCSNSKPVNAAGRYFNSKVPITRTKSTPFELIQQRETKEVDSKENFSYLESQPHDSCFVEMQAQKVMHVSSAELNYSLPYDSKHQIRNASNVKHHDSSALGVYSYIPLVENPYFSSWPPSGTSSKMSLDLPEKQDGTVFPSSLLPTSSTSLFSYYNSHDSLSLNSPTNISSLLNQESAVLATAPRIDDEIPPPLPVWTPESFIVVEEAGEFSPNVPKSLSSAVKVKIGTSLEWGGTSEPKKFDDSVILRPSKSVKLRSPKSELHQDRSSPPPPLPERTLESFFLADEDCMQAQSIETYSTSYPDTMENSTSSKQTLKTPGKSFTRSKSLKILRNMKKSICNSCPPNKPAESVQSNNSSSFLNFGFANRFSKPKGPRNPPPTWNI

SEQ ID NO: 34250 - protein, 913 aa, Homo sapiens
  ENSP00000363667
MTSRLRALGGRINNIRTSELPKEKTRSEVICSIHFLDGVVQTFKVTKQDTGQVLLDMVHNHLGVTEKEYFGLQHDDDSVDSPRWLEASKAIRKQLKGGFPCTLHFRVRFFIPDPNTLQQEQTRHLYFLQLKMDICEGRLTCPLNSAVVLASYAVQSHFGDYNSSIHHPGYLSDSHFIPDQNEDFLTKVESLHEQHSGLKQSEAESCYINIARTLDFYGVELHSGRDLHNLDLMIGIASAGVAVYRKYICTSFYPWVNILKISFKRKKFFIHQRQKQAESREHIVAFNMLNYRSCKNLWKSCVEHHTFFQAKKLLPQEKNVLSQYWTMGSRNTKKSVNNQYCKKVIGGMVWNPAMRRSLSVEHLETKSLPSRSPPITPNWRSPRLRHEIRKPRHSSADNLANEMTYITETEDVFYTYKGSLAPQDSDSEVSQNRSPHQESLSENNPAQSYLTQKSSSSVSPSSNAPGSCSPDGVDQQLLDDFHRVTKGGSTEDASQYYCDKNDNGDSYLVLIRITPDEDGKFGFNLKGGVDQKMPLVVSRINPESPADTCIPKLNEGDQIVLINGRDISEHTHDQVVMFIKASRESHSRELALVIRRRAVRSFADFKSEDELNQLFPEAIFPMCPEGGDTLEGSMAQLKKGLESGTVLIQFEQLYRKKPGLAITFAKLPQNLDKNRYKDVLPYDTTRVLLQGNEDYINASYVNMEIPAANLVNKYIATQGPLPHTCAQFWQVVWDQKLSLIVMLTTLTERGRTKCHQYWPDPPDVMNHGGFHIQCQSEDCTIAYVSREMLVTNTQTGEEHTVTHLQYVAWPDHGVPDDSSDFLEFVNYVRSLRVDSEPVLVHCSAGIGRTGVLVTMETAMCLTERNLPIYPLDIVRKMRDQRAMMVQTSSQYKFVCEAILRVYEEGLVQMLDPS

SEQ ID NO: 34251 - protein, 782 aa, Homo sapiens
  ENSP00000416654
MDICEGRLTCPLNSAVVLASYAVQSHFGDYNSSIHHPGYLSDSHFIPDQNEDFLTKVESLHEQHSGLKQSEAESCYINIARTLDFYGVELHSGRDLHNLDLMIGIASAGVAVYRKYICTSFYPWVNILKISFKRKKFFIHQRQKQAESREHIVAFNMLNYRSCKNLWKSCVEHHTFFQAKKLLPQEKNVLSQYWTMGSRNTKKSVNNQYCKKVIGGMVWNPAMRRSLSVEHLETKSLPSRSPPITPNWRSPRLRHEIRKPRHSSADNLANEMTYITETEDVFYTYKGSLAPQDSDSEVSQNRSPHQESLSENNPAQSYLTQKSSSSVSPSSNAPGSCSPDGVDQQLLDDFHRVTKGGSTEDASQYYCDKNDNGDSYLVLIRITPDEDGKFGFNLKGGVDQKMPLVVSRINPESPADTCIPKLNEGDQIVLINGRDISEHTHDQVVMFIKASRESHSRELALVIRRRAVRSFADFKSEDELNQLFPEAIFPMCPEGGDTLEGSMAQLKKGLESGTVLIQFEQLYRKKPGLAITFAKLPQNLDKNRYKDVLPYDTTRVLLQGNEDYINASYVNMEIPAANLVNKYIATQGPLPHTCAQFWQVVWDQKLSLIVMLTTLTERGRTKCHQYWPDPPDVMNHGGFHIQCQSEDCTIAYVSREMLVTNTQTGEEHTVTHLQYVAWPDHGVPDDSSDFLEFVNYVRSLRVDSEPVLVHCSAGIGRTGVLVTMETAMCLTERNLPIYPLDIVRKMRDQRAMMVQTSSQYKFVCEAILRVYEEGLVQMLDPS

SEQ ID NO: 34252 - protein, 737 aa, Homo sapiens
  ENSP00000395384
MDICEGRLTCPLNSAVVLASYAVQSHFGDYNSSIHHPGYLSDSHFIPDQNEDFLTKVESLHEQHSGLKQSEAESCYINIARTLDFYGVELHSGRDLHNLDLMIGIASAGVAVYRKYICTSFYPWVNILKISFKRKKFFIHQRQKQAESREHIVAFNMLNYRSCKNLWKSCVEHHTFFQAKKLLPQEKNVLSQYWTMGSRNTKKRSPRLRHEIRKPRHSSADNLANEMTYITETEDVFYTYKGSLAPQDSDSEVSQNRSPHQESLSENNPAQSYLTQKSSSSVSPSSNAPGSCSPDGVDQQLLDDFHRVTKGGSTEDASQYYCDKNDNGDSYLVLIRITPDEDGKFGFNLKGGVDQKMPLVVSRINPESPADTCIPKLNEGDQIVLINGRDISEHTHDQVVMFIKASRESHSRELALVIRRRAVRSFADFKSEDELNQLFPEAIFPMCPEGGDTLEGSMAQLKKGLESGTVLIQFEQLYRKKPGLAITFAKLPQNLDKNRYKDVLPYDTTRVLLQGNEDYINASYVNMEIPAANLVNKYIATQGPLPHTCAQFWQVVWDQKLSLIVMLTTLTERGRTKCHQYWPDPPDVMNHGGFHIQCQSEDCTIAYVSREMLVTNTQTGEEHTVTHLQYVAWPDHGVPDDSSDFLEFVNYVRSLRVDSEPVLVHCSAGIGRTGVLVTMETAMCLTERNLPIYPLDIVRKMRDQRAMMVQTSSQYKFVCEAILRVYEEGLVQMLDPS

SEQ ID NO: 34253 - protein, 839 aa, Homo sapiens
  ENSP00000262539
MTSRLRALGGRINNIRTSELPKEKTRSEVICSIHFLDGVVQTFKVTKQDTGQVLLDMVHNHLGVTEKEYFGLQHDDDSVDSPRWLEASKAIRKQLKGGFPCTLHFRVRFFIPDPNTLQQEQTRHLYFLQLKMDICEGRLTCPLNSAVVLASYAVQSHFGDYNSSIHHPGYLSDSHFIPDQNEDFLTKVESLHEQHSGLKQSEAESCYINIARTLDFYGVELHSGRDLHNLDLMIGIASAGVAVYRKYICTSFYPWVNILKISFKRKKFFIHQRQKQAESREHIVAFNMLNYRSCKNLWKSCVEHHTFFQAKKLLPQEKNVLSQYWTMGSRNTKKSVNNQYCKKVIGGMVWNPAMRRSLSVEHLETKSLPSRSPPITPNWRSPRLRHEIRKPRHSSADNLANEMTYITETEDVFYTYKGSLAPQDSDSEVSQNRSPHQESLSENNPAQSYLTQKSSSSVSPSSNAPGSCSPDGVDQQLLDDFHRVTKGGSTEDASQYYCDKNDNGDSYLVLIRITPDEDGKFGFNLKGGVDQKMPLVVSRINPESPADTCIPKLNEGDQIVLINGRDISEHTHDQVVMFIKASRESHSRELALVIRRRAVRSFADFKSEDELNQLFPEAIFPMCPEGGDTLEGSMAQLKKGLESGTVLIQFEQLYRKKPGLAITFAKLPQNLDKNRYKDVLPYDTTRVLLQGNEDYINASYVNMEIPAANLVNKYIATQGPLPHTCAQFWQVVWDQKLSLIVMLTTLTERGRTKCHQYWPDPPDVMNHGGFHIQCQSEDCTIAYVSREMLVTNTQVSRSLRGTVEGQVLNQRPLSSQVVTLLGVHSVCTWQACQPGKNTQ

SEQ ID NO: 34254 - protein, 369 aa, Homo sapiens
  ENSP00000435056
MEEKIEDDFLDLDPVPETPVFDCVMDIKPEADPTSLTVKSMGLQERRGSNVSLTLDMCTPGCNEEGFGYLMSPREESAREYLLSASRVLQAEELHEKALDPFLLQAEFFEIPMNFVDPKEYDIPGLVRKNRYKTILPNPHSRVCLTSPDPDDPLSSYINANYIRGYGGEEKVYIATQGPIVSTVADFWRMVWQEHTPIIVMITNIEEMNEKCTEYWPEEQVAYDGVEITVQKVIHTEDYRLRLISLKSGTEERGLKHYWFTSWPDQKTPDRAPPLLHLVREVEEAAQQEGPHCAPIIVHCSAGIGRTGCFIATSICCQQLRQEGVVDILKTTCQLRQDRGGMIQTCEQYQFVHHVMSLYEKQLSHQSPE

SEQ ID NO: 34255 - protein, 565 aa, Homo sapiens
  ENSP00000351342
MNYEGARSERENHAADDSEGGALDMCCSERLPGLPQPIVMEALDEAEGLQDSQREMPPPPPPSPPSDPAQKPPPRGAGSHSLTVRSSLCLFAASQFLLACGVLWFSGYGHIWSQNATNLVSSLLTLLKQLEPTAWLDSGTWGVPSLLLVFLSVGLVLVTTLVWHLLRTPPEPPTPLPPEDRRQSVSRQPSFTYSEWMEEKIEDDFLDLDPVPETPVFDCVMDIKPEADPTSLTVKSMGLQERRGSNVSLTLDMCTPGCNEEGFGYLMSPREESAREYLLSASRVLQAEELHEKALDPFLLQAEFFEIPMNFVDPKEYDIPGLVRKNRYKTILPNPHSRVCLTSPDPDDPLSSYINANYIRGYGGEEKVYIATQGPIVSTVADFWRMVWQEHTPIIVMITNIEEMNEKCTEYWPEEQVAYDGVEITVQKVIHTEDYRLRLISLKSGTEERGLKHYWFTSWPDQKTPDRAPPLLHLVREVEEAAQQEGPHCAPIIVHCSAGIGRTGCFIATSICCQQLRQEGVVDILKTTCQLRQDRGGMIQTCEQYQFVHHVMSLYEKQLSHQSPE

SEQ ID NO: 34256 - protein, 171 aa, Homo sapiens
  ENSP00000379469
MWPRWKGEGVPLSVFFLCSSSFHLISISGLVCELKEFTHTWGGPLSPRQSGTEERGLKHYWFTSWPDQKTPDRAPPLLHLVREVEEAAQQEGPHCAPIIVHCSAGIGRTGCFIATSICCQQLRQEGVVDILKTTCQLRQDRGGMIQTCEQYQFVHHVMSLYEKQLSHQSPE

SEQ ID NO: 34257 - protein, 533 aa, Homo sapiens
  ENSP00000379473
MNYEGARSERENHAADDSEGGALDMCCSERLPGLPQPIVMEALDEAEGLQDSQREMPPPPPPSPPSDPAQKPPPRGAGSHSLTVRSSLCLFAASQFLLEPTAWLDSGTWGVPSLLLVFLSVGLVLVTTLVWHLLRTPPEPPTPLPPEDRRQSVSRQPSFTYSEWMEEKIEDDFLDLDPVPETPVFDCVMDIKPEADPTSLTVKSMGLQERRGSNVSLTLDMCTPGCNEEGFGYLMSPREESAREYLLSASRVLQAEELHEKALDPFLLQAEFFEIPMNFVDPKEYDIPGLVRKNRYKTILPNPHSRVCLTSPDPDDPLSSYINANYIRGYGGEEKVYIATQGPIVSTVADFWRMVWQEHTPIIVMITNIEEMNEKCTEYWPEEQVAYDGVEITVQKVIHTEDYRLRLISLKSGTEERGLKHYWFTSWPDQKTPDRAPPLLHLVREVEEAAQQEGPHCAPIIVHCSAGIGRTGCFIATSICCQQLRQEGVVDILKTTCQLRQDRGGMIQTCEQYQFVHHVMSLYEKQLSHQSPE

SEQ ID NO: 34258 - protein, 541 aa, Homo sapiens
  ENSP00000379471
MCCSERLPGLPQPIVMEALDEAEGLQDSQREMPPPPPPSPPSDPAQKPPPRGAGSHSLTVRSSLCLFAASQFLLACGVLWFSGYGHIWSQNATNLVSSLLTLLKQLEPTAWLDSGTWGVPSLLLVFLSVGLVLVTTLVWHLLRTPPEPPTPLPPEDRRQSVSRQPSFTYSEWMEEKIEDDFLDLDPVPETPVFDCVMDIKPEADPTSLTVKSMGLQERRGSNVSLTLDMCTPGCNEEGFGYLMSPREESAREYLLSASRVLQAEELHEKALDPFLLQAEFFEIPMNFVDPKEYDIPGLVRKNRYKTILPNPHSRVCLTSPDPDDPLSSYINANYIRGYGGEEKVYIATQGPIVSTVADFWRMVWQEHTPIIVMITNIEEMNEKCTEYWPEEQVAYDGVEITVQKVIHTEDYRLRLISLKSGTEERGLKHYWFTSWPDQKTPDRAPPLLHLVREVEEAAQQEGPHCAPIIVHCSAGIGRTGCFIATSICCQQLRQEGVVDILKTTCQLRQDRGGMIQTCEQYQFVHHVMSLYEKQLSHQSPE

SEQ ID NO: 34259 - protein, 2215 aa, Homo sapiens
  ENSP00000334928
MEAEFYMVILTCLIFRNSEGFQIVHVQKQQCLFKNEKVVVGSCNRTIQNQQWMWTEDEKLLHVKSALCLAISNSSRGPSRSAILDRCSQAPRWTCYDQEGFLEVENASLFLQKQGSRVVVKKARKYLHSWMKIDVNKEGKLVNESLCLQKAGLGAEVSVRSTRNTAPPQILTTFNAVPDGLVFLIRNTTEAFIRNAAENYSQNSSERQHPNLHMTGITDTSWVLSTTQPFSSTTEETGLAEPERCNFTLAESKASSHSVSIQWRILGSPCNFSLIYSSDTLGAALCPTFRIDNTTYGCNLQDLQAGTIYNFRIISLDEERTVVLQTDPLPPARFGVSKEKTTSTSLHVWWTPSSGKVTSYEVQLFDENNQKIQGVQIQESTSWNEYTFFNLTAGSKYNIAITAVSGGKRSFSVYTNGSTVPSPVKDIGISTKANSLLISWSHGSGNVERYRLMLMDKGILVHGGVVDKHATSYAFHGLTPGYLYNLTVMTEAAGLQNYRWKLVRTAPMEVSNLKVTNDGSLTSLKVKWQRPPGNVDSYNITLSHKGTIKESRVLAPWITETHFKELVPGRLYQVTVSCVSGELSAQKMAVGRTFPDKVANLEANNNGRMRSLVVSWSPPAGDWEQYRILLFNDSVVLLNITVGKEETQYVMDDTGLVPGRQYEVEVIVESGNLKNSERCQGRTVPLAVLQLRVKHANETSLSIMWQTPVAEWEKYIISLADRDLLLIHKSLSKDAKEFTFTDLVPGRKYMATVTSISGDLKNSSSVKGRTVPAQVTDLHVANQGMTSSLFTNWTQAQGDVEFYQVLLIHENVVIKNESISSETSRYSFHSLKSGSLYSVVVTTVSGGISSRQVVVEGRTVPSSVSGVTVNNSGRNDYLSVSWLLAPGDVDNYEVTLSHDGKVVQSLVIAKSVRECSFSSLTPGRLYTVTITTRSGKYENHSFSQERTVPDKVQGVSVSNSARSDYLRVSWVHATGDFDHYEVTIKNKNNFIQTKSIPKSENECVFVQLVPGRLYSVTVTTKSGQYEANEQGNGRTIPEPVKDLTLRNRSTEDLHVTWSGANGDVDQYEIQLLFNDMKVFPPFHLVNTATEYRFTSLTPGRQYKILVLTISGDVQQSAFIEGFTVPSAVKNIHISPNGATDSLTVNWTPGGGDVDSYTVSAFRHSQKVDSQTIPKHVFEHTFHRLEAGEQYQIMIASVSGSLKNQINVVGRTVPASVQGVIADNAYSSYSLIVSWQKAAGVAERYDILLLTENGILLRNTSEPATTKQHKFEDLTPGKKYKIQILTVSGGLFSKEAQTEGRTVPAAVTDLRITENSTRHLSFRWTASEGELSWYNIFLYNPDGNLQERAQVDPLVQSFSFQNLLQGRMYKMVIVTHSGELSNESFIFGRTVPASVSHLRGSNRNTTDSLWFNWSPASGDFDFYELILYNPNGTKKENWKDKDLTEWRFQGLVPGRKYVLWVVTHSGDLSNKVTAESRTAPSPPSLMSFADIANTSLAITWKGPPDWTDYNDFELQWLPRDALTVFNPYNNRKSEGRIVYGLRPGRSYQFNVKTVSGDSWKTYSKPIFGSVRTKPDKIQNLHCRPQNSTAIACSWIPPDSDFDGYSIECRKMDTQEVEFSRKLEKEKSLLNIMMLVPHKRYLVSIKVQSAGMTSEVVEDSTITMIDRPPPPPPHIRVNEKDVLISKSSINFTVNCSWFSDTNGAVKYFTVVVREADGSDELKPEQQHPLPSYLEYRHNASIRVYQTNYFASKCAENPNSNSKSFNIKLGAEMESLGGKCDPTQQKFCDGPLKPHTAYRISIRAFTQLFDEDLKEFTKPLYSDTFFSLPITTESEPLFGAIEGVSAGLFLIGMLVAVVALLICRQKVSHGRERPSARLSIRRDRPLSVHLNLGQKGNRKTSCPIKINQFEGHFMKLQADSNYLLSKEYEELKDVGRNQSCDIALLPENRGKNRYNNILPYDATRVKLSNVDDDPCSDYINASYIPGNNFRREYIVTQGPLPGTKDDFWKMVWEQNVHNIVMVTQCVEKGRVKCDHYWPADQDSLYYGDLILQMLSESVLPEWTIREFKICGEEQLDAHRLIRHFHYTVWPDHGVPETTQSLIQFVRTVRDYINRSPGAGPTVVHCSAGVGRTGTFIALDRILQQLDSKDSVDIYGAVHDLRLHRVHMVQTECQYVYLHQCVRDVLRARKLRSEQENPLFPIYENVNPEYHRDPVYSRH

SEQ ID NO: 34260 - protein, 2127 aa, Homo sapiens
  ENSP00000448058
MEAEFYMVILTCLIFRNSEGFQIVHVQKQQCLFKNEKVVVGSCNRTIQNQQWMWTEDEKLLHVKSALCLAISNSSRGPSRSAILDRCSQAPRWTCYDQEGFLEVENASLFLQKQGSRVVVKKARKYLHSWMKIDVNKEGKLVNESLCLQKAGLGAEVSVRSTRNTAPPQILTTFNAVPDGLVFLIRNTTEAFIRNAAENYSQNSSERQHPNLHMTGITDTSWVLSTTQPFSSTTEETGLAEPERCNFTLAESKASSHSVSIQWRILGSPCNFSLIYSSDTLGAALCPTFRIDNTTYGCNLQDLQAGTIYNFRIISLDEERTVVLQTDPLPPARFGVSKEKTTSTSLHVWWTPSSGKVTSYEVQLFDENNQKIQGVQIQESTSWNEYTFFNLTAGSKYNIAITAVSGGKRSFSVYTNGSTVPSPVKDIGISTKANSLLISWSHGSGNVERYRLMLMDKGILVHGGVVDKHATSYAFHGLTPGYLYNLTVMTEAAGLQNYRWKLVRTAPMEVSNLKVTNDGSLTSLKVKWQRPPGNVDSYNITLSHKGTIKESRVLAPWITETHFKELVPGRLYQVTVSCVSGELSAQKMAVGRTFPDKVANLEANNNGRMRSLVVSWSPPAGDWEQYRILLFNDSVVLLNITVGKEETQYVMDDTGLVPGRQYEVEVIVESGNLKNSERCQGRTVPLAVLQLRVKHANETSLSIMWQTPVAEWEKYIISLADRDLLLIHKSLSKDAKEFTFTDLVPGRKYMATVTSISGDLKNSSSVKGRTVPAQVTDLHVANQGMTSSLFTNWTQAQGDVEFYQVLLIHENVVIKNESISSETSRYSFHSLKSGSLYSVVVTTVSGGISSRQVVVEGRTVPDKVQGVSVSNSARSDYLRVSWVHATGDFDHYEVTIKNKNNFIQTKSIPKSENECVFVQLVPGRLYSVTVTTKSGQYEANEQGNGRTIPEPVKDLTLRNRSTEDLHVTWSGANGDVDQYEIQLLFNDMKVFPPFHLVNTATEYRFTSLTPGRQYKILVLTISGDVQQSAFIEGFTVPSAVKNIHISPNGATDSLTVNWTPGGGDVDSYTVSAFRHSQKVDSQTIPKHVFEHTFHRLEAGEQYQIMIASVSGSLKNQINVVGRTVPASVQGVIADNAYSSYSLIVSWQKAAGVAERYDILLLTENGILLRNTSEPATTKQHKFEDLTPGKKYKIQILTVSGGLFSKEAQTEGRTVPAAVTDLRITENSTRHLSFRWTASEGELSWYNIFLYNPDGNLQERAQVDPLVQSFSFQNLLQGRMYKMVIVTHSGELSNESFIFGRTVPASVSHLRGSNRNTTDSLWFNWSPASGDFDFYELILYNPNGTKKENWKDKDLTEWRFQGLVPGRKYVLWVVTHSGDLSNKVTAESRTAPSPPSLMSFADIANTSLAITWKGPPDWTDYNDFELQWLPRDALTVFNPYNNRKSEGRIVYGLRPGRSYQFNVKTVSGDSWKTYSKPIFGSVRTKPDKIQNLHCRPQNSTAIACSWIPPDSDFDGYSIECRKMDTQEVEFSRKLEKEKSLLNIMMLVPHKRYLVSIKVQSAGMTSEVVEDSTITMIDRPPPPPPHIRVNEKDVLISKSSINFTVNCSWFSDTNGAVKYFTVVVREADGSDELKPEQQHPLPSYLEYRHNASIRVYQTNYFASKCAENPNSNSKSFNIKLGAEMESLGGKCDPTQQKFCDGPLKPHTAYRISIRAFTQLFDEDLKEFTKPLYSDTFFSLPITTESEPLFGAIEGVSAGLFLIGMLVAVVALLICRQKVSHGRERPSARLSIRRDRPLSVHLNLGQKGNRKTSCPIKINQFEGHFMKLQADSNYLLSKEYEELKDVGRNQSCDIALLPENRGKNRYNNILPYDATRVKLSNVDDDPCSDYINASYIPGNNFRREYIVTQGPLPGTKDDFWKMVWEQNVHNIVMVTQCVEKGRVKCDHYWPADQDSLYYGDLILQMLSESVLPEWTIREFKICGEEQLDAHRLIRHFHYTVWPDHGVPETTQSLIQFVRTVRDYINRSPGAGPTVVHCSAGVGRTGTFIALDRILQQLDSKDSVDIYGAVHDLRLHRVHMVQTECQYVYLHQCVRDVLRARKLRSEQENPLFPIYENVNPEYHRDPVYSRH

SEQ ID NO: 34261 - protein, 1907 aa, Homo sapiens
  ENSP00000438927
MLSHGAGLALWITLSLLQTGLAEPERCNFTLAESKASSHSVSIQWRILGSPCNFSLIYSSDTLGAALCPTFRIDNTTYGCNLQDLQAGTIYNFRIISLDEERTVVLQTDPLPPARFGVSKEKTTSTSLHVWWTPSSGKVTSYEVQLFDENNQKIQGVQIQESTSWNEYTFFNLTAGSKYNIAITAVSGGKRSFSVYTNGSTVPSPVKDIGISTKANSLLISWSHGSGNVERYRLMLMDKGILVHGGVVDKHATSYAFHGLTPGYLYNLTVMTEAAGLQNYRWKLVRTAPMEVSNLKVTNDGSLTSLKVKWQRPPGNVDSYNITLSHKGTIKESRVLAPWITETHFKELVPGRLYQVTVSCVSGELSAQKMAVGRTFPDKVANLEANNNGRMRSLVVSWSPPAGDWEQYRILLFNDSVVLLNITVGKEETQYVMDDTGLVPGRQYEVEVIVESGNLKNSERCQGRTVPLAVLQLRVKHANETSLSIMWQTPVAEWEKYIISLADRDLLLIHKSLSKDAKEFTFTDLVPGRKYMATVTSISGDLKNSSSVKGRTVPAQVTDLHVANQGMTSSLFTNWTQAQGDVEFYQVLLIHENVVIKNESISSETSRYSFHSLKSGSLYSVVVTTVSGGISSRQVVVEGRTVPSSVSGVTVNNSGRNDYLSVSWLLAPGDVDNYEVTLSHDGKVVQSLVIAKSVRECSFSSLTPGRLYTVTITTRSGKYENHSFSQERTVPDKVQGVSVSNSARSDYLRVSWVHATGDFDHYEVTIKNKNNFIQTKSIPKSENECVFVQLVPGRLYSVTVTTKSGQYEANEQGNGRTIPEPVKDLTLRNRSTEDLHVTWSGANGDVDQYEIQLLFNDMKVFPPFHLVNTATEYRFTSLTPGRQYKILVLTISGDVQQSAFIEGFTVPSAVKNIHISPNGATDSLTVNWTPGGGDVDSYTVSAFRHSQKVDSQTIPKHVFEHTFHRLEAGEQYQIMIASVSGSLKNQINVVGRTVPAAVTDLRITENSTRHLSFRWTASEGELSWYNIFLYNPDGNLQERAQVDPLVQSFSFQNLLQGRMYKMVIVTHSGELSNESFIFGRTVPASVSHLRGSNRNTTDSLWFNWSPASGDFDFYELILYNPNGTKKENWKDKDLTEWRFQGLVPGRKYVLWVVTHSGDLSNKVTAESRTAPSPPSLMSFADIANTSLAITWKGPPDWTDYNDFELQWLPRDALTVFNPYNNRKSEGRIVYGLRPGRSYQFNVKTVSGDSWKTYSKPIFGSVRTKPDKIQNLHCRPQNSTAIACSWIPPDSDFDGYSIECRKMDTQEVEFSRKLEKEKSLLNIMMLVPHKRYLVSIKVQSAGMTSEVVEDSTITMIDRPPPPPPHIRVNEKDVLISKSSINFTVNCSWFSDTNGAVKYFTVVVREADGSDELKPEQQHPLPSYLEYRHNASIRVYQTNYFASKCAENPNSNSKSFNIKLGAEMESLGGKCDPTQQKFCDGPLKPHTAYRISIRAFTQLFDEDLKEFTKPLYSDTFFSLPITTESEPLFGAIEGVSAGLFLIGMLVAVVALLICRQKVSHGRERPSARLSIRRDRPLSVHLNLGQKGNRKTSCPIKINQFEGHFMKLQADSNYLLSKEYEELKDVGRNQSCDIALLPENRGKNRYNNILPYDATRVKLSNVDDDPCSDYINASYIPGNNFRREYIVTQGPLPGTKDDFWKMVWEQNVHNIVMVTQCVEKGRVKCDHYWPADQDSLYYGDLILQMLSESVLPEWTIREFKICGEEQLDAHRLIRHFHYTVWPDHGVPETTQSLIQFVRTVRDYINRSPGAGPTVVHCSAGVGRTGTFIALDRILQQLDSKDSVDIYGAVHDLRLHRVHMVQTECQYVYLHQCVRDVLRARKLRSEQENPLFPIYENVNPEYHRDPVYSRH

SEQ ID NO: 34262 - protein, 1907 aa, Homo sapiens
  ENSP00000447302
MLSHGAGLALWITLSLLQTGLAEPERCNFTLAESKASSHSVSIQWRILGSPCNFSLIYSSDTLGAALCPTFRIDNTTYGCNLQDLQAGTIYNFRIISLDEERTVVLQTDPLPPARFGVSKEKTTSTSLHVWWTPSSGKVTSYEVQLFDENNQKIQGVQIQESTSWNEYTFFNLTAGSKYNIAITAVSGGKRSFSVYTNGSTVPSPVKDIGISTKANSLLISWSHGSGNVERYRLMLMDKGILVHGGVVDKHATSYAFHGLTPGYLYNLTVMTEAAGLQNYRWKLVRTAPMEVSNLKVTNDGSLTSLKVKWQRPPGNVDSYNITLSHKGTIKESRVLAPWITETHFKELVPGRLYQVTVSCVSGELSAQKMAVGRTFPLAVLQLRVKHANETSLSIMWQTPVAEWEKYIISLADRDLLLIHKSLSKDAKEFTFTDLVPGRKYMATVTSISGDLKNSSSVKGRTVPAQVTDLHVANQGMTSSLFTNWTQAQGDVEFYQVLLIHENVVIKNESISSETSRYSFHSLKSGSLYSVVVTTVSGGISSRQVVVEGRTVPSSVSGVTVNNSGRNDYLSVSWLLAPGDVDNYEVTLSHDGKVVQSLVIAKSVRECSFSSLTPGRLYTVTITTRSGKYENHSFSQERTVPDKVQGVSVSNSARSDYLRVSWVHATGDFDHYEVTIKNKNNFIQTKSIPKSENECVFVQLVPGRLYSVTVTTKSGQYEANEQGNGRTIPEPVKDLTLRNRSTEDLHVTWSGANGDVDQYEIQLLFNDMKVFPPFHLVNTATEYRFTSLTPGRQYKILVLTISGDVQQSAFIEGFTVPSAVKNIHISPNGATDSLTVNWTPGGGDVDSYTVSAFRHSQKVDSQTIPKHVFEHTFHRLEAGEQYQIMIASVSGSLKNQINVVGRTVPASVQGVIADNAYSSYSLIVSWQKAAGVAERYDILLLTENGILLRNTSEPATTKQHKFEDLTPGKKYKIQILTVSGGLFSKEAQTEGRTVPAAVTDLRITENSTRHLSFRWTASEGELSWYNIFLYNPDGNLQERAQVDPLVQSFSFQNLLQGRMYKMVIVTHSGELSNESFIFGRTVPASVSHLRGSNRNTTDSLWFNWSPASGDFDFYELILYNPNGTKKENWKDKDLTEWRFQGLVPGRKYVLWVVTHSGDLSNKVTAESRTAPSPPSLMSFADIANTSLAITWKGPPDWTDYNDFELQWLPRDALTVFNPYNNRKSEGRIVYGLRPGRSYQFNVKTVSGDSWKTYSKPIFGSVRTKPDKIQNLHCRPQNSTAIACSWIPPDSDFDGYSIECRKMDTQEVEFSRKLEKEKSLLNIMMLVPHKRYLVSIKVQSAGMTSEVVEDSTITMIDRPPPPPPHIRVNEKDVLISKSSINFTVNCSWFSDTNGAVKYFTVVVREADGSDELKPEQQHPLPSYLEYRHNASIRVYQTNYFASKCAENPNSNSKSFNIKLGAEMESLGGKCDPTQQKFCDGPLKPHTAYRISIRAFTQLFDEDLKEFTKPLYSDTFFSLPITTESEPLFGAIEGVSAGLFLIGMLVAVVALLICRQKVSHGRERPSARLSIRRDRPLSVHLNLGQKGNRKTSCPIKINQFEGHFMKLQADSNYLLSKEYEELKDVGRNQSCDIALLPENRGKNRYNNILPYDATRVKLSNVDDDPCSDYINASYIPGNNFRREYIVTQGPLPGTKDDFWKMVWEQNVHNIVMVTQCVEKGRVKCDHYWPADQDSLYYGDLILQMLSESVLPEWTIREFKICGEEQLDAHRLIRHFHYTVWPDHGVPETTQSLIQFVRTVRDYINRSPGAGPTVVHCSAGVGRTGTFIALDRILQQLDSKDSVDIYGAVHDLRLHRVHMVQTECQYVYLHQCVRDVLRARKLRSEQENPLFPIYENVNPEYHRDPVYSRH

SEQ ID NO: 34263 - protein, 1997 aa, Homo sapiens
  ENSP00000261266
MLSHGAGLALWITLSLLQTGLAEPERCNFTLAESKASSHSVSIQWRILGSPCNFSLIYSSDTLGAALCPTFRIDNTTYGCNLQDLQAGTIYNFRIISLDEERTVVLQTDPLPPARFGVSKEKTTSTSLHVWWTPSSGKVTSYEVQLFDENNQKIQGVQIQESTSWNEYTFFNLTAGSKYNIAITAVSGGKRSFSVYTNGSTVPSPVKDIGISTKANSLLISWSHGSGNVERYRLMLMDKGILVHGGVVDKHATSYAFHGLTPGYLYNLTVMTEAAGLQNYRWKLVRTAPMEVSNLKVTNDGSLTSLKVKWQRPPGNVDSYNITLSHKGTIKESRVLAPWITETHFKELVPGRLYQVTVSCVSGELSAQKMAVGRTFPDKVANLEANNNGRMRSLVVSWSPPAGDWEQYRILLFNDSVVLLNITVGKEETQYVMDDTGLVPGRQYEVEVIVESGNLKNSERCQGRTVPLAVLQLRVKHANETSLSIMWQTPVAEWEKYIISLADRDLLLIHKSLSKDAKEFTFTDLVPGRKYMATVTSISGDLKNSSSVKGRTVPAQVTDLHVANQGMTSSLFTNWTQAQGDVEFYQVLLIHENVVIKNESISSETSRYSFHSLKSGSLYSVVVTTVSGGISSRQVVVEGRTVPSSVSGVTVNNSGRNDYLSVSWLLAPGDVDNYEVTLSHDGKVVQSLVIAKSVRECSFSSLTPGRLYTVTITTRSGKYENHSFSQERTVPDKVQGVSVSNSARSDYLRVSWVHATGDFDHYEVTIKNKNNFIQTKSIPKSENECVFVQLVPGRLYSVTVTTKSGQYEANEQGNGRTIPEPVKDLTLRNRSTEDLHVTWSGANGDVDQYEIQLLFNDMKVFPPFHLVNTATEYRFTSLTPGRQYKILVLTISGDVQQSAFIEGFTVPSAVKNIHISPNGATDSLTVNWTPGGGDVDSYTVSAFRHSQKVDSQTIPKHVFEHTFHRLEAGEQYQIMIASVSGSLKNQINVVGRTVPASVQGVIADNAYSSYSLIVSWQKAAGVAERYDILLLTENGILLRNTSEPATTKQHKFEDLTPGKKYKIQILTVSGGLFSKEAQTEGRTVPAAVTDLRITENSTRHLSFRWTASEGELSWYNIFLYNPDGNLQERAQVDPLVQSFSFQNLLQGRMYKMVIVTHSGELSNESFIFGRTVPASVSHLRGSNRNTTDSLWFNWSPASGDFDFYELILYNPNGTKKENWKDKDLTEWRFQGLVPGRKYVLWVVTHSGDLSNKVTAESRTAPSPPSLMSFADIANTSLAITWKGPPDWTDYNDFELQWLPRDALTVFNPYNNRKSEGRIVYGLRPGRSYQFNVKTVSGDSWKTYSKPIFGSVRTKPDKIQNLHCRPQNSTAIACSWIPPDSDFDGYSIECRKMDTQEVEFSRKLEKEKSLLNIMMLVPHKRYLVSIKVQSAGMTSEVVEDSTITMIDRPPPPPPHIRVNEKDVLISKSSINFTVNCSWFSDTNGAVKYFTVVVREADGSDELKPEQQHPLPSYLEYRHNASIRVYQTNYFASKCAENPNSNSKSFNIKLGAEMESLGGKCDPTQQKFCDGPLKPHTAYRISIRAFTQLFDEDLKEFTKPLYSDTFFSLPITTESEPLFGAIEGVSAGLFLIGMLVAVVALLICRQKVSHGRERPSARLSIRRDRPLSVHLNLGQKGNRKTSCPIKINQFEGHFMKLQADSNYLLSKEYEELKDVGRNQSCDIALLPENRGKNRYNNILPYDATRVKLSNVDDDPCSDYINASYIPGNNFRREYIVTQGPLPGTKDDFWKMVWEQNVHNIVMVTQCVEKGRVKCDHYWPADQDSLYYGDLILQMLSESVLPEWTIREFKICGEEQLDAHRLIRHFHYTVWPDHGVPETTQSLIQFVRTVRDYINRSPGAGPTVVHCSAGVGRTGTFIALDRILQQLDSKDSVDIYGAVHDLRLHRVHMVQTECQYVYLHQCVRDVLRARKLRSEQENPLFPIYENVNPEYHRDPVYSRH

SEQ ID NO: 34264 - protein, 1583 aa, Homo sapiens
  ENSP00000448349
MEAEFYMVILTCLIFRNSGFQIVHVQKQQCLFKNEKVVVGSCNRTIQNQQWMWTEDEKLLHVKSALCLAISNSSRGPSRSAILDRCSQAPRWTCYDQEGFLEVENASLFLQKQGSRVVVKKARKYLHSWMKIDVNKEGKLVNESLCLQKAGLGAEVSVRSTRNTAPPQILTTFNAVPDGLVFLIRNTTEAFIRNAAENYSQNSSERQHPNLHMTGITDTSWVLSTTQPFSSTTEETGLAEPERCNFTLAESKASSHSVSIQWRILGSPCNFSLIYSSDTLGAALCPTFRIDNTTYGCNLQDLQAGTIYNFRIISLDEERTVVLQTDPLPPARFGVSKEKTTSTSLHVWWTPSSGKVTSYEVQLFDENNQKIQGVQIQESTSWNEYTFFNLTAGSKYNIAITAVSGGKRSFSVYTNGSTVPSPVKDIGISTKANSLLISWSHGSGNVERYRLMLMDKGILVHGGVVDKHATSYAFHGLTPGYLYNLTVMTEAAGLQNYRWKLVRTAPMEVSNLKVTNDGSLTSLKVKWQRPPGNVDSYNITLSHKGTIKESRVLAPWITETHFKELVPGRLYQVTVSCVSGELSAQKMAVGRTFPDKVANLEANNNGRMRSLVVSWSPPAGDWEQYRILLFNDSVVLLNITVGKEETQYVMDDTGLVPGRQYEVEVIVESGNLKNSERCQGRTVPLAVLQLRVKHANETSLSIMWQTPVAEWEKYIISLADRDLLLIHKSLSKDAKEFTFTDLVPGRKYMATVTSISGDLKNSSSVKGRTVPAQVTDLHVANQGMTSSLFTNWTQAQGDVEFYQVLLIHENVVIKNESISSETSRYSFHSLKSGSLYSVVVTTVSGGISSRQVVVEGRTVPSSVSGVTVNNSGRNDYLSVSWLLAPGDVDNYEVTLSHDGKVVQSLVIAKSVRECSFSSLTPGRLYTVTITTRSGKYENHSFSQERTVPDKVQGVSVSNSARSDYLRVSWVHATGDFDHYEVTIKNKNNFIQTKSIPKSENECVFVQLVPGRLYSVTVTTKSGQYEANEQGNGRTIPEPVKDLTLRNRSTEDLHVTWSGANGDVDQYEIQLLFNDMKVFPPFHLVNTATEYRFTSLTPGRQYKILVLTISGDVQQSAFIEGFTVPSAVKNIHISPNGATDSLTVNWTPGGGDVDSYTVSAFRHSQKVDSQTIPKHVFEHTFHRLEAGEQYQIMIASVSGSLKNQINVVGRTVPASVQGVIADNAYSSYSLIVSWQKAAGVAERYDILLLTENGILLRNTSEPATTKQHKFEDLTPGKKYKIQILTVSGGLFSKEAQTEGRTVPAAVTDLRITENSTRHLSFRWTASEGELSWYNIFLYNPDGNLQERAQVDPLVQSFSFQNLLQGRMYKMVIVTHSGELSNESFIFGRTVPASVSHLRGSNRNTTDSLWFNWSPASGDFDFYELILYNPNGTKKENWKDKDLTEWRFQGLVPGRKYVLWVVTHSGDLSNKVTAESRTAPSPPSLMSFADIANTSLAITWKGPPDWTDYNDFELQWLPRDALTVFNPYNNRKSEGRIVYGLRPGRSYQFNVKTVSGDSWKTYSKPIFGSVRTSMTCFATLISQME

SEQ ID NO: 34265 - protein, 1407 aa, Homo sapiens
  ENSP00000446982
MEAEFYMVILTCLIFRNSEGFQIVHVQKQQCLFKNEKVVVGSCNRTIQNQQWMWTEDEKLLHVKSALCLAFIRNAAENYSQNSSERQHPNLHMTGITDTSWVLSTTQPFSSTTEETGLAEPERCNFTLAESKASSHSVSIQWRILGSPCNFSLIYSSDTLGAALCPTFRIDNTTYGCNLQDLQAGTIYNFRIISLDEERTVVLQTDPLPPARFGVSKEKTTSTSLHVWWTPSSGKVTSYEVQLFDENNQKIQGVQIQESTSWNEYTFFNLTAGSKYNIAITAVSGGKRSFSVYTNGSTVPSPVKDIGISTKANSLLISWSHGSGNVERYRLMLMDKGILVHGGVVDKHATSYAFHGLTPGYLYNLTVMTEAAGLQNYRWKLVRTAPMEVSNLKVTNDGSLTSLKVKWQRPPGNVDSYNITLSHKGTIKESRVLAPWITETHFKELVPGRLYQVTVSCVSGELSAQKMAVGRTFPDKVANLEANNNGRMRSLVVSWSPPAGDWEQYRILLFNDSVVLLNITVGKEETQYVMDDTGLVPGRQYEVEVIVESGNLKNSERCQGRTVPLAVLQLRVKHANETSLSIMWQTPVAEWEKYIISLADRDLLLIHKSLSKDAKEFTFTDLVPGRKYMATVTSISGDLKNSSSVKGRTVPAQVTDLHVANQGMTSSLFTNWTQAQGDVEFYQVLLIHENVVIKNESISSETSRYSFHSLKSGSLYSVVVTTVSGGISSRQVVVEGRTVPSSVSGVTVNNSGRNDYLSVSWLLAPGDVDNYEVTLSHDGKVVQSLVIAKSVRECSFSSLTPGRLYTVTITTRSGKYENHSFSQERTVPDKVQGVSVSNSARSDYLRVSWVHATGDFDHYEVTIKNKNNFIQTKSIPKSENECVFVQLVPGRLYSVTVTTKSGQYEANEQGNGRTIPEPVKDLTLRNRSTEDLHVTWSGANGDVDQYEIQLLFNDMKVFPPFHLVNTATEYRFTSLTPGRQYKILVLTISGDVQQSAFIEGFTVPSAVKNIHISPNGATDSLTVNWTPGGGDVDSYTVSAFRHSQKVDSQTIPKHVFEHTFHRLEAGEQYQIMIASVSGSLKNQINVVGRTVPASVQGVIADNAYSSYSLIVSWQKAAGVAERYDILLLTENGILLRNTSEPATTKQHKFEDLTPGKKYKIQILTVSGGLFSKEAQTEGRTVPAAVTDLRITENSTRHLSFRWTASEGELSWYNIFLYNPDGNLQERAQVDPLVQSFSFQNLLQGRMYKMVIVTHSGELSNESFIFGRTVPASVSHLRGSNRNTTDSLWFNWSPASGDFDFYELILYNPNGTKKENWKDKDLTEWRFQGLVPGRKYVLWVVTHSGDLSNKVTAESRTAPSPPSLMSFADIANTSLAITWKGPPDWTDYNDFELQWLPRDALTVFNPYN

SEQ ID NO: 34266 - protein, 103 aa, Homo sapiens
  ENSP00000446934
  MOD_RES (1)..(1): Any amino acid
XLWITLSLLQTGLAEPERCNFTLAESKASSHSVSIQWRILGSPCNFSLIYSSDTLGAALCPTFRIDNTTYGCNLQDLQAGTIYNFRIISLDEERTVVLQTGKG

SEQ ID NO: 34267 - protein, 700 aa, Homo sapiens
  ENSP00000254667
MEPLCPLLLVGFSLPLARALRGNETTADSNETTTTSGPPDPGASQPLLAWLLLPLLLLLLVLLLAAYFFRFRKQRKAVVSTSDKKMPNGILEEQEQQRVMLLSRSPSGPKKYFPIPVEHLEEEIRIRSADDCKQFREEFNSLPSGHIQGTFELANKEENREKNRYPNILPNDHSRVILSQLDGIPCSDYINASYIDGYKEKNKFIAAQGPKQETVNDFWRMVWEQKSATIVMLTNLKERKEEKCHQYWPDQGCWTYGNIRVCVEDCVVLVDYTIRKFCIQPQLPDGCKAPRLVSQLHFTSWPDFGVPFTPIGMLKFLKKVKTLNPVHAGPIVVHCSAGVGRTGTFIVIDAMMAMMHAEQKVDVFEFVSRIRNQRPQMVQTDMQYTFIYQALLEYYLYGDTELDVSSLEKHLQTMHGTTTHFDKIGLEEEFRKLTNVRIMKENMRTGNLPANMKKARVIQIIPYDFNRVILSMKRGQEYTDYINASFIDGYRQKDYFIATQGPLAHTVEDFWRMIWEWKSHTIVMLTEVQEREQDKCYQYWPTEGSVTHGEITIEIKNDTLSEAISIRDFLVTLNQPQARQEEQVRVVRQFHFHGWPEIGIPAEGKGMIDLIAAVQKQQQQTGNHPITVHCSAGAGRTGTFIALSNILERVKAEGLLDVFQAVKSLRLQRPHMVQTLEQYEFCYKVVQDFIDIFSDYANFK

SEQ ID NO: 34268 - protein, 140 aa, Homo sapiens
  ENSP00000410540
MEPLCPLLLVGFSLPLARALRGNETTADSNETTTTSGPPDPGASQPLLAWLLLPLLLLLLVLLLAAYFFRFRKQRKAVVSTSDKKMPNGILEEQEQQRVMLLSRSPSGPKKYFPIPVEHLEEEIRIRSADDCKQFREEFN

SEQ ID NO: 34269 - protein, 149 aa, Homo sapiens
  ENSP00000474102
MEPLCPLLLVGFSLPLARALRGNETTADSNETTTTSGPPDPGASQPLLAWLLLPLLLLLLVLLLAAYFFRFRKQRKAVVSTSDKKMPNGILEEQAKGDAAQQVTLRAQEVFSHPRGAPGGGDPYQIRRRLQAVSGGVQLIAIWTHTRNF

SEQ ID NO: 34270 - protein, 153 aa, Homo sapiens
  ENSP00000416939
MEPLCPLLLVGFSLPLARALRGNETTADSNETTTTSGPPDPGASQPLLAWLLLPLLLLLLVLLLAAYFFRFRKQRKAVVSTSDKKMPNGILEEQEQQRVMLLSRSPSGPKKYFPIPVEHLEEEIRIRSADDCKQFREEFNSLPSGHIQGTFEL

SEQ ID NO: 34271 - protein, 107 aa, Homo sapiens
  ENSP00000474830
RLPAAAGLAATAAAAPPPRAPSRRLLLQEAEESCGQHQRQEDAQRNLGGARAAKGDAAQQVTLRAQEVFSHPRGAPGGGDPYQIRRRLQAVSGGVQLIAIWTHTRNF

SEQ ID NO: 34272 - protein, 642 aa, Homo sapiens
  ENSP00000303350
MSNRSSFSRLTWFRKQRKAVVSTSDKKMPNGILEEQEQQRVMLLSRSPSGPKKYFPIPVEHLEEEIRIRSADDCKQFREEFNSLPSGHIQGTFELANKEENREKNRYPNILPNDHSRVILSQLDGIPCSDYINASYIDGYKEKNKFIAAQGPKQETVNDFWRMVWEQKSATIVMLTNLKERKEEKCHQYWPDQGCWTYGNIRVCVEDCVVLVDYTIRKFCIQPQLPDGCKAPRLVSQLHFTSWPDFGVPFTPIGMLKFLKKVKTLNPVHAGPIVVHCSAGVGRTGTFIVIDAMMAMMHAEQKVDVFEFVSRIRNQRPQMVQTDMQYTFIYQALLEYYLYGDTELDVSSLEKHLQTMHGTTTHFDKIGLEEEFRKLTNVRIMKENMRTGNLPANMKKARVIQIIPYDFNRVILSMKRGQEYTDYINASFIDGYRQKDYFIATQGPLAHTVEDFWRMIWEWKSHTIVMLTEVQEREQDKCYQYWPTEGSVTHGEITIEIKNDTLSEAISIRDFLVTLNQPQARQEEQVRVVRQFHFHGWPEIGIPAEGKGMIDLIAAVQKQQQQTGNHPITVHCSAGAGRTGTFIALSNILERVKAEGLLDVFQAVKSLRLQRPHMVQTLEQYEFCYKVVQDFIDIFSDYANFK

SEQ ID NO: 34273 - protein, 118 aa, Homo sapiens
  ENSP00000475063
MSNRSSFSRLTWFRKQRKAVVSTSDKKMPNGILEEQEQQRVMLLSRSPSGPKKYFPIPVEHLEEEIRIRSADDCKQFREEFNSLPSGHIQGTFELANKEENREKNRYPNILPRLQREE

SEQ ID NO: 34274 - protein, 536 aa, Homo sapiens
  ENSP00000473761
MSNRSSFSRLTWFRKQRKAVVSTSDKKMPNGILEEQEQQRVMLLSRSPSGPKKYFPIPVEHLEEEIRIRSADDCKQFREEFNSLPSGHIQGTFELANKEENREKNRYPNILPNDHSRVILSQLDGIPCSDYINASYIDGYKEKNKFIAAQGPKQETVNDFWRMVWEQKSATIVMLTNLKERKEEKCHQYWPDQGCWTYGNIRVCVEDCVVLVDYTIRKFCIQPQLPDGCKAPRLVSQLHFTSWPDFGVPFTPIGMLKFLKKVKTLNPVHAGPIVVHCSAGVGRTGTFIVIDAMMAMMHAEQKVDVFEFVSRIRNQRPQMVQTDMQYTFIYQALLEYYLYGDTELDVSSLEKHLQTMHGTTTHFDKIGLEEEFRKLTNVRIMKENMRTGNLPANMKKARVIQIIPCKAPVAWLGQGWGGAGAGGFHPGEAIDRLPLCTRVKSRVSSGLRLRAPVCCTKCQVEKTPVKHQLTQTVLHGSQASCFGYELADAGGQPRLISGEGFTEAGDLRQARLGIPCLIPCLPKPGQRPASPLHRGA

SEQ ID NO: 34275 - protein, 1337 aa, Homo sapiens
  ENSP00000400010
MKPAAREARLPPRSPGLRWALPLLLLLLRLGQILCAGGTPSPIPDPSVATVATGENGITQISSTAESFHKQNGTGTPQVETNTSEDGESSGANDSLRTPEQGSNGTDGASQKTPSSTGPSPVFDIKAVSISPTNVILTWKSNDTAASEYKYVVKHKMENEKTITVVHQPWCNITGLRPATSYVFSITPGIGNETWGDPRVIKVITEPIPVSDLRVALTGVRKAALSWSNGNGTASCRVLLESIGSHEELTQDSRLQVNISGLKPGVQYNINPYLLQSNKTKGDPLGTEGGLDASNTERSRAGSPTAPVHDESLVGPVDPSSGQQSRDTEVLLVGLEPGTRYNATVYSQAANGTEGQPQAIEFRTNAIQVFDVTAVNISATSLTLIWKVSDNESSSNYTYKIHVAGETDSSNLNVSEPRAVIPGLRSSTFYNITVCPVLGDIEGTPGFLQVHTPPVPVSDFRVTVVSTTEIGLAWSSHDAESFQMHITQEGAGNSRVEITTNQSIIIGGLFPGTKYCFEIVPKGPNGTEGASRTVCNRTVPSAVFDIHVVYVTTTEMWLDWKSPDGASEYVYHLVIESKHGSNHTSTYDKAITLQGLIPGTLYNITISPEVDHVWGDPNSTAQYTRPSNVSNIDVSTNTTAATLSWQNFDDASPTYSYCLLIEKAGNSSNATQVVTDIGITDATVTELIPGSSYTVEIFAQVGDGIKSLEPGRKSFCTDPASMASFDCEVVPKEPALVLKWTCPPGANAGFELEVSSGAWNNATHLESCSSENGTEYRTEVTYLNFSTSYNISITTVSCGKMAAPTRNTCTTGITDPPPPDGSPNITSVSHNSVKVKFSGFEASHGPIKAYAVILTTGEAGHPSADVLKYTYEDFKKGASDTYVTYLIRTEEKGRSQSLSEVLKYEIDVGNESTTLGYYNGKLEPLGSYRACVAGFTNITFHPQNKGLIDGAESYVSFSRYSDAVSLPQDPGVICGAVFGCIFGALVIVTVGGFIFWRKKRKDAKNNEVSFSQIKPKKSKLIRVENFEAYFKKQQADSNCGFAEEYEDLKLVGISQPKYAAELAENRGKNRYNNVLPYDISRVKLSVQTHSTDDYINANYMPGYHSKKDFIATQGPLPNTLKDFWRMVWEKNVYAIIMLTKCVEQGRTKCEEYWPSKQAQDYGDITVAMTSEIVLPEWTIRDFTVKNIQTSESHPLRQFHFTSWPDHGVPDTTDLLINFRYLVRDYMKQSPPESPILVHCSAGVGRTGTFIAIDRLIYQIENENTVDVYGIVYDLRMHRPLMVQTEDQYVFLNQCVLDIVRSQKDSKVDLIYQNTTAMTIYENLAPVTTFGKTNGYIA

SEQ ID NO: 34276 - protein, 539 aa, Homo sapiens
  ENSP00000409733
MKPAAREARLPPRSPGLRWALPLLLLLLRLGQILCAGGTPSPIPDPSVATVATGENGITQISSTAESFHKQNGTGTPQVETNTSEDGESSGANDSLRTPEQGSNGTDGASQKTPSSTGPSPVFDIKAVSISPTNVILTWKSNDTAASEYKYVVKHKMENEKTITVVHQPWCNITGLRPATSYVFSITPGIGNETWGDPRVIKVITEPIPVSDLRVALTGVRKAALSWSNGNGTASCRVLLESIGSHEELTQDSRLQVNISGLKPGVQYNINPYLLQSNKTKGDPLGTEGGLDASNTERSRAGSPTAPVHDESLVGPVDPSSGQQSRDTEVLLVGLEPGTRYNATVYSQAANGTEGQPQAIEFRTNAIQVFDVTAVNISATSLTLIWKVSDNESSSNYTYKIHVAGETDSSNLNVSEPRAVIPGLRSSTFYNITVCPVLGDIEGTPGFLQVHTPPVPVSDFRVTVVSTTEIGLAWSSHDAESFQMHITQEGAGNSRVEITTNQSIIIGGLFPGTKYCFEIVPKGPNGTEGASRTVCNRTG

SEQ ID NO: 34277 - protein, 120 aa, Homo sapiens
  ENSP00000432686
MKPAAREARLPPRSPGLRWALPLLLLLLRLGQILCAGGRPSPVFDIKAVSISPTNVILTWKSNDTAASEYKYVVKHKMENEKTITVVHQPWCNITGLRPATSYVFSITPGIGNETWGDPR

SEQ ID NO: 34278 - protein, 146 aa, Homo sapiens
  ENSP00000435618
MKPAAREARLPPRSPGLRWALPLLLLLLRLGQILCAGGTPSPIPDPSVATVATGENGITQISSTAESFHKQNGTGTPQVETNTSEDGESSGANDSLRTPEQGSNGTDGASQKTPSSTEPIPVSDLRVALTGVRKAALSWSNGNGTA

SEQ ID NO: 34279 - protein, 1338 aa, Homo sapiens [sequence omitted]

SEQ ID NO: 34280 - protein, 1342 aa, Homo sapiens
  ENSP00000479342
MKPAAREARLPPRSPGLRWALPLLLLLLRLGQILCAGGTPSPIPDPSVATVATGENGITQISSTAESFHKQNGTGTPQVETNTSEDGESSGANDSLRTPEQGSNGTDGASQKTPSSTGPSPVFDIKAVSISPTNVILTWKSNDTAASEYKYVVKHKMENEKTITVVHQPWCNITGLRPATSYVFSITPGIGNETWGDPRVIKVITEPIPVSDLRVALTGVRKAALSWSNGNGTASCRVLLESIGSHEELTQDSRLQVNISGLKPGVQYNINPYLLQSNKTKGDPLGTEGGLDASNTERSRAGSPTAPVHDESLVGPVDPSSGQQSRDTEVLLVGLEPGTRYNATVYSQAANGTEGQPQAIEFRTNAIQVFDVTAVNISATSLTLIWKVSDNESSSNYTYKIHVAGETDSSNLNVSEPRAVIPGLRSSTFYNITVCPVLGDIEGTPGFLQVHTPPVPVSDFRVTVVSTTEIGLAWSSHDAESFQMHITQEGAGNSRVEITTNQSIIIGGLFPGTKYCFEIVPKGPNGTEGASRTVCNRTVPSAVFDIHVVYVTTTEMWLDWKSPDGASEYVYHLVIESKHGSNHTSTYDKAITLQGLIPGTLYNITISPEVDHVWGDPNSTAQYTRPSNVSNIDVSTNTTAATLSWQNFDDASPTYSYCLLIEKAGNSSNATQVVTDIGITDATVTELIPGSSYTVEIFAQVGDGIKSLEPGRKSFCTDPASMASFDCEVVPKEPALVLKWTCPPGANAGFELEVSSGAWNNATHLESCSSENGTEYRTEVTYLNFSTSYNISITTVSCGKMAAPTRNTCTTGITDPPPPDGSPNITSVSHNSVKVKFSGFEASHGPIKAYAVILTTGEAGHPSADVLKYTYEDFKKGASDTYVTYLIRTEEKGRSQSLSEVLKYEIDVGNESTTLGYYNGKLEPLGSYRCLLRACVAGFTNITFHPQNKGLIDGAESYVSFSRYSDAVSLPQDPGVICGAVFGCIFGALVIVTVGGFIFWRKKRKDAKNNEVSFSQIKSLKRSKLIRVENFEAYFKKQQADSNCGFAEEYEDLKLVGISQPKYAAELAENRGKNRYNNVLPYDISRVKLSVQTHSTDDYINANYMPGYHSKKDFIATQGPLPNTLKDFWRMVWEKNVYAIIMLTKCVEQGRTKCEEYWPSKQAQDYGDITVAMTSEIVLPEWTIRDFTVKNIQTSESHPLRQFHFTSWPDHGVPDTTDLLINFRYLVRDYMKQSPPESPILVHCSAGVGRTGTFIAIDRLIYQIENENTVDVYGIVYDLRMHRPLMVQTEDQYVFLNQCVLDIVRSQKDSKVDLIYQNTTAMTIYENLAPVTTFGKTNGYIA

SEQ ID NO: 34281 - protein, 1440 aa, Homo sapiens
  ENSP00000357209
MDTTAAAALPAFVALLLLSPWPLLGSAQGQFSAGGCTFDDGPGACDYHQDLYDDFEWVHVSAQEPHYLPPEMPQGSYMIVDSSDHDPGEKARLQLPTMKENDTHCIDFSYLLYSQKGLNPGTLNILVRVNKGPLANPIWNVTGFTGRDWLRAELAVSTFWPNEYQVIFEAEVSGGRSGYIAIDDIQVLSYPCDKSPHFLRLGDVEVNAGQNATFQCIATGRDAVHNKLWLQRRNGEDIPVAQTKNINHRRFAASFRLQEVTKTDQDLYRCVTQSERGSGVSNFAQLIVREPPRPIAPPQLLGVGPTYLLIQLNANSIIGDGPIILKEVEYRMTSGSWTETHAVNAPTYKLWHLDPDTEYEIRVLLTRPGEGGTGLPGPPLITRTKCAEPMRTPKTLKIAEIQARRIAVDWESLGYNITRCHTFNVTICYHYFRGHNESKADCLDMDPKAPQHVVNHLPPYTNVSLKMILTNPEGRKESEETIIQTDEDVPGPVPVKSLQGTSFENKIFLNWKEPLDPNGIITQYEISYSSIRSFDPAVPVAGPPQTVSNLWNSTHHVFMHLHPGTTYQFFIRASTVKGFGPATAINVTTNISAPTLPDYEGVDASLNETATTITVLLRPAQAKGAPISAYQIVVEELHPHRTKREAGAMECYQVPVTYQNAMSGGAPYYFAAELPPGNLPEPAPFTVGDNRTYQGFWNPPLAPRKGYNIYFQAMSSVEKETKTQCVRIATKAAATEEPEVIPDPAKQTDRVVKIAGISAGILVFILLLLVVILIVKKSKLAKKRKDAMGNTRQEMTHMVNAMDRSYADQSTLHAEDPLSITFMDQHNFSPRYENHSATAESSRLLDVPRYLCEGTESPYQTGQLHPAIRVADLLQHINLMKTSDSYGFKEEYESFFEGQSASWDVAKKDQNRAKNRYGNIIAYDHSRVILQPVEDDPSSDYINANYIDGYQRPSHYIATQGPVHETVYDFWRMIWQEQSACIVMVTNLVEVGRVKCYKYWPDDTEVYGDFKVTCVEMEPLAEYVVRTFTLERRGYNEIREVKQFHFTGWPDHGVPYHATGLLSFIRRVKLSNPPSAGPIVVHCSAGAGRTGCYIVIDIMLDMAEREGVVDIYNCVKALRSRRINMVQTEEQYIFIHDAILEACLCGETAIPVCEFKAAYFDMIRIDSQTNSSHLKDEFQTLNSVTPRLQAEDCSIACLPRNHDKNRFMDMLPPDRCLPFLITIDGESSNYINAALMDSYRQPAAFIVTQYPLPNTVKDFWRLVYDYGCTSIVMLNEVDLSQGCPQYWPEEGMLRYGPIQVECMSCSMDCDVINRIFRICNLTRPQEGYLMVQQFQYLGWASHREVPGSKRSFLKLILQVEKWQEECEEGEGRTIIHCLNGGGRSGMFCAIGIVVEMVKRQNVVDVFHAVKTLRNSKPNMVEAPEQYRFCYDVALEYLESS

SEQ ID NO: 34282 - protein, 1462 aa, Homo sapiens
  ENSP00000432973
MDTTAAAALPAFVALLLLSPWPLLGSAQGQFSAGGCTFDDGPGACDYHQDLYDDFEWVHVSAQEPHYLPPEMPQGSYMIVDSSDHDPGEKARLQLPTMKENDTHCIDFSYLLYSQKGLNPGTLNILVRVNKGPLANPIWNVTGFTGRDWLRAELAVSTFWPNEYQVIFEAEVSGGRSGYIAIDDIQVLSYPCDKSPHFLRLGDVEVNAGQNATFQCIATGRDAVHNKLWLQRRNGEDIPVAQTKNINHRRFAASFRLQEVTKTDQDLYRCVTQSERGSGVSNFAQLIVREPPRPIAPPQLLGVGPTYLLIQLNANSIIGDGPIILKEVEYRMTSGSWTETHAVNAPTYKLWHLDPDTEYEIRVLLTRPGEGGTGLPGPPLITRTKCAEPMRTPKTLKIAEIQARRIAVDWESLGYNITRCHTFNVTICYHYFRGHNESKADCLDMDPKAPQHVVNHLPPYTNVSLKMILTNPEGRKESEETIIQTDEDVPGPVPVKSLQGTSFENKIFLNWKEPLDPNGIITQYEISYSSIRSFDPAVPVAGPPQTVSNLWNSTHHVFMHLHPGTTYQFFIRASTVKGFGPATAINVTTNISAPTLPDYEGVDASLNETATTITVLLRPAQAKGAPISAYQIVVEELHPHRTKREAGAMECYQVPVTYQNAMSGGAPYYFAAELPPGNLPEPAPFTVGDNRTYQGFWNPPLAPRKGYNIYFQAMSSVEKETKTQCVRIATKAAATEEPEVIPDPAKQTDRVVKIAGISAGILVFILLLLVVILIVKKSKLAKKRKDAMGNTRQEMTHMVNAMDRSYADQSTLHAEDPLSITFMDQHNFSPRLPNDPLVPTAVLVPITDENHSATAESSRLLDVPRYLCEGTESPYQTGQLHPAIRVADLLQHINLMKTSDSYGFKEEYESFFEGQSASWDVAKKDQNRAKNRYGNIIAYDHSRVILQPVEDDPSSDYINANYIDIWLYRDGYQRPSHYIATQGPVHETVYDFWRMIWQEQSACIVMVTNLVEVGRVKCYKYWPDDTEVYGDFKVTCVEMEPLAEYVVRTFTLERRGYNEIREVKQFHFTGWPDHGVPYHATGLLSFIRRVKLSNPPSAGPIVVHCSAGAGRTGCYIVIDIMLDMAEREGVVDIYNCVKALRSRRINMVQTEEQYIFIHDAILEACLCGETAIPVCEFKAAYFDMIRIDSQTNSSHLKDEFQTLNSVTPRLQAEDCSIACLPRNHDKNRFMDMLPPDRCLPFLITIDGESSNYINAALMDSYRQPAAFIVTQYPLPNTVKDFWRLVYDYGCTSIVMLNEVDLSQGCPQYWPEEGMLRYGPIQVECMSCSMDCDVINRIFRICNLTRPQEGYLMVQQFQYLGWASHREVPGSKRSFLKLILQVEKWQEECEEGEGRTIIHCLNGGGRSGMFCAIGIVVEMVKRQNVVDVFHAVKTLRNSKPNMVEAPEQYRFCYDVALEYLESS

SEQ ID NO: 34283 - protein, 1446 aa, Homo sapiens
  ENSP00000357196
MDTTAAAALPAFVALLLLSPWPLLGSAQGQFSAGGCTFDDGPGACDYHQDLYDDFEWVHVSAQEPHYLPPEMPQGSYMIVDSSDHDPGEKARLQLPTMKENDTHCIDFSYLLYSQKGLNPGTLNILVRVNKGPLANPIWNVTGFTGRDWLRAELAVSTFWPNEYQVIFEAEVSGGRSGYIAIDDIQVLSYPCDKSPHFLRLGDVEVNAGQNATFQCIATGRDAVHNKLWLQRRNGEDIPVAQTKNINHRRFAASFRLQEVTKTDQDLYRCVTQSERGSGVSNFAQLIVREPPRPIAPPQLLGVGPTYLLIQLNANSIIGDGPIILKEVEYRMTSGSWTETHAVNAPTYKLWHLDPDTEYEIRVLLTRPGEGGTGLPGPPLITRTKCAEPMRTPKTLKIAEIQARRIAVDWESLGYNITRCHTFNVTICYHYFRGHNESKADCLDMDPKAPQHVVNHLPPYTNVSLKMILTNPEGRKESEETIIQTDEDVPGPVPVKSLQGTSFENKIFLNWKEPLDPNGIITQYEISYSSIRSFDPAVPVAGPPQTVSNLWNSTHHVFMHLHPGTTYQFFIRASTVKGFGPATAINVTTNISAPTLPDYEGVDASLNETATTITVLLRPAQAKGAPISAYQIVVEELHPHRTKREAGAMECYQVPVTYQNAMSGGAPYYFAAELPPGNLPEPAPFTVGDNRTYQGFWNPPLAPRKGYNIYFQAMSSVEKETKTQCVRIATKAAATEEPEVIPDPAKQTDRVVKIAGISAGILVFILLLLVVILIVKKSKLAKKRKDAMGNTRQEMTHMVNAMDRSYADQSTLHAEDPLSITFMDQHNFSPRYENHSATAESSRLLDVPRYLCEGTESPYQTGQLHPAIRVADLLQHINLMKTSDSYGFKEEYESFFEGQSASWDVAKKDQNRAKNRYGNIIAYDHSRVILQPVEDDPSSDYINANYIDIWLYRDGYQRPSHYIATQGPVHETVYDFWRMIWQEQSACIVMVTNLVEVGRVKCYKYWPDDTEVYGDFKVTCVEMEPLAEYVVRTFTLERRGYNEIREVKQFHFTGWPDHGVPYHATGLLSFIRRVKLSNPPSAGPIVVHCSAGAGRTGCYIVIDIMLDMAEREGVVDIYNCVKALRSRRINMVQTEEQYIFIHDAILEACLCGETAIPVCEFKAAYFDMIRIDSQTNSSHLKDEFQTLNSVTPRLQAEDCSIACLPRNHDKNRFMDMLPPDRCLPFLITIDGESSNYINAALMDSYRQPAAFIVTQYPLPNTVKDFWRLVYDYGCTSIVMLNEVDLSQGCPQYWPEEGMLRYGPIQVECMSCSMDCDVINRIFRICNLTRPQEGYLMVQQFQYLGWASHREVPGSKRSFLKLILQVEKWQEECEEGEGRTIIHCLNGGGRSGMFCAIGIVVEMVKRQNVVDVFHAVKTLRNSKPNMVEAPEQYRFCYDVALEYLESS

SEQ ID NO: 34284 - protein, 1458 aa, Homo sapiens
  ENSP00000357193
MDTTAAAALPAFVALLLLSPWPLLGSAQGQFSAGGCTFDDGPGACDYHQDLYDDFEWVHVSAQEPHYLPPEMPQGSYMIVDSSDHDPGEKARLQLPTMKENDTHCIDFSYLLYSQKGLNPGTLNILVRVNKGPLANPIWNVTGFTGRDWLRAELAVSTFWPNEYQVIFEAEVSGGRSGYIAIDDIQVLSYPCDKSPHFLRLGDVEVNAGQNATFQCIATGRDAVHNKLWLQRRNGEDIPVAQTKNINHRRFAASFRLQEVTKTDQDLYRCVTQSERGSGVSNFAQLIVREPPRPIAPPQLLGVGPTYLLIQLNANSIIGDGPIILKEVEYRMTSGSWTETHAVNAPTYKLWHLDPDTEYEIRVLLTRPGEGGTGLPGPPLITRTKCAEPMRTPKTLKIAEIQARRIAVDWESLGYNITRCHTFNVTICYHYFRGHNESKADCLDMDPKAPQHVVNHLPPYTNVSLKMILTNPEGRKESEETIIQTDEDVPGPVPVKSLQGTSFENKIFLNWKEPLDPNGIITQYEISYSSIRSFDPAVPVAGPPQTVSNLWNSTHHVFMHLHPGTTYQFFIRASTVKGFGPATAINVTTNISAPTLPDYEGVDASLNETATTITVLLRPAQAKGAPISAYQIVVEELHPHRTKREAGAMECYQVPVTYQNAMSGGAPYYFAAELPPGNLPEPAPFTVGDNRTYQGFWNPPLAPRKGYNIYFQAMSSVEKETKTQCVRIATKAAATEEPEVIPDPAKQTDRVVKIAGISAGILVFILLLLVVILIVKKSKLAKKRKDAMGNTRQEMTHMVNAMDRSYADQSTLHAEDPLSITFMDQHNFSPRLPNDPLVPTAVLDENHSATAESSRLLDVPRYLCEGTESPYQTGQLHPAIRVADLLQHINLMKTSDSYGFKEEYESFFEGQSASWDVAKKDQNRAKNRYGNIIAYDHSRVILQPVEDDPSSDYINANYIDIWLYRDGYQRPSHYIATQGPVHETVYDFWRMIWQEQSACIVMVTNLVEVGRVKCYKYWPDDTEVYGDFKVTCVEMEPLAEYVVRTFTLERRGYNEIREVKQFHFTGWPDHGVPYHATGLLSFIRRVKLSNPPSAGPIVVHCSAGAGRTGCYIVIDIMLDMAEREGVVDIYNCVKALRSRRINMVQTEEQYIFIHDAILEACLCGETAIPVCEFKAAYFDMIRIDSQTNSSHLKDEFQTLNSVTPRLQAEDCSIACLPRNHDKNRFMDMLPPDRCLPFLITIDGESSNYINAALMDSYRQPAAFIVTQYPLPNTVKDFWRLVYDYGCTSIVMLNEVDLSQGCPQYWPEEGMLRYGPIQVECMSCSMDCDVINRIFRICNLTRPQEGYLMVQQFQYLGWASHREVPGSKRSFLKLILQVEKWQEECEEGEGRTIIHCLNGGGRSGMFCAIGIVVEMVKRQNVVDVFHAVKTLRNSKPNMVEAPEQYRFCYDVALEYLESS

SEQ ID NO: 34285 - protein, 1439 aa, Homo sapiens
  ENSP00000357198
MDTTAAAALPAFVALLLLSPWPLLGSAQGQFSAGGCTFDDGPGACDYHQDLYDDFEWVHVSAQEPHYLPPEMPQGSYMIVDSSDHDPGEKARLQLPTMKENDTHCIDFSYLLYSQKGLNPGTLNILVRVNKGPLANPIWNVTGFTGRDWLRAELAVSTFWPNEYQVIFEAEVSGGRSGYIAIDDIQVLSYPCDKSPHFLRLGDVEVNAGQNATFQCIATGRDAVHNKLWLQRRNGEDIPVAQTKNINHRRFAASFRLQEVTKTDQDLYRCVTQSERGSGVSNFAQLIVREPPRPIAPPQLLGVGPTYLLIQLNANSIIGDGPIILKEVEYRMTSGSWTETHAVNAPTYKLWHLDPDTEYEIRVLLTRPGEGGTGLPGPPLITRTKCAEPMRTPKTLKIAEIQARRIAVDWESLGYNITRCHTFNVTICYHYFRGHNESKADCLDMDPKAPQHVVNHLPPYTNVSLKMILTNPEGRKESEETIIQTDEDVPGPVPVKSLQGTSFENKIFLNWKEPLDPNGIITQYEISYSSIRSFDPAVPVAGPPQTVSNLWNSTHHVFMHLHPGTTYQFFIRASTVKGFGPATAINVTTNISAPTLPDYEGVDASLNETATTITVLLRPAQAKGAPISAYQIVVEELHPHRTKREAGAMECYQVPVTYQNAMSGGAPYYFAAELPPGNLPEPAPFTVGDNRTYQGFWNPPLAPRKGYNIYFQAMSSVEKETKTQCVRIATKAATEEPEVIPDPAKQTDRVVKIAGISAGILVFILLLLVVILIVKKSKLAKKRKDAMGNTRQEMTHMVNAMDRSYADQSTLHAEDPLSITFMDQHNFSPRYENHSATAESSRLLDVPRYLCEGTESPYQTGQLHPAIRVADLLQHINLMKTSDSYGFKEEYESFFEGQSASWDVAKKDQNRAKNRYGNIIAYDHSRVILQPVEDDPSSDYINANYIDGYQRPSHYIATQGPVHETVYDFWRMIWQEQSACIVMVTNLVEVGRVKCYKYWPDDTEVYGDFKVTCVEMEPLAEYVVRTFTLERRGYNEIREVKQFHFTGWPDHGVPYHATGLLSFIRRVKLSNPPSAGPIVVHCSAGAGRTGCYIVIDIMLDMAEREGVVDIYNCVKALRSRRINMVQTEEQYIFIHDAILEACLCGETAIPVCEFKAAYFDMIRIDSQTNSSHLKDEFQTLNSVTPRLQAEDCSIACLPRNHDKNRFMDMLPPDRCLPFLITIDGESSNYINAALMDSYRQPAAFIVTQYPLPNTVKDFWRLVYDYGCTSIVMLNEVDLSQGCPQYWPEEGMLRYGPIQVECMSCSMDCDVINRIFRICNLTRPQEGYLMVQQFQYLGWASHREVPGSKRSFLKLILQVEKWQEECEEGEGRTIIHCLNGGGRSGMFCAIGIVVEMVKRQNVVDVFHAVKTLRNSKPNMVEAPEQYRFCYDVALEYLESS

SEQ ID NO: 34286 - protein, 1472 aa, Homo sapiens
  ENSP00000357190
MDTTAAAALPAFVALLLLSPWPLLGSAQGQFSAGGCTFDDGPGACDYHQDLYDDFEWVHVSAQEPHYLPPEMPQGSYMIVDSSDHDPGEKARLQLPTMKENDTHCIDFSYLLYSQKGLNPGTLNILVRVNKGPLANPIWNVTGFTGRDWLRAELAVSTFWPNEYQVIFEAEVSGGRSGYIAIDDIQVLSYPCDKSPHFLRLGDVEVNAGQNATFQCIATGRDAVHNKLWLQRRNGEDIPVAQTKNINHRRFAASFRLQEVTKTDQDLYRCVTQSERGSGVSNFAQLIVREPPRPIAPPQLLGVGPTYLLIQLNANSIIGDGPIILKEVEYRMTSGSWTETHAVNAPTYKLWHLDPDTEYEIRVLLTRPGEGGTGLPGPPLITRTKCAEPMRTPKTLKIAEIQARRIAVDWESLGYNITRCHTFNVTICYHYFRGHNESKADCLDMDPKAPQHVVNHLPPYTNVSLKMILTNPEGRKESEETIIQTDEDVPGPVPVKSLQGTSFENKIFLNWKEPLDPNGIITQYEISYSSIRSFDPAVPVAGPPQTVSNLWNSTHHVFMHLHPGTTYQFFIRASTVKGFGPATAINVTTNISAPTLPDYEGVDASLNETATTITVLLRPAQAKGAPISAYQIVVEELHPHRTKREAGAMECYQVPVTYQNAMSGGAPYYFAAELPPGNLPEPAPFTVGDNRTYQGFWNPPLAPRKGYNIYFQAMSSVEKETKTQCVRIATKAAATEEPEVIPDPAKQTDRVVKIAGISAGILVFILLLLVVILIVKKRRSYYSYSYYLKLAKKRKDAMGNTRQEMTHMVNAMDRSYADQSTLHAEDPLSITFMDQHNFSPRLPNDPLVPTAVLVPITDENHSATAESSRLLDVPRYLCEGTESPYQTGQLHPAIRVADLLQHINLMKTSDSYGFKEEYESFFEGQSASWDVAKKDQNRAKNRYGNIIAYDHSRVILQPVEDDPSSDYINANYIDIWLYRDGYQRPSHYIATQGPVHETVYDFWRMIWQEQSACIVMVTNLVEVGRVKCYKYWPDDTEVYGDFKVTCVEMEPLAEYVVRTFTLERRGYNEIREVKQFHFTGWPDHGVPYHATGLLSFIRRVKLSNPPSAGPIVVHCSAGAGRTGCYIVIDIMLDMAEREGVVDIYNCVKALRSRRINMVQTEEQYIFIHDAILEACLCGETAIPVCEFKAAYFDMIRIDSQTNSSHLKDEFQTLNSVTPRLQAEDCSIACLPRNHDKNRFMDMLPPDRCLPFLITIDGESSNYINAALMDSYRQPAAFIVTQYPLPNTVKDFWRLVYDYGCTSIVMLNEVDLSQGCPQYWPEEGMLRYGPIQVECMSCSMDCDVINRIFRICNLTRPQEGYLMVQQFQYLGWASHREVPGSKRSFLKLILQVEKWQEECEEGEGRTIIHCLNGGGRSGMFCAIGIVVEMVKRQNVVDVFHAVKTLRNSKPNMVEAPEQYRFCYDVALEYLESS

SEQ ID NO: 34287 - protein, 343 aa, Homo sapiens
  ENSP00000406825
  MOD_RES (1)..(1): Any amino acid
XKAAATEEPEVIPDPAKQTDRVVKIAGISAGILVFILLLLVVILIVKKRRSYYSYSYYLKLAKKRKDAMGNTRQEMTHMVNAMDRSYADQSTLHAEDPLSITFMDQHNFSPRLPNDPLVPTAVLDENHSATAESSRLLDVPRYLCEGTESPYQTGQLHPAIRVADLLQHINLMKTSDSYGFKEEYESFFEGQSASWDVAKKDQNRAKNRYGNIIAYDHSRVILQPVEDDPSSDYINANYIDGYQRPSHYIATQGPVHETVYDFWRMIWQEQSACIVMVTNLVEVGRVKCYKYWPDDTEVYGDFKVTCVEMEPLAEYVVRTFTLERRGYNEIREVKQFHFTGWP

SEQ ID NO: 34288 - protein, 260 aa, Homo sapiens
  ENSP00000408180
WRRHICIRNIRRSYYSYSYYLKLAKKRKDAMGNTRQEMTHMVNAMDRSYADQSTLHAEDPLSITFMDQHNFSPRLPNDPLVPTAVLVPITDENHSATAESSRLLDVPRYLCEGTESPYQTGQLHPAIRVADLLQHINLMKTSDSYGFKEEYESFFEGQSASWDVAKKDQNRAKNRYGNIIAYDHSRVILQPVEDDPSSDYINANYIDGYQRPSHYIATQGPVHETVYDFWRMIWQEQSACIVMVTNLVEVGRVKCYKYWP

SEQ ID NO: 34289 - protein, 20 aa, Homo sapiens
  ENSP00000432960
VHVSAQEPHYLPPEMPQGNI

SEQ ID NO: 34290 - protein, 204 aa, Homo sapiens
  ENSP00000434058
  MOD_RES (1)..(1): Any amino acid
XNPGTLNILVRVNKGPLANPIWNVTGFTGRDWLRAELAVSTFWPNEYQRRNGEDIPVAQTKNINHRRFAASFRLQEVTKTDQDLYRCVTQSERGSGVSNFAQLIVREPPRPIAPPQLLGVGPTYLLIQLNANSIIGDGPIILKEVEYRMTSGSWTETHAVNAPTYKLWHLDPDTEYEIRVLLTRPGEGGTGLPGPPLITRTKCA

SEQ ID NO: 34291 - protein, 248 aa, Homo sapiens
  ENSP00000434116
MDTTAAAALPAFVALLLLSPWPLLGSAQGQFSAGGCTFDDGPGACDYHQDLYDDFEWVHVSAQEPHYLPPEMPQGSYMIVDSSDHDPGEKARLQLPTMKENDTHCIDFSYLLYSQKGLNPGTLNILVRVNKGPLANPIWNVTGFTGRDWLRAELAVSTFWPNEYQVIICTFLVYVLMSSVLTICVIHRCKYASHGNERLPSCLPHPHYWGSVIHRYTYASHGNERLPLFLPHPVDEEVFGDIGTKPSN

SEQ ID NO: 34292 - protein, 77 aa, Homo sapiens
  ENSP00000376243
MDTTAAAALPAFVALLLLSPWPLLGSAQGQFSAVSVLVVGNFCCCCSAAVCHSIRHLSRTQNPGQDHEGRLKRWLYF

SEQ ID NO: 34293 - protein, 39 aa, Homo sapiens
  ENSP00000437299
MDTTAAAALPAFVALLLLSPWPLLGSAQGQFSAEKACSY

SEQ ID NO: 34294 - protein, 1440 aa, Homo sapiens; identical to SEQ ID NO: 34281
  ENSP00000483766

SEQ ID NO: 34295 - protein, 1462 aa, Homo sapiens; identical to SEQ ID NO: 34282
  ENSP00000477791

SEQ ID NO: 34296 - protein, 1446 aa, Homo sapiens; identical to SEQ ID NO: 34283
  ENSP00000484742

SEQ ID NO: 34297 - protein, 1458 aa, Homo sapiens; identical to SEQ ID NO: 34284
  ENSP00000487066

SEQ ID NO: 34298 - protein, 1439 aa, Homo sapiens; identical to SEQ ID NO: 34285
  ENSP00000486442

SEQ ID NO: 34299 - protein, 1472 aa, Homo sapiens; identical to SEQ ID NO: 34286
  ENSP00000487005

SEQ ID NO: 34300 - protein, 314 aa, Homo sapiens
  ENSP00000485812
  MOD_RES (1)..(1): Any amino acid
XAATEEPEVIPDPAKQTDRVVKIAGISAGILVFILLLLVVILIVKKRRSYYSYSYYLKLAKKRKDAMGNTRQEMTHMVNAMDRSYADQSTLHAEDPLSITFMDQHNFSPRLPNDPLVPTAVLDENHSATAESSRLLDVPRYLCEGTESPYQTGQLHPAIRVADLLQHINLMKTSDSYGFKEEYESFFEGQSASWDVAKKDQNRAKNRYGNIIAYDHSRVILQPVEDDPSSDYINANYIDGYQRPSHYIATQGPVHETVYDFWRMIWQEQSACIVMVTNLVEVGRVKCYKYWPDDTEVYGDFKVTCVEMEPLAEY

SEQ ID NO: 34301 - protein, 260 aa, Homo sapiens; identical to SEQ ID NO: 34288
  ENSP00000487578

SEQ ID NO: 34302 - protein, 20 aa, Homo sapiens
  ENSP00000486036
VHVSAQEPHYLPPEMPQGNI

SEQ ID NO: 34303 - protein, 204 aa, Homo sapiens; identical to SEQ ID NO: 34290
  ENSP00000487445
  MOD_RES (1)..(1): Any amino acid

SEQ ID NO: 34304 - protein, 248 aa, Homo sapiens; identical to SEQ ID NO: 34291
  ENSP00000486448

SEQ ID NO: 34305 - protein, 77 aa, Homo sapiens; identical to SEQ ID NO: 34292
  ENSP00000482183

SEQ ID NO: 34306 - protein, 39 aa, Homo sapiens; identical to SEQ ID NO: 34293
  ENSP00000485893

SEQ ID NO: 34307 - protein, 1465 aa, Homo sapiens
  ENSP00000463325
MRGLGTCLATLAGLLLTAAGETFSGGCLFDEPYSTCGYSQSEGDDFNWEQVNTLTKPTSDPWMPSGSFMLVNASGRPEGQRAHLLLPQLKENDTHCIDFHYFVSSKSNSPPGLLNVYVKVNNGPLGNPIWNISGDPTRTWNRAELAISTFWPNFYQVIFEVITSGHQGYLAIDEVKVLGHPCTRTPHFLRIQNVEVNAGQFATFQCSAIGRTVAGDRLWLQGIDVRDAPLKEIKVTSSRRFIASFNVVNTTKRDAGKYRCMIRTEGGVGISNYAELVVKEPPVPIAPPQLASVGATYLWIQLNANSINGDGPIVAREVEYCTASGSWNDRQPVDSTSYKIGHLDPDTEYEISVLLTRPGEGGTGSPGPALRTRTKCADPMRGPRKLEVVEVKSRQITIRWEPFGYNVTRCHSYNLTVHYCYQVGGQEQVREEVSWDTENSHPQHTITNLSPYTNVSVKLILMNPEGRKESQELIVQTDEDLPGAVPTESIQGSTFEEKIFLQWREPTQTYGVITLYEITYKAVSSFDPEIDLSNQSGRVSKLGNETHFLFFGLYPGTTYSFTIRASTAKGFGPPATNQFTTKISAPSMPAYELETPLNQTDNTVTVMLKPAHSRGAPVSVYQIVVEEERPRRTKKTTEILKCYPVPIHFQNASLLNSQYYFAAEFPADSLQAAQPFTIGDNKTYNGYWNTPLLPYKSYRIYFQAASRANGETKIDCVQVATKGAATPKPVPEPEKQTDHTVKIAGVIAGILLFVIIFLGVVLVMKKRKLAKKRKETMSSTRQEMTVMVNSMDKSYAEQGTNCDEAFSFMDTHNLNGRSVSSPSSFTMKTNTLSTSVPNSYYPDPFVPTAILVPINDETHTMASDTSSLVQSHTYKKREPADVPYQTGQLHPAIRVADLLQHITQMKCAEGYGFKEEYESFFEGQSAPWDSAKKDENRMKNRYGNIIAYDHSRVRLQTIEGDTNSDYINGNYIDGYHRPNHYIATQGPMQETIYDFWRMVWHENTASIIMVTNLVEVGRVKCCKYWPDDTEIYKDIKVTLIETELLAEYVIRTFAVEKRGVHEIREIRQFHFTGWPDHGVPYHATGLLGFVRQVKSKSPPSAGPLVVHCSAGAGRTGCFIVIDIMLDMAEREGVVDIYNCVRELRSRRVNMVQTEEQYVFIHDAILEACLCGDTSVPASQVRSLYYDMNKLDPQTNSSQIKEEFRTLNMVTPTLRVEDCSIALLPRNHEKNRCMDILPPDRCLPFLITIDGESSNYINAALMDSYKQPSAFIVTQHPLPNTVKDFWRLVLDYHCTSVVMLNDVDPAQLCPQYWPENGVHRHGPIQVEFVSADLEEDIISRIFRIYNAARPQDGYRMVQQFQFLGWPMYRDTPVSKRSFLKLIRQVDKWQEEYNGGEGRTVVHCLNGGGRSGTFCAISIVCEMLRHQRTVDVFHAVKTLRNNKPNMVDLLDQYKFCYEVALEYLNSG

SEQ ID NO: 34308 - protein, 1452 aa, Homo sapiens
  ENSP00000331418
MRGLGTCLATLAGLLLTAAGETFSGGCLFDEPYSTCGYSQSEGDDFNWEQVNTLTKPTSDPWMPSGSFMLVNASGRPEGQRAHLLLPQLKENDTHCIDFHYFVSSKSNSPPGLLNVYVKVNNGPLGNPIWNISGDPTRTWNRAELAISTFWPNFYQVIFEVITSGHQGYLAIDEVKVLGHPCTRTPHFLRIQNVEVNAGQFATFQCSAIGRTVAGDRLWLQGIDVRDAPLKEIKVTSSRRFIASFNVVNTTKRDAGKYRCMIRTEGGVGISNYAELVVKEPPVPIAPPQLASVGATYLWIQLNANSINGDGPIVAREVEYCTASGSWNDRQPVDSTSYKIGHLDPDTEYEISVLLTRPGEGGTGSPGPALRTRTKCADPMRGPRKLEVVEVKSRQITIRWEPFGYNVTRCHSYNLTVHYCYQVGGQEQVREEVSWDTENSHPQHTITNLSPYTNVSVKLILMNPEGRKESQELIVQTDEDLPGAVPTESIQGSTFEEKIFLQWREPTQTYGVITLYEITYKAVSSFDPEIDLSNQSGRVSKLGNETHFLFFGLYPGTTYSFTIRASTAKGFGPPATNQFTTKISAPSMPAYELETPLNQTDNTVTVMLKPAHSRGAPVSVYQIVVEEERPRRTKKTTEILKCYPVPIHFQNASLLNSQYYFAAEFPADSLQAAQPFTIGDNKTYNGYWNTPLLPYKSYRIYFQAASRANGETKIDCVQVATKGAATPKPVPEPEKQTDHTVKIAGVIAGILLFVIIFLGVVLVMKKRKLAKKRKETMSSTRQEMTVMVNSMDKSYAEQGTNCDEAFSFMDTHNLNGRSVSSPSSFTMKTNTLSTSVPNSYYPDETHTMASDTSSLVQSHTYKKREPADVPYQTGQLHPAIRVADLLQHITQMKCAEGYGFKEEYESFFEGQSAPWDSAKKDENRMKNRYGNIIAYDHSRVRLQTIEGDTNSDYINGNYIDGYHRPNHYIATQGPMQETIYDFWRMVWHENTASIIMVTNLVEVGRVKCCKYWPDDTEIYKDIKVTLIETELLAEYVIRTFAVEKRGVHEIREIRQFHFTGWPDHGVPYHATGLLGFVRQVKSKSPPSAGPLVVHCSAGAGRTGCFIVIDIMLDMAEREGVVDIYNCVRELRSRRVNMVQTEEQYVFIHDAILEACLCGDTSVPASQVRSLYYDMNKLDPQTNSSQIKEEFRTLNMVTPTLRVEDCSIALLPRNHEKNRCMDILPPDRCLPFLITIDGESSNYINAALMDSYKQPSAFIVTQHPLPNTVKDFWRLVLDYHCTSVVMLNDVDPAQLCPQYWPENGVHRHGPIQVEFVSADLEEDIISRIFRIYNAARPQDGYRMVQQFQFLGWPMYRDTPVSKRSFLKLIRQVDKWQEEYNGGEGRTVVHCLNGGGRSGTFCAISIVCEMLRHQRTVDVFHAVKTLRNNKPNMVDLLDQYKFCYEVALEYLNSG

SEQ ID NO: 34309 - protein, 1390 aa, Homo sapiens
  ENSP00000382927
MPSGSFMLVNASGRPEGQRAHLLLPQLKENDTHCIDFHYFVSSKSNSPPGLLNVYVKVNNGPLGNPIWNISGDPTRTWNRAELAISTFWPNFYQVIFEVITSGHQGYLAIDEVKVLGHPCTRTPHFLRIQNVEVNAGQFATFQCSAIGRTVAGDRLWLQGIDVRDAPLKEIKVTSSRRFIASFNVVNTTKRDAGKYRCMIRTEGGVGISNYAELVVKEPPVPIAPPQLASVGATYLWIQLNANSINGDGPIVAREVEYCTASGSWNDRQPVDSTSYKIGHLDPDTEYEISVLLTRPGEGGTGSPGPALRTRTKCADPMRGPRKLEVVEVKSRQITIRWEPFGYNVTRCHSYNLTVHYCYQVGGQEQVREEVSWDTENSHPQHTITNLSPYTNVSVKLILMNPEGRKESQELIVQTDEDLPGAVPTESIQGSTFEEKIFLQWREPTQTYGVITLYEITYKAVSSFDPEIDLSNQSGRVSKLGNETHFLFFGLYPGTTYSFTIRASTAKGFGPPATNQFTTKISAPSMPAYELETPLNQTDNTVTVMLKPAHSRGAPVSVYQIVVEEERPRRTKKTTEILKCYPVPIHFQNASLLNSQYYFAAEFPADSLQAAQPFTIGDNKTYNGYWNTPLLPYKSYRIYFQAASRANGETKIDCVQVATKGAATPKPVPEPEKQTDHTVKIAGVIAGILLFVIIFLGVVLVMKKRKLAKKRKETMSSTRQEMTVMVNSMDKSYAEQGTNCDEAFSFMDTHNLNGRSVSSPSSFTMKTNTLSTSVPNSYYPDETHTMASDTSSLVQSHTYKKREPADVPYQTGQLHPAIRVADLLQHITQMKCAEGYGFKEEYESFFEGQSAPWDSAKKDENRMKNRYGNIIAYDHSRVRLQTIEGDTNSDYINGNYIDGYHRPNHYIATQGPMQETIYDFWRMVWHENTASIIMVTNLVEVGRVKCCKYWPDDTEIYKDIKVTLIETELLAEYVIRTFAVEKRGVHEIREIRQFHFTGWPDHGVPYHATGLLGFVRQVKSKSPPSAGPLVVHCSAGAGRTGCFIVIDIMLDMAEREGVVDIYNCVRELRSRRVNMVQTEEQYVFIHDAILEACLCGDTSVPASQVRSLYYDMNKLDPQTNSSQIKEEFRTLNMVTPTLRVEDCSIALLPRNHEKNRCMDILPPDRCLPFLITIDGESSNYINAALMDSYKQPSAFIVTQHPLPNTVKDFWRLVLDYHCTSVVMLNDVDPAQLCPQYWPENGVHRHGPIQVEFVSADLEEDIISRIFRIYNAARPQDGYRMVQQFQFLGWPMYRDTPVSKRSFLKLIRQVDKWQEEYNGGEGRTVVHCLNGGGRSGTFCAISIVCEMLRHQRTVDVFHAVKTLRNNKPNMVDLLDQYKFCYEVALEYLNSG

SEQ ID NO: 34310 - protein, 173 aa, Homo sapiens
  ENSP00000463558
MGTLSLHPGIDVRDAPLKEIKVTSSRRFIASFNVVNTTKRDAGKYRCMIRTEGGVGISNYAELVVKEPPVPIAPPQLASVGATYLWIQLNANSINGDGPIVAREVEYCTASGSWNDRQPVDSTSYKIGHLDPDTEYEISVLLTRPGEGGTGSPGPALRTRTKCADPMRGPRKL

SEQ ID NO: 34311 - protein, 264 aa, Homo sapiens
  ENSP00000462176
  MOD_RES (1)..(1): Any amino acid
XEIDLSNQSGRVSKLGNETHFLFFGLYPGTTYSFTIRASTAKGFGPPATNQFTTKISAPSMPAYELETPLNQTDNTVTVMLKPAHSRGAPVSVYQIVVEEERPRRTKKTTEILKCYPVPIHFQNASLLNSQYYFAAEFPADSLQAAQPFTIGDNKTYNGYWNTPLLPYKSYRIYFQAASRANGETKIDCVQVATKAAIIVTQLTTPYIRIAPAAGDGQLTGAATPKPVPEPEKQTDHTVKIAGVIAGILLFVIIFLGVVLVMKK

SEQ ID NO: 34312 - protein, 207 aa, Homo sapiens
  ENSP00000464128
HFQNASLLNSQYYFAAEFPADSLQAAQPFTIGDNKTYNGYWNTPLLPYKSYRIYFQAASRANGETKIDCVQVATKGAATPKPVPEPEKQTDHTVKIAGVIAGILLFVIIFLGVVLVMKKRKLAKKRKETMSSTRQEMTVMVNSMDKSYAEQGTNCDEAFSFMDTHNLNGRSVSSPSSFTMKTNTLSTSVPNSYYPDPFVPTAILELL

SEQ ID NO: 34313 - protein, 238 aa, Homo sapiens
  ENSP00000462809
  MOD_RES (1)..(1): Any amino acid
XDIKVTLIETELLAEYVIRTFAVEKGGAGGEANCSPSREVSQRGVHEIREIRQFHFTGWPDHGVPYHATGLLGFVRQVKSKSPPSAGPLVVHCSAGAGRTGCFIVIDIMLDMAEREGVVDIYNCVRELRSRRVNMVQTEEQYVFIHDAILEACLCGDTSVPASQVRSLYYDMNKLDPQTNSSQIKEEFRTLNMVTPTLRVEDCSIALLPRNHEKNRCMDILPPDRCLPFLITIDGESS

SEQ ID NO: 34314 - protein, 279 aa, Homo sapiens
  ENSP00000382933
MNKLDPQTNSSQIKEEFRTLNMVTPTLRVEDCSIALLPRNHEKNRCMDILPPDRCLPFLITIDGESSNYINAALMDSYKQPSAFIVTQHPLPNTVKDFWRLVLDYHCTSVVMLNDVDPAQLCPQYWPENGVHRHGPIQVEFVSADLEEDIISRIFRIYNAARPQDGYRMVQQFQFLGWPMYRDTPVSKRSFLKLIRQVDKWQEEYNGGEGRTVVHCLNGGGRSGTFCAISIVCEMLRHQRTVDVFHAVKTLRNNKPNMVDLLDQYKFCYEVALEYLNSG

SEQ ID NO: 34315 - protein, 950 aa, Homo sapiens
  ENSP00000386638
MRRPRRPGGLGGSGGLRLLLCLLLLSSRPGGCSAVSAHGCLFDRRLCSHLEVCIQDGLFGQCQVGVGQARPLLQVTSPVLQRLQGVLRQLMSQGLSWHDDLTQYVISQEMERIPRLRPPEPRPRDRSGLAPKRPGPAGELLLQDIPTGSAPAAQHRLPQPPVGKGGAGASSSLSPLQAELLPPLLEHLLLPPQPPHPSLSYEPALLQPYLFHQFGSRDGSRVSEGSPGMVSVGPLPKAEAPALFSRTASKGIFGDHPGHSYGDLPGPSPAQLFQDSGLLYLAQELPAPSRARVPRLPEQGSSSRAEDSPEGYEKEGLGDRGEKPASPAVQPDAALQRLAAVLAGYGVELRQLTPEQLSTLLTLLQLLPKGAGRNPGGVVNVGADIKKTMEGPVEGRDTAELPARTSPMPGHPTASPTSSEVQQVPSPVSSEPPKAARPPVTPVLLEKKSPLGQSQPTVAGQPSARPAAEEYGYIVTDQNVVGPALTFRIRHNEQNLSLADVTQQAGLVKSELEAQTGLQILQTGVGQREEAAAVLPQTAHSTSPMRSVLLTLVALAGVAGLLVALAVALCVRQHARQQDKERLAALGPEGAHGDTTFEYQDLCRQHMATKSLFNRAEGPPEPSRVSSVSSQFSDAAQASPSSHSSTPSWCEEPAQANMDISTGHMILAYMEDHLRNRDRLAKEWQALCAYQAEPNTCATAQGEGNIKKNRHPDFLPYDHARIKLKVESSPSRSDYINASPIIEHDPRMPAYIATQGPLSHTIADFWQMVWESGCTVIVMLTPLVEDGVKQCDRYWPDEGASLYHVYEVNLVSEHIWCEDFLVRSFYLKNVQTQETRTLTQFHFLSWPAEGTPASTRPLLDFRRKVNKCYRGRSCPIIVHCSDGAGRTGTYILIDMVLNRMAKGVKEIDIAATLEHVRDQRPGLVRSKDQFEFALTAVAEEVNAILKALPQ

SEQ ID NO: 34316 - protein, 979 aa, Homo sapiens
  ENSP00000295718
MRRPRRPGGLGGSGGLRLLLCLLLLSSRPGGCSAVSAHGCLFDRRLCSHLEVCIQDGLFGQCQVGVGQARPLLQVTSPVLQRLQGVLRQLMSQGLSWHDDLTQYVISQEMERIPRLRPPEPRPRDRSGLAPKRPGPAGELLLQDIPTGSAPAAQHRLPQPPVGKGGAGASSSLSPLQAELLPPLLEHLLLPPQPPHPSLSYEPALLQPYLFHQFGSRDGSRVSEGSPGMVSVGPLPKAEAPALFSRTASKGIFGDHPGHSYGDLPGPSPAQLFQDSGLLYLAQELPAPSRARVPRLPEQGSSSRAEDSPEGYEKEGLGDRGEKPASPAVQPDAALQRLAAVLAGYGVELRQLTPEQLSTLLTLLQLLPKGAGRNPGGVVNVGADIKKTMEGPVEGRDTAELPARTSPMPGHPTASPTSSEVQQVPSPVSSEPPKAARPPVTPVLLEKKSPLGQSQPTVAGQPSARPAAEEYGYIVTDQKPLSLAAGVKLLEILAEHVHMSSGSFINISVVGPALTFRIRHNEQNLSLADVTQQAGLVKSELEAQTGLQILQTGVGQREEAAAVLPQTAHSTSPMRSVLLTLVALAGVAGLLVALAVALCVRQHARQQDKERLAALGPEGAHGDTTFEYQDLCRQHMATKSLFNRAEGPPEPSRVSSVSSQFSDAAQASPSSHSSTPSWCEEPAQANMDISTGHMILAYMEDHLRNRDRLAKEWQALCAYQAEPNTCATAQGEGNIKKNRHPDFLPYDHARIKLKVESSPSRSDYINASPIIEHDPRMPAYIATQGPLSHTIADFWQMVWESGCTVIVMLTPLVEDGVKQCDRYWPDEGASLYHVYEVNLVSEHIWCEDFLVRSFYLKNVQTQETRTLTQFHFLSWPAEGTPASTRPLLDFRRKVNKCYRGRSCPIIVHCSDGAGRTGTYILIDMVLNRMAKGVKEIDIAATLEHVRDQRPGLVRSKDQFEFALTAVAEEVNAILKALPQ

SEQ ID NO: 34317 - protein, 137 aa, Homo sapiens
  ENSP00000396842
  MOD_RES (1)..(1): Any amino acid
XWESGCTVIVMLTPLVEDGVKQCDRYWPDEGASLYHVYEVNLVSEHIWCEDFLVRSFYLKNVQTQETRTLTQFHFLSWPAEGTPASTRPLLDFRRKVNKCYRGRSCPIIVHCSDGAGRTGTYILIDMVLNRMAKGPV

SEQ ID NO: 34318 - protein, 889 aa, Homo sapiens
  ENSP00000392598
MSQGLSWHDDLTQYVISQEMERIPRLRPPEPRPRDRSGLAPKRPGPAGELLLQDIPTGSAPAAQHRLPQPPVGKGGAGASSSLSPLQAELLPPLLEHLLLPPQPPHPSLSYEPALLQPYLFHQFGSRDGSRVSEGSPGMVSVGPLPKAEAPALFSRTASKGIFGDHPGHSYGDLPGPSPAQLFQDSGLLYLAQELPAPSRARVPRLPEQGSSSRAEDSPEGYEKEGLGDRGEKPASPAVQPDAALQRLAAVLAGYGVELRQLTPEQLSTLLTLLQLLPKGAGRNPGGVVNVGADIKKTMEGPVEGRDTAELPARTSPMPGHPTASPTSSEVQQVPSPVSSEPPKAARPPVTPVLLEKKSPLGQSQPTVAGQPSARPAAEEYGYIVTDQKPLSLAAGVKLLEILAEHVHMSSGSFINISVVGPALTFRIRHNEQNLSLADVTQQAGLVKSELEAQTGLQILQTGVGQREEAAAVLPQTAHSTSPMRSVLLTLVALAGVAGLLVALAVALCVRQHARQQDKERLAALGPEGAHGDTTFEYQDLCRQHMATKSLFNRAEGPPEPSRVSSVSSQFSDAAQASPSSHSSTPSWCEEPAQANMDISTGHMILAYMEDHLRNRDRLAKEWQALCAYQAEPNTCATAQGEGNIKKNRHPDFLPYDHARIKLKVESSPSRSDYINASPIIEHDPRMPAYIATQGPLSHTIADFWQMVWESGCTVIVMLTPLVEDGVKQCDRYWPDEGASLYHVYEVNLVSEHIWCEDFLVRSFYLKNVQTQETRTLTQFHFLSWPAEGTPASTRPLLDFRRKVNKCYRGRSCPIIVHCSDGAGRTGTYILIDMVLNRMAKGVKEIDIAATLEHVRDQRPGLVRSKDQFEFALTAVAEEVNAILKALPQ

SEQ ID NO: 34319 - protein, 125 aa, Homo sapiens
  ENSP00000388429
MSQGLSWHDDLTQYVISQEMERIPRLRPPEPRPRDRSGLAPKRPGPAGELLLQDIPTGSAPAAQHRLPQPPVGKGGAGASSSLSPLQAELLPPLLEHLLLPPQPPHPSLSYEPALLQPYLFHQFG

SEQ ID NO: 34320 - protein, 124 aa, Homo sapiens
  ENSP00000395379
MSQGLSWHDDLTQYVISQEMERIPRLRPPEPRPRDRSGLAPKRPGPAGELLLQDIPTGSAPAAQHRLPQPPVGKGGAGASSSLSPLQAELLPPLLEHLLLPPQPPHPSLSYEPALLQPYLFHQF

SEQ ID NO: 34321 - protein, 166 aa, Homo sapiens
  ENSP00000408036
MRDEEGCLFDRRLCSHLEVCIQDGLFGQCQVGVGQARPLLQVTSPVLQRLQGVLRQLMSQGLSWHDDLTQYVISQEMERIPRLRPPEPRPRDRSGLAPKRPGPAGELLLQDIPTGSAPAAQHRLPQPPVGKGGAGASSSLSPLQAELLPPLLEHLLLPPQPPHPSL

SEQ ID NO: 34322 - protein, 86 aa, Homo sapiens
  ENSP00000396464
MSQGLSWHDDLTQYVISQEMERIPRLRPPEPRPRDRSGLAPKRPGPAGELLLQDIPTGSAPAAQHRLPQPPVGKGGAGASSSLSPL

SEQ ID NO: 34323 - protein, 67 aa, Homo sapiens
  ENSP00000397105
MSQGLSWHDDLTQYVISQEMERIPRLRPPEPRPRDRSGLAPKRPGPAGELLLQDIPTGSAPAAQHRL

SEQ ID NO: 34324 - protein, 52 aa, Homo sapiens
  ENSP00000475591
MRRPRRPGGLGGSGGLRLLLCLLLLSSRPGGCSAVSAHGSGEGHGVHVGRGT

SEQ ID NO: 34325 - protein, 1216 aa, Homo sapiens
  ENSP00000281171
MGHLPTGIHGARRLLPLLWLFVLFKNATAFHVTVQDDNNIVVSLEASDVISPASVYVVKITGESKNYFFEFEEFNSTLPPPVIFKASYHGLYYIITLVVVNGNVVTKPSRSITVLTKPLPVTSVSIYDYKPSPETGVLFEIHYPEKYNVFTRVNISYWEGKDFRTMLYKDFFKGKTVFNHWLPGMCYSNITFQLVSEATFNKSTLVEYSGVSHEPKQHRTAPYPPQNISVRIVNLNKNNWEEQSGNFPEESFMRSQDTIGKEKLFHFTEETPEIPSGNISSGWPDFNSSDYETTSQPYWWDSASAAPESEDEFVSVLPMEYENNSTLSETEKSTSGSFSFFPVQMILTWLPPKPPTAFDGFHIHIEREENFTEYLMVDEEAHEFVAELKEPGKYKLSVTTFSSSGSCETRKSQSAKSLSFYISPSGEWIEELTEKPQHVSVHVLSSTTALMSWTSSQENYNSTIVSVVSLTCQKQKESQRLEKQYCTQVNSSKPIIENLVPGAQYQVVIYLRKGPLIGPPSDPVTFAIVPTGIKDLMLYPLGPTAVVLSWTRPYLGVFRKYVVEMFYFNPATMTSEWTTYYEIAATVSLTASVRIANLLPAWYYNFRVTMVTWGDPELSCCDSSTISFITAPVAPEITSVEYFNSLLYISWTYGDDTTDLSHSRMLHWMVVAEGKKKIKKSVTRNVMTAILSLPPGDIYNLSVTACTERGSNTSMLRLVKLEPAPPKSLFAVNKTQTSVTLLWVEEGVADFFEVFCQQVGSSQKTKLQEPVAVSSHVVTISSLLPATAYNCSVTSFSHDSPSVPTFIAVSTMVTEMNPNVVVISVLAILSTLLIGLLLVTLIILRKKHLQMARECGAGTFVNFASLERDGKLPYNWRRSIFAFLTLLPSCLWTDYLLAFYINPWSKNGLKKRKLTNPVQLDDFDAYIKDMAKDSDYKFSLQFEELKLIGLDIPHFAADLPLNRCKNRYTNILPYDFSRVRLVSMNEEEGADYINANYIPGYNSPQEYIATQGPLPETRNDFWKMVLQQKSQIIVMLTQCNEKRRVKCDHYWPFTEEPIAYGDITVEMISEEEQDDWACRHFRINYADEMQDVMHFNYTAWPDHGVPTANAAESILQFVHMVRQQATKSKGPMIIHCSAGVGRTGTFIALDRLLQHIRDHEFVDILGLVSEMRSYRMSMVQTEEQYIFIHQCVQLMWMKKKQQFCISDVIYENVSKS

SEQ ID NO: 34326 - protein, 597 aa, Homo sapiens
  ENSP00000444173
MGHLPTGIHGARRLLPLLWLFVLFKNATAFHVTVQDDNNIVVSLEASDVISPASVYVVKITGESKNYFFEFEEFNSTLPPPVIFKASYHGLYYIITLVVVNGNVVTKPSRSITVLTKPLPVTSVSIYDYKPSPETGVLFEIHYPEKYNVFTRVNISYWEGKDFRTMLYKDFFKGKTVFNHWLPGMCYSNITFQLVSEATFNKSTLVEYSGVSHEPKQHRTAPYPPQNISVRIVNLNKNNWEEQSGNFPEESFMRSQDTIGKEKLFHFTEETPEIPSGNISSGWPDFNSSDYETTSQPYWWDSASAAPESEDEFVSVLPMEYENNSTLSETEKSTSGSFSFFPVQMILTWLPPKPPTAFDGFHIHIEREENFTEYLMVDEEAHEFVAELKEPGKYKLSVTTFSSSGSCETRKSQSAKSLSFYISPSGEWIEELTEKPQHVSVHVLSSTTALMSWTSSQENYNSTIVSVVSLTCQKQKESQRLEKQYCTQVNSSKPIIENLVPGAQYQVVIYLRKGPLIGPPSDPVTFAIVPTGIKDLMLYPLGPTAVVLSWTRPYLGVFRKYVVEMFYFNPATMTSEWTTYYEIAATVSLTASVVIFP

SEQ ID NO: 34327 - protein, 1188 aa, Homo sapiens
  ENSP00000343434
MGHLPTGIHGARRLLPLLWLFVLFKNATAFHVTVQDDNNIVVSLEASDVISPASVYVVKITGESKNYFFEFEEFNSTLPPPVIFKASYHGLYYIITLVVVNGNVVTKPSRSITVLTKPLPVTSVSIYDYKPSPETGVLFEIHYPEKYNVFTRVNISYWEGKDFRTMLYKDFFKGKTVFNHWLPGMCYSNITFQLVSEATFNKSTLVEYSGVSHEPKQHRTAPYPPQNISVRIVNLNKNNWEEQSGNFPEESFMRSQDTIGKEKLFHFTEETPEIPSGNISSGWPDFNSSDYETTSQPYWWDSASAAPESEDEFVSVLPMEYENNSTLSETEKSTSGSFSFFPVQMILTWLPPKPPTAFDGFHIHIEREENFTEYLMVDEEAHEFVAELKEPGKYKLSVTTFSSSGSCETRKSQSAKSLSFYISPSGEWIEELTEKPQHVSVHVLSSTTALMSWTSSQENYNSTIVSVVSLTCQKQKESQRLEKQYCTQVNSSKPIIENLVPGAQYQVVIYLRKGPLIGPPSDPVTFAIVPTGIKDLMLYPLGPTAVVLSWTRPYLGVFRKYVVEMFYFNPATMTSEWTTYYEIAATVSLTASVRIANLLPAWYYNFRVTMVTWGDPELSCCDSSTISFITAPVAPEITSVEYFNSLLYISWTYGDDTTDLSHSRMLHWMVVAEGKKKIKKSVTRNVMTAILSLPPGDIYNLSVTACTERGSNTSMLRLVKLEPAPPKSLFAVNKTQTSVTLLWVEEGVADFFEVFCQQVGSSQKTKLQEPVAVSSHVVTISSLLPATAYNCSVTSFSHDSPSVPTFIAVSTMVTEMNPNVVVISVLAILSTLLIGLLLVTLIILRKKHLQMARECGAGTFVNFASLERDGKLPYNWSKNGLKKRKLTNPVQLDDFDAYIKDMAKDSDYKFSLQFEELKLIGLDIPHFAADLPLNRCKNRYTNILPYDFSRVRLVSMNEEEGADYINANYIPGYNSPQEYIATQGPLPETRNDFWKMVLQQKSQIIVMLTQCNEKRRVKCDHYWPFTEEPIAYGDITVEMISEEEQDDWACRHFRINYADEMQDVMHFNYTAWPDHGVPTANAAESILQFVHMVRQQATKSKGPMIIHCSAGVGRTGTFIALDRLLQHIRDHEFVDILGLVSEMRSYRMSMVQTEEQYIFIHQCVQLMWMKKKQQFCISDVIYENVSKS

SEQ ID NO: 34328 - protein, 405 aa, Homo sapiens
  ENSP00000404188
MVTEMNPNVVVISVLAILSTLLIGLLLVTLIILRKKHLQMARECGAGTFVNFASLERDGKLPYNWRRSIFAFLTLLPSCLWTDYLLAFYINPWSKNGLKKRKLTNPVQLDDFDAYIKDMAKDSDYKFSLQFEELKLIGLDIPHFAADLPLNRCKNRYTNILPYDFSRVRLVSMNEEEGADYINANYIPGYNSPQEYIATQGPLPETRNDFWKMVLQQKSQIIVMLTQCNEKRRVKCDHYWPFTEEPIAYGDITVEMISEEEQDDWACRHFRINYADEMQDVMHFNYTAWPDHGVPTANAAESILQFVHMVRQQATKSKGPMIIHCSAGVGRTGTFIALDRLLQHIRDHEFVDILGLVSEMRSYRMSMVQTEEQYIFIHQCVQLMWMKKKQQFCISDVIYENVSKS

SEQ ID NO: 34329 - protein, 377 aa, Homo sapiens
  ENSP00000437571
MVTEMNPNVVVISVLAILSTLLIGLLLVTLIILRKKHLQMARECGAGTFVNFASLERDGKLPYNWSKNGLKKRKLTNPVQLDDFDAYIKDMAKDSDYKFSLQFEELKLIGLDIPHFAADLPLNRCKNRYTNILPYDFSRVRLVSMNEEEGADYINANYIPGYNSPQEYIATQGPLPETRNDFWKMVLQQKSQIIVMLTQCNEKRRVKCDHYWPFTEEPIAYGDITVEMISEEEQDDWACRHFRINYADEMQDVMHFNYTAWPDHGVPTANAAESILQFVHMVRQQATKSKGPMIIHCSAGVGRTGTFIALDRLLQHIRDHEFVDILGLVSEMRSYRMSMVQTEEQYIFIHQCVQLMWMKKKQQFCISDVIYENVSKS

SEQ ID NO: 34330 - protein, 405 aa, Homo sapiens; identical to SEQ ID NO: 34328
  ENSP00000393449

SEQ ID NO: 34331 - protein, 377 aa, Homo sapiens; identical to SEQ ID NO: 34329
  ENSP00000439234

SEQ ID NO: 34332 - protein, 88 aa, Homo sapiens
  ENSP00000445621
  MOD_RES (1)..(1): Any amino acid
XVTLLWVEEGVADFFEVFCQQVGSSQKTKLQEPVAVSSHVVTISSLLPATAYNCSVTSFSHDSPSVPTFIAVSTMGSVELVHLSILHP

SEQ ID NO: 34333 - protein, 116 aa, Homo sapiens
  ENSP00000446201
WKMVLQQKSQIIVMLTQCNEKRRVKCDHYWPFTEEPIAYGDITVEMISEEEQDDWACRHFRINYADEMQDVMHFNYTAWPDHGVPTANAAESILQFVHMVRQQATKSKGPMIIHCR

SEQ ID NO: 34334 - protein, 412 aa, Homo sapiens
  ENSP00000391750
MILYRLKERFQLSLRQDKEKNQEIHLSPITLQPALSEAKTVHSMVQPEQAPKVLNVVVDPQGRGAPEIKATTATSVCPSPFKMKPIGLQERRGSNVSLTLDMSSLGNIEPFVSIPTPREKVAMEYLQSASRILTRSQLRDVVASSHLLQSEFMEIPMNFVDPKEIDIPRHGTKNRYKTILPNPLSRVCLRPKNVTDSLSTYINANYIRGYSGKEKAFIATQGPMINTVDDFWQMVWQEDSPVIVMITKLKEKNEKCVLYWPEKRGIYGKVEVLVISVNECDNYTIRNLVLKQGSHTQHVKHYWYTSWPDHKTPDSAQPLLQLMLDVEEDRLASQGRGPVVVHCSAGIGRTGCFIATSIGCQQLKEEGVVDALSIVCQLRMDRGGMVQTSEQYEFVHHALCLYESRLSAETVQ

SEQ ID NO: 34335 - protein, 141 aa, Homo sapiens
  ENSP00000448049
MNFVDPKEIDIPRHGTKNRYKTILPNPLSRVCLRPKNVTDSLSTYINANYIRGYSGKEKAFIATQGPMINTVDDFWQMVWQEDSPVIVMITKLKEKNEKRRLTGLAPAHTWHSTFPWAKLSGSRCPHPMTRACAGAITPPC

SEQ ID NO: 34336 - protein, 657 aa, Homo sapiens
  ENSP00000283228
MRRAVCFPALCLLLNLHAAGCFSGNNDHFLAINQKKSGKPVFIYKHSQDIEKSLDIAPQKIYRHSYHSSSEAQVSKRHQIVNSAFPRPAYDPSLNLLAMDGQDLEVENLPIPAANVIVVTLQMDVNKLNITLLRIFRQGVAAALGLLPQQVHINRLIGKKNSIELFVSPINRKTGISDALPSEEVLRSLNINVLHQSLSQFGITEVSPEKNVLQGQHEADKIWSKEGFYAVVIFLSIFVIIVTCLMILYRLKERFQLSLRQDKEKNQEIHLSPITLQPALSEAKTVHSMVQPEQAPKVLNVVVDPQGRGAPEIKATTATSVCPSPFKMKPIGLQERRGSNVSLTLDMSSLGNIEPFVSIPTPREKVAMEYLQSASRILTRSQLRDVVASSHLLQSEFMEIPMNFVDPKEIDIPRHGTKNRYKTILPNPLSRVCLRPKNVTDSLSTYINANYIRGYSGKEKAFIATQGPMINTVDDFWQMVWQEDSPVIVMITKLKEKNEKCVLYWPEKRGIYGKVEVLVISVNECDNYTIRNLVLKQGSHTQHVKHYWYTSWPDHKTPDSAQPLLQLMLDVEEDRLASQGRGPVVVHCSAGIGRTGCFIATSIGCQQLKEEGVVDALSIVCQLRMDRGGMVQTSEQYEFVHHALCLYESRLSAETVQ

SEQ ID NO: 34337 - protein, 545 aa, Homo sapiens
  ENSP00000339605
MQSISKQTLQMDVNKLNITLLRIFRQGVAAALGLLPQQVHINRLIGKKNSIELFVSPINRKTGISDALPSEEVLRSLNINVLHQSLSQFGITEVSPEKNVLQGQHEADKIWSKEGFYAVVIFLSIFVIIVTCLMILYRLKERFQLSLRQDKEKNQEIHLSPITLQPALSEAKTVHSMVQPEQAPKVLNVVVDPQGRGAPEIKATTATSVCPSPFKMKPIGLQERRGSNVSLTLDMSSLGNIEPFVSIPTPREKVAMEYLQSASRILTRSQLRDVVASSHLLQSEFMEIPMNFVDPKEIDIPRHGTKNRYKTILPNPLSRVCLRPKNVTDSLSTYINANYIRGYSGKEKAFIATQGPMINTVDDFWQMVWQEDSPVIVMITKLKEKNEKCVLYWPEKRGIYGKVEVLVISVNECDNYTIRNLVLKQGSHTQHVKHYWYTSWPDHKTPDSAQPLLQLMLDVEEDRLASQGRGPVVVHCSAGIGRTGCFIATSIGCQQLKEEGVVDALSIVCQLRMDRGGMVQTSEQYEFVHHALCLYESRLSAETVQ

SEQ ID NO: 34338 - protein, 412 aa, Homo sapiens; identical to SEQ ID NO: 34334
  ENSP00000446943

SEQ ID NO: 34339 - protein, 198 aa, Homo sapiens
  ENSP00000449616
MILYRLKERFQLSLRQDKEKNQEIHLSPITLQPALSEAKTVHSMVQPEQAPKVLNVVVDPQGRGAPEIKATTATSVCPSPFKMKPIGLQERRGSNVSLTLDMSSLGNIEPFVSIPTPREKVAMEYLQSASRILTRSQLRDVVASSHLLQSEFMEIPMNFVDPKEIDIPRHGTKNRYKTILPNPLSRVCLRPKNVTDSL

SEQ ID NO: 34340 - protein, 451 aa, Homo sapiens
  ENSP00000368054
MNQKNVLQGQHEADKIWSKEGFYAVVIFLSIFVIIVTCLMILYRLKERFQLSLRQDKEKNQEIHLSPITLQPALSEAKTVHSMVQPEQAPKVLNVVVDPQGRGAPEIKATTATSVCPSPFKMKPIGLQERRGSNVSLTLDMSSLGNIEPFVSIPTPREKVAMEYLQSASRILTRSQLRDVVASSHLLQSEFMEIPMNFVDPKEIDIPRHGTKNRYKTILPNPLSRVCLRPKNVTDSLSTYINANYIRGYSGKEKAFIATQGPMINTVDDFWQMVWQEDSPVIVMITKLKEKNEKCVLYWPEKRGIYGKVEVLVISVNECDNYTIRNLVLKQGSHTQHVKHYWYTSWPDHKTPDSAQPLLQLMLDVEEDRLASQGRGPVVVHCSAGIGRTGCFIATSIGCQQLKEEGVVDALSIVCQLRMDRGGMVQTSEQYEFVHHALCLYESRLSAETVQ

SEQ ID NO: 34341 - protein, 1441 aa, Homo sapiens
  ENSP00000362283
MASLAALALSLLLRLQLPPLPGARAQSAAGGCSFDEHYSNCGYSVALGTNGFTWEQINTWEKPMLDQAVPTGSFMMVNSSGRASGQKAHLLLPTLKENDTHCIDFHYYFSSRDRSSPGALNVYVKVNGGPQGNPVWNVSGVVTEGWVKAELAISTFWPHFYQVIFESVSLKGHPGYIAVDEVRVLAHPCRKAPHFLRLQNVEVNVGQNATFQCIAGGKWSQHDKLWLQQWNGRDTALMVTRVVNHRRFSATVSVADTAQRSVSKYRCVIRSDGGSGVSNYAELIVKEPPTPIAPPELLAVGATYLWIKPNANSIIGDGPIILKEVEYRTTTGTWAETHIVDSPNYKLWHLDPDVEYEIRVLLTRPGEGGTGPPGPPLTTRTKCADPVHGPQNVEIVDIRARQLTLQWEPFGYAVTRCHSYNLTVQYQYVFNQQQYEAEEVIQTSSHYTLRGLRPFMTIRLRLLLSNPEGRMESEELVVQTEEDVPGAVPLESIQGGPFEEKIYIQWKPPNETNGVITLYEINYKAVGSLDPSADLSSQRGKVFKLRNETHHLFVGLYPGTTYSFTIKASTAKGFGPPVTTRIATKISAPSMPEYDTDTPLNETDTTITVMLKPAQSRGAPVSVYQLVVKEERLQKSRRAADIIECFSVPVSYRNASSLDSLHYFAAELKPANLPVTQPFTVGDNKTYNGYWNPPLSPLKSYSIYFQALSKANGETKINCVRLATKGASTQNSNTVEPEKQVDNTVKMAGVIAGLLMFIIILLGVMLTIKRRRNAYSYSYYLKLAKKQKETQSGAQREMGPVASADKPTTKLSASRNDEGFSSSSQDVNGFTDGSRGELSQPTLTIQTHPYRTCDPVEMSYPRDQFQPAIRVADLLQHITQMKRGQGYGFKEEYEALPEGQTASWDTAKEDENRNKNRYGNIISYDHSRVRLLVLDGDPHSDYINANYIDGYHRPRHYIATQGPMQETVKDFWRMIWQENSASIVMVTNLVEVGRVKCVRYWPDDTEVYGDIKVTLIETEPLAEYVIRTFTVQKKGYHEIRELRLFHFTSWPDHGVPCYATGLLGFVRQVKFLNPPEAGPIVVHCSAGAGRTGCFIAIDTMLDMAENEGVVDIFNCVRELRAQRVNLVQTEEQYVFVHDAILEACLCGNTAIPVCEFRSLYYNISRLDPQTNSSQIKDEFQTLNIVTPRVRPEDCSIGLLPRNHDKNRSMDVLPLDRCLPFLISVDGESSNYINAALMDSHKQPAAFVVTQHPLPNTVADFWRLVFDYNCSSVVMLNEMDTAQFCMQYWPEKTSGCYGPIQVEFVSADIDEDIIHRIFRICNMARPQDGYRIVQHLQYIGWPAYRDTPPSKRSLLKVVRRLEKWQEQYDGREGRTVVHCLNGGGRSGTFCAICSVCEMIQQQNIIDVFHIVKTLRNNKSNMVETLEQYKFVYEVALEYLSSF

SEQ ID NO: 34342 - protein, 1450 aa, Homo sapiens
  ENSP00000348408
MASLAALALSLLLRLQLPPLPGARAQSAAGGCSFDEHYSNCGYSVALGTNGFTWEQINTWEKPMLDQAVPTGSFMMVNSSGRASGQKAHLLLPTLKENDTHCIDFHYYFSSRDRSSPGALNVYVKVNGGPQGNPVWNVSGVVTEGWVKAELAISTFWPHFYQVIFESVSLKGHPGYIAVDEVRVLAHPCRKAPHFLRLQNVEVNVGQNATFQCIAGGKWSQHDKLWLQQWNGRDTALMVTRVVNHRRFSATVSVADTAQRSVSKYRCVIRSDGGSGVSNYAELIVKEPPTPIAPPELLAVGATYLWIKPNANSIIGDGPIILKEVEYRTTTGTWAETHIVDSPNYKLWHLDPDVEYEIRVLLTRPGEGGTGPPGPPLTTRTKCADPVHGPQNVEIVDIRARQLTLQWEPFGYAVTRCHSYNLTVQYQYVFNQQQYEAEEVIQTSSHYTLRGLRPFMTIRLRLLLSNPEGRMESEELVVQTEEDVPGAVPLESIQGGPFEEKIYIQWKPPNETNGVITLYEINYKAVGSLDPSADLSSQRGKVFKLRNETHHLFVGLYPGTTYSFTIKASTAKGFGPPVTTRIATKISAPSMPEYDTDTPLNETDTTITVMLKPAQSRGAPVSVYQLVVKEERLQKSRRAADIIECFSVPVSYRNASSLDSLHYFAAELKPANLPVTQPFTVGDNKTYNGYWNPPLSPLKSYSIYFQALSKANGETKINCVRLATKAPMGSAQVTPGTPLCLLTTGASTQNSNTVEPEKQVDNTVKMAGVIAGLLMFIIILLGVMLTIKRRKLAKKQKETQSGAQREMGPVASADKPTTKLSASRNDEGFSSSSQDVNGFTDGSRGELSQPTLTIQTHPYRTCDPVEMSYPRDQFQPAIRVADLLQHITQMKRGQGYGFKEEYEALPEGQTASWDTAKEDENRNKNRYGNIISYDHSRVRLLVLDGDPHSDYINANYIDGYHRPRHYIATQGPMQETVKDFWRMIWQENSASIVMVTNLVEVGRVKCVRYWPDDTEVYGDIKVTLIETEPLAEYVIRTFTVQKKGYHEIRELRLFHFTSWPDHGVPCYATGLLGFVRQVKFLNPPEAGPIVVHCSAGAGRTGCFIAIDTMLDMAENEGVVDIFNCVRELRAQRVNLVQTEEQYVFVHDAILEACLCGNTAIPVCEFRSLYYNISRLDPQTNSSQIKDEFQTLNIVTPRVRPEDCSIGLLPRNHDKNRSMDVLPLDRCLPFLISVDGESSNYINAALMDSHKQPAAFVVTQHPLPNTVADFWRLVFDYNCSSVVMLNEMDTAQFCMQYWPEKTSGCYGPIQVEFVSADIDEDIIHRIFRICNMARPQDGYRIVQHLQYIGWPAYRDTPPSKRSLLKVVRRLEKWQEQYDGREGRTVVHCLNGGGRSGTFCAICSVCEMIQQQNIIDVFHIVKTLRNNKSNMVETLEQYKFVYEVALEYLSSF

SEQ ID NO: 34343 - protein, 1451 aa, Homo sapiens
  ENSP00000362280
MASLAALALSLLLRLQLPPLPGARAQSAAGGCSFDEHYSNCGYSVALGTNGFTWEQINTWEKPMLDQAVPTGSFMMVNSSGRASGQKAHLLLPTLKENDTHCIDFHYYFSSRDRSSPGALNVYVKVNGGPQGNPVWNVSGVVTEGWVKAELAISTFWPHFYQVIFESVSLKGHPGYIAVDEVRVLAHPCRKAPHFLRLQNVEVNVGQNATFQCIAGGKWSQHDKLWLQQWNGRDTALMVTRVVNHRRFSATVSVADTAQRSVSKYRCVIRSDGGSGVSNYAELIVKEPPTPIAPPELLAVGATYLWIKPNANSIIGDGPIILKEVEYRTTTGTWAETHIVDSPNYKLWHLDPDVEYEIRVLLTRPGEGGTGPPGPPLTTRTKCADPVHGPQNVEIVDIRARQLTLQWEPFGYAVTRCHSYNLTVQYQYVFNQQQYEAEEVIQTSSHYTLRGLRPFMTIRLRLLLSNPEGRMESEELVVQTEEDVPGAVPLESIQGGPFEEKIYIQWKPPNETNGVITLYEINYKAVGSLDPSADLSSQRGKVFKLRNETHHLFVGLYPGTTYSFTIKASTAKGFGPPVTTRIATKISAPSMPEYDTDTPLNETDTTITVMLKPAQSRGAPVSVYQLVVKEERLQKSRRAADIIECFSVPVSYRNASSLDSLHYFAAELKPANLPVTQPFTVGDNKTYNGYWNPPLSPLKSYSIYFQALSKANGETKINCVRLATKGASTQNSNTVEPEKQVDNTVKMAGVIAGLLMFIIILLGVMLTIKRRKLAKKQKETQSGAQREMGPVASADKPTTKLSASRNDEGFSSSSQDVNGFTDGSRGELSQPTLTIQTHPYRTCDPVEMSYPRDQFQPAIRVADLLQHITQMKRGQGYGFKEEYEALPEGQTASWDTAKEDENRNKNRYGNIISYDHSRVRLLVLDGDPHSDYINANYIDGYHRPRHYIATQGPMQETVKDFWRMIWQENSASIVMVTNLVEVGRHPAEHTVGNATLGRAASPGMVKCVRYWPDDTEVYGDIKVTLIETEPLAEYVIRTFTVQKKGYHEIRELRLFHFTSWPDHGVPCYATGLLGFVRQVKFLNPPEAGPIVVHCSAGAGRTGCFIAIDTMLDMAENEGVVDIFNCVRELRAQRVNLVQTEEQYVFVHDAILEACLCGNTAIPVCEFRSLYYNISRLDPQTNSSQIKDEFQTLNIVTPRVRPEDCSIGLLPRNHDKNRSMDVLPLDRCLPFLISVDGESSNYINAALMDSHKQPAAFVVTQHPLPNTVADFWRLVFDYNCSSVVMLNEMDTAQFCMQYWPEKTSGCYGPIQVEFVSADIDEDIIHRIFRICNMARPQDGYRIVQHLQYIGWPAYRDTPPSKRSLLKVVRRLEKWQEQYDGREGRTVVHCLNGGGRSGTFCAICSVCEMIQQQNIIDVFHIVKTLRNNKSNMVETLEQYKFVYEVALEYLSSF

SEQ ID NO: 34344 - protein, 1440 aa, Homo sapiens
  ENSP00000362286
MASLAALALSLLLRLQLPPLPGARAQSAAGGCSFDEHYSNCGYSVALGTNGFTWEQINTWEKPMLDQAVPTGSFMMVNSSGRASGQKAHLLLPTLKENDTHCIDFHYYFSSRDRSSPGALNVYVKVNGGPQGNPVWNVSGVVTEGWVKAELAISTFWPHFYQVIFESVSLKGHPGYIAVDEVRVLAHPCRKAPHFLRLQNVEVNVGQNATFQCIAGGKWSQHDKLWLQQWNGRDTALMVTRVVNHRRFSATVSVADTAQRSVSKYRCVIRSDGGSGVSNYAELIVKEPPTPIAPPELLAVGATYLWIKPNANSIIGDGPIILKEVEYRTTTGTWAETHIVDSPNYKLWHLDPDVEYEIRVLLTRPGEGGTGPPGPPLTTRTKCADPVHGPQNVEIVDIRARQLTLQWEPFGYAVTRCHSYNLTVQYQYVFNQQQYEAEEVIQTSSHYTLRGLRPFMTIRLRLLLSNPEGRMESEELVVQTEEDVPGAVPLESIQGGPFEEKIYIQWKPPNETNGVITLYEINYKAVGSLDPSADLSSQRGKVFKLRNETHHLFVGLYPGTTYSFTIKASTAKGFGPPVTTRIATKISAPSMPEYDTDTPLNETDTTITVMLKPAQSRGAPVSVYQLVVKEERLQKSRRAADIIECFSVPVSYRNASSLDSLHYFAAELKPANLPVTQPFTVGDNKTYNGYWNPPLSPLKSYSIYFQALSKANGETKINCVRLATKGASTQNSNTVEPEKQVDNTVKMAGVIAGLLMFIIILLGVMLTIKRRRNAYSYSYYLKLAKKQKETQSGAQREMGPVASADKPTTKLSASRNDEGFSSSSQDVNGFNGSRGELSQPTLTIQTHPYRTCDPVEMSYPRDQFQPAIRVADLLQHITQMKRGQGYGFKEEYEALPEGQTASWDTAKEDENRNKNRYGNIISYDHSRVRLLVLDGDPHSDYINANYIDGYHRPRHYIATQGPMQETVKDFWRMIWQENSASIVMVTNLVEVGRVKCVRYWPDDTEVYGDIKVTLIETEPLAEYVIRTFTVQKKGYHEIRELRLFHFTSWPDHGVPCYATGLLGFVRQVKFLNPPEAGPIVVHCSAGAGRTGCFIAIDTMLDMAENEGVVDIFNCVRELRAQRVNLVQTEEQYVFVHDAILEACLCGNTAIPVCEFRSLYYNISRLDPQTNSSQIKDEFQTLNIVTPRVRPEDCSIGLLPRNHDKNRSMDVLPLDRCLPFLISVDGESSNYINAALMDSHKQPAAFVVTQHPLPNTVADFWRLVFDYNCSSVVMLNEMDTAQFCMQYWPEKTSGCYGPIQVEFVSADIDEDIIHRIFRICNMARPQDGYRIVQHLQYIGWPAYRDTPPSKRSLLKVVRRLEKWQEQYDGREGRTVVHCLNGGGRSGTFCAICSVCEMIQQQNIIDVFHIVKTLRNNKSNMVETLEQYKFVYEVALEYLSSF

SEQ ID NO: 34345 - protein, 1460 aa, Homo sapiens
  ENSP00000362294
MASLAALALSLLLRLQLPPLPGARAQSAAGGCSFDEHYSNCGYSVALGTNGFTWEQINTWEKPMLDQAVPTGSFMMVNSSGRASGQKAHLLLPTLKENDTHCIDFHYYFSSRDRSSPGALNVYVKVNGGPQGNPVWNVSGVVTEGWVKAELAISTFWPHFYQVIFESVSLKGHPGYIAVDEVRVLAHPCRKAPHFLRLQNVEVNVGQNATFQCIAGGKWSQHDKLWLQQWNGRDTALMVTRVVNHRRFSATVSVADTAQRSVSKYRCVIRSDGGSGVSNYAELIVKEPPTPIAPPELLAVGATYLWIKPNANSIIGDGPIILKEVEYRTTTGTWAETHIVDSPNYKLWHLDPDVEYEIRVLLTRPGEGGTGPPGPPLTTRTKCADPVHGPQNVEIVDIRARQLTLQWEPFGYAVTRCHSYNLTVQYQYVFNQQQYEAEEVIQTSSHYTLRGLRPFMTIRLRLLLSNPEGRMESEELVVQTEEDVPGAVPLESIQGGPFEEKIYIQWKPPNETNGVITLYEINYKAVGSLDPSADLSSQRGKVFKLRNETHHLFVGLYPGTTYSFTIKASTAKGFGPPVTTRIATKISAPSMPEYDTDTPLNETDTTITVMLKPAQSRGAPVSVYQLVVKEERLQKSRRAADIIECFSVPVSYRNASSLDSLHYFAAELKPANLPVTQPFTVGDNKTYNGYWNPPLSPLKSYSIYFQALSKANGETKINCVRLATKAPMGSAQVTPGTPLCLLTTGASTQNSNTVEPEKQVDNTVKMAGVIAGLLMFIIILLGVMLTIKRRRNAYSYSYYLKLAKKQKETQSGAQREMGPVASADKPTTKLSASRNDEGFSSSSQDVNGFTDGSRGELSQPTLTIQTHPYRTCDPVEMSYPRDQFQPAIRVADLLQHITQMKRGQGYGFKEEYEALPEGQTASWDTAKEDENRNKNRYGNIISYDHSRVRLLVLDGDPHSDYINANYIDGYHRPRHYIATQGPMQETVKDFWRMIWQENSASIVMVTNLVEVGRVKCVRYWPDDTEVYGDIKVTLIETEPLAEYVIRTFTVQKKGYHEIRELRLFHFTSWPDHGVPCYATGLLGFVRQVKFLNPPEAGPIVVHCSAGAGRTGCFIAIDTMLDMAENEGVVDIFNCVRELRAQRVNLVQTEEQYVFVHDAILEACLCGNTAIPVCEFRSLYYNISRLDPQTNSSQIKDEFQTLNIVTPRVRPEDCSIGLLPRNHDKNRSMDVLPLDRCLPFLISVDGESSNYINAALMDSHKQPAAFVVTQHPLPNTVADFWRLVFDYNCSSVVMLNEMDTAQFCMQYWPEKTSGCYGPIQVEFVSADIDEDIIHRIFRICNMARPQDGYRIVQHLQYIGWPAYRDTPPSKRSLLKVVRRLEKWQEQYDGREGRTVVHCLNGGGRSGTFCAICSVCEMIQQQNIIDVFHIVKTLRNNKSNMVETLEQYKFVYEVALEYLSSF

SEQ ID NO: 34346 - protein, 1431 aa, Homo sapiens
  ENSP00000362297
MASLAALALSLLLRLQLPPLPGARAQSAAGGCSFDEHYSNCGYSVALGTNGFTWEQINTWEKPMLDQAVPTGSFMMVNSSGRASGQKAHLLLPTLKENDTHCIDFHYYFSSRDRSSPGALNVYVKVNGGPQGNPVWNVSGVVTEGWVKAELAISTFWPHFYQVIFESVSLKGHPGYIAVDEVRVLAHPCRKAPHFLRLQNVEVNVGQNATFQCIAGGKWSQHDKLWLQQWNGRDTALMVTRVVNHRRFSATVSVADTAQRSVSKYRCVIRSDGGSGVSNYAELIVKEPPTPIAPPELLAVGATYLWIKPNANSIIGDGPIILKEVEYRTTTGTWAETHIVDSPNYKLWHLDPDVEYEIRVLLTRPGEGGTGPPGPPLTTRTKCADPVHGPQNVEIVDIRARQLTLQWEPFGYAVTRCHSYNLTVQYQYVFNQQQYEAEEVIQTSSHYTLRGLRPFMTIRLRLLLSNPEGRMESEELVVQTEEDVPGAVPLESIQGGPFEEKIYIQWKPPNETNGVITLYEINYKAVGSLDPSADLSSQRGKVFKLRNETHHLFVGLYPGTTYSFTIKASTAKGFGPPVTTRIATKISAPSMPEYDTDTPLNETDTTITVMLKPAQSRGAPVSVYQLVVKEERLQKSRRAADIIECFSVPVSYRNASSLDSLHYFAAELKPANLPVTQPFTVGDNKTYNGYWNPPLSPLKSYSIYFQALSKANGETKINCVRLATKGASTQNSNTVEPEKQVDNTVKMAGVIAGLLMFIIILLGVMLTIKRRKLAKKQKETQSGAQREMGPVASADKPTTKLSASRNDEGFSSSSQDVNGFTDGSRGELSQPTLTIQTHPYRTCDPVEMSYPRDQFQPAIRVADLLQHITQMKRGQGYGFKEEYEALPEGQTASWDTAKEDENRNKNRYGNIISYDHSRVRLLVLDGDPHSDYINANYIDGYHRPRHYIATQGPMQETVKDFWRMIWQENSASIVMVTNLVEVGRVKCVRYWPDDTEVYGDIKVTLIETEPLAEYVIRTFTVQKKGYHEIRELRLFHFTSWPDHGVPCYATGLLGFVRQVKFLNPPEAGPIVVHCSAGAGRTGCFIAIDTMLDMAENEGVVDIFNCVRELRAQRVNLVQTEEQYVFVHDAILEACLCGNTAIPVCEFRSLYYNISRLDPQTNSSQIKDEFQTLNIVTPRVRPEDCSIGLLPRNHDKNRSMDVLPLDRCLPFLISVDGESSNYINAALMDSHKQPAAFVVTQHPLPNTVADFWRLVFDYNCSSVVMLNEMDTAQFCMQYWPEKTSGCYGPIQVEFVSADIDEDIIHRIFRICNMARPQDGYRIVQHLQYIGWPAYRDTPPSKRSLLKVVRRLEKWQEQYDGREGRTVVHCLNGGGRSGTFCAICSVCEMIQQQNIIDVFHIVKTLRNNKSNMVETLEQYKFVYEVALEYLSSF

SEQ ID NO: 34347 - protein, 1463 aa, Homo sapiens
  ENSP00000362289
MASLAALALSLLLRLQLPPLPGARAQSAAGGCSFDEHYSNCGYSVALGTNGFTWEQINTWEKPMLDQAVPTGSFMMVNSSGRASGQKAHLLLPTLKENDTHCIDFHYYFSSRDRSSPGALNVYVKVNGGPQGNPVWNVSGVVTEGWVKAELAISTFWPHFYQVIFESVSLKGHPGYIAVDEVRVLAHPCRKAPHFLRLQNVEVNVGQNATFQCIAGGKWSQHDKLWLQQWNGRDTALMVTRVVNHRRFSATVSVADTAQRSVSKYRCVIRSDGGSGVSNYAELIVKEPPTPIAPPELLAVGATYLWIKPNANSIIGDGPIILKEVEYRTTTGTWAETHIVDSPNYKLWHLDPDVEYEIRVLLTRPGEGGTGPPGPPLTTRTKCADPVHGPQNVEIVDIRARQLTLQWEPFGYAVTRCHSYNLTVQYQYVFNQQQYEAEEVIQTSSHYTLRGLRPFMTIRLRLLLSNPEGRMESEELVVQTEEDVPGAVPLESIQGGPFEEKIYIQWKPPNETNGVITLYEINYKAVGSLDPSADLSSQRGKVFKLRNETHHLFVGLYPGTTYSFTIKASTAKGFGPPVTTRIATKISAPSMPEYDTDTPLNETDTTITVMLKPAQSRGAPVSVYQLVVKEERLQKSRRAADIIECFSVPVSYRNASSLDSLHYFAAELKPANLPVTQPFTVGDNKTYNGYWNPPLSPLKSYSIYFQALSKANGETKINCVRLATKAPMGSAQVTPGTPLCLLTTGASTQNSNTVEPEKQVDNTVKMAGVIAGLLMFIIILLGVMLTIKRRRNAYSYSYYLSQRKLAKKQKETQSGAQREMGPVASADKPTTKLSASRNDEGFSSSSQDVNGFTDGSRGELSQPTLTIQTHPYRTCDPVEMSYPRDQFQPAIRVADLLQHITQMKRGQGYGFKEEYEALPEGQTASWDTAKEDENRNKNRYGNIISYDHSRVRLLVLDGDPHSDYINANYIDGYHRPRHYIATQGPMQETVKDFWRMIWQENSASIVMVTNLVEVGRVKCVRYWPDDTEVYGDIKVTLIETEPLAEYVIRTFTVQKKGYHEIRELRLFHFTSWPDHGVPCYATGLLGFVRQVKFLNPPEAGPIVVHCSAGAGRTGCFIAIDTMLDMAENEGVVDIFNCVRELRAQRVNLVQTEEQYVFVHDAILEACLCGNTAIPVCEFRSLYYNISRLDPQTNSSQIKDEFQTLNIVTPRVRPEDCSIGLLPRNHDKNRSMDVLPLDRCLPFLISVDGESSNYINAALMDSHKQPAAFVVTQHPLPNTVADFWRLVFDYNCSSVVMLNEMDTAQFCMQYWPEKTSGCYGPIQVEFVSADIDEDIIHRIFRICNMARPQDGYRIVQHLQYIGWPAYRDTPPSKRSLLKVVRRLEKWQEQYDGREGRTVVHCLNGGGRSGTFCAICSVCEMIQQQNIIDVFHIVKTLRNNKSNMVETLEQYKFVYEVALEYLSSF

SEQ ID NO: 34348 - protein, 47 aa, Homo sapiens
  ENSP00000484248
MASLAALALSLLLRLQLPPLPGARAQSAAGVAVPLMSTTATVVIVWL

SEQ ID NO: 34349 - protein, 313 aa, Homo sapiens
  ENSP00000480136
GSFMMVNSSGRASGQKAHLLLPTLKENDTHCIDFHYYFSSRDRSSPGALNVYVKVNGGPQGNPVWNVSGVVTEGWVKAELAISTFWPHFYQVIFESVSLKGHPGYIAVDEVRVLAHPCRKAPHFLRLQNVEVNVGQNATFQCIAGGKWSQHDKLWLQQWNGRDTALMVTRVVNHRRFSATVSVADTAQRSVSKYRCVIRSDGGSGVSNYAELIVKEPPTPIAPPELLAVGATYLWIKPNANSIIGDGPIILKEVEYRTTTGTWAETHIVDSPNYKLWHLDPDVEYEIRVLLTRPGEGGTGPPGPPLTTRTKCA

SEQ ID NO: 34350 - protein, 1076 aa, Homo sapiens
  ENSP00000484524
  MOD_RES (1)..(1): Any amino acid
XPVHGPQNVEIVDIRARQLTLQWEPFGYAVTRCHSYNLTVQYQYVFNQQQYEAEEVIQTSSHYTLRGLRPFMTIRLRLLLSNPEGRMESEELVVQTEEDVPGAVPLESIQGGPFEEKIYIQWKPPNETNGVITLYEINYKAVGSLDPSADLSSQRGKVFKLRNETHHLFVGLYPGTTYSFTIKASTAKGFGPPVTTRIATKISAPSMPEYDTDTPLNETDTTITVMLKPAQSRGAPVSVYQLVVKEERLQKSRRAADIIECFSVPVSYRNASSLDSLHYFAAELKPANLPVTQPFTVGDNKTYNGYWNPPLSPLKSYSIYFQALSKANGETKINCVRLATKAPMGSAQVTPGTPLCLLTTGASTQNSNTVEPEKQVDNTVKMAGVIAGLLMFIIILLGVMLTIKRRRNAYSYSYYLKLAKKQKETQSGAQREMGPVASADKPTTKLSASRNDEGFSSSSQDVNGFTDGSRGELSQPTLTIQTHPYRTCDPVEMSYPRDQFQPAIRVADLLQHITQMKRGQGYGFKEEYEALPEGQTASWDTAKEDENRNKNRYGNIISYDHSRVRLLVLDGDPHSDYINANYIDGYHRPRHYIATQGPMQETVKDFWRMIWQENSASIVMVTNLVEVGRVKCVRYWPDDTEVYGDIKVTLIETEPLAEYVIRTFTVQKKGYHEIRELRLFHFTSWPDHGVPCYATGLLGFVRQVKFLNPPEAGPIVVHCSAGAGRTGCFIAIDTMLDMAENEGVVDIFNCVRELRAQRVNLVQTEEQYVFVHDAILEACLCGNTAIPVCEFRSLYYNISRLDPQTNSSQIKDEFQTLNIVTPRVRPEDCSIGLLPRNHDKNRSMDVLPLDRCLPFLISVDGESSNYINAALMDSHKQPAAFVVTQHPLPNTVADFWRLVFDYNCSSVVMLNEMDTAQFCMQYWPEKTSGCYGPIQVEFVSADIDEDIIHRIFRICNMARPQDGYRIVQHLQYIGWPAYRDTPPSKRSLLKVVRRLEKWQEQYDGREGRTVVHCLNGGGRSGTFCAICSVCEMIQQQNIIDVFHIVKTLRNNKSNMVETLEQYKFVYEVALEYLSSF

SEQ ID NO: 34351 - protein, 1059 aa, Homo sapiens [sequence omitted]

SEQ ID NO: 34352 - protein, 2315 aa, Homo sapiens
  ENSP00000377047
MRILKRFLACIQLLCVCRLDWANGYYRQQRKLVEEIGWSYTGALNQKNWGKKYPTCNSPKQSPINIDEDLTQVNVNLKKLKFQGWDKTSLENTFIHNTGKTVEINLTNDYRVSGGVSEMVFKASKITFHWGKCNMSSDGSEHSLEGQKFPLEMQIYCFDADRFSSFEEAVKGKGKLRALSILFEVGTEENLDFKAIIDGVESVSRFGKQAALDPFILLNLLPNSTDKYYIYNGSLTSPPCTDTVDWIVFKDTVSISESQLAVFCEVLTMQQSGYVMLMDYLQNNFREQQYKFSRQVFSSYTGKEEIHEAVCSSEPENVQADPENYTSLLVTWERPRVVYDTMIEKFAVLYQQLDGEDQTKHEFLTDGYQDLGAILNNLLPNMSYVLQIVAICTNGLYGKYSDQLIVDMPTDNPELDLFPELIGTEEIIKEEEEGKDIEEGAIVNPGRDSATNQIRKKEPQISTTTHYNRIGTKYNEAKTNRSPTRGSEFSGKGDVPNTSLNSTSQPVTKLATEKDISLTSQTVTELPPHTVEGTSASLNDGSKTVLRSPHMNLSGTAESLNTVSITEYEEESLLTSFKLDTGAEDSSGSSPATSAIPFISENISQGYIFSSENPETITYDVLIPESARNASEDSTSSGSEESLKDPSMEGNVWFPSSTDITAQPDVGSGRESFLQTNYTEIRVDESEKTTKSFSAGPVMSQGPSVTDLEMPHYSTFAYFPTEVTPHAFTPSSRQQDLVSTVNVVYSQTTQPVYNGETPLQPSYSSEVFPLVTPLLLDNQILNTTPAASSSDSALHATPVFPSVDVSFESILSSYDGAPLLPFSSASFSSELFRHLHTVSQILPQVTSATESDKVPLHASLPVAGGDLLLEPSLAQYSDVLSTTHAASETLEFGSESGVLYKTLMFSQVEPPSSDAMMHARSSGPEPSYALSDNEGSQHIFTVSYSSAIPVHDSVGVTYQGSLFSGPSHIPIPKSSLITPTASLLQPTHALSGDGEWSGASSDSEFLLPDTDGLTALNISSPVSVAEFTYTTSVFGDDNKALSKSEIIYGNETELQIPSFNEMVYPSESTVMPNMYDNVNKLNASLQETSVSISSTKGMFPGSLAHTTTKVFDHEISQVPENNFSVQPTHTVSQASGDTSLKPVLSANSEPASSDPASSEMLSPSTQLLFYETSASFSTEVLLQPSFQASDVDTLLKTVLPAVPSDPILVETPKVDKISSTMLHLIVSNSASSENMLHSTSVPVFDVSPTSHMHSASLQGLTISYASEKYEPVLLKSESSHQVVPSLYSNDELFQTANLEINQAHPPKGRHVFATPVLSIDEPLNTLINKLIHSDEILTSTKSSVTGKVFAGIPTVASDTFVSTDHSVPIGNGHVAITAVSPHRDGSVTSTKLLFPSKATSELSHSAKSDAGLVGGGEDGDTDDDGDDDDDDRGSDGLSIHKCMSCSSYRESQEKVMNDSDTHENSLMDQNNPISYSLSENSEEDNRVTSVSSDSQTGMDRSPGKSPSANGLSQKHNDGKEENDIQTGSALLPLSPESKAWAVLTSDEESGSGQGTSDSLNENETSTDFSFADTNEKDADGILAAGDSEITPGFPQSPTSSVTSENSEVFHVSEAEASNSSHESRIGLAEGLESEKKAVIPLVIVSALTFICLVVLVGILIYWRKCFQTAHFYLEDSTSPRVISTPPTPIFPISDDVGAIPIKHFPKHVADLHASSGFTEEFETLKEFYQEVQSCTVDLGITADSSNHPDNKHKNRYINIVAYDHSRVKLAQLAEKDGKLTDYINANYVDGYNRPKAYIAAQGPLKSTAEDFWRMIWEHNVEVIVMITNLVEKGRRKCDQYWPADGSEEYGNFLVTQKSVQVLAYYTVRNFTLRNTKIKKGSQKGRPSGRVVTQYHYTQWPDMGVPEYSLPVLTFVRKAAYAKRHAVGPVVVHCSAGVGRTGTYIVLDSMLQQIQHEGTVNIFGFLKHIRSQRNYLVQTEEQYVFIHDTLVEAILSKETEVLDSHIHAYVNALLIPGPAGKTKLEKQFQLLSQSNIQQSDYSAALKQCNREKNRTSSIIPVERSRVGISSLSGEGTDYINASYIMGYYQSNEFIITQHPLLHTIKDFWRMIWDHNAQLVVMIPDGQNMAEDEFVYWPNKDEPINCESFKVTLMAEEHKCLSNEEKLIIQDFILEATQDDYVLEVRHFQCPKWPNPDSPISKTFELISVIKEEAANRDGPMIVHDEHGGVTAGTFCALTTLMHQLEKENSVDVYQVAKMINLMRPGVFADIEQYQFLYKVILSLVSTRQEENPSTSLDSNGAALPDGNIAESLESLV

SEQ ID NO: 34353 - protein, 1448 aa, Homo sapiens
  ENSP00000410000
MRILKRFLACIQLLCVCRLDWANGYYRQQRKLVEEIGWSYTGALNQKNWGKKYPTCNSPKQSPINIDEDLTQVNVNLKKLKFQGWDKTSLENTFIHNTGKTVEINLTNDYRVSGGVSEMVFKASKITFHWGKCNMSSDGSEHSLEGQKFPLEMQIYCFDADRFSSFEEAVKGKGKLRALSILFEVGTEENLDFKAIIDGVESVSRFGKQAALDPFILLNLLPNSTDKYYIYNGSLTSPPCTDTVDWIVFKDTVSISESQLAVFCEVLTMQQSGYVMLMDYLQNNFREQQYKFSRQVFSSYTGKEEIHEAVCSSEPENVQADPENYTSLLVTWERPRVVYDTMIEKFAVLYQQLDGEDQTKHEFLTDGYQDLGAILNNLLPNMSYVLQIVAICTNGLYGKYSDQLIVDMPTDNPELDLFPELIGTEEIIKEEEEGKDIEEGAIVNPGRDSATNQIRKKEPQISTTTHYNRIGTKYNEAKTNRSPTRGSEFSGKGDVPNTSLNSTSQPVTKLATEKDISLTSQTVTELPPHTVEGTSASLNDGSKTVLRSPHMNLSGTAESLNTVSITEYEEESLLTSFKLDTGAEDSSGSSPATSAIPFISENISQGYIFSSENPETITYDVLIPESARNASEDSTSSGSEESLKDPSMEGNVWFPSSTDITAQPDVGSGRESFLQTNYTEIRVDESEKTTKSFSAGPVMSQGPSVTDLEMPHYSTFAYFPTEVTPHAFTPSSRQQDLVSTVNVVYSQTTQPVYNEASNSSHESRIGLAEGLESEKKAVIPLVIVSALTFICLVVLVGILIYWRKCFQTAHFYLEDSTSPRVISTPPTPIFPISDDVGAIPIKHFPKHVADLHASSGFTEEFEEVQSCTVDLGITADSSNHPDNKHKNRYINIVAYDHSRVKLAQLAEKDGKLTDYINANYVDGYNRPKAYIAAQGPLKSTAEDFWRMIWEHNVEVIVMITNLVEKGRRKCDQYWPADGSEEYGNFLVTQKSVQVLAYYTVRNFTLRNTKIKKGSQKGRPSGRVVTQYHYTQWPDMGVPEYSLPVLTFVRKAAYAKRHAVGPVVVHCSAGVGRTGTYIVLDSMLQQIQHEGTVNIFGFLKHIRSQRNYLVQTEEQYVFIHDTLVEAILSKETEVLDSHIHAYVNALLIPGPAGKTKLEKQFQLLSQSNIQQSDYSAALKQCNREKNRTSSIIPVERSRVGISSLSGEGTDYINASYIMGYYQSNEFIITQHPLLHTIKDFWRMIWDHNAQLVVMIPDGQNMAEDEFVYWPNKDEPINCESFKVTLMAEEHKCLSNEEKLIIQDFILEATQDDYVLEVRHFQCPKWPNPDSPISKTFELISVIKEEAANRDGPMIVHDEHGGVTAGTFCALTTLMHQLEKENSVDVYQVAKMINLMRPGVFADIEQYQFLYKVILSLVSTRQEENPSTSLDSNGAALPDGNIAESLESLV

SEQ ID NO: 34354 - protein, 202 aa, Homo sapiens
  ENSP00000377536
MATLIYVDKENGEPGTRVVAKDGLKLGSGPSIKALDGRSQVSTPRFGKTFDAPPALPKATRKALGTVNRATEKSVKTKGPLKQKQPSFSAKKMTEKTVKAKSSVPASDDAYPEIEKFFPFNPLDFESFDLPEEHQIAHLPLSGVPLMILDEERELEKLFQLGPPSPVKMPSPPWESNLLQSPSSILSTLDVELPPVCCDIDI

SEQ ID NO: 34355 - protein, 202 aa, Homo sapiens; identical to SEQ ID NO: 34354
  ENSP00000430642

SEQ ID NO: 34356 - protein, 121 aa, Homo sapiens
  ENSP00000431068
MPLPKVGGGFGGERSSLYTQYLSCTGILLLEYSYGKTFSSAIKALDGRSQVSTPRFGKTFDAPPALPKATRKALGTVNRATEKSVKTKGPLKQKQPSFSAKKMTEKTVKAKSSVPASDDAY

SEQ ID NO: 34357 - protein, 202 aa, Homo sapiens; identical to SEQ ID NO: 34354
  ENSP00000344936

SEQ ID NO: 34358 - protein, 228 aa, Homo sapiens
  ENSP00000370467
MAAPPQPVTHLIFDMDGLLLDTERLYSVVFQEICNRYDKKYSWDVKSLVMGKKALEAAQIIIDVLQLPMSKEELVEESQTKLKEVFPTAALMPGAEKLIIHLRKHGIPFALATSSGSASFDMKTSRHKEFFSLFSHIVLGDDPEVQHGKPDPDIFLACAKRFSPPPAMEKCLVFEDAPNGVEAALAAGMQVVMVPDGNLSRDLTTKATLVLNSLQDFQPELFGLPSYE

SEQ ID NO: 34359 - protein, 185 aa, Homo sapiens
  ENSP00000406260
MAAPPQPVTHLIFDMDGLLLDTERLYSVVFQEICNRYDKKYSWDVKSLVMGAEKLIIHLRKHGIPFALATSSGSASFDMKTSRHKEFFSLFSHIVLGDDPEVQHGKPDPDIFLACAKRFSPPPAMEKCLVFEDAPNGVEAALAAGMQVVMVPDGNLSRDLTTKATLVLNSLQDFQPELFGLPSYE

SEQ ID NO: 34360 - protein, 251 aa, Homo sapiens
  ENSP00000396452
MAAPPQPVTHLIFDMDGLLLGYTGSIVAAASGESSRGLQSRWTDTERLYSVVFQEICNRYDKKYSWDVKSLVMGKKALEAAQIIIDVLQLPMSKEELVEESQTKLKEVFPTAALMPGAEKLIIHLRKHGIPFALATSSGSASFDMKTSRHKEFFSLFSHIVLGDDPEVQHGKPDPDIFLACAKRFSPPPAMEKCLVFEDAPNGVEAALAAGMQVVMVPDGNLSRDLTTKATLVLNSLQDFQPELFGLPSYE

SEQ ID NO: 34361 - protein, 191 aa, Homo sapiens
  ENSP00000430995
MAAPPQPVTHLIFDMDGLLLDTERLYSVVFQEICNRYDKKYSWDVKSLVMGKKALEAAQIIIDVLQLPMSKEELVEESQTKLKEVFPTAALMPGAEKLIIHLRKHGIPFALATSSGSASFDMKTSRHKEFFSLFSHIVLGDDPEVQHGKPDPDIFLACAKRFSPPPAMEKSSIHRPRLLTAQKCQGCRDPF

SEQ ID NO: 34362 - protein, 208 aa, Homo sapiens
  ENSP00000441208
MAAPPQPVTHLIFDMDGLLLDTERLYSVVFQEICNRYDKKYSWDVKSLVMGKKALEAAQIIIDVLQLPMSKEELVEESQTKLKEVFPTAALMPGAEKLIIHLRKHGIPFALATSSGSASFDMKTSRHKEFFSLFSHIVLGDDPEVQHGKPDPDIFLACAKRFSPPPAMEKSSIHRPRLLTAQKCQGCRDPFSALLLLCNQLLLCSDDT

SEQ ID NO: 34363 - protein, 312 aa, Homo sapiens
  ENSP00000379051
MADGDSGSERGGGGGPCGFQPASRGGGEQETQELASKRLDIQNKRFYLDVKQNAKGRFLKIAEVGAGGSKSRLTLSMAVAAEFRDSLGDFIEHYAQLGPSSPEQLAAGAEEGGGPRRALKSEFLVRENRKYYLDLKENQRGRFLRIRQTVNRGGGGFGAGPGPGGLQSGQTIALPAQGLIEFRDALAKLIDDYGGEDDELAGGPGGGAGGPGGGLYGELPEGTSITVDSKRFFFDVGCNKYGVFLRVSEVKPSYRNAITVPFKAWGKFGGAFCRYADEMKEIQERQRDKLYERRGGGSGGGEESEGEEVDED

SEQ ID NO: 34364 - protein, 78 aa, Homo sapiens
  ENSP00000485850
MVGLKKKSADDVKKVFHMLDKDKSGFIEEDELGFILKGFSPDARDLSAKETKMLMAAGDKDGDGKIGVDEFSTLVAES

SEQ ID NO: 34365 - protein, 101 aa, Homo sapiens
  ENSP00000487336
MSMTDLLNAEDIKKAVGAFSATDSFDHKKFFQMVGLKKKSADDVKKVFHMLDKDKSGFIEEDELGFILKGFSPDARDLSAKETKMLMAAGDKDGDGKIGVD

SEQ ID NO: 34366 - protein, 110 aa, Homo sapiens
  ENSP00000486144
MSMTDLLNAEDIKKAVGAFSATDSFDHKKFFQMVGLKKKSADDVKKVFHMLDKDKSGFIEEDELGFILKGFSPDARDLSAKETKMLMAAGDKDGDGKIGVDEFSTLVAES

SEQ ID NO: 34367 - protein, 110 aa, Homo sapiens; identical to SEQ ID NO: 34366
  ENSP00000480913

SEQ ID NO: 34368 - protein, 106 aa, Homo sapiens
  ENSP00000487426
  MOD_RES (1)..(1): Any amino acid
XMTDLLNAEDIKKAVGAFSATDSFDHKKFFQMVGLKKKSADDVKKVFHMLDKDKSGFIEEDELGFILKGFSPDARDLSAKETKMLMAAGDKDGDGKIGVDDPADVD

SEQ ID NO: 34369 - protein, 110 aa, Homo sapiens; identical to SEQ ID NO: 34366
  ENSP00000400247

SEQ ID NO: 34370 - protein, 110 aa, Homo sapiens; identical to SEQ ID NO: 34366
  ENSP00000216200

SEQ ID NO: 34371 - protein, 106 aa, Homo sapiens; identical to SEQ ID NO: 34368
  ENSP00000384735
  MOD_RES (1)..(1): Any amino acid

SEQ ID NO: 34372 - protein, 78 aa, Homo sapiens; identical to SEQ ID NO: 34364
  ENSP00000386089

SEQ ID NO: 34373 - protein, 101 aa, Homo sapiens; identical to SEQ ID NO: 34365
  ENSP00000406977

SEQ ID NO: 34374 - protein, 179 aa, Homo sapiens
  ENSP00000369630
  MOD_RES (1)..(1): Any amino acid
XQSRRIEPVMGRLLLCASHGEIEKHPSLHASSYGLVAIKEAHDIETRLNEVEKLLKTIISMPCKYSRSEVVLTFFERSPLDQVLKNDNVHKIQPSFQSPVKISEIMRSNGFCLANTETIVIDHSIPNGRDQQLGVDPTEHLFENGSEFPSELEDGDDPAAYVTNLSYYHLVPFETDIWD

SEQ ID NO: 34375 - protein, 231 aa, Homo sapiens
  ENSP00000369636
MASAVFEGTSLVNMFVRGCWVNGIRRLIVSRRGDEEEFFEIRTEWSDRSVLYLHRSLADLGRLWQRLRDAFPEDRSELAQGPLRQGLVAIKEAHDIETRLNEVEKLLKTIISMPCKYSRSEVVLTFFERSPLDQVLKNDNVHKIQPSFQSPVKISEIMRSNGFCLANTETIVIDHSIPNGRDQQLGVDPTEHLFENGSEFPSELEDGDDPAAYVTNLSYYHLVPFETDIWD

SEQ ID NO: 34376 - protein, 1479 aa, Homo sapiens
  ENSP00000252804
MAKRSRGPGRRCLLALVLFCAWGTLAVVAQKPGAGCPSRCLCFRTTVRCMHLLLEAVPAVAPQTSILDLRFNRIREIQPGAFRRLRNLNTLLLNNNQIKRIPSGAFEDLENLKYLYLYKNEIQSIDRQAFKGLASLEQLYLHFNQIETLDPDSFQHLPKLERLFLHNNRITHLVPGTFNHLESMKRLRLDSNTLHCDCEILWLADLLKTYAESGNAQAAAICEYPRRIQGRSVATITPEELNCERPRITSEPQDADVTSGNTVYFTCRAEGNPKPEIIWLRNNNELSMKTDSRLNLLDDGTLMIQNTQETDQGIYQCMAKNVAGEVKTQEVTLRYFGSPARPTFVIQPQNTEVLVGESVTLECSATGHPPPRISWTRGDRTPLPVDPRVNITPSGGLYIQNVVQGDSGEYACSATNNIDSVHATAFIIVQALPQFTVTPQDRVVIEGQTVDFQCEAKGNPPPVIAWTKGGSQLSVDRRHLVLSSGTLRISGVALHDQGQYECQAVNIIGSQKVVAHLTVQPRVTPVFASIPSDTTVEVGANVQLPCSSQGEPEPAITWNKDGVQVTESGKFHISPEGFLTINDVGPADAGRYECVARNTIGSASVSMVLSVNVPDVSRNGDPFVATSIVEAIATVDRAINSTRTHLFDSRPRSPNDLLALFRYPRDPYTVEQARAGEIFERTLQLIQEHVQHGLMVDLNGTSYHYNDLVSPQYLNLIANLSGCTAHRRVNNCSDMCFHQKYRTHDGTCNNLQHPMWGASLTAFERLLKSVYENGFNTPRGINPHRLYNGHALPMPRLVSTTLIGTETVTPDEQFTHMLMQWGQFLDHDLDSTVVALSQARFSDGQHCSNVCSNDPPCFSVMIPPNDSRARSGARCMFFVRSSPVCGSGMTSLLMNSVYPREQINQLTSYIDASNVYGSTEHEARSIRDLASHRGLLRQGIVQRSGKPLLPFATGPPTECMRDENESPIPCFLAGDHRANEQLGLTSMHTLWFREHNRIATELLKLNPHWDGDTIYYETRKIVGAEIQHITYQHWLPKILGEVGMRTLGEYHGYDPGINAGIFNAFATAAFRFGHTLVNPLLYRLDENFQPIAQDHLPLHKAFFSPFRIVNEGGIDPLLRGLFGVAGKMRVPSQLLNTELTERLFSMAHTVALDLAAINIQRGRDHGIPPYHDYRVYCNLSAAHTFEDLKNEIKNPEIREKLKRLYGSTLNIDLFPALVVEDLVPGSRLGPTLMCLLSTQFKRLRDGDRLWYENPGVFSPAQLTQIKQTSLARILCDNADNITRVQSDVFRVAEFPHGYGSCDEIPRVDLRVWQDCCEDCRTRGQFNAFSYHFRGRRSLEFSYQEDKPTKKTRPRKIPSVGRQGEHLSNSTSAFSTRSDASGTNDFREFVLEMQKTITDLRTQIKKLESRLSTTECVDAGGESHANNTKWKKDACTICECKDGQVTCFVEACPPATCAVPVNIPGACCPVCLQKRAEEKP

SEQ ID NO: 34377 - protein, 76 aa, Homo sapiens
  ENSP00000414098
  MOD_RES (1)..(1): Any amino acid
XVQSDVFRVAEFPHGYGSCDEIPRVDLRVWQDCCEDCRTRGQFNAFSYHFRGRRSLEFSYQEDKPTKKTRPRKIPR

SEQ ID NO: 34378 - protein, 723 aa, Homo sapiens
  ENSP00000402738
  MOD_RES (1)..(1): Any amino acid
XRGPGRRCLLALVLFCAWGTLAVVAQKPGAGCPSRCLCFRTTVRCMHLLLEAVPAVAPQTSILDLRFNRIREIQPGAFRRLRNLNTLLLNNNQIKRIPSGAFEDLENLKYLYLYKNEIQSIDRQAFKGLASLEQLYLHFNQIETLDPDSFQHLPKLERLFLHNNRITHLVPGTFNHLESMKRLRLDSNTLHCDCEILWLADLLKTYAESGNAQAAAICEYPRRIQGRSVATITPEELNCERPRITSEPQDADVTSGNTVYFTCRAEGNPKPEIIWLRNNNELSMKTDSRLNLLDDGTLMIQNTQETDQGIYQCMAKNVAGEVKTQEVTLRYFGSPARPTFVIQPQNTEVLVGESVTLECSATGHPPPRISWTRGDRTPLPVDPRVNITPSGGLYIQNVVQGDSGEYACSATNNIDSVHATAFIIVQALPQFTVTPQDRVVIEGQTVDFQCEAKGNPPPVIAWTKGGSQLSVDRRHLVLSSGTLRISGVALHDQGQYECQAVNIIGSQKVVAHLTVQPRVTPVFASIPSDTTVEVGANVQLPCSSQGEPEPAITWNKDGVQVTESGKFHISPEGFLTINDVGPADAGRYECVARNTIGSASVSMVLSVNVPDVSRNGDPFVATSIVEAIATVDRAINSTRTHLFDSRPRSPNDLLALFRYPRDPYTVEQARAGEIFERTLQLIQEHVQHGLMVDLNGTSQCQSLFFLLHGLSNGVEHASVKSHS

SEQ ID NO: 34379 - protein, 196 aa, Homo sapiens
  ENSP00000408701
  MOD_RES (1)..(1): Any amino acid
XGSWFPSAPGLSTTVLLNNNQIKRIPSGAFEDLENLKYLYLYKNEIQSIDRQAFKGLASLEQLYLHFNQIETLDPDSFQHLPKLERLFLHNNRITHLVPGTFNHLESMKRLRLDSNTLHCDCEILWLADLLKTYAESGNAQAAAICEYPRRIQGRSVATITPEELNCERPRITSEPQDADVTSGNTVYFTCRAEGN

SEQ ID NO: 34380 - protein, 224 aa, Homo sapiens
  ENSP00000398363
MAKRSRGPGRRCLLALVLFCAWGTLAVVAQKPGAGCPSRCLCFRTTVRCMHLLLEAVPAVAPQTSILDLRFNRIREIQPGAFRRLRNLNTLLLNNNQIKRIPSGAFEDLENLKYLYLHFNQIETLDPDSFQHLPKLERLFLHNNRITHLVPGTFNHLESMKRLRLDSNTLHCDCEILWLADLLKTYAESGNAQAAAICEYPRRIQGRSVATITPEELNCERPRI

SEQ ID NO: 34381 - protein, 582 aa, Homo sapiens
  ENSP00000429855
NNLQQPTWGAALTAFARLLQPAYRDGIRAPRGLGLPVGSRQPLPPPRLVATVWARAAAVTPDHSYTRMLMHWGWFLEHDLDHTVPALSTARFSDGRPCSSVCTNDPPCFPMNTRHADPRGTHAPCMLFARSSPACASGRPSATVDSVYAREQINQQTAYIDGSNVYGSSERESQALRDPSVPRGLLKTGFPWPPSGKPLLPFSTGPPTECARQEQESPCFLAGDHRANEHLALAAMHTLWFREHNRMATELSALNPHWEGNTVYQEARKIVGAELQHITYSHWLPKVLGDPGTRMLRGYRGYNPNVNAGIINSFATAAFRFGHTLINPILYRLNATLGEISEGHLPFHKALFSPSRIIKEGGIDPVLRGLFGVAAKWRAPSYLLSPELTQRLFSAAYSAAVDSAATIIQRGRDHGIPPYVDFRVFCNLTSVKNFEDLQNEIKDSEIRQKLRKLYGSPGDIDLWPALMVEDLIPGTRVGPTLMCLFVTQFQRLRDGDRFWYENPGVFTPAQLTQLKQASLSRVLCDNGDSIQQVQADVFVKAEYPQDYLNCSEIPKVDLRVWQDCCADKQAGGTPEAGRVYRC

SEQ ID NO: 34382 - protein, 537 aa, Homo sapiens
  ENSP00000428114
  MOD_RES (1)..(1): Any amino acid
XAREQINQQTAYIDGSNVYGSSERESQALRDPSVPRGLLKTGFPWPPSGKPLLPFSTGPPTECARQEQESPCFLAGDHRANEHLALAAMHTLWFREHNRMATELSALNPHWEGNTVYQEARKIVGAELQHITYSHWLPKVLGDPGTRMLRGYRGYNPNVNAGIINSFATAAFRFGHTLINPILYRLNATLGEISEGHLPFHKALFSPSRIIKEGGIDPVLRGLFGVAAKWRAPSYLLSPELTQRLFSAAYSAAVDSAATIIQRGRDHGIPPYVDFRVFCNLTSVKNFEDLQNEIKDSEIRQKLRKFWYENPGVFTPAQLTQLKQASLSRVLCDNGDSIQQVQADVFVKAEYPQDYLNCSEIPKVDLRVWQDCCADCRSRGQFRAVTQESQKKRSAQYSYPVDKDMELSHLRSRQQDKIYVGEDARNVTVLAKTKFSQDFSTFAAEIQETITALREQINKLEARLRQAGCTDVRGVPRKAEERWMKEDCTHCICESGQVTCVVEICPPAPCPSPELVKGTCCPVCRDRGMPSDSPEKR

SEQ ID NO: 34383 - protein, 1463 aa, Homo sapiens
  ENSP00000348645
MEPRLFCWTTLFLLAGWCLPGLPCPSRCLCFKSTVRCMHLMLDHIPQVPQQTTVLDLRFNRIREIPGSAFKKLKNLNTLLLNNNHIRKISRNAFEGLENLLYLYLYKNEIHALDKQTFKGLISLEHLYIHFNQLEMLQPETFGDLLRLERLFLHNNKLSKIPAGSFSNLDSLKRLRLDSNALVCDCDLMWLGELLQGFAQHGHTQAAATCEYPRRLHGRAVASVTVEEFNCQSPRITFEPQDVEVPSGNTVYFTCRAEGNPKPEIIWIHNNHSLDLEDDTRLNVFDDGTLMIRNTRESDQGVYQCMARNSAGEAKTQSAMLRYSSLPAKPSFVIQPQDTEVLIGTSTTLECMATGHPHPLITWTRDNGLELDGSRHVATSSGLYLQNITQRDHGRFTCHANNSHGTVQAAANIIVQAPPQFTVTPKDQVVLEEHAVEWLCEADGNPPPVIVWTKTGGQLPVEGQHTVLSSGTLRIDRAAQHDQGQYECQAVSSLGVKKVSVQLTVKPKALAVFTQLPQDTSVEVGKNINISCHAQGEPQPIITWNKEGVQITESGKFHVDDEGTLTIYDAGFPDQGRYECVARNSFGLAVTNMFLTVTAIQGRQAGDDFVESSILDAVQRVDSAINSTRRHLFSQKPHTSSDLLAQFHYPRDPLIVEMARAGEIFEHTLQLIRERVKQGLTVDLEGKEFRYNDLVSPRSLSLIANLSGCTARRPLPNCSNRCFHAKYRAHDGTCNNLQQPTWGAALTAFARLLQPAYRDGIRAPRGLGLPVGSRQPLPPPRLVATVWARAAAVTPDHSYTRMLMHWGWFLEHDLDHTVPALSTARFSDGRPCSSVCTNDPPCFPMNTRHADPRGTHAPCMLFARSSPACASGRPSATVDSVYAREQINQQTAYIDGSNVYGSSERESQALRDPSVPRGLLKTGFPWPPSGKPLLPFSTGPPTECARQEQESPCFLAGDHRANEHLALAAMHTLWFREHNRMATELSALNPHWEGNTVYQEARKIVGAELQHITYSHWLPKVLGDPGTRMLRGYRGYNPNVNAGIINSFATAAFRFGHTLINPILYRLNATLGEISEGHLPFHKALFSPSRIIKEGGIDPVLRGLFGVAAKWRAPSYLLSPELTQRLFSAAYSAAVDSAATIIQRGRDHGIPPYVDFRVFCNLTSVKNFEDLQNEIKDSEIRQKLRKLYGSPGDIDLWPALMVEDLIPGTRVGPTLMCLFVTQFQRLRDGDRFWYENPGVFTPAQLTQLKQASLSRVLCDNGDSIQQVQADVFVKAEYPQDYLNCSEIPKVDLRVWQDCCADCRSRGQFRAVTQESQKKRSAQYSYPVDKDMELSHLRSRQQDKIYVGEDARNVTVLAKTKFSQDFSTFAAEIQETITALREQINKLEARLRQAGCTDVRGVPRKAEERWMKEDCTHCICESGQVTCVVEICPPAPCPSPELVKGTCCPVCRDRGMPSDSPEKR

SEQ ID NO: 34384 - protein, 578 aa, Homo sapiens
  ENSP00000348472
MAFMEKPPAGKVLLDDTVPLTAAIEASQSLQSHTEYIIRVQRGISVENSWQIVRRYSDFDLLNNSLQIAGLSLPLPPKKLIGNMDREFIAERQKGLQNYLNVITTNHILSNCELVKKFLDPNNYSANYTEIALQQVSMFFRSEPKWEVVEPLKDIGWRIRKKYFLMKIKNQPKERLVLSWADLGPDKYLSDKDFQCLIKLLPSCLHPYIYRVTFATANESSALLIRMFNEKGTLKDLIYKAKPKDPFLKKYCNPKKIQGLELQQIKTYGRQILEVLKFLHDKGFPYGHLHASNVMLDGDTCRLLDLENSLLGLPSFYRSYFSQFRKINTLESVDVHCFGHLLYEMTYGRPPDSVPVDSFPPAPSMAVVAVLESTLSCEACKNGMPTISRLLQMPLFSDVLLTTSEKPQFKIPTKLKEALRIAKECIEKRLIEEQKQIHQHRRLTRAQSHHGSEEERKKRKILARKKSKRSALENSEEHSAKYSNSNNSAGSGASSPLTSPSSPTPPSTSGISALPPPPPPPPPPAAPLPPASTEAPAQLSSQAVNGMSRGALLSSIQNFQKGTLRKAKTCDHSAPKIG

SEQ ID NO: 34385 - protein, 56 aa, Homo sapiens
  ENSP00000417167
MAFMEKPPAGKVLLDDTVPLTAAIEASQSLQSHTRLPCNRFPCSSDQNQSGRWWNL

SEQ ID NO: 34386 - protein, 482 aa, Homo sapiens
  ENSP00000417903
MAFMEKPPAGKVLLDDTVPLTAAIEASQSLQSHTIAGLSLPLPPKKLIGNMDREFIAERQKGLQNYLNVITTNHILSNCELVKKFLDPNNYSANYTEIALQQVSMFFRSEPKWEVVEPLKDIGWRIRKKYFLMKIKNQPKERLVLSWADLGPDKYLSDKDFQCLIKLLPSCLHPYIYRVTFATANESSALLIRMFNEKGTLKDLIYKAKPKDPFLKKYCNPKKIQGLELQQIKTYGRQILEVLKFLHDKGFPYGHLHASNVMLDGDTCRLLDLENSLLGLPSFYRSYFSQFRKINTLESVDVHCFGHLLYEMTYGRPPDSVPVDSFPPAPSMAVVAVLESTLSCEACKNGMPTISRLLQMPLFSDVLLTTSEKPQFKIPTKLKEALRIAKECIEKRLIEEQKQIHQHRRLTRAQSHHGSEEERKKRKILARKKSKRSALENSEEHSAKYSNSNNSAGSGASSPLTSPSSPTPPSTSVEHAPF

SEQ ID NO: 34387 - protein, 498 aa, Homo sapiens
  ENSP00000373221
MAFMEKPPAGKVLLDDTVPLTAAIEASQSLQSHTIVRRYSDFDLLNNSLQIAGLSLPLPPKKLIGNMDREFIAERQKGLQNYLNVITTNHILSNCELVKKFLDPNNYSANYTEIALQQVSMFFRSEPKWEVVEPLKDIGWRIRKKYFLMKIKNQPKERLVLSWADLGPDKYLSDKDFQCLIKLLPSCLHPYIYRVTFATANESSALLIRMFNEKGTLKDLIYKAKPKDPFLKKYCNPKKIQGLELQQIKTYGRQILEVLKFLHDKGFPYGHLHASNVMLDGDTCRLLDLENSLLGLPSFYRSYFSQFRKINTLESVDVHCFGHLLYEMTYGRPPDSVPVDSFPPAPSMAVVAVLESTLSCEACKNGMPTISRLLQMPLFSDVLLTTSEKPQFKIPTKLKEALRIAKECIEKRLIEEQKQIHQHRRLTRAQSHHGSEEERKKRKILARKKSKRSALENSEEHSAKYSNSNNSAGSGASSPLTSPSSPTPPSTSVEHAPF

SEQ ID NO: 34388 - protein, 515 aa, Homo sapiens
  ENSP00000417915
MAFMEKPPAGKVLLDDTVPLTAAIEASQSLQSHTEYIIRVQRGISVENSWQIVRRYSDFDLLNNSLQIAGLSLPLPPKKLIGNMDREFIAERQKGLQNYLNVITTNHILSNCELVKKFLDPNNYSANYTEIALQQVSMFFRSEPKWEVVEPLKDIGWRIRKKYFLMKIKNQPKERLVLSWADLGPDKYLSDKDFQCLIKLLPSCLHPYIYRVTFATANESSALLIRMFNEKGTLKDLIYKAKPKDPFLKKYCNPKKIQGLELQQIKTYGRQILEVLKFLHDKGFPYGHLHASNVMLDGDTCRLLDLENSLLGLPSFYRSYFSQFRKINTLESVDVHCFGHLLYEMTYGRPPDSVPVDSFPPAPSMAVVAVLESTLSCEACKNGMPTISRLLQMPLFSDVLLTTSEKPQFKIPTKLKEALRIAKECIEKRLIEEQKQIHQHRRLTRAQSHHGSEEERKKRKILARKKSKRSALENSEEHSAKYSNSNNSAGSGASSPLTSPSSPTPPSTSVEHAPF

SEQ ID NO: 34389 - protein, 563 aa, Homo sapiens
  ENSP00000419049
MAFMEKPPAGKVLLDDTVPLTAAIEASQSLQSHTIVRRYSDFDLLNNSLQIAGLSLPLPPKKLIGNMDREFIAERQKGLQNYLNVITTNHILSNCELVKKFLDPNNYSANYTEIALQQVSMFFRSEPKWEVVEPLKDIGWRIRKKYFLMKIKNQPKERLVLSWADLGPDKYLSDKDFQCLIKLLPSCLHPYIYRVTFATANESSALLIRMFNEKGTLKDLIYKAKPKDPFLKKYCNPKKIQGLELQQIKTYGRQILEVLKFLHDKGFPYGHLHASNVMLDGDTCRLLDLENSLLGLPSFYRSYFSQFRKINTLESVDVHCFGHLLYEMTYGRPPDSVPVDSFPPAPSMAVVAVLESTLSCEACKNGMPTISRLLQMPLFSDVLLTTSEKPQFKIPTKLKEALRIAKECIEKRLIEEQKQIHQHRRLTRAQSHHGSEEERKKRKILARKKSKRSALENSEEHSAKYSNSNNSGSGASSPLTSPSSPTPPSTSAALGLSKRCKERDICITSTSSTSTTTSSSLASCEHRGTCPALVSGCEWHEPRGLAQLHPEFPKRNFEESQNL

SEQ ID NO: 34390 - protein, 141 aa, Homo sapiens
  ENSP00000420403
MAFMEKPPAGKVLLDDTVPLTAAIEASQSLQSHTEYIIRVQRGISVENSWQIVRRYSDFDLLNNSLQIAGLSLPLPPKKLIGNMDREFIAERQKGLQNYLNVITTNHILSNCELVKKFLDPNNYSANYTAPLHLSGYLCHS

SEQ ID NO: 34391 - protein, 113 aa, Homo sapiens
  ENSP00000418831
MKCDSRAYLLGQQSVSGWGLQPRFQEYIIRVQRGISVENSWQIVRRYSDFDLLNNSLQIAGLSLPLPPKKLIGNMDREFIAERQKGLQNYLNVITTNHILSNCELVKKFLDPN

SEQ ID NO: 34392 - protein, 312 aa, Homo sapiens
  ENSP00000418202
  MOD_RES (1)..(1): Any amino acid
XFLKKYCNPKKIQGLELQQIKTYGRQILEVLKFLHDKGFPYGHLHASNVMLDGDTCRLLDLENSLLGLPSFYRSYFSQFRKINTLESVDVHCFGHLLYEMTYGRPPDSVPVDSFPPAPSMAVVAVLESTLSCEACKNGMPTISRLLQMPLFSDVLLTTSEKPQFKIPTKLKEALRIAKECIEKRLIEEQKQIHQHRRLTRAQSHHGSEEERKKRKILARKKSKRSALENSEEHSAKYSNSNNSGISALPPPPPPPPPPAAPLPPASTEAPAQLSSQAVNGMSRGALLSSIQNFQKGTLRKAKTCDHSAPKIG

SEQ ID NO: 34393 - protein, 203 aa, Homo sapiens
  ENSP00000476179
NSLLGLPSFYRSYFSQFRKINTLESVDVHCFGHLLYEMTYGRPPDSVPVDSFPPAPSMAVVAVLESTLSCEACKNGMPTISRLLQMPLFSDVLLTTSEKPQFKIPTKLKEALRIAKECIEKRLIEEQKQIHQHRRLTRAQSHHGSEEERKKRKILARKKSKRSALENSEEHSAKYSNSNNSAGSGASSPLTSPSSPTPPSTSG

SEQ ID NO: 34394 - protein, 85 aa, Homo sapiens
  ENSP00000418376
  MOD_RES (1)..(1): Any amino acid
XLIEEQKQIHQHRRLTRAQSHHGSEEERKKRKILARKKSKRSALENSEEHSAKYSNSNNSGSGASSPLTSPSSPTPPSTSEHAPF

SEQ ID NO: 34395 - protein, 50 aa, Homo sapiens
  ENSP00000418836
KKSKRSALENSEEHSAKYSNSNNSGSGASSPLTSPSSPTPPSTSVEHAPF

SEQ ID NO: 34396 - protein, 515 aa, Homo sapiens; identical to SEQ ID NO: 34388
  ENSP00000373222

SEQ ID NO: 34397 - protein, 557 aa, Homo sapiens
  ENSP00000305045
MAFMEKPPAGKVLLDDTVPLTAAIEASQSLQSHTEYIIRVQRGISVENSWQIVRRYSDFDLLNNSLQIAGLSLPLPPKKLIGNMDREFIAERQKGLQNYLNVITTNHILSNCELVKKFLDPNNYSANYTEIALQQVSMFFRSEPKWEVVEPLKDIGWRIRKKYFLMKIKNQPKERLVLSWADLGPDKYLSDKDFQCLIKLLPSCLHPYIYRVTFATANESSALLIRMFNEKGTLKDLIYKAKPKDPFLKKYCNPKKIQGLELQQIKTYGRQILEVLKFLHDKGFPYGHLHASNVMLDGDTCRLLDLENSLLGLPSFYRSYFSQFRKINTLESVDVHCFGHLLYEMTYGRPPDSVPVDSFPPAPSMAVVAVLESTLSCEACKNGMPTISRLLQMPLFSDVLLTTSEKPQFKIPTKLKEALRIAKECIEKRLIEEQKQIHQHRRLTRAQSHHGSEEERKKRKILARKKSKRSALENSEEHSAKYSNSNNSGISALPPPPPPPPPPAAPLPPASTEAPAQLSSQAVNGMSRGALLSSIQNFQKGTLRKAKTCDHSAPKIG

SEQ ID NO: 34398 - protein, 424 aa, Homo sapiens
  ENSP00000395536
MSTSLGSNLSELDRLLLELNAVQHNPPGFPADEANSSPPLPGALSPLYGVPETNSPLGGKAGPLTKEKPKRNGGRGLEDVRPSVESLLDELESSVPSPVPAITVNQGEMSSPQRVTSTQQQTRISASSATRELDELMASLSDFKFMAQGKTGSSSPPGGPPKPGSQLDSMLGSLQSDLNKLGVATVAKGVCGACKKPIAGQVVTAMGKTWHPEHFVCTHCQEEIGSRNFFERDGQPYCEKDYHNLFSPRCYYCNGPILDKVVTALDRTWHPEHFFCAQCGAFFGPEGFHEKDGKAYCRKDYFDMFAPKCGGCARAILENYISALNTLWHPECFVCRECFTPFVNGSFFEHDGQPYCEVHYHERRGSLCSGCQKPITGRCITAMAKKFHPEHFVCAFCLKQLNKGTFKEQNDKPYCQNCFLKLFC

SEQ ID NO: 34399 - protein, 591 aa, Homo sapiens
  ENSP00000228307
MDDLDALLADLESTTSHISKRPVFLSEETPYSYPTGNHTYQEIAVPPPVPPPPSSEALNGTILDPLDQWQPSSSRFIHQQPQSSSPVYGSSAKTSSVSNPQDSVGSPCSRVGEEEHVYSFPNKQKSAEPSPTVMSTSLGSNLSELDRLLLELNAVQHNPPGFPADEANSSPPLPGALSPLYGVPETNSPLGGKAGPLTKEKPKRNGGRGLEDVRPSVESLLDELESSVPSPVPAITVNQGEMSSPQRVTSTQQQTRISASSATRELDELMASLSDFKIQGLEQRADGERCWAAGWPRDGGRSSPGGQDEGGFMAQGKTGSSSPPGGPPKPGSQLDSMLGSLQSDLNKLGVATVAKGVCGACKKPIAGQVVTAMGKTWHPEHFVCTHCQEEIGSRNFFERDGQPYCEKDYHNLFSPRCYYCNGPILDKVVTALDRTWHPEHFFCAQCGAFFGPEGFHEKDGKAYCRKDYFDMFAPKCGGCARAILENYISALNTLWHPECFVCRECFTPFVNGSFFEHDGQPYCEVHYHERRGSLCSGCQKPITGRCITAMAKKFHPEHFVCAFCLKQLNKGTFKEQNDKPYCQNCFLKLFC

SEQ ID NO: 34400 - protein, 557 aa, Homo sapiens
  ENSP00000391283
MDDLDALLADLESTTSHISKRPVFLSEETPYSYPTGNHTYQEIAVPPPVPPPPSSEALNGTILDPLDQWQPSSSRFIHQQPQSSSPVYGSSAKTSSVSNPQDSVGSPCSRVGEEEHVYSFPNKQKSAEPSPTVMSTSLGSNLSELDRLLLELNAVQHNPPGFPADEANSSPPLPGALSPLYGVPETNSPLGGKAGPLTKEKPKRNGGRGLEDVRPSVESLLDELESSVPSPVPAITVNQGEMSSPQRVTSTQQQTRISASSATRELDELMASLSDFKFMAQGKTGSSSPPGGPPKPGSQLDSMLGSLQSDLNKLGVATVAKGVCGACKKPIAGQVVTAMGKTWHPEHFVCTHCQEEIGSRNFFERDGQPYCEKDYHNLFSPRCYYCNGPILDKVVTALDRTWHPEHFFCAQCGAFFGPEGFHEKDGKAYCRKDYFDMFAPKCGGCARAILENYISALNTLWHPECFVCRECFTPFVNGSFFEHDGQPYCEVHYHERRGSLCSGCQKPITGRCITAMAKKFHPEHFVCAFCLKQLNKGTFKEQNDKPYCQNCFLKLFC

SEQ ID NO: 34401 - protein, 192 aa, Homo sapiens
  ENSP00000490896
  MOD_RES (1)..(1): Any amino acid
XMTERGSVARPTQGPETPRSPEGTTEAATQDGKEQPELPCAMAMGTPSTTERISTSGQIRSVIRRSWESGHAHPMSREPSPRRRLDPATLSRTPSQEQLIAELQGRLGIQPEAEEPAEAAGPSAQDWLTEGVIITVQPRGKRAGGQLVEKVARRCPWLGLGQSQAPGVRVLPWPQCWPEGRSGERVGVSCLL

SEQ ID NO: 34402 - protein, 589 aa, Homo sapiens
  ENSP00000443887
MADALLADLESTTSHISKRPVFLSEETPYSYPTGNHTYQEIAVPPPVPPPPSSEALNGTILDPLDQWQPSSSRFIHQQPQSSSPVYGSSAKTSSVSNPQDSVGSPCSRVGEEEHVYSFPNKQKSAEPSPTVMSTSLGSNLSELDRLLLELNAVQHNPPGFPADEANSSPPLPGALSPLYGVPETNSPLGGKAGPLTKEKPKRNGGRGLEDVRPSVESLLDELESSVPSPVPAITVNQGEMSSPQRVTSTQQQTRISASSATRELDELMASLSDFKIQGLEQRADGERCWAAGWPRDGGRSSPGGQDEGGFMAQGKTGSSSPPGGPPKPGSQLDSMLGSLQSDLNKLGVATVAKGVCGACKKPIAGQVVTAMGKTWHPEHFVCTHCQEEIGSRNFFERDGQPYCEKDYHNLFSPRCYYCNGPILDKVVTALDRTWHPEHFFCAQCGAFFGPEGFHEKDGKAYCRKDYFDMFAPKCGGCARAILENYISALNTLWHPECFVCRECFTPFVNGSFFEHDGQPYCEVHYHERRGSLCSGCQKPITGRCITAMAKKFHPEHFVCAFCLKQLNKGTFKEQNDKPYCQNCFLKLFC

SEQ ID NO: 34403 - protein, 706 aa, Homo sapiens
  ENSP00000489977
MDDLDALLADLESTTSHISKRPVFLSEETPYSYPTGNHTYQEIAVPPPVPPPPSSEALNGTILDPLDQWQPSSSRFIHQQPQSSSPVYGSSAKTSSVSNPQDSVGSPCSRVGEEEHVYSFPNKQKSAEPSPTVMSTSLGSNLSELDRLLLELNAVQHNPPGFPADEANSSPPLPGALSPLYGVPETNSPLGGKAGPLTKEKPKRNGGRGLEDVRPSVESLLDELESSVPSPVPAITVNQGEMSSPQRVTSTQQQTRISASSATRELDELMASLSDFKTSSSTVALSAPGLSSSAPSSYCSLPPSPPPMPSVFLPPTTIPSPRGQGHTPEFPCTEQSGRGLLPPVAPSWLDLAGLGVMPDTFNSRSPSVEGSLWAVGTESQGRDWRHLPTITSELSGAPRCHTVPCAGSTALQEPGEPQGPPASPSCPEEALAATWEQPWASEVFGPERMPPSGAARSFQEVTEPAVVAVDRQAIFPDTWTLTEEHGLQQERPRPEPGRLGSSSPASVTTEQLGAKMTERGSVARPTQGPETPRSPEGTTEAATQDGKEQPELPCAMAMGTPSTTERISTSGQIRSVIRRSWESGHAHPMSREPSPRRRLDPATLSRTPSQEQLIAELQGRLGIQPEAEEPAEAAGPSAQDWLTEGVIITVQPRGKRAGGQLVEKVARRCPWLGLGQSQAPGVRVLPWPQCWPEGRSGERVGVSCLL

SEQ ID NO: 34404 - protein, 1081 aa, Homo sapiens
  ENSP00000489840
MDDLDALLADLESTTSHISKRPVFLSEETPYSYPTGNHTYQEIAVPPPVPPPPSSEALNGTILDPLDQWQPSSSRFIHQQPQSSSPVYGSSAKTSSVSNPQDSVGSPCSRVGEEEHVYSFPNKQKSAEPSPTVMSTSLGSNLSELDRLLLELNAVQHNPPGFPADEANSSPPLPGALSPLYGVPETNSPLGGKAGPLTKEKPKRNGGRGLEDVRPSVESLLDELESSVPSPVPAITVNQGEMSSPQRVTSTQQQTRISASSATRELDELMASLSDFKTSSSTVALSAPGLSSSAPSSYCSLPPSPPPMPSVFLPPTTIPSPRGQGHTPEFPCTEQSGRGLLPPVAPSWLDLAGLGVMPDTFNSRSPSVEGSLWAVGTESQGRDWRHLPTITSELSGAPRCHTVPCAGSTALQEPGEPQGPPASPSCPEEALAATWEQPWASEVFGPERMPPSGAARSFQEVTEPAVVAVDRQAIFPDTWTLTEEHGLQQERPRPEPGRLGSSSPASVTTEQLGAKMTERGSVARPTQGPETPRSPEGTTEAATQDGKEQPELPCAMAMGTPSTTERISTSGQIRSVIRRSWESGHAHPMSREPSPRRRLDPATLSRTPSQEQLIAELQGRLGIQPEAEEPAEAAGPSAQDWLTEGVIITVQPRGKRAGGQLVEKVVFPPGSPIPLRRTISVLASPSVPLLQHRTDAAASSSSPLPSLLASSPLGPSAYTCGSSGVQSAGEEPHDEGVQGPALPIPAPHTMRSVGCQTDEDPLFPPMQIQGLEQRADGERCWAAGWPRDGGRSSPGGQDEGGFMAQGKTGSSSPPGGPPKPGSQLDSMLGSLQSDLNKLGVATVAKGVCGACKKPIAGQVVTAMGKTWHPEHFVCTHCQEEIGSRNFFERDGQPYCEKDYHNLFSPRCYYCNGPILDKVVTALDRTWHPEHFFCAQCGAFFGPEGFHEKDGKAYCRKDYFDMFAPKCGGCARAILENYISALNTLWHPECFVCRECFTPFVNGSFFEHDGQPYCEVHYHERRGSLCSGCQKPITGRCITAMAKKFHPEHFVCAFCLKQLNKGTFKEQNDKPYCQNCFLKLFC

SEQ ID NO: 34405 - protein, 207 aa, Homo sapiens
  ENSP00000490352
SLLDELESSVPSPVPAITVNQGEMSSPQRVTSTQQQTRISASSATRELDELMASLSDFKVVFPPGSPIPLRRTISVLASPSVPLLQHRTDAAASSSSPLPSLLASSPLGPSAYTCGSSGVQSAGEEPHDEGVQGPALPIPAPHTMRSVGCQTDEDPLFPPMQIQGLEQRADGERCWAAGWPRDGGRSSPGGQDEGGFMAQGKTGSSS

SEQ ID NO: 34406 - protein, 91 aa, Homo sapiens
  ENSP00000446893
MDDLDSEFQTGTSLAAARPCQEGTQCQVPDSQRRPAGGLGVYHLPHLQTACVLVGGDPLLIPNWKPHIPGDCRATPRPPTPVQRGPQWHNP

SEQ ID NO: 34407 - protein, 176 aa, Homo sapiens
  ENSP00000443745
MAGNKDALLADLESTTSHISKRPVFLSEETPYSYPTGNHTYQEIAVPPPVPPPPSSEALNGTILDPLDQWQPSSSRFIHQQPQSSSPVYGSSAKTSSVSNPQDSVGSPCSRVGEEEHVYSFPNKQKSAEPSPTVMSTSLGSNLSELDRLLLELNAVQHNPPGFPADEANSSPPLPG

SEQ ID NO: 34408 - protein, 37 aa, Homo sapiens
  ENSP00000447180
MSTSLGSNLSELDRLLLELNAVQHNPPGFPADEANSS

SEQ ID NO: 34409 - protein, 36 aa, Homo sapiens
  ENSP00000446607
MSTSLGSNLSELDRLLLELNAVQHNPPGFPADEANS

SEQ ID NO: 34410 - protein, 31 aa, Homo sapiens
  ENSP00000446650
MSTSLGSNLSELDRLLLELNAVQHNPPGFPA

SEQ ID NO: 34411 - protein, 605 aa, Homo sapiens
  ENSP00000267257
MDDLDALLADLESTTSHISKRPVFLSEETPYSYPTGNHTYQEIAVPPPVPPPPSSEALNGTILDPLDQWQPSSSRFIHQQPQSSSPVYGSSAKTSSVSNPQDSVGSPCSRVGEEEHVYSFPNKQKSAEPSPTVMSTSLGSNLSELDRLLLELNAVQHNPPGFPADEANSSPPLPGALSPLYGVPETNSPLGGKAGPLTKEKPKRNGGRGLEDVRPSVESLLDELESSVPSPVPAITVNQGEMSSPQRVTSTQQQTRISASSATRELDELMASLSDFKGSWPLEEVVLLVSISSSVQEGEKYPHPCAARHRTPSLRSPDQPPPCPQFMAQGKTGSSSPPGGPPKPGSQLDSMLGSLQSDLNKLGVATVAKGVCGACKKPIAGQVVTAMGKTWHPEHFVCTHCQEEIGSRNFFERDGQPYCEKDYHNLFSPRCYYCNGPILDKVVTALDRTWHPEHFFCAQCGAFFGPEGFHEKDGKAYCRKDYFDMFAPKCGGCARAILENYISALNTLWHPECFVCRECFTPFVNGSFFEHDGQPYCEVHYHERRGSLCSGCQKPITGRCITAMAKKFHPEHFVCAFCLKQLNKGTFKEQNDKPYCQNCFLKLFC

SEQ ID NO: 34412 - protein, 145 aa, Homo sapiens
  ENSP00000421271
MLFRNRFLLLLALAALLAFVSLSLQFFHLIPVSTPKNGMSSKSRKRIMPDPVTEPPVTDPVYEALLYCNIPSVAERSMEGHAPHHFKLVSVHVFIRHGDRYPLYVIPKTKRPEIDCTLVANRKPYHPKLEAFISHMSKGSGASFE

SEQ ID NO: 34413 - protein, 182 aa, Homo sapiens
  ENSP00000490861
MLFRNRFLLLLALAALLAFVSLSLQFFHLIPVSTPKNGMSSKSRKRIMPDPVTEPPVTDPVYEALLYCNIPSVAERSMEGHAPHHFKLVSVHVFIRHGDRYPLYVIPKTKRPEIDCTLVANRKPYHPKLEAFISHMSKGSGASFESPLNSLPLYPNHPLCEMGELTQTVRRWLSASQEERPH

SEQ ID NO: 34414 - protein, 26 aa, Homo sapiens
  ENSP00000425264
MLFRNRFLLLLALAALLAFVSLSLQF

SEQ ID NO: 34415 - protein, 480 aa, Homo sapiens
  ENSP00000286353
MLFRNRFLLLLALAALLAFVSLSLQFFHLIPVSTPKNGMSSKSRKRIMPDPVTEPPVTDPVYEALLYCNIPSVAERSMEGHAPHHFKLVSVHVFIRHGDRYPLYVIPKTKRPEIDCTLVANRKPYHPKLEAFISHMSKGSGASFESPLNSLPLYPNHPLCEMGELTQTGVVQHLQNGQLLRDIYLKKHKLLPNDWSADQLYLETTGKSRTLQSGLALLYGFLPDFDWKKIYFRHQPSALFCSGSCYCPVRNQYLEKEQRRQYLLRLKNSQLEKTYGEMAKIVDVPTKQLRAANPIDSMLCHFCHNVSFPCTRNGCVDMEHFKVIKTHQIEDERERREKKLYFGYSLLGAHPILNQTIGRMQRATEGRKEELFALYSAHDVTLSPVLSALGLSEARFPRFAARLIFELWQDREKPSEHSVRILYNGVDVTFHTSFCQDHHKRSPKPMCPLENLVRFVKRDMFVALGGSGTNYYDACHREGF

SEQ ID NO: 34416 - protein, 182 aa, Homo sapiens; identical to SEQ ID NO: 34413
  ENSP00000490743

SEQ ID NO: 34417 - protein, 442 aa, Homo sapiens
  ENSP00000422558
MSSKSRKRIMPDPVTEPPVTDPVYEALLYCNIPSVAERSMEGHAPHHFKLVSVHVFIRHGDRYPLYVIPKTKRPEIDCTLVANRKPYHPKLEAFISHMSKGSGASFESPLNSLPLYPNHPLCEMGELTQTGVVQHLQNGQLLRDIYLKKHKLLPNDWSADQLYLETTGKSRTLQSGLALLYGFLPDFDWKKIYFRHQPSALFCSGSCYCPVRNQYLEKEQRRQYLLRLKNSQLEKTYGEMAKIVDVPTKQLRAANPIDSMLCHFCHNVSFPCTRNGCVDMEHFKVIKTHQIEDERERREKKLYFGYSLLGAHPILNQTIGRMQRATEGRKEELFALYSAHDVTLSPVLSALGLSEARFPRFAARLIFELWQDREKPSEHSVRILYNGVDVTFHTSFCQDHHKRSPKPMCPLENLVRFVKRDMFVALGGSGTNYYDACHREGF

SEQ ID NO: 34418 - protein, 480 aa, Homo sapiens; identical to SEQ ID NO: 34415
  ENSP00000376733

SEQ ID NO: 34419 - protein, 95 aa, Homo sapiens
  ENSP00000426956
MLFRNRFLLLLALAALLAFVSLSLQFFHLIPVSTPKNGMSSKSRKRIMPDPVTEPPVTDPVYEALLYCNIPSVAERSMEGHAPHHFKLVSVHVFI

SEQ ID NO: 34420 - protein, 26 aa, Homo sapiens
  ENSP00000426348
MLFRNRFLLLLALAALLAFVSLSLQF

SEQ ID NO: 34421 - protein, 179 aa, Homo sapiens
  ENSP00000490114
MLFRNRFLLLLALAALLAFVSLSLQFFHLIPVSTPKNGMSSKSRKRIMPDPVTEPPVTDPVYEALLYCNIPSVAERSMEGHAPHHFKLVSVHVFIRHGDRYPLYVIPKTKRPEIDCTLVANRKPYHPKLEAFISHMSKGSGASFESPLNSLPLYPNHPLCEMGELTQTVGLAVHLRGSC

SEQ ID NO: 34422 - protein, 130 aa, Homo sapiens
  ENSP00000423702
MSSKSRKRIMPDPVTEPPVTDPVYEALLYCNIPSVAERSMEGHAPHHFKLVSVHVFIRHGDRYPLYVIPKTKRPEIDCTLVANRKPYHPKLEAFISHMSKGSGASFESPLNSLPLYPNHPLCEMGELTQT

SEQ ID NO: 34423 - protein, 463 aa, Homo sapiens
  ENSP00000426877
MDVLTALLLVHLIPVSTPKNGMSSKSRKRIMPDPVTEPPVTDPVYEALLYCNIPSVAERSMEGHAPHHFKLVSVHVFIRHGDRYPLYVIPKTKRPEIDCTLVANRKPYHPKLEAFISHMSKGSGASFESPLNSLPLYPNHPLCEMGELTQTGVVQHLQNGQLLRDIYLKKHKLLPNDWSADQLYLETTGKSRTLQSGLALLYGFLPDFDWKKIYFRHQPSALFCSGSCYCPVRNQYLEKEQRRQYLLRLKNSQLEKTYGEMAKIVDVPTKQLRAANPIDSMLCHFCHNVSFPCTRNGCVDMEHFKVIKTHQIEDERERREKKLYFGYSLLGAHPILNQTIGRMQRATEGRKEELFALYSAHDVTLSPVLSALGLSEARFPRFAARLIFELWQDREKPSEHSVRILYNGVDVTFHTSFCQDHHKRSPKPMCPLENLVRFVKRDMFVALGGSGTNYYDACHREGF

SEQ ID NO: 34424 - protein, 471 aa, Homo sapiens
  ENSP00000422901
MRYFIKSMEHSVCPSSAVHLIPVSTPKNGMSSKSRKRIMPDPVTEPPVTDPVYEALLYCNIPSVAERSMEGHAPHHFKLVSVHVFIRHGDRYPLYVIPKTKRPEIDCTLVANRKPYHPKLEAFISHMSKGSGASFESPLNSLPLYPNHPLCEMGELTQTGVVQHLQNGQLLRDIYLKKHKLLPNDWSADQLYLETTGKSRTLQSGLALLYGFLPDFDWKKIYFRHQPSALFCSGSCYCPVRNQYLEKEQRRQYLLRLKNSQLEKTYGEMAKIVDVPTKQLRAANPIDSMLCHFCHNVSFPCTRNGCVDMEHFKVIKTHQIEDERERREKKLYFGYSLLGAHPILNQTIGRMQRATEGRKEELFALYSAHDVTLSPVLSALGLSEARFPRFAARLIFELWQDREKPSEHSVRILYNGVDVTFHTSFCQDHHKRSPKPMCPLENLVRFVKRDMFVALGGSGTNYYDACHREGF

SEQ ID NO: 34425 - protein, 754 aa, Homo sapiens
  ENSP00000366650
MSRPLSDQEKRKQISVRGLAGVENVTELKKNFNRHLHFTLVKDRNVATPRDYYFALAHTVRDHLVGRWIRTQQHYYEKDPKKISGGWQMEEADDWLRYGNPWEKARPEFTLPVHFYGHVEHTSQGAKWVDTQVVLAMPYDTPVPGYRNNVVNTMRLWSAKAPNDFNLKDFNVGGYIQAVLDRNLAENISRVLYPNDNFFEGKELRLKQEYFVVAATLQDIIRRFKSSKFGCRDPVRTNFDAFPDKVAIQLNDTHPSLAIPELMRILVDLERMDWDKAWDVTVRTCAYTNHTVLPEALERWPVHLLETLLPRHLQIIYEINQRFLNRVAAAFPGDVDRLRRMSLVEEGAVKRINMAHLCIAGSHAVNGVARIHSEILKKTIFKDFYELEPHKFQNKTNGITPRRWLVLCNPGLAEVIAERIGEDFISDLDQLRKLLSFVDDEAFIRDVAKVKQENKLKFAAYLEREYKVHINPNSLFDIQVKRIHEYKRQLLNCLHVITLYNRIKREPNKFFVPRTVMIGGKAAPGYHMAKMIIRLVTAIGDVVNHDPAVGDRLRVIFLENYRVSLAEKVIPAADLSEQISTAGTEASGTGNMKFMLNGALTIGTMDGANVEMAEEAGEENFFIFGMRVEDVDKLDQRGYNAQEYYDRIPELRQVIEQLSSGFFSPKQPDLFKDIVNMLMHHDRFKVFADYEDYIKCQEKVSALYKNPREWTRMVIRNIATSGKFSSDRTIAQYAREIWGVEPSRQRLPAPDEAI

SEQ ID NO: 34426 - protein, 842 aa, Homo sapiens
  ENSP00000164139
MSRPLSDQEKRKQISVRGLAGVENVTELKKNFNRHLHFTLVKDRNVATPRDYYFALAHTVRDHLVGRWIRTQQHYYEKDPKRIYYLSLEFYMGRTLQNTMVNLALENACDEATYQLGLDMEELEEIEEDAGLGNGGLGRLAACFLDSMATLGLAAYGYGIRYEFGIFNQKISGGWQMEEADDWLRYGNPWEKARPEFTLPVHFYGHVEHTSQGAKWVDTQVVLAMPYDTPVPGYRNNVVNTMRLWSAKAPNDFNLKDFNVGGYIQAVLDRNLAENISRVLYPNDNFFEGKELRLKQEYFVVAATLQDIIRRFKSSKFGCRDPVRTNFDAFPDKVAIQLNDTHPSLAIPELMRILVDLERMDWDKAWDVTVRTCAYTNHTVLPEALERWPVHLLETLLPRHLQIIYEINQRFLNRVAAAFPGDVDRLRRMSLVEEGAVKRINMAHLCIAGSHAVNGVARIHSEILKKTIFKDFYELEPHKFQNKTNGITPRRWLVLCNPGLAEVIAERIGEDFISDLDQLRKLLSFVDDEAFIRDVAKVKQENKLKFAAYLEREYKVHINPNSLFDIQVKRIHEYKRQLLNCLHVITLYNRIKREPNKFFVPRTVMIGGKAAPGYHMAKMIIRLVTAIGDVVNHDPAVGDRLRVIFLENYRVSLAEKVIPAADLSEQISTAGTEASGTGNMKFMLNGALTIGTMDGANVEMAEEAGEENFFIFGMRVEDVDKLDQRGYNAQEYYDRIPELRQVIEQLSSGFFSPKQPDLFKDIVNMLMHHDRFKVFADYEDYIKCQEKVSALYKNPREWTRMVIRNIATSGKFSSDRTIAQYAREIWGVEPSRQRLPAPDEAI

SEQ ID NO: 34427 - protein, 581 aa, Homo sapiens
  ENSP00000359607
MAASGRGLCKAVAASPFPAWRRDNTEARGGLKPEYDAVVIGAGHNGLVAAAYLQRLGVNTAVFERRHVIGGAAVTEEIIPGFKFSRASYLLSLLRPQIYTDLELKKHGLRLHLRNPYSFTPMLEEGAGSKVPRCLLLGTDMAENQKQIAQFSQKDAQVFPKYEEFMHRLALAIDPLLDAAPVDMAAFQHGSLLQRMRSLSTLKPLLKAGRILGAQLPRYYEVLTAPITKVLDQWFESEPLKATLATDAVIGAMTSPHTPGSGYVLLHHVMGGLEGMQGAWGYVQGGMGALSDAIASSATTHGASIFTEKTVAKVQVNSEGCVQGVVLEDGTEVRSKMVLSNTSPQITFLKLTPQEWLPEEFLERISQLDTRSPVTKINVAVDRLPSFLAAPNAPRGQPLPHHQCSIHLNCEDTLLLHQAFEDAMDGLPSHRPVIELCIPSSLDPTLAPPGCHVVSLFTQYMPYTLAGGKAWDEQERDAYADRVFDCIEVYAPGFKDSVVGRDILTPPDLERIFGLPGGNIFHCAMSLDQLYFARPVPLHSGYRCPLQGLYLCGSGAHPGGGVMGAAGRNAAHVAFRDLKSM

SEQ ID NO: 34428 - protein, 36 aa, Homo sapiens
  ENSP00000426039
MAAAAAAGEARRVLVYGGRGALGSRCVQAFRARNWI

SEQ ID NO: 34429 - protein, 128 aa, Homo sapiens
  ENSP00000420873
  MOD_RES (1)..(1): Any amino acid
XCVQAFRARNWWVASVDVVENEEASASIIVKMTDSFTEQADQVTAEVGKLLGEEKVDAILCVAGGWAGGNAKSKSLFKNCDLMWKQSIWTSTISSHLATKHLKEGGLLTLAGAKAALDGTPGLPWIPR

SEQ ID NO: 34430 - protein, 162 aa, Homo sapiens
  ENSP00000426377
MAAAAAAGEARRVLVYGGRGALGSRCVQAFRARNWWVASVDVVENEEASASIIVKMTDSFTEQADQVTAEVGKLLGEEKVDAILCVAGGWAGGNAKSKSLFKNCDLMWKQSIWTSTISSHLATKHLKEGGLLTLAGAKAALDGTPELSMTGSQGKTDRAQEA

SEQ ID NO: 34431 - protein, 244 aa, Homo sapiens
  ENSP00000281243
MAAAAAAGEARRVLVYGGRGALGSRCVQAFRARNWWVASVDVVENEEASASIIVKMTDSFTEQADQVTAEVGKLLGEEKVDAILCVAGGWAGGNAKSKSLFKNCDLMWKQSIWTSTISSHLATKHLKEGGLLTLAGAKAALDGTPGMIGYGMAKGAVHQLCQSLAGKNSGMPPGAAAIAVLPVTLDTPMNRKSMPEADFSSWTPLEFLVETFHDWITGKNRPSSGSLIQVVTTEGRTELTPAYF

SEQ ID NO: 34432 - protein, 213 aa, Homo sapiens
  ENSP00000390944
MAAAAAAGEARRVLVYGGRGALGSRCVQAFRARNWVTAEVGKLLGEEKVDAILCVAGGWAGGNAKSKSLFKNCDLMWKQSIWTSTISSHLATKHLKEGGLLTLAGAKAALDGTPGMIGYGMAKGAVHQLCQSLAGKNSGMPPGAAAIAVLPVTLDTPMNRKSMPEADFSSWTPLEFLVETFHDWITGKNRPSSGSLIQVVTTEGRTELTPAYF

SEQ ID NO: 34433 - protein, 152 aa, Homo sapiens
  ENSP00000423227
MAAAAAAGEARRVLVYGGRGALGSRCVQAFRARNWWVASVDVVENEEASASIIVKMTDSFTEQADQVTAEVGKLLGEEKVDAILCVAGGWAGGNAKSKSLFKNCDLMWKQSIWTSTISSHLATKHLKEGGLLTLAGAKAALDGTPGLPWIPR

SEQ ID NO: 34434 - protein, 152 aa, Homo sapiens; identical to SEQ ID NO: 34433
  ENSP00000422759

SEQ ID NO: 34435 - protein, 319 aa, Homo sapiens
  ENSP00000354951
MVGEMETKEKPKPTPDYLMQLMNDKKLMSSLPNFCGIFNHLERLLDEEISRVRKDMYNDTLNGSTEKRSAELPDAVGPIVQLQEKLYVPVKEYPDFNFVGRILGPRGLTAKQLEAETGCKIMVRGKGSMRDKKKEEQNRGKPNWEHLNEDLHVLITVEDAQNRAEIKLKRAVEEVKKLLVPAAEGEDSLKKMQLMELAILNGTYRDANIKSPALAFSLAATAQAAPRIITGPAPVLPPAALRTPTPAGPTIMPLIRQIQTAVMPNGTPHPTAAIVPPGPEAGLIYTPYEYPYTLAPATSILEYPIEPSGVLGMAFPTKG

SEQ ID NO: 34436 - protein, 319 aa, Homo sapiens; identical to SEQ ID NO: 34435
  ENSP00000408775

SEQ ID NO: 34437 - protein, 325 aa, Homo sapiens
  ENSP00000275262
MVGEMETKEKPKPTPDYLMQLMNDKKLMSSLPNFCGIFNHLERLLDEEISRVRKDMYNDTLNGSTEKRSAELPDAVGPIVQLQEKLYVPVKEYPDFNFVGRILGPRGLTAKQLEAETGCKIMVRGKGSMRDKKKEEQNRGKPNWEHLNEDLHVLITVEDAQNRAEIKLKRAVEEVKKLLVPAAEGEDSLKKMQLMELAILNGTYRDANIKSPALAFSLAATAQAAPRIITGPAPVLPPAALRTPTPAGPTIMPLIRQIQTAVMPNGTPHPTAAIVPPGPEAGLIYTPYEYPYTLAPATSILEYPIEPSGVLEWIEMPVMPDISAH

SEQ ID NO: 34438 - protein, 319 aa, Homo sapiens
  ENSP00000375973
MVGEMETKEKPKPTPDYLMQLMNDKKLMSSLPNFCGIFNHLERLLDEEISRVRKDMYNDTLNGSTEKRSAELPDAVGPIVQLQEKLYVPVKEYPDFNFVGRILGPRGLTAKQLEAETGCKIMVRGKGSMRDKKKEEQNRGKPNWEHLNEDLHVLITVEDAQNRAEIKLKRAVEEVKKLLVPAAEGEDSLKKMQLMELAILNGTYRDANIKSPALAFSLAATAQAAPRIITGPAPVLPPAALRTPTPAGPTIMPLIRQIQTAVMPNGTPHPTAAIVPPGPEAGLIYTPYEYPYTLAPATSILEYPIEPSGVLGKFFSPWG

SEQ ID NO: 34439 - protein, 341 aa, Homo sapiens
  ENSP00000355094
MVGEMETKEKPKPTPDYLMQLMNDKKLMSSLPNFCGIFNHLERLLDEEISRVRKDMYNDTLNGSTEKRSAELPDAVGPIVQLQEKLYVPVKEYPDFNFVGRILGPRGLTAKQLEAETGCKIMVRGKGSMRDKKKEEQNRGKPNWEHLNEDLHVLITVEDAQNRAEIKLKRAVEEVKKLLVPAAEGEDSLKKMQLMELAILNGTYRDANIKSPALAFSLAATAQAAPRIITGPAPVLPPAALRTPTPAGPTIMPLIRQIQTAVMPNGTPHPTAAIVPPGPEAGLIYTPYEYPYTLAPATSILEYPIEPSGVLGAVATKVRRHDMRVHPYQRIVTADRAATGN

SEQ ID NO: 34440 - protein, 333 aa, Homo sapiens
  ENSP00000354867
MVGEMETKEKPKPTPDYLMQLMNDKKLMSSLPNFCGIFNHLERLLDEEISRVRKDMYNDTLNGSTEKRSAELPDAVGPIVQLQEKLYVPVKEYPDFNFVGRILGPRGLTAKQLEAETGCKIMVRGKGSMRDKKKEEQNRGKPNWEHLNEDLHVLITVEDAQNRAEIKLKRAVEEVKKLLVPAAEGEDSLKKMQLMELAILNGTYRDANIKSPTAQAAPRIITGPAPVLPPAALRTPTPAGPTIMPLIRQIQTAVMPNGTPHPTAAIVPPGPEAGLIYTPYEYPYTLAPATSILEYPIEPSGVLGAVATKVRRHDMRVHPYQRIVTADRAATGN

SEQ ID NO: 34441 - protein, 317 aa, Homo sapiens
  ENSP00000408382
MVGEMETKEKPKPTPDYLMQLMNDKKLMSSLPNFCGIFNHLERLLDEEISRVRKDMYNDTLNGSTEKRSAELPDAVGPIVQLQEKLYVPVKEYPDFNFVGRILGPRGLTAKQLEAETGCKIMVRGKGSMRDKKKEEQNRGKPNWEHLNEDLHVLITVEDAQNRAEIKLKRAVEEVKKLLVPAAEGEDSLKKMQLMELAILNGTYRDANIKSPTAQAAPRIITGPAPVLPPAALRTPTPAGPTIMPLIRQIQTAVMPNGTPHPTAAIVPPGPEAGLIYTPYEYPYTLAPATSILEYPIEPSGVLEWIEMPVMPDISAH

SEQ ID NO: 34442 - protein, 34 aa, Homo sapiens
  ENSP00000437867
  MOD_RES (1)..(1): Any amino acid
XDYLMQLMNDKKLMSSLPNFCGIFNHLERLLDEV

SEQ ID NO: 34443 - protein, 100 aa, Homo sapiens
  ENSP00000443690
MYNDTLNGSTEKRSAELPDAVGPIVQLQEKLYVPVKEYPDFNFVGRILGPRGLTAKQLEAETGCKIMVRGKGSMRDKKKEEQNRGKPNWEHLNEDLHVLI

SEQ ID NO: 34444 - protein, 160 aa, Homo sapiens
  ENSP00000440991
MYNDTLNGSTEKRSAELPDAVGPIVQLQEKLYVPVKEYPDFNFVGRILGPRGLTAKQLEAETGCKIMVRGKGSMRDKKKEEQNRGKPNWEHLNEDLHVLITVEDAQNRAEIKLKRAVEEVKKLLVPAAEGEDSLKKMQLMELAILNGTYRDANIKSPTAQ

SEQ ID NO: 34445 - protein, 47 aa, Homo sapiens
  ENSP00000443106
MYNDTLNGSTEKRSAELPDAVGPIVQLQEKLYVPVKEYPDFNFVGRI

SEQ ID NO: 34446 - protein, 41 aa, Homo sapiens
  ENSP00000441252
MYNDTLNGSTEKRSAELPDAVGPIVQLQEKLYVPVKEYPDL

SEQ ID NO: 34447 - protein, 170 aa, Homo sapiens
  ENSP00000440599
MYNDTLNGSTEKRSAELPDAVGPIVQLQEKLYVPVKEYPDFNFVGRILGPRGLTAKQLEAETGCKIMVRGKGSMRDKKKEEQNRGKPNWEHLNEDLHVLITVEDAQNRAEIKLKRAVEEVKKLLVPAAEGEDSLKKMQLMELAILNGTYRDANIKSPALAFSLAATAQAA

SEQ ID NO: 34448 - protein, 238 aa, Homo sapiens
  ENSP00000441773
  MOD_RES (1)..(1): Any amino acid
XEKRSAELPDAVGPIVQLQEKLYVPVKEYPDEEQNRGKPNWEHLNEDLHVLITVEDAQNRAEIKLKRAVEEVKKLLVPAAEGEDSLKKMQLMELAILNGTYRDANIKSPALAFSLAATAQAAPRIITGPAPVLPPAALRTPTPAGPTIMPLIRQIQTAVMPNGTPHPTAAIVPPGPEAGLIYTPYEYPYTLAPATSILEYPIEPSGVLGAVATKVRRHDMRVHPYQRIVTADRAATGN

SEQ ID NO: 34449 - protein, 185 aa, Homo sapiens
  ENSP00000442848
  MOD_RES (1)..(1): Any amino acid
XLKRAVEEVKKLLVPAAEGEDSLKKMQLMELAILNGTYRDANIKSPALAFSLAATAQAAPRIITGPAPVLPPAALRTPTPAGPTIMPLIRQIQTAVMPNGTPHPTAAIVPPGPEAGLIYTPYEYPYTLAPATSILEYPIEPSGVLGAVATKVRRHDMRVHPYQRIVTADRVTMATVQKILSNLRI

SEQ ID NO: 34450 - protein, 319 aa, Homo sapiens; identical to SEQ ID NO: 34435
  ENSP00000354951

SEQ ID NO: 34451 - protein, 319 aa, Homo sapiens; identical to SEQ ID NO: 34435
  ENSP00000408775

SEQ ID NO: 34452 - protein, 325 aa, Homo sapiens; identical to SEQ ID NO: 34437
  ENSP00000275262

SEQ ID NO: 34453 - protein, 319 aa, Homo sapiens; identical to SEQ ID NO: 34438
  ENSP00000375973

SEQ ID NO: 34454 - protein, 341 aa, Homo sapiens; identical to SEQ ID NO: 34439
  ENSP00000355094

SEQ ID NO: 34455 - protein, 333 aa, Homo sapiens; identical to SEQ ID NO: 34440
  ENSP00000354867

SEQ ID NO: 34456 - protein, 317 aa, Homo sapiens; identical to SEQ ID NO: 34441
  ENSP00000408382

SEQ ID NO: 34457 - protein, 34 aa, Homo sapiens; identical to SEQ ID NO: 34442
  ENSP00000437867
  MOD_RES (1)..(1): Any amino acid

SEQ ID NO: 34458 - protein, 100 aa, Homo sapiens; identical to SEQ ID NO: 34443
  ENSP00000443690

SEQ ID NO: 34459 - protein, 160 aa, Homo sapiens; identical to SEQ ID NO: 34444
  ENSP00000440991

SEQ ID NO: 34460 - protein, 47 aa, Homo sapiens; identical to SEQ ID NO: 34445
  ENSP00000443106

SEQ ID NO: 34461 - protein, 41 aa, Homo sapiens; identical to SEQ ID NO: 34446
  ENSP00000441252

SEQ ID NO: 34462 - protein, 170 aa, Homo sapiens; identical to SEQ ID NO: 34447
  ENSP00000440599

SEQ ID NO: 34463 - protein, 238 aa, Homo sapiens; identical to SEQ ID NO: 34448
  ENSP00000441773
  MOD_RES (1)..(1): Any amino acid

SEQ ID NO: 34464 - protein, 185 aa, Homo sapiens; identical to SEQ ID NO: 34449
  ENSP00000442848
  MOD_RES (1)..(1): Any amino acid

SEQ ID NO: 34465 - protein, 297 aa, Homo sapiens
  ENSP00000378782
MDAEGLALLLPPVTLAALVDSWLREDCPGLNYAALVSGAGPSQAALWAKSPGVLAGQPFFDAIFTQLNCQVSWFLPEGSKLVPVARVAEVRGPAHCLLLGERVALNTLARCSGIASAAAAAVEAARGAGWTGHVAGTRKTTPGFRLVEKYGLLVGGAASHRYDLGGLVMVKDNHVVAAGGVEKAVRAARQAADFTLKVEVECSSLQEAVQAAEAGADLVLLDNFKPEELHPTATVLKAQFPSVAVEASGGITLDNLPQFCGPHIDVISMGMLTQAAPALDFSLKLFAKEVAPVPKIH

SEQ ID NO: 34466 - protein, 149 aa, Homo sapiens
  ENSP00000455183
MDAEGLALLLPPVTLAALVDSWLREDCPGLNYAALAVRAARQAADFTLKVEVECSSLQEAVQAAEAGADLVLLDNFKPEELHPTATVLKAQFPSVAVEASGGITLDNLPQFCGPHIDVISMGMLTQAAPALDFSLKLFAKEVAPVPKIH

SEQ ID NO: 34467 - protein, 649 aa, Homo sapiens
  ENSP00000287263
MSLMVSAGRGLGAVWSPTHVQVTVLQARGLRAKGPGGTSDAYAVIQVGKEKYATSVSERSLGAPVWREEATFELPSLLSSGPAAAATLQLTVLHRALLGLDKFLGRAEVDLRDLHRDQGRRKTQWYKLKSKPGKKDKERGEIEVDIQFMRNNMTASMFDLSMKDKSRNPFGKLKDKIKGKNKDSGSDTASAIIPSTTPSVDSDDESVVKDKKKKSKIKTLLSKSNLQKTPLSQSMSVLPTSKPEKVLLRPGDFQSQWDEDDNEDESSSASDVMSHKRTASTDLKQLNQVNFTLPKKEGLSFLGGLRSKNDVLSRSNVCINGNHVYLEQPEAKGEIKDSSPSSSPSPKGFRKKHLFSSTENLAAGSWKEPAEGGGLSSDRQLSESSTKDSLKSMTLPSYRPAPLVSGDLRENMAPANSEATKEAKESKKPESRRSSLLSLMTGKKDVAKGSEGENPLTVPGREKEGMLMGVKPGEDASGPAEDLVRRSEKDTAAVVSRQGSSLNLFEDVQITEPEAEPESKSEPRPPISSPRAPQTRAVKPRLHPVKPMNAMATKVANCSLGTATIISENLNNEVMMKKYSPSDPAFAYAQLTHDELIQLVLKQKETISKKEFQVRELEDYIDNLLVRVMEETPNILRIPTQVGKKAGKM

SEQ ID NO: 34468 - protein, 1283 aa, Homo sapiens [sequence omitted]

SEQ ID NO: 34469 - protein, 501 aa, Homo sapiens
  ENSP00000430009
MRNNMTASMFDLSMKDKSRNPFGKLKDKIKGKNKDSGSDTASAIIPSTTPSVDSDDESVVKDKKKKSKIKTLLSKSNLQKTPLSQSMSVLPTSKPEKVLLRPGDFQSQWDEDDNEDESSSASDVMSHKRTASTDLKQLNQVNFTLPKKEGLSFLGGLRSKNDVLSRSNVCINGNHVYLEQPEAKGEIKDSSPSSSPSPKGFRKKHLFSSTENLAAGSWKEPAEGGGLSSDRQLSESSTKDSLKSMTLPSYRPAPLVSGDLRENMAPANSEATKEAKESKKPESRRSSLLSLMTGKKDVAKGSEGENPLTVPGREKEGMLMGVKPGEDASGPAEDLVRRSEKDTAAVVSRQGSSLNLFEDVQITEPEAEPESKSEPRPPISSPRAPQTRAVKPRLHPVKPMNAMATKVANCSLGTATIISENLNNEVMMKKYSPSDPAFAYAQLTHDELIQLVLKQKETISKKEFQVRELEDYIDNLLVRVMEETPNILRIPTQVGKKAGKM

SEQ ID NO: 34470 - protein, 439 aa, Homo sapiens
  ENSP00000430680
MRNNMTASMFDLSMKDKSRNPFGKLKDKIKGKNKDSGSDTASAIIPSTTPSVDSDDESVVKDKKKKSKIKTLLSKSNLQKTPLSQSMSVLPTSKPEKVLLRPGDFQSQWDEDDNEDESSSASDVMSHKRTASTDLKQLNQVNFTLPKKEGLSFLGGLRSKNDVLSRSNVCINGNHVYLEQPEAKGEIKDSSPSSSPSPKGFRKKHLFSSTENLAAGSWKEPAEGGGLSSDRQLSESSTKDSLKSMTLPSYRPAPLVSGDLRENMAPANSEATKEAKESKKPESRRSSLLSLMTGKKDVAKGSEGENPLTVPGREKEGMLMGVKPGEDASGPAEDLVRRSEKDTAAVVSRQGSSLNLFEDVQITEPEAEPESKSEPRPPISSPRAPQTRAVKPRLHPVKPMNAMATKVANCSLGTATIISENLNNEVMMKVCPLRSWCVR

SEQ ID NO: 34471 - protein, 208 aa, Homo sapiens
  ENSP00000267512
MAKQYDVLFRLLLIGDSGVGKTCLLCRFTDNEFHSSHISTIGVDFKMKTIEVDGIKVRIQIWDTAGQERYQTITKQYYRRAQGIFLVYDISSERSYQHIMKWVSDVDEVGDATSLPGCGEGASPGKARRGPDGKANASRKLCLPQPWMKTSGTHQKASRRSLLGIRLMRSRNGRWEESKGSSWRRSMAWTSMKQVPAPTSTLKSHSRV

SEQ ID NO: 34472 - protein, 212 aa, Homo sapiens
  ENSP00000434103
MAKQYDVLFRLLLIGDSGVGKTCLLCRFTDNEFHSSHISTIGVDFKMKTIEVDGIKVRIQIWDTAGQERYQTITKQYYRRAQGIFLVYDISSERSYQHIMKWVSDVDEYAPEGVQKILIGNKADEEQKRQVGREQGQQLAKEYGMDFYETSACTNLNIKESFTRLTELVLQAHRKELEGLRMRASNELALAELEEEEGKPEGPANSSKTCWC

SEQ ID NO: 34473 - protein, 140 aa, Homo sapiens
  ENSP00000464662
  MOD_RES (1)..(1): Any amino acid
XPRPQLGRNCQPLRLEAVAPEAGVRDKSRGVDFKMKTIEVDGIKVRIQIWDTAGQERYQTITKQYYRRAQGIFLVYDISSERSYQHIMKWVSDVDEVGDATSLPGCGEGASPGKARRGPDGKANASRKLCLPQPWMKTSG

SEQ ID NO: 34474 - protein, 166 aa, Homo sapiens
  ENSP00000433485
MKTIEVDGIKVRIQIWDTAGQERYQTITKQYYRRAQGIFLVYDISSERSYQHIMKWVSDVDEYAPEGVQKILIGNKADEEQKRQVGREQGQQLAKEYGMDFYETSACTNLNIKESFTRLTELVLQAHRKELEGLRMRASNELALAELEEEEGKPEGPANSSKTCWC

SEQ ID NO: 34475 - protein, 150 aa, Homo sapiens
  ENSP00000452195
MKTIEVDGIKVRIQIWDTAGQERYQTITKQYYRRAQGIFLVYDISSERSYQHIMKWVSDVDEYAPEGVQKILIGNKADEEQKRQVGREQGQQLAKEYGMDFYETSACTNLNIKESFTRLTELVLQAHRKELEGLRMRASNELALAELEEE

SEQ ID NO: 34476 - protein, 221 aa, Homo sapiens
  ENSP00000379601
MSDGDYDYLIKFLALGDSGVGKTSVLYQYTDGKFNSKFITTVGIDFREKRVVYRASGPDGATGRGQRIHLQLWDTAGQERFRSLTTAFFRDAMGFLLLFDLTNEQSFLNVRNWISQLQMHAYCENPDIVLCGNKSDLEDQRVVKEEEAIALAEKYGIPYFETSAANGTNISQAIEMLLDLIMKRMERCVDKSWIPEGVVRSNGHASTDQLSEEKEKGACGC

SEQ ID NO: 34477 - protein, 221 aa, Homo sapiens; identical to SEQ ID NO: 34476
  ENSP00000455012

SEQ ID NO: 34478 - protein, 221 aa, Homo sapiens; identical to SEQ ID NO: 34476
  ENSP00000456059

SEQ ID NO: 34479 - protein, 185 aa, Homo sapiens
  ENSP00000454695
MSDGDYDYLIKFLALGDSGVGKTSVLYQYTDGKFNSKFITTVGIDFREKRVVYRASGPDGATGRGQRIHLQLWDTAGQERFRSLTTAFFRDAMGFLLLFDLTNEQSFLNVRNWISQLQMHAYCENPDIVLCGNKSDLEDQRVVKEEEAIALAEKYGIPYFETSAANGTNISQAIEMLLDLIMKRM

SEQ ID NO: 34480 - protein, 146 aa, Homo sapiens
  ENSP00000458127
MSDGDYDYLIKFLALGDSGVGKTSVLYQYTDGKFNSKFITTVGIDFREKRVVYRASGPDGATGRGQRIHLQLWDTAGQERFRSLTTAFFRDAMGFLLLFDLTNEQSFLNVRNWISQLQMHAYCENPDIVLCGNKSDLEDQRVVKEE

SEQ ID NO: 34481 - protein, 136 aa, Homo sapiens
  ENSP00000456536
MSDGDYDYLIKFLALGDSGVGKTSVLYQYTDGKFNSKFITTVGIDFREKRVVYRASGPDGATGRGQRIHLQLWDTAGQERFRSLTTAFFRDAMGFLLLFDLTNEQSFLNVRNWISQLQMHAYCENPDIVLCGNKSD

SEQ ID NO: 34482 - protein, 95 aa, Homo sapiens
  ENSP00000457595
MSDGDYDYLIKFLALGDSGVGKTSVLYQYTDGKFNSKFITTVGIDFREKRVVYRASGPDGATGRGQRIHLQLWDTAGQERFRSLTTAFFRDAMGF

SEQ ID NO: 34483 - protein, 71 aa, Homo sapiens
  ENSP00000457517
MSDGDYDYLIKFLALGDSGVGKTSVLYQYTDGKFNSKFITTVGIDFREKRVVYRASGPDGATGRGQRIHLQ

SEQ ID NO: 34484 - protein, 221 aa, Homo sapiens; identical to SEQ ID NO: 34476
  ENSP00000337761

SEQ ID NO: 34485 - protein, 87 aa, Homo sapiens
  ENSP00000468542
MTDGDYDYLIKLLALGDSGVGKTTFLYRYTDNKFNPKFITTVGIDFREKRVVYNAQGPNGSSGKAFKVHLQLWDTAGQERFRSLTTA

SEQ ID NO: 34486 - protein, 218 aa, Homo sapiens
  ENSP00000262094
MTDGDYDYLIKLLALGDSGVGKTTFLYRYTDNKFNPKFITTVGIDFREKRVVYNAQGPNGSSGKAFKVHLQLWDTAGQERFRSLTTAFFRDAMGFLLMFDLTSQQSFLNVRNWMSQLQANAYCENPDIVLIGNKADLPDQREVNERQARELADKYGIPYFETSAATGQNVEKAVETLLDLIMKRMEQCVEKTQIPDTVNGGNSGNLDGEKPPEKKCIC

SEQ ID NO: 34487 - protein, 131 aa, Homo sapiens
  ENSP00000465009
  MOD_RES (1)..(1): Any amino acid
XFRDAMGFLLMFDLTSQQSFLNVRNWMSQLQANAYCENPDIVLIGNKADLPDQREVNERQARELADKYGCKLSTLGINKFDEACLSLHQWSCSLFCISLHLKRIHNSFLIAYYTKRLREKSSFVKDFGCII

SEQ ID NO: 34488 - protein, 195 aa, Homo sapiens
  ENSP00000461945
MMAIRELKVCLLGDTGVGKSSIVCRFVQDHFDHNISPTIGASFMTKTVPCGNELHKFLIWDTAGQERFHSLAPMYYRGSAAAVIVYDITKQDSFYTLKKWVKELKEHGPENIVMAIAGNKCDLSDIREVPLKDAKEYAESIGAIVVETSAKNAINIEELFQGISRQIPPLDPHENGNNGTIKVEKPTMQASRRCC

SEQ ID NO: 34489 - protein, 25 aa, Homo sapiens
  ENSP00000462164
MMAIRELKVCLLGGIFYDQNCALWK

SEQ ID NO: 34490 - protein, 74 aa, Homo sapiens
  ENSP00000464046
MMAIRELKVCLLGDTGVGKSSIVCRFVQDHFDHNISPTIGASFMTKTVPCGNELHKFLIWDTAGQERGGSPEGC

SEQ ID NO: 34491 - protein, 59 aa, Homo sapiens
  ENSP00000462561
MMAIRELKVCLLGGLMEPICSLTKCHSIGRTLDKDKEGCIPVAPPGGRWRYVLRTPATG

SEQ ID NO: 34492 - protein, 237 aa, Homo sapiens
  ENSP00000257017
MAQPILGHGSLQPASAAGLASLELDSSLDQYVQIRIFKIIVIGDSNVGKTCLTFRFCGGTFPDKTEATIGVDFREKTVEIEGEKIKVQVWDTAGQERFRKSMVEHYYRNVHAVVFVYDVTKMTSFTNLKMWIQECNGHAVPPLVPKVLVGNKCDLREQIQVPSNLALKFADAHNMLLFETSAKDPKESQNVESIFMCLACRLKAQKSLLYRDAERQQGKVQKLEFPQEANSKTSCPC

SEQ ID NO: 34493 - protein, 197 aa, Homo sapiens
  ENSP00000378664
MVGQPQPRDDVGSPRPRVIVGTIRPRVIVGTIRPRVIVGSARARPPPDGTPRPQLAAEESPRPRVIFGTPRARVILGSPRPRVIVSSPWPAVVVASPRPRTPVGSPWPRVVVGTPRPRVIVGSPRARVADADPASAPSQGALQGRRQDEHSGTRAEGSRPGGAAPVPEEGGRFARAQRLPPPRHLRLPGAPDRHRGI

SEQ ID NO: 34494 - protein, 211 aa, Homo sapiens
  ENSP00000487160
MNILAPVRRDRVLAELPQCLRKEAALHGHKDFHPRVTCACQEHRTGTVGRFKISKVIVVGDLSVGKTCLINRFCKDTFDKNYKATIGVDFEMERFEVLGIPFSLQLWDTAGQERFKCIASTYYRGAQAIIIVFNLNDVASLEHTKQWLADALKENDPSSVLLFLVGSKKDLSTPAQYALMEKDALQVAQEMKTVQRLPSPRALCHPHSSRA

SEQ ID NO: 34495 - protein, 259 aa, Homo sapiens
  ENSP00000301043
MNILAPVRRDRVLAELPQCLRKEAALHGHKDFHPRVTCACQEHRTGTVGFKISKVIVVGDLSVGKTCLINRFCKDTFDKNYKATIGVDFEMERFEVLGIPFSLQLWDTAGQERFKCIASTYYRGAQAIIIVFNLNDVASLEHTKQWLADALKENDPSSVLLFLVGSKKDLSTPAQYALMEKDALQVAQEMKAEYWAVSSLTGENVREFFFRVAALTFEANVLAELEKSGARRIGDVVRINSDDSNLYLTASKKKPTCCP

SEQ ID NO: 34496 - protein, 251 aa, Homo sapiens
  ENSP00000391048
MNILAPVRRDRVLAELPQCLRKEAALHGHKDFHPRVTCACQEHRTGTVGFKISKVIVVGDLSVGKTCLINRFCKDTFDKNYKATIGVDFEMERFEVLGIPFSLQLWDTAGQERFKCIASTYYRGAQAIIIVFNLNDVASLEHTKQWLADALKENDPSSVLLFLTPAQYALMEKDALQVAQEMKAEYWAVSSLTGENVREFFFRVAALTFEANVLAELEKSGARRIGDVVRINSDDSNLYLTASKKKPTCCP

SEQ ID NO: 34497 - protein, 237 aa, Homo sapiens
  ENSP00000410279
MNILAPVRRDRVLAELPQCLRKEAALHGHKDFHPRVTCACQEHRTGTVGFCKDTFDKNYKATIGVDFEMERFEVLGIPFSLQLWDTAGQERFKCIASTYYRGAQAIIIVFNLNDVASLEHTKQWLADALKENDPSSVLLFLVGSKKDLSTPAQYALMEKDALQVAQEMKAEYWAVSSLTGENVREFFFRVAALTFEANVLAELEKSGARRIGDVVRINSDDSNLYLTASKKKPTCCP

SEQ ID NO: 34498 - protein, 171 aa, Homo sapiens
  ENSP00000397499
MNILAPVRRDRVLAELPQCLRKEAALHGHKDFHPRVTCACQEHRTGTVGFKISKVIVVGDLSVGKTCLINRFCKDTFDKNYKATIGVDFEMERFEVLGIPFSLQLWDTAGQERFKCIASTYYRGAQAIIIVFNLNDVASLEHTKFQEGSEYPCSVCADGERRPPGGPGDEG

SEQ ID NO: 34499 - protein, 259 aa, Homo sapiens; identical to SEQ ID NO: 34495
  ENSP00000404180

SEQ ID NO: 34500 - protein, 258 aa, Homo sapiens
  ENSP00000407953
MSHLPGLELRREAPPLLGPLLSPFPLPAGSWHRQMLRSSLRFPITNSAGFKISKVIVVGDLSVGKTCLINRFCKDTFDKNYKATIGVDFEMERFEVLGIPFSLQLWDTAGQERFKCIASTYYRGAQAIIIVFNLNDVASLEHTKQWLADALKENDPSSVLLFLVGSKKDLSTPAQYALMEKDALQVAQEMKAEYWAVSSLTGENVREFFFRVAALTFEANVLAELEKSGARRIGDVVRINSDDSNLYLTASKKKPTCC

SEQ ID NO: 34501 - protein, 156 aa, Homo sapiens
  ENSP00000463488
  MOD_RES (1)..(1): Any amino acid
XMLRSSLRFPITNSAGLQLWDTAGQERFKCIASTYYRGAQAIIIVFNLNDVASLEHTKQWLADALKENDPSSVLLFLTPAQYALMEKDALQVAQEMKAEYWAVSSLTGENVREFFFRVAALTFEANVLAELEKSGARRIGDVVRINSDDSNLYLTA

SEQ ID NO: 34502 - protein, 250 aa, Homo sapiens
  ENSP00000489794
MVGQPQPRDDVGSPRPRVIVGTIRPRVIVGTIRPRVIVGSARARPPPDGTPRPQLAAEESPRPRVIFGTPRARVILGSPRPRVIVSSPWPAVVVASPRPRTPVGSPWPRVVVGTPRPRVIVGSPRARVADADPASAPSQGALQGRRQDEHSGTRAEGSRPGGAAPDLRSPRSLWWGTCRWGRLASLIGSAKTPLIRITRPPLEWTSRWNDLRCWAFPSVCSFGIPLGRRGSNALHQPTIEELKPSSLSST

SEQ ID NO: 34503 - protein, 210 aa, Homo sapiens
  ENSP00000226259
MNILAPVRRDRVLAELPQCLRKEAALHGHKDFHPRVTCACQEHRTGTVGFKISKVIVVGDLSVGKTCLINRFCKDTFDKNYKATIGVDFEMERFEVLGIPFSLQLWDTAGQERFKCIASTYYRGAQAIIIVFNLNDVASLEHTKQWLADALKENDPSSVLLFLVGSKKDLSTPAQYALMEKDALQVAQEMKAEYWAVSSLTGENVREFFF

SEQ ID NO: 34504 - protein, 210 aa, Homo sapiens; identical to SEQ ID NO: 34503
  ENSP00000398706

SEQ ID NO: 34505 - protein, 228 aa, Homo sapiens
  ENSP00000490855
MVGQPQPRDDVGSPRPRVIVGTIRPRVIVGTIRPRVIVGSARARPPPDGTPRPQLAAEESPRPRVIFGTPRARVILGSPRPRVIVSSPWPAVVVASPRPRTPVGSPWPRVVVGTPRPRVIVGSPRARVADADPASAPSQGALQGRRQDEHSGTRAEGSRPGGAAPGSAKTPLIRITRPPLEWTSRWNDLRCWAFPSVCSFGIPLGRRGSNALHQPTIEELKPSSLSST

SEQ ID NO: 34506 - protein, 149 aa, Homo sapiens
  ENSP00000464723
MNILAPVRRDRVLAELPQCLRKEAALHGHKDFHPRVTCACQEHRTGTVGFKISKVIVVGDLSVGKTCLINRFCKDTFDKNYKATIGVDFEMERFEVLGIPFSLQLWDTAGQERFKCIASTYYRGAQAIIIVFNLNDVASLEHTKQWLAD

SEQ ID NO: 34507 - protein, 198 aa, Homo sapiens
  ENSP00000490450
MVGQPQPRDDVGSPRPRVIVGTIRPRVIVGTIRPRVIVGSARARPPPDGTPRPQLAAEESPRPRVIFGTPRARVILGSPRPRVIVSSPWPAVVVASPRPRTPVGSPWPRVVVGTPRPRVIVGSPRARVADADPASAPSQGALQGRRQDEHSGTRAEGSRPGGAAPVPEEGGRFARAQRLPPPRHLRLPGAPDRHRGQI

SEQ ID NO: 34508 - protein, 83 aa, Homo sapiens
  ENSP00000490529
MSHLPGLELRREAPPLLGPLLSPFPLPAGSWHRQMLRSSLRFPITNSAGVSETADSRRVPVAPSCSRDTPAAGDRRVSTRPGR

SEQ ID NO: 34509 - protein, 51 aa, Homo sapiens
  ENSP00000465352
MNILAPVRRDRVLAELPQCLRKEAALHGHKDFHPRVTCACQEHRTGTVGRF

SEQ ID NO: 34510 - protein, 48 aa, Homo sapiens
  ENSP00000476427
MNILAPVRRDRVLAELPQCLRKEAALHGHKDFHPRVTCACQEHRTGTV

SEQ ID NO: 34511 - protein, 268 aa, Homo sapiens
  ENSP00000413156
MSHLPGLELRREAPPLLGPLLSPFPLPAGSWHRQMLRSSLRFPITNSAGAPCKAAGRMNILAPVRRDRVLAELPQCLRKEAALHGHKDFHPRVTCACQEHRTGTVGRFKISKVIVVGDLSVGKTCLINRFCKDTFDKNYKATIGVDFEMERFEVLGIPFSLQLWDTAGQERFKCIASTYYRGAQAIIIVFNLNDVASLEHTKQWLADALKENDPSSVLLFLVGSKKDLSTPAQYALMEKDALQVAQEMKTVQRLPSPRALCHPHSSRA

SEQ ID NO: 34512 - protein, 259 aa, Homo sapiens; identical to SEQ ID NO: 34495
  ENSP00000378666

SEQ ID NO: 34513 - protein, 182 aa, Homo sapiens
  ENSP00000341354
MDLQRPDSYQGGAGPDFNDHVLHKTILVGDSGVGKTSLLVQFDQGKFIPGSFSATVGIGFTNKVVTVDGVRVKLQIWDTAGQERFRSVTHAYYRDAQALLLLYDITNKSSFDNIRAWLTEIHEYAQRDVVIMLLGNKADMSSERVIRSEDGETLAREYGVPFLETSAKTGMNVELAFLAIAK

SEQ ID NO: 34514 - protein, 216 aa, Homo sapiens
  ENSP00000383934
MDLQRPDSYQGGAGPDFNDHVLHKTILVGDSGVGKTSLLVQFDQGKFIPGSFSATVGIGFTNKVVTVDGVRVKLQIWDTAGQERFRSVTHAYYRDAQALLLLYDITNKSSFDNIRAWLTEIHEYAQRDVVIMLLGNKADMSSERVIRSEDGETLAREYGVPFLETSAKTGMNVELAFLAIAKELKYRAGHQADEPSFQIRDYVESQKKRSSCCSFM

SEQ ID NO: 34515 - protein, 196 aa, Homo sapiens
  ENSP00000432086
MCCKVMLLGDTGVGKTCFLIQFKDGAFLSGTFIATVGIDFRNKVVTVDGVRVKLQIWDTAGQERFRSVTHAYYRDAQALLLLYDITNKSSFDNIRAWLTEIHEYAQRDVVIMLLGNKADMSSERVIRSEDGETLAREYGVPFLETSAKTGMNVELAFLAIAKELKYRAGHQADEPSFQIRDYVESQKKRSSCCSFM

SEQ ID NO: 34516 - protein, 191 aa, Homo sapiens
  ENSP00000376391
MWLMSEAHGAEPVLLREAARPFTQTLRLCVPSGNSKNKVVTVDGVRVKLQIWDTAGQERFRSVTHAYYRDAQALLLLYDITNKSSFDNIRAWLTEIHEYAQRDVVIMLLGNKADMSSERVIRSEDGETLAREYGVPFLETSAKTGMNVELAFLAIAKELKYRAGHQADEPSFQIRDYVESQKKRSSCCSFM

SEQ ID NO: 34517 - protein, 228 aa, Homo sapiens
  ENSP00000376390
MWLMSEAHGAEPVLLREAARPFTQTLRLCVPSGNSKVMLLGDTGVGKTCFLIQFKDGAFLSGTFIATVGIDFRNKVVTVDGVRVKLQIWDTAGQERFRSVTHAYYRDAQALLLLYDITNKSSFDNIRAWLTEIHEYAQRDVVIMLLGNKADMSSERVIRSEDGETLAREYGVPFLETSAKTGMNVELAFLAIAKELKYRAGHQADEPSFQIRDYVESQKKRSSCCSFM

SEQ ID NO: 34518 - protein, 223 aa, Homo sapiens
  ENSP00000376389
MTGTPGAVATRDGEAPERSPPCSPSYDLTGKVMLLGDTGVGKTCFLIQFKDGAFLSGTFIATVGIDFRNKVVTVDGVRVKLQIWDTAGQERFRSVTHAYYRDAQALLLLYDITNKSSFDNIRAWLTEIHEYAQRDVVIMLLGNKADMSSERVIRSEDGETLAREYGVPFLETSAKTGMNVELAFLAIAKELKYRAGHQADEPSFQIRDYVESQKKRSSCCSFM

SEQ ID NO: 34519 - protein, 186 aa, Homo sapiens
  ENSP00000376388
MTGTPGAVATRDGEAPERSPPCSPSYDLTGKNKVVTVDGVRVKLQIWDTAGQERFRSVTHAYYRDAQALLLLYDITNKSSFDNIRAWLTEIHEYAQRDVVIMLLGNKADMSSERVIRSEDGETLAREYGVPFLETSAKTGMNVELAFLAIAKELKYRAGHQADEPSFQIRDYVESQKKRSSCCSFM

SEQ ID NO: 34520 - protein, 189 aa, Homo sapiens
  ENSP00000376387
MTGTPGAVATRDGEAPERSPPCSPSYDLTGKVMLLGDTGVGKTCFLIQFKDGAFLSGTFIATVGIDFRNKVVTVDGVRVKLQIWDTAGQERFRSVTHAYYRDAQALLLLYDITNKSSFDNIRAWLTEIHEYAQRDVVIMLLGNKADMSSERVIRSEDGETLAREYGVPFLETSAKTGMNVELAFLAIAK

SEQ ID NO: 34521 - protein, 223 aa, Homo sapiens; identical to SEQ ID NO: 34518
  ENSP00000436563

SEQ ID NO: 34522 - protein, 223 aa, Homo sapiens; identical to SEQ ID NO: 34518
  ENSP00000483155

SEQ ID NO: 34523 - protein, 220 aa, Homo sapiens
  ENSP00000222256
MASATDSRYGQKESSDQNFDYMFKILIIGNSSVGKTSFLFRYADDSFTPAFVSTVGIDFKVKTIYRNDKRIKLQIWDTAGQERYRTITTAYYRGAMGFILMYDITNEESFNAVQDWSTQIKTYSWDNAQVLLVGNKCDMEDERVVSSERGRQLADHLGFEFFEASAKDNINVKQTFERLVDVICEKMSESLDTADPAVTGAKQGPQLSDQQVPPHQDCAC

SEQ ID NO: 34524 - protein, 125 aa, Homo sapiens
  ENSP00000474603
MGFILMYDITNEESFNAVQDWSTQIKTYSWDNAQVLLVGNKCDMEDERVVSSERGRQLADHLGFEFFEASAKDNINVKQTFERLVDVICEKMSESLDTADPAVTGAKQGPQLSDQQVPPHQDCAC

SEQ ID NO: 34525 - protein, 115 aa, Homo sapiens
  ENSP00000472335
MASATDSRYGQKESSDQNFDYMFKILIIGNSSVGKTSFLFRYADDSFTPAFVSTVGIDFKVKTIYRNDKRIKLQIWDTAGQERYRTITTAYYRGAMGFILMYDITNEESFNAVQD

SEQ ID NO: 34526 - protein, 219 aa, Homo sapiens
  ENSP00000360718
MASVTDGKTGVKDASDQNFDYMFKLLIIGNSSVGKTSFLFRYADDTFTPAFVSTVGIDFKVKTVYRHEKRVKLQIWDTAGQERYRTITTAYYRGAMGFILMYDITNEESFNAVQDWATQIKTYSWDNAQVILVGNKCDMEEERVVPTEKGQLLAEQLGFDFFEASAKENISVRQAFERLVDAICDKMSDSLDTDPSMLGSSKNTRLSDTPPLLQQNCSC

SEQ ID NO: 34527 - protein, 227 aa, Homo sapiens
  ENSP00000282878
MRHEAPMQMASAQDARYGQKDSSDQNFDYMFKLLIIGNSSVGKTSFLFRYADDSFTSAFVSTVGIDFKVKTVFKNEKRIKLQIWDTAGQERYRTITTAYYRGAMGFILMYDITNEESFNAVQDWSTQIKTYSWDNAQVILVGNKCDMEDERVISTERGQHLGEQLGFEFFETSAKDNINVKQTFERLVDIICDKMSESLETDPAITAAKQNTRLKETPPPPQPNCAC

SEQ ID NO: 34528 - protein, 208 aa, Homo sapiens
  ENSP00000285208
MSAGGDFGNPLRKFKLVFLGEQSVGKTSLITRFMYDSFDNTYQATIGIDFLSKTMYLEDRTVRLQLWDTAGQERFRSLIPSYIRDSTVAVVVYDITNLNSFQQTSKWIDDVRTERGSDVIIMLVGNKTDLADKRQITIEEGEQRAKELSVMFIETSAKTGYNVKQLFRRVASALPGMENVQEKSKEGMIDIKLDKPQEPPASEGGCSC

SEQ ID NO: 34529 - protein, 71 aa, Homo sapiens
  ENSP00000418540
MSAGGDFGNPLRKFKLVFLGEQSVGKTSLITRCCWQLQLRGAWFIDWGAMCTSENILTSPPSSQYTCLGQV

SEQ ID NO: 34530 - protein, 195 aa, Homo sapiens
  ENSP00000419381
MWHMTRNWPLVGKTSLITRFMYDSFDNTYQATIGIDFLSKTMYLEDRTVRLQLWDTAGQERFRSLIPSYIRDSTVAVVVYDITNLNSFQQTSKWIDDVRTERGSDVIIMLVGNKTDLADKRQITIEEGEQRAKELSVMFIETSAKTGYNVKQLFRRVASALPGMENVQEKSKEGMIDIKLDKPQEPPASEGGCSC

SEQ ID NO: 34531 - protein, 124 aa, Homo sapiens
  ENSP00000419941
MYDSFDNTYQATIGIDFLSKTMYLEDRTVRLQLWDTAGQERFRSLIPSYIRDSTVAVVVYDITNLNSFQQTSKWIDDVRTERGSDVIIMLVGNKTDLADKRQITIEEGEQRAKELSVMFIETSA

SEQ ID NO: 34532 - protein, 83 aa, Homo sapiens
  ENSP00000419526
MYLEDRTVRLQLWDTAGQERFRSLIPSYIRDSTVAVVVYDITNLNSFQQTSKWIDDVRTERGSDVIIMLVGNKTDLADKRQIT

SEQ ID NO: 34533 - protein, 49 aa, Homo sapiens
  ENSP00000417433
MYDSFDNTYQATIGIDFLSKTMYLEDRTVRLQLWDTAGQERFRSLIPSY

SEQ ID NO: 34534 - protein, 208 aa, Homo sapiens; identical to SEQ ID NO: 34528
  ENSP00000437797

SEQ ID NO: 34535 - protein, 480 aa, Homo sapiens
  ENSP00000392578
MDDLQSQNLSMDMTDSPPALANNRLENGMAQLITTEAWNINSTDLVEGSSAPELNPNGNATYVMTTQGPVQLPVVLEQHVFQHLNSPLVLPQEAPCSSSTIHNNLFQGAEDPEAQPQLLDLRIPSQPQEPTLPFEAVLQNLFPSQGTLGPPPCQPPPGYAPVPPQPFSSPLSPLVPPATLLVPYPVIVPLPVPVPIPIPIPMPQSSESKFSSSFPKPPSSFGLHPFKGTQTPLEKDELKPFDILQPKEYFQLSRHTVIKMGSENEALDLSMKSVPWLKAGEVSPPIFQEDAALDLSVAAHRKSEPPPETLYDSGASVDSSGHTVMEKLPSGMEISFAPATSHEAPAMMDSHISSSDAATEMLSQPNHPSGEVKAENNIEMVGESQAAKVIVSVEDAVPTIFCGKIKGLSGVSTKNFSFKREDSVLQGYDINSQGEESMGNAEPLRKPIKNRSIKLKKVNSQEIHMLPIKKQRLATFFPRK

SEQ ID NO: 34536 - protein, 530 aa, Homo sapiens
  ENSP00000353106
MDDLQSQNLSMDMTDSPPALANNRLENGMAQLITTEAWNINSTDLVKKALVTVPAPSILNPPAESQSGMALKVAATVLQPLCLGESPVVMPIHMQVEGSSAPELNPNGNATYVMTTQGPVQLPVVLEQHVFQHLNSPLVLPQEAPCSSSTIHNNLFQGAEDPEAQPQLLDLRIPSQPQEPTLPFEAVLQNLFPSQGTLGPPPCQPPPGYAPVPPQPFSSPLSPLVPPATLLVPYPVIVPLPVPVPIPIPIPMPQSSESKFSSSFPKPPSSFGLHPFKGTQTPLEKDELKPFDILQPKEYFQLSRHTVIKMGSENEALDLSMKSVPWLKAGEVSPPIFQEDAALDLSVAAHRKSEPPPETLYDSGASVDSSGHTVMEKLPSGMEISFAPATSHEAPAMMDSHISSSDAATEMLSQPNHPSGEVKAENNIEMVGESQAAKVIVSVEDAVPTIFCGKIKGLSGVSTKNFSFKREDSVLQGYDINSQGEESMGNAEPLRKPIKNRSIKLKKVNSQEIHMLPIKKQRLATFFPRK

SEQ ID NO: 34537 - protein, 530 aa, Homo sapiens; identical to SEQ ID NO: 34536
  ENSP00000333456

SEQ ID NO: 34538 - protein, 81 aa, Homo sapiens
  ENSP00000473562
MDDLQSQNLSMDMTDSPPALANNRLENGMAQLITTEAWNINSTDLPLCLGESPVVMPIHMQVEGSSAPELNPNGNATYVMT

SEQ ID NO: 34539 - protein, 530 aa, Homo sapiens; identical to SEQ ID NO: 34536
  ENSP00000401323

SEQ ID NO: 34540 - protein, 530 aa, Homo sapiens; identical to SEQ ID NO: 34536
  ENSP00000444210

SEQ ID NO: 34541 - protein, 583 aa, Homo sapiens
  ENSP00000356607
MDLMNGQASSVNIAATASEKSSSSESLSDKGSELKKSFDAVVFDVLKVTPEEYAGQITLMDVPVFKAIQPDELSSCGWNKKEKYSSAPNAVAFTRRFNHVSFWVVREILHAQTLKIRAEVLSHYIKTAKKLYELNNLHALMAVVSGLQSAPIFRLTKTWALLSRKDKTTFEKLEYVMSKEDNYKRLRDYISSLKMTPCIPYLGIYLSDLTYIDSAYPSTGSILENEQRSNLMNNILRIISDLQQSCEYDIPMLPHVQKYLNSVQYIEELQKFVEDDNYKLSLKIEPGTSTPRSAASREDLVGPEVGASPQSGRKSVAAEGALLPQTPPSPRNLIPHGHRKCHSLGYNFIHKMNTAEFKSATFPNAGPRHLLDDSVMEPHAPSRGQAESSTLSSGISIGSSDGSELSEETSWPAFERNRLYHSLGPVTRVARNGYRSHMKASSSAESEDLAVHLYPGAVTIQGVLRRKTLLKEGKKPTVASWTKYWAALCGTQLFYYAAKSLKATERKHFKSTSNKNVSVIGWMVMMADDPEHPDLFLLTDSEKGNSYKFQAGNRMNAMLWFKHLSAACQSNKQQVPTNLMTFE

SEQ ID NO: 34542 - protein, 266 aa, Homo sapiens
  ENSP00000313613
MDLMNGQASSVNIAATASEGQITLMDVPVFKAIQPDELSSCGWNKKEKYSSAPNAVAFTRRFNHVSFWVVREILHAQTLKIRAEVLSHYIKTAKKLYELNNLHALMAVVSGLQSAPIFRLTKTWALLSRKDKTTFEKLEYVMSKEDNYKRLRDYISSLKMTPCIPYLGIYLSDLTYIDSAYPSTGSILENEQRSNLMNNILRIISDLQQSCEYDIPMLPHVQKYLNSVQYIEELQKFVEDDNYKLSLKIEPGTSTPRSAASREDLV

SEQ ID NO: 34543 - protein, 99 aa, Homo sapiens
  ENSP00000405903
  MOD_RES (1)..(1): Any amino acid
XQYIEELQKFVEDDNYKLSLKIEPGTSTPRSAASREDLVGPEVGASPQSGRKSVAAEGALLPQTPPSPRNLIPHGHRKCHSLGYKSAFLILSFKFLSLL

SEQ ID NO: 34544 - protein, 146 aa, Homo sapiens
  ENSP00000356604
  MOD_RES (1)..(1): Any amino acid
XQAESSTLSSGISIGSSDGSELSEETSWPAFESSAESEDLAVHLYPGAVTIQGVLRRKTLLKEGKKPTVASWTKYWAALCGTQLFYYAAKSLKATERKHFKSTSNKNVSVIGWMVMMADDPEHPDLFLLTDSEKGNSYKFQAGNRM

SEQ ID NO: 34545 - protein, 557 aa, Homo sapiens
  ENSP00000356606
MDLMNGQASSVNIAATASEKSSSSESLSDKGSELKKSFDAVVFDVLKVTPEEYAGQITLMDVPVFKAIQPDELSSCGWNKKEKYSSAPNAVAFTRRFNHVSFWVVREILHAQTLKIRAEVLSHYIKTAKKLYELNNLHALMAVVSGLQSAPIFRLTKTWALLSRKDKTTFEKLEYVMSKEDNYKRLRDYISSLKMTPCIPYLGIYLSDLTYIDSAYPSTGSILENEQRSNLMNNILRIISDLQQSCEYDIPMLPHVQKYLNSVQYIEELQKFVEDDNYKLSLKIEPGTSTPRSAASREDLVGPEVGASPQSGRKSVAAEGALLPQTPPSPRNLIPHGHRKCHSLGYNFIHKMNTAEFKSATFPNAGPRHLLDDSVMEPHAPSRGQAESSTLSSGISIGSSDGSELSEETSWPAFESSAESEDLAVHLYPGAVTIQGVLRRKTLLKEGKKPTVASWTKYWAALCGTQLFYYAAKSLKATERKHFKSTSNKNVSVIGWMVMMADDPEHPDLFLLTDSEKGNSYKFQAGNRMNAMLWFKHLSAACQSNKQQVPTNLMTFE

SEQ ID NO: 34546 - protein, 85 aa, Homo sapiens
  ENSP00000427787
MTGKTQTSNVTNKNDPKSINSRVFIGNLNTAIVKKVDIEAIFSKYGKIVGCSVHKGYAFVQYMSERHARAAVAGENARVIAGQPL

SEQ ID NO: 34547 - protein, 291 aa, Homo sapiens
  ENSP00000430394
MTGKTQTSNVTNKNDPKSINSRVFIGNLNTAIVKKVDIEAIFSKYGKIVGCSVHKGYAFVQYMSERHARAAVAGENARVIAGQPLDINMAGEPKPYRPKPGNKRPLSALYRLESKEPFLSVGGYVFDYDYYRDDFYNRLFDYHGRVPPPPRAVIPLKRPRVAVTTTRRGKGVFSMKGGSRSTASGSTGSKLKSDELQTIKKELTQIKTKIDSLLGRLEKIEKQQKAEAEAQKKQLEESLVLIQEECVSEIADHSTEEPAEGGPDADGEEMTDGIEEDFDEDGGHELFLQIK

SEQ ID NO: 34548 - protein, 291 aa, Homo sapiens; identical to SEQ ID NO: 34547
  ENSP00000428667

SEQ ID NO: 34549 - protein, 291 aa, Homo sapiens; identical to SEQ ID NO: 34547
  ENSP00000430367

SEQ ID NO: 34550 - protein, 280 aa, Homo sapiens
  ENSP00000430065
MTGKTQTSNVTNKNDPKSINSRVFIGNLNTAIVKKVDIEAIFSKYGKIVGCSVHKGYAFVQYMSERHARAAVAGENARVIAGQPLDINMAGEPKPYRPKPGNKRPLSALYSGYVFDYDYYRDDFYNRLFDYHGRVPPPPRAVIPLKRPRVAVTTTRRGKGVFSMKGGSRSTASGSTGSKLKSDELQTIKKELTQIKTKIDSLLGRLEKIEKQQKAEAEAQKKQLEESLVLIQEECVSEIADHSTEEPAEGGPDADGEEMTDGIEEDFDEDGGHELFLQIK

SEQ ID NO: 34551 - protein, 85 aa, Homo sapiens; identical to SEQ ID NO: 34546
  ENSP00000428711

SEQ ID NO: 34552 - protein, 304 aa, Homo sapiens
  ENSP00000430128
MSKRRRLKQGEPIMTGKTQTSNVTNKNDPKSINSRVFIGNLNTAIVKKVDIEAIFSKYGKIVGCSVHKGYAFVQYMSERHARAAVAGENARVIAGQPLDINMAGEPKPYRPKPGNKRPLSALYRLESKEPFLSVGGYVFDYDYYRDDFYNRLFDYHGRVPPPPRAVIPLKRPRVAVTTTRRGKGVFSMKGGSRSTASGSTGSKLKSDELQTIKKELTQIKTKIDSLLGRLEKIEKQQKAEAEAQKKQLEESLVLIQEECVSEIADHSTEEPAEGGPDADGEEMTDGIEEDFDEDGGHELFLQIK

SEQ ID NO: 34553 - protein, 47 aa, Homo sapiens
  ENSP00000429284
MTGKTQTSNVTNKNDPKSINSRVFIGNLNTAIVKKVDIEAIFSKYGK

SEQ ID NO: 34554 - protein, 218 aa, Homo sapiens
  ENSP00000428807
MTMYKSKRRHQRYINMAGEPKPYRPKPGNKRPLSALYRLESKEPFLSVGGYVFDYDYYRDDFYNRLFDYHGRVPPPPRAVIPLKRPRVAVTTTRRGKGVFSMKGGSRSTASGSTGSKLKSDELQTIKKELTQIKTKIDSLLGRLEKIEKQQKAEAEAQKKQLEESLVLIQEECVSEIADHSTEEPAEGGPDADGEEMTDGIEEDFDEDGGHELFLQIK

SEQ ID NO: 34555 - protein, 146 aa, Homo sapiens
  ENSP00000428310
MTMYKSKRRHQRYINMAGEPKPYRPKPGNKRPLSALYRLESKEPFLSVGLFDYHGRVPPPPRAVIPLKRPRVAVTTTRRGKGVFSMKGGSRSTASGSTGSKLKSDELQTIKKELTQIKTKIDSLLGRLEKIEKQQKAEAVSTDKVI

SEQ ID NO: 34556 - protein, 126 aa, Homo sapiens
  ENSP00000384688
MTTACQEANYGALLRELCLTQFQVDMEAVGETLWCDWGRTIRSYRELADCTWHMAEKLGCFWPNAEVDRFFLAVHGRYFRSCPISGRAVRDPPGSILYPFIVVPITVTLLVTALVVWQSKRTEGIV

SEQ ID NO: 34557 - protein, 148 aa, Homo sapiens
  ENSP00000254661
MARALCRLPRRGLWLLLAHHLFMTTACQEANYGALLRELCLTQFQVDMEAVGETLWCDWGRTIRSYRELADCTWHMAEKLGCFWPNAEVDRFFLAVHGRYFRSCPISGRAVRDPPGSILYPFIVVPITVTLLVTALVVWQSKRTEGIV

SEQ ID NO: 34558 - protein, 126 aa, Homo sapiens; identical to SEQ ID NO: 34556
  ENSP00000386720

SEQ ID NO: 34559 - protein, 126 aa, Homo sapiens; identical to SEQ ID NO: 34556
  ENSP00000386046

SEQ ID NO: 34560 - protein, 100 aa, Homo sapiens
  ENSP00000467463
MDPIEKDWCDWAMISRPYSTLRDCLEHFAELFDLGFPNPLAERIIFETHQIHFANCSLVQPTFSDPPEDVLLAMIIAPICLIPFLITLVVWRSKDSEAQA

SEQ ID NO: 34561 - protein, 49 aa, Homo sapiens
  ENSP00000466980
MDPIEKDWCDWAMISRPYSTLRDCLEHFAELFDLGFPNPLAERIIFETH

SEQ ID NO: 34562 - protein, 175 aa, Homo sapiens
  ENSP00000253796
MASLRVERAGGPRLPRTRVGRPAALRLLLLLGAVLNPHEALAQPLPTTGTPGSEGGTVKNYETAVQFCWNHYKDQMDPIEKDWCDWAMISRPYSTLRDCLEHFAELFDLGFPNPLAERIIFETHQIHFANCSLVQPTFSDPPEDVLLAMIIAPICLIPFLITLVVWRSKDSEAQA

SEQ ID NO: 34563 - protein, 180 aa, Homo sapiens
  ENSP00000466455
MASLRVERAGGPRLPRTRVGRPAALRLLLLLGAVLNPHEALAQPLPTTGTPGSEASVPTGGTVKNYETAVQFCWNHYKDQMDPIEKDWCDWAMISRPYSTLRDCLEHFAELFDLGFPNPLAERIIFETHQIHFANCSLVQPTFSDPPEDVLLAMIIAPICLIPFLITLVVWRSKDSEAQA

SEQ ID NO: 34564 - protein, 112 aa, Homo sapiens
  ENSP00000465725
MASLRVERAGGPRLPRTRVGRPAALRLLLLLGAVLNPHEALAQPLPTTGTPGSEGLIAPCEIAWSTLQSCLTWASPIPWQRGSSLRLTRSTLPTAPWCSPPSLTPQRMYSWP

SEQ ID NO: 34565 - protein, 3224 aa, Homo sapiens
  ENSP00000283195
MRRSKADVERYIASVQGSTPSPRQKSMKGFYFAKLYYEAKEYDLAKKYICTYINVQERDPKAHRFLGLLYELEENTDKAVECYRRSVELNPTQKDLVLKIAELLCKNDVTDGRAKYWLERAAKLFPGSPAIYKLKEQLLDCEGEDGWNKLFDLIQSELYVRPDDVHVNIRLVEVYRSTKRLKDAVAHCHEAERNIALRSSLEWNSCVVQTLKEYLESLQCLESDKSDWRATNTDLLLAYANLMLLTLSTRDVQESRELLQSFDSALQSVKSLGGNDELSATFLEMKGHFYMHAGSLLLKMGQHSSNVQWRALSELAALCYLIAFQVPRPKIKLIKGEAGQNLLEMMACDRLSQSGHMLLNLSRGKQDFLKEIVETFANKSGQSALYDALFSSQSPKDTSFLGSDDIGNIDVREPELEDLTRYDVGAIRAHNGSLQHLTWLGLQWNSLPALPGIRKWLKQLFHHLPHETSRLETNAPESICILDLEVFLLGVVYTSHLQLKEKCNSHHSSYQPLCLPLPVCKQLCTERQKSWWDAVCTLIHRKAVPGNVAKLRLLVQHEINTLRAQEKHGLQPALLVHWAECLQKTGSGLNSFYDQREYIGRSVHYWKKVLPLLKIIKKKNSIPEPIDPLFKHFHSVDIQASEIVEYEEDAHITFAILDAVNGNIEDAVTAFESIKSVVSYWNLALIFHRKAEDIENDALSPEEQEECKNYLRKTRDYLIKIIDDSDSNLSVVKKLPVPLESVKEMLNSVMQELEDYSEGGPLYKNGSLRNADSEIKHSTPSPTRYSLSPSKSYKYSPKTPPRWAEDQNSLLKMICQQVEAIKKEMQELKLNSSNSASPHRWPTENYGPDSVPDGYQGSQTFHGAPLTVATTGPSVYYSQSPAYNSQYLLRPAANVTPTKGPVYGMNRLPPQQHIYAYPQQMHTPPVQSSSACMFSQEMYGPPALRFESPATGILSPRGDDYFNYNVQQTSTNPPLPEPGYFTKPPIAAHASRSAESKTIEFGKTNFVQPMPGEGLRPSLPTQAHTTQPTPFKFNSNFKSNDGDFTFSSPQVVTQPPPAAYSNSESLLGLLTSDKPLQGDGYSGAKPIPGGQTIGPRNTFNFGSKNVSGISFTENMGSSQQKNSGFRRSDDMFTFHGPGKSVFGTPTLETANKNHETDGGSAHGDDDDDGPHFEPVVPLPDKIEVKTGEEDEEEFFCNRAKLFRFDVESKEWKERGIGNVKILRHKTSGKIRLLMRREQVLKICANHYISPDMKLTPNAGSDRSFVWHALDYADELPKPEQLAIRFKTPEEAALFKCKFEEAQSILKAPGTNVAMASNQAVRIVKEPTSHDNKDICKSDAGNLNFEFQVAKKEGSWWHCNSCSLKNASTAKKCVSCQNLNPSNKELVGPPLAETVFTPKTSPENVQDRFALVTPKKEGHWDCSICLVRNEPTVSRCIACQNTKSANKSGSSFVHQASFKFGQGDLPKPINSDFRSVFSTKEGQWDCSACLVQNEGSSTKCAACQNPRKQSLPATSIPTPASFKFGTSETSKTLKSGFEDMFAKKEGQWDCSSCLVRNEANATRCVACQNPDKPSPSTSVPAPASFKFGTSETSKAPKSGFEGMFTKKEGQWDCSVCLVRNEASATKCIACQNPGKQNQTTSAVSTPASSETSKAPKSGFEGMFTKKEGQWDCSVCLVRNEASATKCIACQNPGKQNQTTSAVSTPASSETSKAPKSGFEGMFTKKEGQWDCSVCLVRNEASATKCIACQCPSKQNQTTAISTPASSEISKAPKSGFEGMFIRKGQWDCSVCCVQNESSSLKCVACDASKPTHKPIAEAPSAFTLGSEMKLHDSSGSQVGTGFKSNFSEKASKFGNTEQGFKFGHVDQENSPSFMFQGSSNTEFKSTKEGFSIPVSADGFKFGISEPGNQEKKSEKPLENGTGFQAQDISGQKNGRGVIFGQTSSTFTFADLAKSTSGEGFQFGKKDPNFKGFSGAGEKLFSSQYGKMANKANTSGDFEKDDDAYKTEDSDDIHFEPVVQMPEKVELVTGEEDEKVLYSQRVKLFRFDAEVSQWKERGLGNLKILKNEVNGKLRMLMRREQVLKVCANHWITTTMNLKPLSGSDRAWMWLASDFSDGDAKLEQLAAKFKTPELAEEFKQKFEECQRLLLDIPLQTPHKLVDTGRAAKLIQRAEEMKSGLKDFKTFLTNDQTKVTEEENKGSGTGAAGASDTTIKPNPENTGPTLEWDNYDLREDALDDSVSSSSVHASPLASSPVRKNLFRFGESTTGFNFSFKSALSPSKSPAKLNQSGTSVGTDEESDVTQEEERDGQYFEPVVPLPDLVEVSSGEENEQVVFSHRAKLYRYDKDVGQWKERGIGDIKILQNYDNKQVRIVMRRDQVLKLCANHRITPDMTLQNMKGTERVWLWTACDFADGERKVEHLAVRFKLQDVADSFKKIFDEAKTAQEKDSLITPHVSRSSTPRESPCGKIAVAVLEETTRERTDVIQGDDVADATSEVEVSSTSETTPKAVVSPPKFVFGSESVKSIFSSEKSKPFAFGNSSATGSLFGFSFNAPLKSNNSETSSVAQSGSESKVEPKKCELSKNSDIEQSSDSKVKNLFASFPTEESSINYTFKTPEKAKEKKKPEDSPSDDDVLIVYELTPTAEQKALATKLKLPPTFFCYKNRPDYVSEEEEDDEDFETAVKKLNGKLYLDGSEKCRPLEENTADNEKECIIVWEKKPTVEEKAKADTLKLPPTFFCGVCSDTDEDNGNGEDFQSELQKVQEAQKSQTEEITSTTDSVYTGGTEVMVPSFCKSEEPDSITKSISSPSVSSETMDKPVDLSTRKEIDTDSTSQGESKIVSFGFGSSTGLSFADLASSNSGDFAFGSKDKNFQWANTGAAVFGTQSVGTQSAGKVGEDEDGSDEEVVHNEDIHFEPIVSLPEVEVKSGEEDEEILFKERAKLYRWDRDVSQWKERGVGDIKILWHTMKNYYRILMRRDQVFKVCANHVITKTMELKPLNVSNNALVWTASDYADGEAKVEQLAVRFKTKEVADCFKKTFEECQQNLMKLQKGHVSLAAELSKETNPVVFFDVCADGEPLGRITMELFSNIVPRTAENFRALCTGEKGFGFKNSIFHRVIPDFVCQGGDITKHDGTGGQSIYGDKFEDENFDVKHTGPGLLSMANQGQNTNNSQFVITLKKAEHLDFKHVVFGFVKDGMDTVKKIESFGSPKGSVCRRITITECGQI

SEQ ID NO: 34566 - protein, 51 aa, Homo sapiens
  ENSP00000398970
MRRSKADVERYIASVQGSTPSPRQKSMKGFYFAKLYYEAKEYDLAKNVQWN

SEQ ID NO: 34567 - protein, 51 aa, Homo sapiens; identical to SEQ ID NO: 34566
  ENSP00000485979

SEQ ID NO: 34568 - protein, 465 aa, Homo sapiens
  ENSP00000296604
MTTIPRKGSSHLPGSLHTCKLKLQEDRRQQEKSVIAQPIFVFEKGEQTFKRPAEDTLYEAAEPECNGFPTKRVRSSSFTFHITDSQSQGVRKNNVFMTSALVQSSVDIKSAEQGPVKHSKHVIRPAILQLPQARSCAKVRKTFGHKALESCKTKEKTNNKISEGNSYLLSENLSRARISVQLSTNQDFLGATSVGCQPNEDKCSFKSCSSNFVFGENMVERVLGTQKLTQPQLENDSYAKEKPFKSIPKFPVNFLSSRTDSIKNTSLIESAAAFSSQPSRKCLLEKIDVITGEETEHNVLKINCKLFIFNKTTQSWIERGRGTLRLNDTASTDCGTLQSRLIMRNQGSLRLILNSKLWAQMKIQRANHKNVRITATDLEDYSIKIFLIQASAQDTAYLYAAIHHRLVALQSFNKQRDVNQAESLSETAQQLNCESCDENEDDFIQVTKNGSDPSSWTHRQSVACS

SEQ ID NO: 34569 - protein, 490 aa, Homo sapiens
  ENSP00000421853
MTTIPRKGSSHLPGSLHTCKLKLQEDRRQQEKSVIAQPIFVFEKGEQTFKRPAEDTLYEAAEPECNGFPTKRVRSSSFTFHITDSQSQGVSTLSQKQMRCSSVTNLPTFPHSGPVRKNNVFMTSALVQSSVDIKSAEQGPVKHSKHVIRPAILQLPQARSCAKVRKTFGHKALESCKTKEKTNNKISEGNSYLLSENLSRARISVQLSTNQDFLGATSVGCQPNEDKCSFKSCSSNFVFGENMVERVLGTQKLTQPQLENDSYAKEKPFKSIPKFPVNFLSSRTDSIKNTSLIESAAAFSSQPSRKCLLEKIDVITGEETEHNVLKINCKLFIFNKTTQSWIERGRGTLRLNDTASTDCGTLQSRLIMRNQGSLRLILNSKLWAQMKIQRANHKNVRITATDLEDYSIKIFLIQASAQDTAYLYAAIHHRLVALQSFNKQRDVNQAESLSETAQQLNCESCDENEDDFIQVTKNGSDPSSWTHRQSVACS

SEQ ID NO: 34570 - protein, 321 aa, Homo sapiens
  ENSP00000421149
MTTIPRKGSSHLPGSLHTCKLKLQEDRRQQEKSVIAQPIFVFEKGEQTFKRPAEDTLYEAAEPECNGFPTKRVRSSSFTFHITDSQSQGVRKNNVFMTSALVQSSVDIKSAEQGPVKHSKHVIRPAILQLPQARSCAKVRKTFGHKALESCKTKEKTNNKISEGNSYLLSENLSRARISVQLSTNQDFLGATSVGCQPNEDKCSFKSCSSNFVFGENMVERVLGTQKLTQPQLENDSYAKEKPFKSIPKFPVNFLSSRTDSIKNTSLIESAAAFSSQPSRKCLLEKIDVITGEETEHNVLKVCISCFTLSGSIYILGIKLT

SEQ ID NO: 34571 - protein, 108 aa, Homo sapiens
  ENSP00000427147
MTTIPRKGSSHLPGSLHTCKLKLQEDRRQQEKSVIAQPIFVFEKGEQTFKRPAEDTLYEAAEPECNGFPTKRVRSSSFTFHITDSQSQGVRKNNVFMTSALVQSSVDI

SEQ ID NO: 34572 - protein, 923 aa, Homo sapiens
  ENSP00000395708
MKVGWPGESCWQVGLAVEDSPALGAPRVGALPDVVPEGTLLNMVLRRMHRPRSCSYQLLLEHQRPSCIQGLRWTPLTNSEESLDFSESLEQASTERVLRAGRQLHRHLLATCPNLIRDRKYHLRLYRQCCSGRELVDGILALGLGVHSRSQVVGICQVLLDEGALCHVKHDWAFQDRDAQFYRFPGPEPEPVRTHEMEEELAEAVALLSQRGPDALLTVALRKPPGQRTDEELDLIFEELLHIKAVAHLSNSVKRELAAVLLFEPHSKAGTVLFSQGDKGTSWYIIWKGSVNVVTHGKGLVTTLHEGDDFGQLALVNDAPRAATIILREDNCHFLRVDKQDFNRIIKDVEAKTMRLEEHGKVVLVLERASQGAGPSRPPTPGRNRYTVMSGTPEKILELLLEAMGPDSSAHDPTETFLSDFLLTHRVFMPSAQLCAALLHHFHVEPAGGSEQERSTYVCNKRQQILRLVSQWVALYGSMLHTDPVATSFLQKLSDLVGRDTRLSNLLREQWPERRRCHRLENGCGNASPQMKARNLPVWLPNQDEPLPGSSCAIQVGDKVPYDICRPDHSVLTLQLPVTASVREVMAALAQEDGWTKGQVLVKVNSAGDAIGLQPDARGVATSLGLNERLFVVNPQEVHELIPHPDQLGPTVGSAEGLDLVSAKDLAGQLTDHDWSLFNSIHQVELIHYVLGPQHLRDVTTANLERFMRRFNELQYWVATELCLCPVPGPRAQLLRKFIKLAAHLKEQKNLNSFFAVMFGLSNSAISRLAHTWERLPHKVRKLYSALERLLDPSWNHRVYRLALAKLSPPVIPFMPLLLKDMTFIHEGNHTLVENLINFEKMRMMARAARMLHHCRSHNPVPLSPLRSRVSHLHEDSQVARISTCSEQSLSTRSPASTWAYVQQLKVIDNQRELSRLSRELEP

SEQ ID NO: 34573 - protein, 79 aa, Homo sapiens
  ENSP00000449905
MKVGWPGESCWQVGLAVEDSPALGAPRVGALPDVVPEGTLLNMVLRRMHRPRSCSYQLLLEHQRPSCIQGLRWPRSAHG

SEQ ID NO: 34574 - protein, 881 aa, Homo sapiens
  ENSP00000448619
MVLRRMHRPRSCSYQLLLEHQRPSCIQGLRWTPLTNSEESLDFSESLEQASTERVLRAGRQLHRHLLATCPNLIRDRKYHLRLYRQCCSGRELVDGILALGLGVHSRSQVVGICQVLLDEGALCHVKHDWAFQDRDAQFYRFPGPEPEPVRTHEMEEELAEAVALLSQRGPDALLTVALRKPPGQRTDEELDLIFEELLHIKAVAHLSNSVKRELAAVLLFEPHSKAGTVLFSQGDKGTSWYIIWKGSVNVVTHGKGLVTTLHEGDDFGQLALVNDAPRAATIILREDNCHFLRVDKQDFNRIIKDVEAKTMRLEEHGKVVLVLERASQGAGPSRPPTPGRNRYTVMSGTPEKILELLLEAMGPDSSAHDPTETFLSDFLLTHRVFMPSAQLCAALLHHFHVEPAGGSEQERSTYVCNKRQQILRLVSQWVALYGSMLHTDPVATSFLQKLSDLVGRDTRLSNLLREQWPERRRCHRLENGCGNASPQMKARNLPVWLPNQDEPLPGSSCAIQVGDKVPYDICRPDHSVLTLQLPVTASVREVMAALAQEDGWTKGQVLVKVNSAGDAIGLQPDARGVATSLGLNERLFVVNPQEVHELIPHPDQLGPTVGSAEGLDLVSAKDLAGQLTDHDWSLFNSIHQVELIHYVLGPQHLRDVTTANLERFMRRFNELQYWVATELCLCPVPGPRAQLLRKFIKLAAHLKEQKNLNSFFAVMFGLSNSAISRLAHTWERLPHKVRKLYSALERLLDPSWNHRVYRLALAKLSPPVIPFMPLLLKDMTFIHEGNHTLVENLINFEKMRMMARAARMLHHCRSHNPVPLSPLRSRVSHLHEDSQVARISTCSEQSLSTRSPASTWAYVQQLKVIDNQRELSRLSRELEP

SEQ ID NO: 34575 - protein, 923 aa, Homo sapiens; identical to SEQ ID NO: 34572
  ENSP00000373864

SEQ ID NO: 34576 - protein, 814 aa, Homo sapiens
  ENSP00000448480
MVLRRMHRPRSCSYQLLLEHQRPSCIQGLRWTPLTNSEESLDFSESLEQASTERVLRAGRQLHRHLLATCPNLIRDRKYHLRLYRQCCSGRELVDGILALGLGVHSRSQVVGICQVLLDEGALCHVKHDWAFQDRDAQFYRFPGPEPEPVRTHEMEEELAEAVALLSQRGPDALLTVALRKPPGQRTDEELDLIFEELLHIKAVAHLSNSVKRELAAVLLFEPHSKAGTVLFSQGDKGTSWYIIWKGSVNVVTHGKGLVTTLHEGDDFGQLALVNDAPRAATIILREDNCHFLRVDKQDFNRIIKDVEAKTMRLEEHGKVVLVLERASQGAGPSRPPTPGRNRYTVMSGTPEKILELLLEAMGPDSSAHDPTETFLSDFLLTHRVFMPSAQLCAALLHHFHVEPAGGSEQERSTYVCNKRQQILRLVSQWVALYGSMLHTDPVATSFLQKLSDLVGRDTRLSNLLREQWPERRRCHRLENGCGNASPQMKARNLPVWLPNQDEPLPGSSCAIQVGDKDAIGLQPDARGVATSLGLNERLFVVNPQEVHELIPHPDQLGPTVGSAEGLDLVSAKDLAGQLTDHDWSLFNSIHQVELIHYVLGPQHLRDVTTANLERFMRRFNELQYWVATELCLCPVPGPRAQLLRKFIKLAAHNSAISRLAHTWERLPHKVRKLYSALERLLDPSWNHRVYRLALAKLSPPVIPFMPLLLKDMTFIHEGNHTLVENLINFEKMRMMARAARMLHHCRSHNPVPLSPLRSRVSHLHEDSQVARISTCSEQSLSTRSPASTWAYVQQLKVIDNQRELSRLSRELEP

SEQ ID NO: 34577 - protein, 184 aa, Homo sapiens
  ENSP00000447691
  MOD_RES (1)..(1): Any amino acid
XAIGLQPDARGVATSLGLNERLFVVNPQEVHELIPHPDQLGPTVGSAEGLDLVSAKDLAGQLTDHDWSLFNSIHQVELIHYVLGPQHLRDVTTANLERFMRRFNELQYWVATELCLCPVPGPRAQLLRKFIKLAAHLKEQKNLNSFFAVMFGLSNSAISRLAHTWERLPHKVRKLYSALERLLC

SEQ ID NO: 34578 - protein, 598 aa, Homo sapiens
  ENSP00000378764
MKVGWPGESCWQVGLAVEDSPALGAPRVGALPDVVPEGTLLNMVLRRMHRPRSCSYQLLLEHQRPSCIQGLRWTPLTNSEESLDFSESLEQASTERVLRAGRQLHRHLLATCPNLIRDRKYHLRLYRQCCSGRELVDGILALGLGVHSRSQVVGICQVLLDEGALCHVKHDWAFQDRDAQFYRFPGPEPEPVRTHEMEEELAEAVALLSQRGPDALLTVALRKPPGQRTDEELDLIFEELLHIKAVAHLSNSVKRELAAVLLFEPHSKAGTVLFSQGDKGTSWYIIWKGSVNVVTHGKGLVTTLHEGDDFGQLALVNDAPRAATIILREDNCHFLRVDKQDFNRIIKDVEAKTMRLEEHGKVVLVLERASQGAGPSRPPTPGRNRYTVMSGTPEKILELLLEAMGPDSSAHDPTETFLSDFLLTHRVFMPSAQLCAALLHHFHVEPAGGSEQERSTYVCNKRQQILRLVSQWVALYGSMLHTDPVATSFLQKLSDLVGRDTRLSNLLREQWPERRRCHRLENGCGNASPQMKVSAWPQFLSSAPPGLQAPPSPPDPEGLCGRGKLSSHRHTLGSLIGVHGALAACGALGQAVPGGAEA

SEQ ID NO: 34579 - protein, 108 aa, Homo sapiens
  ENSP00000449818
FPGPEPEPVRTHEMEEELAEAVALLSQRGPDALLTVALRKPPGQRTDEELDLIFEELLHIKAVAHLSNSVKRELAAVLLFEPHSKAGTVSRGTRALRGTLSGRDLSTW

SEQ ID NO: 34580 - protein, 222 aa, Homo sapiens
  ENSP00000446731
MVLRRMHRPRSCSYQLLLEHQRPSCIQGLRWTPLTNSEESLDFSESLEQASTERVLRAGRQLHRHLLATCPNLIRDRKYHLRLYRQCCSGRELVDGILALGLGVHSRSQVVGICQVLLDEGALCHVKHDWAFQDRDAQFYRFPGPEPEPVRTHEMEEELAEAVALLSQRGPDALLTVALRKPPGQRTDEELDLIFEELLHIKAVAHLSNSVKRELAAVLLFE

SEQ ID NO: 34581 - protein, 141 aa, Homo sapiens
  ENSP00000448804
MVLRRMHRPRSCSYQLLLEHQRPSCIQGLRWTPLTNSEESLDFSESLEQASTERVLRAGRQLHRHLLATCPNLIRDRKYHLRLYRQCCSGRELVDGILALGLGVHSRSQVVGICQVLLDEGALCHVKHDWAFQDRDAQFYR

SEQ ID NO: 34582 - protein, 881 aa, Homo sapiens; identical to SEQ ID NO: 34574
  ENSP00000384521

SEQ ID NO: 34583 - protein, 1011 aa, Homo sapiens
  ENSP00000380271
MVAAHAAHSSSSAEWIACLDKRPLERSSEDVDIIFTRLKEVKAFEKFHPNLLHQICLCGYYENLEKGITLFRQGDIGTNWYAVLAGSLDVKVSETSSHQDAVTICTLGIGTAFGESILDNTPRHATIVTRESSELLRIEQKDFKALWEKYRQYMAGLLAPPYGVMETGSNNDRIPDKENTPLIEPHVPLRPANTITKVPSEKILRAGKILRNAILSRAPHMIRDRKYHLKTYRQCCVGTELVDWMMQQTPCVHSRTQAVGMWQVLLEDGVLNHVDQEHHFQDKYLFYRFLDDEHEDAPLPTEEEKKECDEELQDTMLLLSQMGPDAHMRMILRKPPGQRTVDDLEIIYEELLHIKALSHLSTTVKRELAGVLIFESHAKGGTVLFNQGEEGTSWYIILKGSVNVVIYGKGVVCTLHEGDDFGKLALVNDAPRAASIVLREDNCHFLRVDKEDFNRILRDVEANTVRLKEHDQDVLVLEKVPAGNRASNQGNSQPQQKYTVMSGTPEKILEHFLETIRLEATLNEATDSVLNDFIMMHCVFMPNTQLCPALVAHYHAQPSQGTEQEKMDYALNNKRRVIRLVLQWAAMYGDLLQEDDVSMAFLEEFYVSVSDDARMIAALKEQLPELEKIVKQISEDAKAPQKKHKVLLQQFNTGDERAQKRQPIRGSDEVLFKVYCMDHTYTTIRVPVATSVKEVISAVADKLGSGEGLIIVKMSSGGEKVVLKPNDVSVFTTLTINGRLFACPREQFDSLTPLPEQEGPTVGTVGTFELMSSKDLAYQMTIYDWELFNCVHELELIYHTFGRHNFKKTTANLDLFLRRFNEIQFWVVTEICLCSQLSKRVQLLKKFIKIAAHCKEYKNLNSFFAIVMGLSNVAVSRLALTWEKLPSKFKKFYAEFESLMDPSRNHRAYRLTVAKLEPPLIPFMPLLIKDMTFTHEGNKTFIDNLVNFEKMRMIANTARTVRYYRSQPFNPDAAQANKNHQDVRSYVRQLNVIDNQRTLSQMSHRLEPRRP

SEQ ID NO: 34584 - protein, 943 aa, Homo sapiens
  ENSP00000387104
MVAAHAAHSSSSAEWIACLDKRPLERSSEDVDIIFTRLKEVKAFEKFHPNLLHQICLCGYYENLEKGITLFRQGDIGTNWYAVLAGSLDVKVSETSSHQDAVTICTLGIGTAFGESILDNTPRHATIVTRESSELLRIEQKDFKALWEKYRQYMAGLLAPPYGVMETGSNNDRIPDKENTPLIEPHVPLRPANTITKVPSEKILRAGKILRNAILSRAPHMIRDRKYHLKTYRQCCVGTELVDWMMQQTPCVHSRTQAVGMWQVLLEDGVLNHVDQEHHFQDKYLFYRFLDDEHEDAPLPTEEEKKECDEELQDTMLLLSQMGPDAHMRMILRKPPGQRTVDDLEIIYEELLHIKALSHLSTTVKRELAGVLIFESHAKGGTVLFNQGEEGTSWYIILKGSVNVVIYGKGVVCTLHEGDDFGKLALVNDAPRAASIVLREDNCHFLRVDKEDFNRILRDVEANTVRLKEHDQDVLVLEKVPAGNRASNQGNSQPQQKYTVMSGTPEKILEHFLETIRLEATLNEATDSVLNDFIMMHCVFMPNTQLCPALVAHYHAQPSQGTEQEKMDYALNNKRRVIRLVLQWAAMYGDLLQEDDVSMAFLEEFYVSVSDDARMIAALKEQLPELEKIVKQISEDAKAPQKKHKVLLQQFNTGDERAQKRQPIRGSDEVLFKVYCMDHTYTTIRVPVATSVKEVISAVADKLGSGEGLIIVKMSSGGEKVVLKPNDVSVFTTLTINGRLFACPREQFDSLTPLPEQEGPTVGTVGTFELMSSKDLAYQMTIYDWELFNCVHELELIYHTFGRHNFKKTTANLDLFLRRFNEIQFWVVTEICLCSQLSKRVQLLKKFIKIAAHCKEYKNLNSFFAIVMGLSNVAVSRLALTWERMIANTARTVRYYRSQPFNPDAAQANKNHQDVRSYVRQLNVIDNQRTLSQMSHRLEPRRP

SEQ ID NO: 34585 - protein, 867 aa, Homo sapiens
  ENSP00000380276
MLYKKYRQYMAGLLAPPYGVMETGSNNDRIPDKENTPLIEPHVPLRPANTITKVPSEKILRAGKILRNAILSRAPHMIRDRKYHLKTYRQCCVGTELVDWMMQQTPCVHSRTQAVGMWQVLLEDGVLNHVDQEHHFQDKYLFYRFLDDEHEDAPLPTEEEKKECDEELQDTMLLLSQMGPDAHMRMILRKPPGQRTVDDLEIIYEELLHIKALSHLSTTVKRELAGVLIFESHAKGGTVLFNQGEEGTSWYIILKGSVNVVIYGKGVVCTLHEGDDFGKLALVNDAPRAASIVLREDNCHFLRVDKEDFNRILRDVEANTVRLKEHDQDVLVLEKVPAGNRASNQGNSQPQQKYTVMSGTPEKILEHFLETIRLEATLNEATDSVLNDFIMMHCVFMPNTQLCPALVAHYHAQPSQGTEQEKMDYALNNKRRVIRLVLQWAAMYGDLLQEDDVSMAFLEEFYVSVSDDARMIAALKEQLPELEKIVKQISEDAKAPQKKHKVLLQQFNTGDERAQKRQPIRGSDEVLFKVYCMDHTYTTIRVPVATSVKEVISAVADKLGSGEGLIIVKMSSGGEKVVLKPNDVSVFTTLTINGRLFACPREQFDSLTPLPEQEGPTVGTVGTFELMSSKDLAYQMTIYDWELFNCVHELELIYHTFGRHNFKKTTANLDLFLRRFNEIQFWVVTEICLCSQLSKRVQLLKKFIKIAAHCKEYKNLNSFFAIVMGLSNVAVSRLALTWEKLPSKFKKFYAEFESLMDPSRNHRAYRLTVAKLEPPLIPFMPLLIKDMTFTHEGNKTFIDNLVNFEKMRMIANTARTVRYYRSQPFNPDAAQANKNHQDVRSYVRQLNVIDNQRTLSQMSHRLEPRRP

SEQ ID NO: 34586 - protein, 187 aa, Homo sapiens
  ENSP00000380274
LMSSKDLAYQMTIYDWELFNCVHELELIYHTFGRHNFKKTTANLDLFLRRFNEIQFWVVTEICLCSQLSKRVQLLKKFIKIAAHCKEYKNLNSFFAIVMGLSNVAVSRLALTWEKLPSKFKKFYAEFESLMDPSRNHRAYRLTVAKLEPPLIPFMPLLIKDMTFTHEGNKTFIDNLVNFEKMVCAVL

SEQ ID NO: 34587 - protein, 791 aa, Homo sapiens
  ENSP00000438011
MIRDRKYHLKTYRQCCVGTELVDWMMQQTPCVHSRTQAVGMWQVLLEDGVLNHVDQEHHFQDKYLFYRFLDDEHEDAPLPTEEEKKECDEELQDTMLLLSQMGPDAHMRMILRKPPGQRTVDDLEIIYEELLHIKALSHLSTTVKRELAGVLIFESHAKGGTVLFNQGEEGTSWYIILKGSVNVVIYGKGVVCTLHEGDDFGKLALVNDAPRAASIVLREDNCHFLRVDKEDFNRILRDVEANTVRLKEHDQDVLVLEKVPAGNRASNQGNSQPQQKYTVMSGTPEKILEHFLETIRLEATLNEATDSVLNDFIMMHCVFMPNTQLCPALVAHYHAQPSQGTEQEKMDYALNNKRRVIRLVLQWAAMYGDLLQEDDVSMAFLEEFYVSVSDDARMIAALKEQLPELEKIVKQISEDAKAPQKKHKVLLQQFNTGDERAQKRQPIRGSDEVLFKVYCMDHTYTTIRVPVATSVKEVISAVADKLGSGEGLIIVKMSSGGEKVVLKPNDVSVFTTLTINGRLFACPREQFDSLTPLPEQEGPTVGTVGTFELMSSKDLAYQMTIYDWELFNCVHELELIYHTFGRHNFKKTTANLDLFLRRFNEIQFWVVTEICLCSQLSKRVQLLKKFIKIAAHCKEYKNLNSFFAIVMGLSNVAVSRLALTWEKLPSKFKKFYAEFESLMDPSRNHRAYRLTVAKLEPPLIPFMPLLIKDMTFTHEGNKTFIDNLVNFEKMRMIANTARTVRYYRSQPFNPDAAQANKNHQDVRSYVRQLNVIDNQRTLSQMSHRLEPRRP

SEQ ID NO: 34588 - protein, 858 aa, Homo sapiens
  ENSP00000440250
MAGLLAPPYGVMETGSNNDRIPDKENTPLIEPHVPLRPANTITKVPSEKILRAGKILRNAILSRAPHMIRDRKYHLKTYRQCCVGTELVDWMMQQTPCVHSRTQAVGMWQVLLEDGVLNHVDQEHHFQDKYLFYRFLDDEHEDAPLPTEEEKKECDEELQDTMLLLSQMGPDAHMRMILRKPPGQRTVDDLEIIYEELLHIKALSHLSTTVKRELAGVLIFESHAKGGTVLFNQGEEGTSWYIILKGSVNVVIYGKGVVCTLHEGDDFGKLALVNDAPRAASIVLREDNCHFLRVDKEDFNRILRDVEANTVRLKEHDQDVLVLEKVPAGNRASNQGNSQPQQKYTVMSGTPEKILEHFLETIRLEATLNEATDSVLNDFIMMHCVFMPNTQLCPALVAHYHAQPSQGTEQEKMDYALNNKRRVIRLVLQWAAMYGDLLQEDDVSMAFLEEFYVSVSDDARMIAALKEQLPELEKIVKQISEDAKAPQKKHKVLLQQFNTGDERAQKRQPIRGSDEVLFKVYCMDHTYTTIRVPVATSVKEVISAVADKLGSGEGLIIVKMSSGGEKVVLKPNDVSVFTTLTINGRLFACPREQFDSLTPLPEQEGPTVGTVGTFELMSSKDLAYQMTIYDWELFNCVHELELIYHTFGRHNFKKTTANLDLFLRRFNEIQFWVVTEICLCSQLSKRVQLLKKFIKIAAHCKEYKNLNSFFAIVMGLSNVAVSRLALTWEKLPSKFKKFYAEFESLMDPSRNHRAYRLTVAKLEPPLIPFMPLLIKDMTFTHEGNKTFIDNLVNFEKMRMIANTARTVRYYRSQPFNPDAAQANKNHQDVRSYVRQLNVIDNQRTLSQMSHRLEPRRP

SEQ ID NO: 34589 - protein, 840 aa, Homo sapiens
  ENSP00000440135
MAGLLAPPYGVMETGSNNDRIPDKENVPSEKILRAGKILRNAILSRAPHMIRDRKYHLKTYRQCCVGTELVDWMMQQTPCVHSRTQAVGMWQVLLEDGVLNHVDQEHHFQDKYLFYRFLDDEHEDAPLPTEEEKKECDEELQDTMLLLSQMGPDAHMRMILRKPPGQRTVDDLEIIYEELLHIKALSHLSTTVKRELAGVLIFESHAKGGTVLFNQGEEGTSWYIILKGSVNVVIYGKGVVCTLHEGDDFGKLALVNDAPRAASIVLREDNCHFLRVDKEDFNRILRDVEANTVRLKEHDQDVLVLEKVPAGNRASNQGNSQPQQKYTVMSGTPEKILEHFLETIRLEATLNEATDSVLNDFIMMHCVFMPNTQLCPALVAHYHAQPSQGTEQEKMDYALNNKRRVIRLVLQWAAMYGDLLQEDDVSMAFLEEFYVSVSDDARMIAALKEQLPELEKIVKQISEDAKAPQKKHKVLLQQFNTGDERAQKRQPIRGSDEVLFKVYCMDHTYTTIRVPVATSVKEVISAVADKLGSGEGLIIVKMSSGGEKVVLKPNDVSVFTTLTINGRLFACPREQFDSLTPLPEQEGPTVGTVGTFELMSSKDLAYQMTIYDWELFNCVHELELIYHTFGRHNFKKTTANLDLFLRRFNEIQFWVVTEICLCSQLSKRVQLLKKFIKIAAHCKEYKNLNSFFAIVMGLSNVAVSRLALTWEKLPSKFKKFYAEFESLMDPSRNHRAYRLTVAKLEPPLIPFMPLLIKDMTFTHEGNKTFIDNLVNFEKMRMIANTARTVRYYRSQPFNPDAAQANKNHQDVRSYVRQLNVIDNQRTLSQMSHRLEPRRP

SEQ ID NO: 34590 - protein, 402 aa, Homo sapiens
  ENSP00000373282
MTTSGHACPVPAVNGHMTHYPATPYPLLFPPVIGGLSLPPLHGLHGHPPPSGCSTPSPATIETQSTSSEELVPSPPSPLPPPRVYKPCFVCQDKSSGYHYGVSACEGCKGFFRRSIQKNMIYTCHRDKNCVINKVTRNRCQYCRLQKCFEVGMSKESVRNDRNKKKKETSKQECTESYEMTAELDDLTEKIRKAHQETFPSLCQLGKYTTNSSADHRVRLDLGLWDKFSELATKCIIKIVEFAKRLPGFTGLTIADQITLLKAACLDILILRICTRYTPEQDTMTFSDGLTLNRTQMHNAGFGPLTDLVFTFANQLLPLEMDDTETGLLSAICLICGDRQDLEEPTKVDKLQEPLLEALKIYIRKRRPSKPHMFPKILMKITDLRSISAKGAERVITLKMEI

SEQ ID NO: 34591 - protein, 336 aa, Homo sapiens
  ENSP00000398840
MIYTCHRDKNCVINKVTRNRCQYCRLQKCFEVGMSKESVRNDRNKKKKETSKQECTESYEMTAELDDLTEKIRKAHQETFPSLCQLGKYTTNSSADHRVRLDLGLWDKFSELATKCIIKIVEFAKRLPGFTGLTIADQITLLKAACLDILILRICTRYTPEQDTMTFSDGLTLNRTQMHNAGFGPLTDLVFTFANQLLPLEMDDTETGLLSAICLICGDRQDLEEPTKVDKLQEPLLEALKIYIRKRRPSKPHMFPKILMKITDLRSISAKGAERVITLKMEIPGSMPPLIQEMLENSEGHEPLTPSSSGNTAEHSPSISPSSVENSGVSQSPLVQ

SEQ ID NO: 34592 - protein, 448 aa, Homo sapiens
  ENSP00000332296
MFDCMDVLSVSPGQILDFYTASPSSCMLQEKALKACFSGLTQTEWQHRHTAQSIETQSTSSEELVPSPPSPLPPPRVYKPCFVCQDKSSGYHYGVSACEGCKGFFRRSIQKNMIYTCHRDKNCVINKVTRNRCQYCRLQKCFEVGMSKESVRNDRNKKKKETSKQECTESYEMTAELDDLTEKIRKAHQETFPSLCQLGKYTTNSSADHRVRLDLGLWDKFSELATKCIIKIVEFAKRLPGFTGLTIADQITLLKAACLDILILRICTRYTPEQDTMTFSDGLTLNRTQMHNAGFGPLTDLVFTFANQLLPLEMDDTETGLLSAICLICGDRQDLEEPTKVDKLQEPLLEALKIYIRKRRPSKPHMFPKILMKITDLRSISAKGAERVITLKMEIPGSMPPLIQEMLENSEGHEPLTPSSSGNTAEHSPSISPSSVENSGVSQSPLVQ

SEQ ID NO: 34593 - protein, 336 aa, Homo sapiens; identical to SEQ ID NO: 34591
  ENSP00000391391

SEQ ID NO: 34594 - protein, 806 aa, Homo sapiens
  ENSP00000450244
MAKSSSLNVRVVEGRALPAKDVSGSSDPYCLVKVDDEVVARTATVWRSLGPFWGEEYTVHLPLDFHQLAFYVLDEDTVGHDDIIGKISLSREAITADPRGIDSWINLSRVDPDAEVQGEICLSVQMLEDGQGRCLRCHVLQARDLAPRDISGTSDPFARVFWGSQSLETSTIKKTRFPHWDEVLELREMPGAPSPLRVELWDWDMVGKNDFLGMVEFSPKTLQQKPPKGWFRLLPFPRAEEDSGGNLGALRVKVRLIEDRVLPSQCYQPLMELLMESVQGPAEEDTASPLALLEELTLGDCRQDLATKLVKLFLGRGLAGRFLDYLTRREVARTMDPNTLFRSNSLASKSMEQFMKLVGMPYLHEVLKPVISRVFEEKKYMELDPCKMDLGRTRRISFKGALSEEQMRETSLGLLTGYLGPIVDAIVGSVGRCPPAMRLAFKQLHRRVEERFPQAEHQQDVKYLAISGFLFLRFFAPAILTPKLFDLRDQHADPQTSRSLLLLAKAVQSIGNLGQQLGQGKELWMAPLHPFLLQCVSRVRDFLDRLVDVDGDEEAGVPARALFPPSAIVREGYLLKRKEEPAGLATRFAFKKRYVWLSGETLSFSKSPEWQMCHSIPVSHIRAVERVDEGAFQLPHVMQVVTQDGTGALHTTYLQCKNVNELNQWLSALRKASAPNPNKLAACHPGAFRSARWTCCLQAERSAAGCSRTHSAVTLGDWSDPLDPDAEAQTVYRQLLLGRDQLRLKLLEDSNMDTTLEADTGACPEVLARQRAATARLLEVLADLDRAHEEFQQQERGKAALGPLGP

SEQ ID NO: 34595 - protein, 804 aa, Homo sapiens
  ENSP00000261729
MAKSSSLNVRVVEGRALPAKDVSGSSDPYCLVKVDDEVVARTATVWRSLGPFWGEEYTVHLPLDFHQLAFYVLDEDTVGHDDIIGKISLSREAITADPRGIDSWINLSRVDPDAEVQGEICLSVQMLEDGQGRCLRCHVLQARDLAPRDISGTSDPFARVFWGSQSLETSTIKKTRFPHWDEVLELREMPGAPSPLRVELWDWDMVGKNDFLGMVEFSPKTLQQKPPKGWFRLLPFPRAEEDSGGNLGALRVKVRLIEDRVLPSQCYQPLMELLMESVQGPAEEDTASPLALLEELTLGDCRQDLATKLVKLFLGRGLAGRFLDYLTRREVARTMDPNTLFRSNSLASKSMEQFMKLVGMPYLHEVLKPVISRVFEEKKYMELDPCKMDLGRTRRISFKGALSEEQMRETSLGLLTGYLGPIVDAIVGSVGRCPPAMRLAFKQLHRRVEERFPQAEHQDVKYLAISGFLFLRFFAPAILTPKLFDLRDQHADPQTSRSLLLLAKAVQSIGNLGQQLGQGKELWMAPLHPFLLQCVSRVRDFLDRLVDVDGDEAGVPARALFPPSAIVREGYLLKRKEEPAGLATRFAFKKRYVWLSGETLSFSKSPEWQMCHSIPVSHIRAVERVDEGAFQLPHVMQVVTQDGTGALHTTYLQCKNVNELNQWLSALRKASAPNPNKLAACHPGAFRSARWTCCLQAERSAAGCSRTHSAVTLGDWSDPLDPDAEAQTVYRQLLLGRDQLRLKLLEDSNMDTTLEADTGACPEVLARQRAATARLLEVLADLDRAHEEFQQQERGKAALGPLGP

SEQ ID NO: 34596 - protein, 776 aa, Homo sapiens
  ENSP00000395920
MAKSSSLNVRVVEGRALPAKDVSGSSDPYCLVKVDDEVVARTATVWRSLGPFWGEEYTVHLPLDFHQLAFYVLDEDTVGHDDIIGKISLSREAITADPRGIDSWINLSRVDPDAEVQGEICLSVQMLEDGQGRCLRCHVLQARDLAPRDISGTSDPFARVFWGSQSLETSTIKKTRFPHWDEVLELREMPGAPSPLRVELWDWDMVGKNDFLGMVEFSPKTLQQKPPKGWFRLLPFPRAEEDSGGNLGALRVKVRLIEDRVLPSQCYQPLMELLMESVQGPAEEDTASPLALLEELTLGDCRQDLATKLVKLFLGRGLAGRFLDYLTRREVARTMDPNTLFRSNSLASKSMEQFMKLVGMPYLHEVLKPVISRVFEEKKYMELDPCKMDLGRTRRISFKGALSEEQMRETSLGLLTGYLGPIVDAIVGSVGRCPPAMRLAFKQLHRRVEERFPQAEHQDVKYLAISGFLFLRFFAPAILTPKLFDLRDQHADPQTSRSLLLLAKAVQSIGNLGQQLGQGKELWMAPLHPFLLQCVSRVRDFLDRLVDVDGDEAGVPARALFPPSAIVREGYLLKRKEEPAGLATRFAFKKRYVWLSGETLSFSKSPEWQVVTQDGTGALHTTYLQCKNVNELNQWLSALRKASAPNPNKLAACHPGAFRSARWTCCLQAERSAAGCSRTHSAVTLGDWSDPLDPDAEAQTVYRQLLLGRDQLRLKLLEDSNMDTTLEADTGACPEVLARQRAATARLLEVLADLDRAHEEFQQQERGKAALGPLGP

SEQ ID NO: 34597 - protein, 805 aa, Homo sapiens
  ENSP00000448510
MAKSSSLNVRVVEGRALPAKDVSGSSDPYCLVKVDDEVVARTATVWRSLGPFWGEEYTVHLPLDFHQLAFYVLDEDTVGHDDIIGKISLSREAITADPRGIDSWINLSRVDPDAEVQGEICLSVQMLEDGQGRCLRCHVLQARDLAPRDISGTSDPFARVFWGSQSLETSTIKKTRFPHWDEVLELREMPGAPSPLRVELWDWDMVGKNDFLGMVEFSPKTLQQKPPKGWFRLLPFPRAEEDSGGNLGALRVKVRLIEDRVLPSQCYQPLMELLMESVQGPAEEDTASPLALLEELTLGDCRQDLATKLVKLFLGRGLAGRFLDYLTRREVARTMDPNTLFRSNSLASKSMEQFMKLVGMPYLHEVLKPVISRVFEEKKYMELDPCKMDLGRTRRISFKGALSEEQMRETSLGLLTGYLGPIVDAIVGSVGRCPPAMRLAFKQLHRRVEERFPQAEHQDVKYLAISGFLFLRFFAPAILTPKLFDLRDQHADPQTSRSLLLLAKAVQSIGNLGQQLGQGKELWMAPLHPFLLQCVSRVRDFLDRLVDVDGDEEAGVPARALFPPSAIVREGYLLKRKEEPAGLATRFAFKKRYVWLSGETLSFSKSPEWQMCHSIPVSHIRAVERVDEGAFQLPHVMQVVTQDGTGALHTTYLQCKNVNELNQWLSALRKASAPNPNKLAACHPGAFRSARWTCCLQAERSAAGCSRTHSAVTLGDWSDPLDPDAEAQTVYRQLLLGRDQLRLKLLEDSNMDTTLEADTGACPEVLARQRAATARLLEVLADLDRAHEEFQQQERGKAALGPLGP

SEQ ID NO: 34598 - protein, 1280 aa, Homo sapiens
  ENSP00000356621
MELSPSSGGAAEALSWPEMFPALESDSPLPPEDLDAVVPVSGAVAGGMLDRILLESVCQQQSWVRVYDVKGPPTHRLSCGQSPYTETTTWERKYCILTDSQLVLLNKEKEIPVEGGQEQQTDSTKGRCLRRTVSVPSEGQFPEYPPEGATKLEVPAERSPRRRSISGTSTSEKPNSMDTANTSPFKVPGFFSKRLKGSIKRTKSQSKLDRNTSFRLPSLRSTDDRSRGLPKLKESRSHESLLSPCSTVECLDLGRGEPVSVKPLHSSILGQDFCFEVTYLSGSKCFSCNSASERDKWMENLRRTVQPNKDNCRRAENVLRLWIIEAKDLAPKKKYFCELCLDDTLFARTTSKTKADNIFWGEHFEFFSLPPLHSITVHIYKDVEKKKKKDKNNYVGLVNIPTASVTGRQFVEKWYPVSTPTPNKGKTGGPSIRIKSRFQTITILPMEQYKEFAEFVTSNYTMLCSVLEPVISVRNKEELACALVHILQSTGRAKDFLTDLVMSEVDRCGEHDVLIFRENTIATKSIEEYLKLVGQQYLHDALGEFIKALYESDENCEVDPSKCSSSELIDHQSNLKMCCELAFCKIINSYCVFPRELKEVFASWKQQCLNRGKQDISERLISASLFLRFLCPAIMSPSLFNLMQEYPDDRTSRTLTLIAKVIQNLANFAKFGNKEEYMAFMNDFLEHEWGGMKRFLLEISNPDTISNTPGFDGYIDLGRELSVLHSLLWEVVSQLDKATVAKLGPLPRVLADITKSLTNPTPIQQQLRRFTEHNSSPNVSGSLSSGLQKIFEDPTDSDLHKLKSPSQDNTDSYFRGKTLLLVQQASSQSMTYSEKDERESSLPNGRSVSLMDLQDTHAAQVEHASVMLDVPIRLTGSQLSITQVASIKQLRETQSTPQSAPQVRRPLHPALNQPGGLQPLSFQNPVYHLNNPIPAMPKASIDSSLENLSTASSRSQSNSEDFKLSGPSNSSMEDFTKRSTQSEDFSRRHTVPDRHIPLALPRQNSTGQAQIRKVDQGGLGARAKAPPSLPHSASLRSTGSMSVVSAALVAEPVQNGSRSRQQSSSSRESPVPKVRAIQRQQTQQVQSPVDSATMSPVERTAAWVLNNGQYEEDVEETEQNLDEAKHAEKYEQEITKLKERLRVSSRRLEEYERRLLVQEQQMQKLLLEYKARLEDSEERLRRQQEEKDSQMKSIISRLMAVEEELKKDHAEMQAVIDAKQKIIDAQEKRIVSLDSANTRLMSALTQVKERYSMQVRNGISPTNPTKLSITENGEFKNSSC

SEQ ID NO: 34599 - protein, 1139 aa, Homo sapiens
  ENSP00000420558
MQTPEVPAERSPRRRSISGTSTSEKPNSMDTANTSPFKVPGFFSKRLKGSIKRTKSQSKLDRNTSFRLPSLRSTDDRSRGLPKLKESRSHESLLSPCSTVECLDLGRGEPVSVKPLHSSILGQDFCFEVTYLSGSKCFSCNSASERDKWMENLRRTVQPNKDNCRRAENVLRLWIIEAKDLAPKKKYFCELCLDDTLFARTTSKTKADNIFWGEHFEFFSLPPLHSITVHIYKDVEKKKKKDKNNYVGLVNIPTASVTGRQFVEKWYPVSTPTPNKGKTGGPSIRIKSRFQTITILPMEQYKEFAEFVTSNYTMLCSVLEPVISVRNKEELACALVHILQSTGRAKDFLTDLVMSEVDRCGEHDVLIFRENTIATKSIEEYLKLVGQQYLHDALGEFIKALYESDENCEVDPSKCSSSELIDHQSNLKMCCELAFCKIINSYCVFPRELKEVFASWKQQCLNRGKQDISERLISASLFLRFLCPAIMSPSLFNLMQEYPDDRTSRTLTLIAKVIQNLANFAKFGNKEEYMAFMNDFLEHEWGGMKRFLLEISNPDTISNTPGFDGYIDLGRELSVLHSLLWEVVSQLDKGENSFLQATVAKLGPLPRVLADITKSLTNPTPIQQQLRRFTEHNSSPNVSGSLSSGLQKIFEDPTDSDLHKLKSPSQDNTDSYFRGKTLLLVQQASSQSMTYSEKDERESSLPNGRSVSLMDLQDTHAAQVEHASVMLDVPIRLTGSQLSITQVASIKQLRETQSTPQSAPQVRRPLHPALNQPGGLQPLSFQNPVYHLNNPIPAMPKASIDSSLENLSTASSRSQSNSEDFKLSGPSNSSMEDFTKRSTQSEDFSRRHTVPDRHIPLALPRQNSTGQAQIRKVDQGGLGARAKAPPSLPHSASLRSTGSMSVVSAALVAEPVQNGSRSRQQSSSSRESPVPKVRAIQRQQTQQVQSPVDSATMSPVERTAAWVLNNGQYEEDVEETEQNLDEAKHAEKYEQEITKLKERLRVSSRRLEEYERRLLVQEQQMQKLLLEYKARLEDSEERLRRQQEEKDSQMKSIISRLMAVEEELKKDHAEMQAVIDAKQKIIDAQEKRIVSLDSANTRLMSALTQVKERYSMQVRNGISPTNPTKLSITENGEFKNSSC

SEQ ID NO: 34600 - protein, 693 aa, Homo sapiens
  ENSP00000402897
  MOD_RES (1)..(1): Any amino acid
XEVFASWKQQCLNRGKQDISERLISASLFLRFLCPAIMSPSLFNLMQEYPDDRTSRTLTLIAKVIQNLANFAKFGNKEEYMAFMNDFLEHEWGGMKRFLLEISNPDTISNTPGFDGYIDLGRELSVLHSLLWEVVSQLDKGENSFLQATVAKLGPLPRVLADITKSLTNPTPIQQQLRRFTEHNSSPNVSGSLSSGLQKIFEDPTDSDLHKLKSPSQDNTDSYFRGKTLLLVQQASSQSMTYSEKDERESSLPNGRSVSLMDLQDTHAAQVEHASVMLDVPIRLTGSQLSITQVASIKQLRETQSTPQSAPQVRRPLHPALNQPGGLQPLSFQNPVYHLNNPIPAMPKASIDSSLENLSTASSRSQSNSEDFKLSGPSNSSMEDFTKRSTQSEDFSRRHTVPDRHIPLALPRQNSTGQAQIRKVDQGGLGARAKAPPSLPHSASLRSTGSMSVVSAALVAEPVQNGSRSRQQSSSSRESPVPKVRAIQRQQTQQVQSPVDSATMSPVERTAAWVLNNGQYEEDVEETEQNLDEAKHAEKYEQEITKLKERLRVSSRRLEEYERRLLVQEQQMQKLLLEYKARLEDSEERLRRQQEEKDSQMKSIISRLMAVEEELKKDHAEMQAVIDAKQKIIDAQVINGDEIIQTGKTDRVPGFSQHQTDERADPSEGAVQHAGPQWHLPHQPHQAFHHGEW

SEQ ID NO: 34601 - protein, 472 aa, Homo sapiens
  ENSP00000425393
MPQTPPFSAMFDSSGYNRNLYQSAEDSCGGLYYHDNNLLSGSLEALIQHLVPNVDYYPDRTYIFTFLLSSRLFMHPYELMAKVCHLCVEHQRLSDPDSDKNQMRKIAPKILQLLTEWTETFPYDFRDERMMRNLKDLAHRIASGEETYRKNVQQMMQCLIRKLAALSQYEEVLAKISSTSTDRLTVLKTKPQSIQRDIITVCNDPYTLAQQLTHIELERLNYIGPEEFVQAFVQKDPLDNDKSCYSERKKTRNLEAYVEWFNRLSYLVATEICMPVKKKHRARMIEYFIDVARECFNIGNFNSLMAIISGMNMSPVSRLKKTWAKVKTAKFDILEHQMDPSSNFYNYRTALRGAAQRSLTAHSSREKIVIPFFSLLIKDIYFLNEGCANRLPNGHVNFEKFWELAKQVSEFMTWKQVECPFERDRKILQYLLTVPVFSEDALYLASYESEGPENHIEKDRWKSLRSSLLGRV

SEQ ID NO: 34602 - protein, 473 aa, Homo sapiens
  ENSP00000264400
MPQTPPFSAMFDSSGYNRNLYQSAEDSCGGLYYHDNNLLSGSLEALIQHLVPNVDYYPDRTYIFTFLLSSRLFMHPYELMAKVCHLCVEHQRLSDPDSDKNQMRKIAPKILQLLTEWTETFPYDFRDERMMRNLKDLAHRIASGEEQTYRKNVQQMMQCLIRKLAALSQYEEVLAKISSTSTDRLTVLKTKPQSIQRDIITVCNDPYTLAQQLTHIELERLNYIGPEEFVQAFVQKDPLDNDKSCYSERKKTRNLEAYVEWFNRLSYLVATEICMPVKKKHRARMIEYFIDVARECFNIGNFNSLMAIISGMNMSPVSRLKKTWAKVKTAKFDILEHQMDPSSNFYNYRTALRGAAQRSLTAHSSREKIVIPFFSLLIKDIYFLNEGCANRLPNGHVNFEKFWELAKQVSEFMTWKQVECPFERDRKILQYLLTVPVFSEDALYLASYESEGPENHIEKDRWKSLRSSLLGRV

SEQ ID NO: 34603 - protein, 560 aa, Homo sapiens
  ENSP00000490436
MAKFLAELLGCTLPSKGASPMFESKSHSRVGLKSSTKQKTTIFSTLASEKSLSDCKKEQQWKPSMYSSITPVCFPSPLIEKPIGKESMPQTPPFSAMFDSSGYNRNLYQSAEDSCGGLYYHDNNLLSGSLEALIQHLVPNVDYYPDRTYIFTFLLSSRLFMHPYELMAKVCHLCVEHQRLSDPDSDKNQMRKIAPKILQLLTEWTETFPYDFRDERMMRNLKDLAHRIASGEEQTYRKNVQQMMQCLIRKLAALSQYEEVLAKISSTSTDRLTVLKTKPQSIQRDIITVCNDPYTLAQQLTHIELERLNYIGPEEFVQAFVQKDPLDNDKSCYSERKKTRNLEAYVEWFNRLSYLVATEICMPVKKKHRARMIEYFIDVARECFNIGNFNSLMAIISGMNMSPVSRLKKTWAKVKTAKFDILEHQMDPSSNFYNYRTALRGAAQRSLTAHSSREKIVIPFFSLLIKDIYFLNEGCANRLPNGHVNFEKFWELAKQVSEFMTWKQVECPFERDRKILQYLLTVPVFSEDALYLASYESEGPENHIEKDRWKSLRSSLLGRV

SEQ ID NO: 34604 - protein, 431 aa, Homo sapiens
  ENSP00000338437
MPQTPPFSAMFDSSGYNRNLYQSAEDSCGGLYYHDNNLLSGSLEALIQHLVPNVDYYPDNQMRKIAPKILQLLTEWTETFPYDFRDERMMRNLKDLAHRIASGEETYRKNVQQMMQCLIRKLAALSQYEEVLAKISSTSTDRLTVLKTKPQSIQRDIITVCNDPYTLAQQLTHIELERLNYIGPEEFVQAFVQKDPLDNDKSCYSERKKTRNLEAYVEWFNRLSYLVATEICMPVKKKHRARMIEYFIDVARECFNIGNFNSLMAIISGMNMSPVSRLKKTWAKVKTAKFDILEHQMDPSSNFYNYRTALRGAAQRSLTAHSSREKIVIPFFSLLIKDIYFLNEGCANRLPNGHVNFEKFWELAKQVSEFMTWKQVECPFERDRKILQYLLTVPVFSEDALYLASYESEGPENHIEKDRWKSLRSSLLGRV

SEQ ID NO: 34605 - protein, 232 aa, Homo sapiens
  ENSP00000426929
MMQCLIRKLAALSQYEEVLAKISSTSTDRLTVLKTKPQSIQRDIITVCNDPYTLAQQLTHIELERLNYIGPEEFVQAFVQKDPLDNDKSCYSERKKTRNLEAYVEWFNRLSYLVATEICMPVKKKHRARMIEYFIDVARECFNIGNFNSLMAIISGMNMSPVSRLKKTWAKVKTAKFDILEHQMDPSSNFYNYRTALRGAAQRSLTAHSSREKIVIPFFSLLIKDIYFLNEG

SEQ ID NO: 34606 - protein, 210 aa, Homo sapiens
  ENSP00000398763
MPQTPPFSAMFDSSGYNRNLYQSAEDSCGGLYYHDNNLLSGSLEALIQHLVPNVDYYPDRTYIFTFLLSSRLFMHPYELMAKVCHLCVEHQRLSDPDSDKNQMRKIAPKILQLLTEWTETFPYDFRDERMMRNLKDLAHRIASGEEVGNLNLARLLEFPGRAWVGNGAELCILISTASSLFCLWASPPHHILVYLVCQVRMIIPSHFKGI

SEQ ID NO: 34607 - protein, 74 aa, Homo sapiens
  ENSP00000476065
MAKFLAELLGCTLPSKGASPMFESKSHSRVGLKSSTKQKTTIFSTLASEKSLSDCKKIIEPGHKETFVLVQVTQ

SEQ ID NO: 34608 - protein, 119 aa, Homo sapiens
  ENSP00000490814
MAKFLAELLGCTLPSKGASPMFESKSHSRVGLKSSTKQKTTIFSTLASEKSLSDCKKEQQWKPSMYSSITPVCFPSPLIEKPIGKVRMNLLLSDTMIRASWLLFLFALSYFGEIIKLIL

SEQ ID NO: 34609 - protein, 73 aa, Homo sapiens
  ENSP00000489822
MAKFLAELLGCTLPSKGASPMFESKSHSRVGLKSSTKQKTTIFSTLASEKSLSDCKKRLCSLPRGVSQWAEEA

SEQ ID NO: 34610 - protein, 80 aa, Homo sapiens
  ENSP00000490663
MAKFLAELLGCTLPSKGASPMFESKSHSRVGLKSSTKQKFMYSSSCSFLRSHGRPPFSAHWPVRSPYLTAKRGCVPCHVG

SEQ ID NO: 34611 - protein, 210 aa, Homo sapiens; identical to SEQ ID NO: 34606
  ENSP00000484927

SEQ ID NO: 34612 - protein, 1257 aa, Homo sapiens
  ENSP00000452781
MQKGIRLNDGHVASLGLLARKDGTRKGYLSKRSSDNTKWQTKWFALLQNLLFYFESDSSSRPSGLYLLEGCVCDRAPSPKPALSAKEPLEKQHYFTVNFSHENQKALELRTEDAKDCDEWVAAIAHASYRTLATEHEALMQKYLHLLQIVETEKTVAKQLRQQIEDGEIEIERLKAEITSLLKDNERIQSTQTVAPNDEDSDIKKIKKVQSFLRGWLCRRKWKTIIQDYIRSPHADSMRKRNQVVFSMLEAEAEYVQQLHILVNNFLRPLRMAASSKKPPITHDDVSSIFLNSETIMFLHQIFYQGLKARISSWPTLVLADLFDILLPMLNIYQEFVRNHQYSLQILAHCKQNRDFDKLLKHYEAKPDCEERTLETFLTYPMFQIPRYILTLHELLAHTPHEHVERNSLDYAKSKLEELSRIMHDEVSETENIRKNLAIERMIIEGCEILLDTSQTFVRQGSLIQVPMSEKGKITRGRLGSLSLKKEGERQCFLFSKHLIICTRGSGGKLHLTKNGVISLIDCTLLEEPESTEEEAKGSGQDIDHLDFKIGVEPKDSPPFTVILVASSRQEKAAWTSDISQCVDNIRCNGLMMNAFEENSKVTVPQMIKSDASLYCDDVDIRFSKTMNSCKVLQIRYASVERLLERLTDLRFLSIDFLNTFLHSYRVFTTAIVVLDKLITIYKKPISAIPARSLELLFASGQNNKLLYGEPPKSPRATRKFSSPPPLSITKTSSPSRRRKLSLNIPIITGGKALDLAALSCNSNGYTSMYSAMSPFSKATLDTSKLYVSSSFTNKIPDEGDTTPEKPEDPSALSKQSSEVSMREESDIDQNQSDDGDTETSPTKSPTTPKSVKNKNSSEFPLFSYNNGVVMTSCRELDNNRSALSAASAFAIATAGANEGTPNKEKYRRMSLASAGFPPDQRNGDKEFVIRRAATNRVLNVLRHWVSKHSQDFETNDELKCKVIGFLEEVMHDPELLTQERKAAANIIRTLTQEDPGDNQITLEEITQMAEGVKAEPFENHSALEIAEQLTLLDHLVFKKIPYEEFFGQGWMKLEKNERTPYIMKTTKHFNDISNLIASEIIRNEDINARVSAIEKWVAVADICRCLHNYNAVLEITSSMNRSAIFRLKKTWLKVSKQTKALIDKLQKLVSSEGRFKNLREALKNCDPPCVPYLGMYLTDLAFIEEGTPNYTEDGLVNFSKMRMISHIIREIRQFQQTAYKIEHQAKVTQYLLDQSFVMDEESLYESSLRIEPKLPT

SEQ ID NO: 34613 - protein, 1273 aa, Homo sapiens
  ENSP00000405963
MQKGIRLNDGHVASLGLLARKDGTRKGYLSKRSSDNTKWQTKWFALLQNLLFYFESDSSSRPSGLYLLEGCVCDRAPSPKPALSAKEPLEKQHYFTVNFSHENQKALELRTEDAKDCDEWVAAIAHASYRTLATEHEALMQKYLHLLQIVETEKTVAKQLRQQIEDGEIEIERLKAEITSLLKDNERIQSTQTVAPNDEDSDIKKIKKVQSFLRGWLCRRKWKTIIQDYIRSPHADSMRKRNQVVFSMLEAEAEYVQQLHILVNNFLRPLRMAASSKKPPITHDDVSSIFLNSETIMFLHQIFYQGLKARISSWPTLVLADLFDILLPMLNIYQEFVRNHQYSLQILAHCKQNRDFDKLLKHYEAKPDCEERTLETFLTYPMFQIPRYILTLHELLAHTPHEHVERNSLDYAKSKLEELSRIMHDEVSETENIRKNLAIERMIIEGCEILLDTSQTFVRQGSLIQVPMSEKGKITRGRLGSLSLKKEGERQCFLFSKHLIICTRGSGGKLHLTKNGVISLIDCTLLEEPESTEEEAKGSGQDIDHLDFKIGVEPKDSPPFTVILVASSRQEKAAWTSDISQCVDNIRCNGLMMNAFEENSKVTVPQMIKRTREGTREAEMSRSDASLYCDDVDIRFSKTMNSCKVLQIRYASVERLLERLTDLRFLSIDFLNTFLHSYRVFTTAIVVLDKLITIYKKPISAIPARWLRSLELLFASGQNNKLLYGEPPKSPRATRKFSSPPPLSITKTSSPSRRRKLSLNIPIITGGKALDLAALSCNSNGYTSMYSAMSPFSKATLDTSKLYVSSSFTNKIPDEGDTTPEKPEDPSALSKQSSEVSMREESDIDQNQSDDGDTETSPTKSPTTPKSVKNKNSSEFPLFSYNNGVVMTSCRELDNNRSALSAASAFAIATAGANEGTPNKEKYRRMSLASAGFPPDQRNGDKEFVIRRAATNRVLNVLRHWVSKHSQDFETNDELKCKVIGFLEEVMHDPELLTQERKAAANIIRTLTQEDPGDNQITLEEITQMAEGVKAEPFENHSALEIAEQLTLLDHLVFKKIPYEEFFGQGWMKLEKNERTPYIMKTTKHFNDISNLIASEIIRNEDINARVSAIEKWVAVADICRCLHNYNAVLEITSSMNRSAIFRLKKTWLKVSKQTKALIDKLQKLVSSEGRFKNLREALKNCDPPCVPYLGMYLTDLAFIEEGTPNYTEDGLVNFSKMRMISHIIREIRQFQQTAYKIEHQAKVTQYLLDQSFVMDEESLYESSLRIEPKLPT

SEQ ID NO: 34614 - protein, 489 aa, Homo sapiens
  ENSP00000378228
MYSAMSPFSKATLDTSKLYVSSSFTNKIPDEGDTTPEKPEDPSALSKQSSEVSMREESDIDQNQSDDGDTETSPTKSPTTPKSVKNKNSSEFPLFSYNNGVVMTSCRELDNNRSALSAASAFAIATAGANEGTPNKEKYRRMSLASAGFPPDQRNGDKEFVIRRAATNRVLNVLRHWVSKHSQDFETNDELKCKVIGFLEEVMHDPELLTQERKAAANIIRTLTQEDPGDNQITLEEITQMAEGVKAEPFENHSALEIAEQLTLLDHLVFKKIPYEEFFGQGWMKLEKNERTPYIMKTTKHFNDISNLIASEIIRNEDINARVSAIEKWVAVADICRCLHNYNAVLEITSSMNRSAIFRLKKTWLKVSKQTKALIDKLQKLVSSEGRFKNLREALKNCDPPCVPYLGMYLTDLAFIEEGTPNYTEDGLVNFSKMRMISHIIREIRQFQQTAYKIEHQAKVTQYLLDQSFVMDEESLYESSLRIEPKLPT

SEQ ID NO: 34615 - protein, 797 aa, Homo sapiens
  ENSP00000310244
MGTLGKAREAPRKPSHGCRAASKARLEAKPANSPFPSHPSLAHITQFRMMVSLGHLAKGASLDDLIDSCIQSFDADGNLCRSNQLLQVMLTMHRIVISSAELLQKVITLYKDALAKNSPGLCLKICYFVRYWITEFWVMFKMDASLTDTMEEFQELVKAKGEELHCRLIDTTQINARDWSRKLTQRIKSNTSKKRKVSLLFDHLEPEELSEHLTYLEFKSFRRISFSDYQNYLVNSCVKENPTMERSIALCNGISQWVQLMVLSRPTPQLRAEVFIKFIQVAQKLHQLQNFNTLMAVIGGLCHSSISRLKETSSHVPHEINKVLGEMTELLSSSRNYDNYRRAYGECTDFKIPILGVHLKDLISLYEAMPDYLEDGKVNVHKLLALYNHISELVQLQEVAPPLEANKDLVHLLTLSLDLYYTEDEIYELSYAREPRNHRAPPLTPSKPPVVVDWASGVSPKPDPKTISKHVQRMVDSVFKNYDHDQDGYISQEEFEKIAASFPFSFCVMDKDREGLISRDEITAYFMRASSIYSKLGLGFPHNFQETTYLKPTFCDNCAGFLWGVIKQGYRCKDCGMNCHKQCKDLVVFECKKRAKNPVAPTENNTSVGPVSNLCSLGAKDLLHAPEEGPFTFPNGEAVEHGEESKDRTIMLMGVSSQKISLRLKRAVAHKATQTESQPWIGSEGPSGPFVLSSPRKTAQDTLYVLPSPTSPCPSPVLVRKRAFVKWENKDSLIKSKEELRHLRLPTYQELEQEINTLKADNDALKIQLKYAQKKIESLQLEKSNHVLAQMEQGDCS

SEQ ID NO: 34616 - protein, 811 aa, Homo sapiens
  ENSP00000453583
IPFLSNLPSERGAARLSPHCLLSFPRKPSHGCRAASKARLEAKPANSPFPSHPSLAHITQFRMMVSLGHLAKGASLDDLIDSCIQSFDADGNLCRSNQLLQVMLTMHRIVISSAELLQKVITLYKDALAKNSPGLCLKICYFVRYWITEFWVMFKMDASLTDTMEEFQELVKAKGEELHCRLIDTTQINARDWSRKLTQRIKSNTSKKRKVSLLFDHLEPEELSEHLTYLEFKSFRRISFSDYQNYLVNSCVKENPTMERSIALCNGISQWVQLMVLSRPTPQLRAEVFIKFIQVAQKLHQLQNFNTLMAVIGGLCHSSISRLKETSSHVPHEINKVLGEMTELLSSSRNYDNYRRAYGECTDFKIPILGVHLKDLISLYEAMPDYLEDGKVNVHKLLALYNHISELVQLQEVAPPLEANKDLVHLLTLSLDLYYTEDEIYELSYAREPRNHRAPPLTPSKPPVVVDWASGVSPKPDPKTISKHVQRMVDSVFKNYDHDQDGYISQEEFEKIAASFPFSFCVMDKDREGLISRDEITAYFMRASSIYSKLGLGFPHNFQETTYLKPTFCDNCAGFLWGVIKQGYRCKDCGMNCHKQCKDLVVFECKKRAKNPVAPTENNTSVGPVSNLCSLGAKDLLHAPEEGPFTFPNGEAVEHGEESKDRTIMLMGVSSQKISLRLKRAVAHKATQTESQPWIGSEGPSGPFVLSSPRKTAQDTLYVLPSPTSPCPSPVLVRKRAFVKWENKDSLIKSKEELRHLRLPTYQELEQEINTLKADNDALKIQLKYAQKKIESLQLEKSNHVLAQMEQGDCS

SEQ ID NO: 34617 - protein, 848 aa, Homo sapiens
  ENSP00000452859
MKVVPTSPTPTDARRPRLGQIWITPVERTSTQAALVQGAGRRAQGTCLRPSPADGYLETPGHRKPSHGCRAASKARLEAKPANSPFPSHPSLAHITQFRMMVSLGHLAKGASLDDLIDSCIQSFDADGNLCRSNQLLQVMLTMHRIVISSAELLQKVITLYKDALAKNSPGLCLKICYFVRYWITEFWVMFKMDASLTDTMEEFQELVKAKGEELHCRLIDTTQINARDWSRKLTQRIKSNTSKKRKVSLLFDHLEPEELSEHLTYLEFKSFRRISFSDYQNYLVNSCVKENPTMERSIALCNGISQWVQLMVLSRPTPQLRAEVFIKFIQVAQKLHQLQNFNTLMAVIGGLCHSSISRLKETSSHVPHEINKVLGEMTELLSSSRNYDNYRRAYGECTDFKIPILGVHLKDLISLYEAMPDYLEDGKVNVHKLLALYNHISELVQLQEVAPPLEANKDLVHLLTLSLDLYYTEDEIYELSYAREPRNHRAPPLTPSKPPVVVDWASGVSPKPDPKTISKHVQRMVDSVFKNYDHDQDGYISQEEFEKIAASFPFSFCVMDKDREGLISRDEITAYFMRASSIYSKLGLGFPHNFQETTYLKPTFCDNCAGFLWGVIKQGYRCKDCGMNCHKQCKDLVVFECKKRAKNPVAPTENNTSVGPVSNLCSLGAKDLLHAPEEGPFTFPNGEAVEHGEESKDRTIMLMGVSSQKISLRLKRAVAHKATQTESQPWIGSEGPSGPFVLSSPRKTAQDTLYVLPSPTSPCPSPVLVRKRAFVKWENKDSLIKSKEELRHLRLPTYQELEQEINTLKADNDALKIQLKYAQKKIESLQLEKSNHVLAQMEQGDCS

SEQ ID NO: 34618 - protein, 762 aa, Homo sapiens
  ENSP00000388540
MGTLGKAREAPRKPSHGCRAASKARLEAKPANSPFPSHPSLAHITQFRMMVSLGHLAKGASLDDLIDSCIQSFDADGNLCRSNQLLQVMLTMHRIVISSAELLQKVITLYKDALAKNSPGLCLKICYFVRYWITEFWVMFKMDASLTDTMEEFQELVKAKGEELHCRLIDTTQINARDWSRKLTQRIKSNTSKKRKVSLLFDHLEPEELSEHLTYLEFKSFRRISFSDYQNYLVNSCVKENPTMERSIALCNGISQWVQLMVLSRPTPQLRAEVFIKFIQVAQKLHQLQNFNTLMAVIGGLCHSSISRLKETSSHVPHEINKVLGEMTELLSSSRNYDNYRRAYGECTDFKIPILGVHLKDLISLYEAMPDYLEDGKVNVHKLLALYNHISELVQLQEVAPPLEANKDLVHLLTLSLDLYYTEDEIYELSYAREPRNHRAPSVFKNYDHDQDGYISQEEFEKIAASFPFSFCVMDKDREGLISRDEITAYFMRASSIYSKLGLGFPHNFQETTYLKPTFCDNCAGFLWGVIKQGYRCKDCGMNCHKQCKDLVVFECKKRAKNPVAPTENNTSVGPVSNLCSLGAKDLLHAPEEGPFTFPNGEAVEHGEESKDRTIMLMGVSSQKISLRLKRAVAHKATQTESQPWIGSEGPSGPFVLSSPRKTAQDTLYVLPSPTSPCPSPVLVRKRAFVKWENKDSLIKSKEELRHLRLPTYQELEQEINTLKADNDALKIQLKYAQKKIESLQLEKSNHVLAQMEQGDCS

SEQ ID NO: 34619 - protein, 597 aa, Homo sapiens
  ENSP00000452721
MGTLGKAREAPRKPSHGCRAASKARLEAKPANSPFPSHPSLAHITQFRMMVSLGHLAKGASLDDLIDSCIQSFDADGNLCRSNQLLQVMLTMHRIVISSAELLQKVITLYKDALAKNSPGLCLKICYFVRYWITEFWVMFKMDASLTDTMEEFQELVKAKGEELHCRLIDTTQINARDWSRKLTQRIKSNTSKKRKVSLLFDHLEPEELSEHLTYLEFKSFRRISFSDYQNYLVNSCVKENPTMERSIALCNGISQWVQLMVLSRPTPQLRAEVFIKFIQVAQKLHQLQNFNTLMAVIGGLCHSSISRLKETSSHVPHEINKVLGEMTELLSSSRNYDNYRRAYGECTDFKIPILGVHLKDLISLYEAMPDYLEDGKVNVHKLLALYNHISELVQLQEVAPPLEANKDLVHLLTLSLDLYYTEDEIYELSYAREPRNHRAPSVFKNYDHDQDGYISQEEFEKIAASFPFSFCVMDKDREGLISRDEITAYFMRASSIYSKLGLGFPHNFQETTYLKPTFCDNCAGFLWGVIKQGYRCKDCGMNCHKQCKDLVVFECKKRAKNPVAPTENNTSVGPVSNLCSLGAKDLLHGNKYSESR

SEQ ID NO: 34620 - protein, 481 aa, Homo sapiens
  ENSP00000413105
MGTLGKAREAPRKPSHGCRAASKARLEAKPANSPFPSHPSLAHITQFRMMVSLGHLAKGASLDDLIDSCIQSFDADGNLCRSNQLLQVMLTMHRIVISSAELLQKVITLYKDALAKNSPGLCLKICYFVRYWITEFWVMFKMDASLTDTMEEFQELVKAKGEELHCRLIDTTQINARDWSRKLTQRIKSNTSKKRKVSLLFDHLEPEELSEHLTYLEFKSFRRISFSDYQNYLVNSCVKENPTMERSIALCNGISQWVQLMVLSRPTPQLRAEVFIKFIQVAQKLHQLQNFNTLMAVIGGLCHSSISRLKETSSHVPHEINKVLGEMTELLSSSRNYDNYRRAYGECTDFKIPILGVHLKDLISLYEAMPDYLEDGKVNVHKLLALYNHISELVQLQEVAPPLEANKDLVHLLTLSLDLYYTEDEIYELSYAREPRNHRAPSVFKNYDHDQDGYISQEEFEKIAASFPFSFCVMDKDSSGE

SEQ ID NO: 34621 - protein, 546 aa, Homo sapiens
  ENSP00000454164
MGTLGKAREAPRKPSHGCRAASKARLEAKPANSPFPSHPSLAHITQFRMMVSLGHLAKGASLDDLIDSCIQSFDADGNLCRSNQLLQVMLTMHRIVISSAELLQKVITLYKDALAKNSPGLCLKICYFVRYWITEFWVMFKMDASLTDTMEEFQELVKAKGEELHCRLIDTTQINARDWSRKLTQRIKSNTSKKRKVSLLFDHLEPEELSEHLTYLEFKSFRRISFSDYQNYLVNSCVKENPTMERSIALCNGISQWVQLMVLSRPTPQLRAEVFIKFIQVAQKLHQLQNFNTLMAVIGGLCHSSISRLKETSSHVPHEINKVLGEMTELLSSSRNYDNYRRAYGECTDFKIPILGVHLKDLISLYEAMPDYLEDGKVNVHKLLALYNHISELVQLQEVAPPLEANKDLVHLLTLSLDLYYTEDEIYELSYAREPRNHRAPSVFKNYDHDQDGYISQEEFEKIAASFPFSFCVMDKDREGLISRDEITAYFMRASSIYSKLGLGFPHNFQETTYLKPTFCDNCAGFLWGVIKQGYRCKGNKYSESR

SEQ ID NO: 34622 - protein, 123 aa, Homo sapiens
  ENSP00000453729
ETTYLKPTFCDNCAGFLWGVIKQGYRCKDIRILLLMLRFTDKGYIKSVSSGLHQVRRMLASLGMLSVLAPEDRTDMCDKKALHEFGCETHWGREKSERLLDPGCLVHRLRDELSQTMQRSGCV

SEQ ID NO: 34623 - protein, 217 aa, Homo sapiens
  ENSP00000454053
QNFNTLMAVIGGLCHSSISRLKETSSHVPHEINKVLGEMTELLSSSRNYDNYRRAYGECTDFKIPILGVHLKDLISLYEAMPDYLEDGKVNVHKLLALYNHISELVQLQEVAPPLEANKDLVHLLTLSLDLYYTEDEIYELSYAREPRNHRAPSVFKNYDHDQDGYISQEEFEKIAASFPFSFCVMDKDRAHGSNHEVAHTILPLRIKRKGRPHQQG

SEQ ID NO: 34624 - protein, 96 aa, Homo sapiens
  ENSP00000453905
MMVSLGHLAKGASLDDLIDSCIQSFDADGNLCRSNQLLQVMLTMHRIVISSAELLQKVITLYKDALAKNSPGLCLKICYFVRYWITEFWVMFKMDA

SEQ ID NO: 34625 - protein, 57 aa, Homo sapiens
  ENSP00000454005
MMVSLGHLAKGASLDDLIDSCIQSFDADGNLCRSNQLLQVMLTMHRIVISSAELLQK

SEQ ID NO: 34626 - protein, 32 aa, Homo sapiens
  ENSP00000452892
MMVSLGHLAKGASLDDLIDSCIQSFDADGNLC

SEQ ID NO: 34627 - protein, 797 aa, Homo sapiens [sequence omitted]

SEQ ID NO: 34628 - protein, 690 aa, Homo sapiens
  ENSP00000385886
MGSSGLGKAATLDELLCTCIEMFDDNGELDNSYLPRIVLLMHRWYLSSTELAEKLLCMYRNATGESCNEFRLKICYFMRYWILKFPAEFNLDLGLIRMTEEFREVASQLGYEKHVSLIDISSIPSYDWMRRVTQRKKVSKKGKACLLFDHLEPIELAEHLTFLEHKSFRRISFTDYQSYVIHGCLENNPTLERSIALFNGISKWVQLMVLSKPTPQQRAEVITKFINVAKKLLQLKNFNTLMAVVGGLSHSSISRLKETHSHLSSEVTKNWNEMTELVSSNGNYCNYRKAFADCDGFKIPILGVHLKDLIAVHVIFPDWTEENKVNIVKMHQLSVTLSELVSLQNASHHLEPNMDLINLLTLSLDLYHTEDDIYKLSLVLEPRNSKSQPTSPTTPNKPVVPLEWALGVMPKPDPTVINKHIRKLVESVFRNYDHDHDGYISQEDFESIAANFPFLDSFCVLDKDQDGLISKDEMMAYFLRAKSQLHCKMGPGFIHNFQEMTYLKPTFCEHCAGFLWGIIKQGYKCKDCGANCHKQCKDLLVLACRRFARAPSLSSGHGSLPGSPSLPPAQDEVFEFPGVTAGHRDLDSRAITLVTGSSRKISVRLQRATTSQATQTEPVWSEAGWGDSGSHTFPKMKSKFHDKAAKDKGFAKWENEKPRVHAGVDVVDRGTEFELDQDEGEETRQDGEDG

SEQ ID NO: 34629 - protein, 172 aa, Homo sapiens
  ENSP00000393866
MGSSGLGKAATLDELLCTCIEMFDDNGELDNSYLPRIVLLMHRWYLSSTELAEKLLCMYRNATGESCNEFRLKICYFMRYWILKFPAEFNLDLGLIRMTEEFREVASQLGYEKHVSLIDISSIPSYDWMRRVTQRKKVSKKGKACLLFDHLEPIELAEHLTFLEHKSFRRIS

SEQ ID NO: 34630 - protein, 690 aa, Homo sapiens; identical to SEQ ID NO: 34628
  ENSP00000384192

SEQ ID NO: 34631 - protein, 77 aa, Homo sapiens
  ENSP00000405648
MGSSGLGKAATLDELLCTCIEMFDDNGELDNSYLPRIVLLMHRWYLSSTELAEKLLCMYRNATGESCNEFRLKICYF

SEQ ID NO: 34632 - protein, 34 aa, Homo sapiens
  ENSP00000401974
MGSSGLGKAATLDELLCTCIEMFDDNGELDNSYL

SEQ ID NO: 34633 - protein, 112 aa, Homo sapiens
  ENSP00000400602
MGSSGLGKAATLDELLCTCIEMFDDNGELDNSYLPRIVLLMHRWYLSSTELAEKLLCMYRNATGESCNEFRLKICYFMRYWILKFPAEFNLDLGLIRMTEEFREVASQLGYE

SEQ ID NO: 34634 - protein, 113 aa, Homo sapiens
  ENSP00000388139
MGSSGLGKAATLDELLCTCIEMFDDNGELDNSYLPRIVLLMHRWYLSSTELAEKLLCMYRNATGESCNEFRLKICYFMRYWILKFPAEFNLDLGLIRMTEEFREVASQLGYEK

SEQ ID NO: 34635 - protein, 689 aa, Homo sapiens
  ENSP00000383917
MGSSGLGKAATLDELLCTCIEMFDDNGELDNSYLPRIVLLMHRWYLSSTELAEKLLCMYRNATGESCNEFRLKICYFMRYWILKFPAEFNLDLGLIRMTEEFREVASQLGYEKHVSLIDISSIPSYDWMRRVTQRKKVSKKGKACLLFDHLEPIELAEHLTFLEHKSFRRISFTDYQSYVIHGCLENNPTLERSIALFNGISKWVQLMVLSKPTPQQRAEVITKFINVAKKLLQLKNFNTLMAVVGGLSHSSISRLKETHSHLSSEVTKNWNEMTELVSSNGNYCNYRKAFADCDGFKIPILGVHLKDLIAVHVIFPDWTEENKVNIVKMHQLSVTLSELVSLQNASHHLEPNMDLINLLTLSLDLYHTEDDIYKLSLVLEPRNSKSPTSPTTPNKPVVPLEWALGVMPKPDPTVINKHIRKLVESVFRNYDHDHDGYISQEDFESIAANFPFLDSFCVLDKDQDGLISKDEMMAYFLRAKSQLHCKMGPGFIHNFQEMTYLKPTFCEHCAGFLWGIIKQGYKCKDCGANCHKQCKDLLVLACRRFARAPSLSSGHGSLPGSPSLPPAQDEVFEFPGVTAGHRDLDSRAITLVTGSSRKISVRLQRATTSQATQTEPVWSEAGWGDSGSHTFPKMKSKFHDKAAKDKGFAKWENEKPRVHAGVDVVDRGTEFELDQDEGEETRQDGEDG

SEQ ID NO: 34636 - protein, 138 aa, Homo sapiens
  ENSP00000409593
ADCDGFKIPILGVHLKDLIAVHVIFPDWTEENKVNIVKMHQLSVTLSELVSLQNASHHLEPNMDLINLLTLSLDLYHTEDDIYKLSLVLEPRNSKSQPTSPTTPNKPVVPLEWALGVMPKPDPTVINKHIRKLVEVSG

SEQ ID NO: 34637 - protein, 963 aa, Homo sapiens
  ENSP00000222145
MLSGERKEGGSPRFGKLHLPVGLWINSPRKQLAKLGRRWPSAASVKSSSSDTGSRSSEPLPPPPPHVELRRVGAVKAAGGASGSRAKRISQLFRGSGTGTTGSSGAGGPGTPGGAQRWASEKKLPELAAGVAPEPPLATRATAPPGVLKIFGAGLASGANYKSVLATARSTARELVAEALERYGLAGSPGGGPGESSCVDAFALCDALGRPAAAGVGSGEWRAEHLRVLGDSERPLLVQELWRARPGWARRFELRGREEARRLEQEAFGAADSEGTGAPSWRPQKNRSRAASGGAALASPGPGTGSGAPAGSGGKERSENLSLRRSVSELSLQGRRRRQQERRQQALSMAPGAADAQIGTADPGDFDQLTQCLIQAPSNRPYFLLLQGYQDAQDFVVYVMTREQHVFGRGGNSSGRGGSPAPYVDTFLNAPDILPRHCTVRAGPEHPAMVRPSRGAPVTHNGCLLLREAELHPGDLLGLGEHFLFMYKDPRTGGSGPARPPWLPARPGATPPGPGWAFSCRLCGRGLQERGEALAAYLDGREPVLRFRPREEEALLGEIVRAAAAGSGDLPPLGPATLLALCVQHSARELELGHLPRLLGRLARLIKEAVWEKIKEIGDRQPENHPEGVPEVPLTPEAVSVELRPLMLWMANTTELLSFVQEKVLEMEKEADQEDPQLCNDLELCDEAMALLDEVIMCTFQQSVYYLTKTLYSTLPALLDSNPFTAGAELPGPGAELGAMPPGLRPTLGVFQAALELTSQCELHPDLVSQTFGYLFFFSNASLLNSLMERGQGRPFYQWSRAVQIRTNLDLVLDWLQGAGLGDIATEFFRKLSMAVNLLCVPRTSLLKASWSSLRTDHPTLTPAQLHHLLSHYQLGPGRGPPAAWDPPPAEREAVDTGDIFESFSSHPPLILPLGSSRLRLTGPVTDDALHRELRRLRRLLWDLEQQELPANYRHGPPVATSP

SEQ ID NO: 34638 - protein, 182 aa, Homo sapiens
  ENSP00000471633
  MOD_RES (1)..(1): Any amino acid
XGREEARRLEQEAFGAADSEGTGAPSWRPQKNRSRAASGGAALASPGPGTGSGAPAGSGGKERSENLSLRRSVSELSLQGRRRRQQERRQQALSMAPGAADAQIGTADPGDFDQLTQCLIQAPSNRPYFLLLQGYQDAQTLYSTLPALLDSNPFTAGAELPGPGAELGAMPPGLRPTLGVFQ

SEQ ID NO: 34639 - protein, 248 aa, Homo sapiens
  ENSP00000248706
MRLIQNMCTIAEYPAPGNAAASDCCVGAAGRRLVKIAVVGASGVGKTALVVRFLTKRFIGDYERNAGNLYTRQVQIEGETLALQVQDTPGIQVHENSLSCSEQLNRCIRWADAVVIVFSITDYKSYELISQLHQHVQQLHLGTRLPVVVVANKADLLHIKQVDPQLGLQLASMLGCSFYEVSVSENYNDVYSAFHVLCKEVSHKQQPSSTPEKRRTSLIPRPKSPNMQDLKRRFKQALSAKVRTVTSV

SEQ ID NO: 34640 - protein, 266 aa, Homo sapiens
  ENSP00000220062
MSSVFGKPRAGSGPQSAPLEVNLAILGRRGAGKSALTVKFLTKRFISEYDPNLEDTYSSEETVDHQPVHLRVMDTADLDTPRNCERYLNWAHAFLVVYSVDSRQSFDSSSSYLELLALHAKETQRSIPALLLGNKLDMAQYRQVTKAEGVALAGRFGCLFFEVSACLDFEHVQHVFHEAVREARRELEKSPLTRPLFISEERALPHQAPLTARHGLASCTFNTLSTINLKEMPTVAQAKLVTVKSSRAQSKRKAPTLTLLKGFKIF

SEQ ID NO: 34641 - protein, 247 aa, Homo sapiens
  ENSP00000390028
MSSVFGKPRAGSGPQSAPLEVNLAILGRRGAGKSEDTYSSEETVDHQPVHLRVMDTADLDTPRNCERYLNWAHAFLVVYSVDSRQSFDSSSSYLELLALHAKETQRSIPALLLGNKLDMAQYRQVTKAEGVALAGRFGCLFFEVSACLDFEHVQHVFHEAVREARRELEKSPLTRPLFISEERALPHQAPLTARHGLASCTFNTLSTINLKEMPTVAQAKLVTVKSSRAQSKRKAPTLTLLKGFKIF

SEQ ID NO: 34642 - protein, 255 aa, Homo sapiens
  ENSP00000412787
MVIMGPELVGSWSDFKNEAADPRALTVKFLTKRFISEYDPNLEDTYSSEETVDHQPVHLRVMDTADLDTPRNCERYLNWAHAFLVVYSVDSRQSFDSSSSYLELLALHAKETQRSIPALLLGNKLDMAQYRQVTKAEGVALAGRFGCLFFEVSACLDFEHVQHVFHEAVREARRELEKSPLTRPLFISEERALPHQAPLTARHGLASCTFNTLSTINLKEMPTVAQAKLVTVKSSRAQSKRKAPTLTLLKGFKIF

SEQ ID NO: 34643 - protein, 326 aa, Homo sapiens
  ENSP00000368710
MDYSHQTSLVPCGQDKYISKNELLLHLKTYNLYYEGQNLQLRHREEEDEFIVEGLLNISWGLRRPIRLQMQDDNERIRPPPSSSSWHSGCNLGAQGTTLKPLTVPKVQISEVDAPPEGDQMPSSTDSRGLKPLQEDTPQLMRTRSDVGVRRRGNVRTPSDQRRIRRHRFSINGHFYNHKTSVFTPAYGSVTNVRINSTMTTPQVLKLLLNKFKIENSAEEFALYVVHTSGEKQKLKATDYPLIARILQGPCEQISKVFLMEKDQVEEVTYDVAQYIKFEMPVLKSFIQKLQEEEDREVKKLMRKYTVLRLMIRQRLEEIAETPATI

SEQ ID NO: 34644 - protein, 326 aa, Homo sapiens; identical to SEQ ID NO: 34643
  ENSP00000368684

SEQ ID NO: 34645 - protein, 322 aa, Homo sapiens [sequence omitted]

SEQ ID NO: 34646 - protein, 63 aa, Homo sapiens
  ENSP00000413789
MAASGEPQRQWQEEVAAVVVVGSCMTDLVRRMCMRICYVHFCCQPTPQLQNCSSLCVITCQEN

SEQ ID NO: 34647 - protein, 147 aa, Homo sapiens
  ENSP00000393558
  MOD_RES (1)..(1): Any amino acid
XNVISRAKVMVCQLEITPATSLEALTMARRSGVKTLFNPAPAIADLDPQFYTLSDVFCCNESEAEILTGLTVGSAADAGEAALVLLKRGCQVVIITLGAEGCVVLSQTEPEPKHIPTEKVKAVDTTCRPGSRPKSEAASVKKQKHYK

SEQ ID NO: 34648 - protein, 36 aa, Homo sapiens
  ENSP00000415975
MAASGEPQRQWQEEVAAVVVVGSCMTDLVRRYIRTQ

SEQ ID NO: 34649 - protein, 18 aa, Homo sapiens
  ENSP00000483033
VLSLYLFCKSKTKKNVLV

SEQ ID NO: 34650 - protein, 420 aa, Homo sapiens
  ENSP00000199814
MATSLGSNTYNRQNWEDADFPILCQTCLGENPYIRMTKEKYGKECKICARPFTVFRWCPGVRMRFKKTEVCQTCSKLKNVCQTCLLDLEYGLPIQVRDAGLSFKDDMPKSDVNKEYYTQNMEREISNSDGTRPVGMLGKATSTSDMLLKLARTTPYYKRNRPHICSFWVKGECKRGEECPYRHEKPTDPDDPLADQNIKDRYYGINDPVADKLLKRASTMPRLDPPEDKTITTLYVGGLGDTITETDLRNHFYQFGEIRTITVVQRQQCAFIQFATRQAAEVAAEKSFNKLIVNGRRLNVKWGRSQAARGKEKEKDGTTDSGIKLEPVPGLPGALPPPPAAEEEASANYFNLPPSGPPAVVNIALPPPPGIAPPPPPGFGPHMFHPMGPPPPFMRAPGPIHYPSQDPQRMGAHAGKHSSP

SEQ ID NO: 34651 - protein, 371 aa, Homo sapiens
  ENSP00000412118
MATSLGSNTYNRQNWEDADFPILCQTCLGENPYIRMTKEKYGLPIQVRDAGLSFKDDMPKSDVNKEYYTQNMEREISNSDGTRPVGMLGKATSTSDMLLKLARTTPYYKRNRPHICSFWVKGECKRGEECPYRHEKPTDPDDPLADQNIKDRYYGINDPVADKLLKRASTMPRLDPPEDKTITTLYVGGLGDTITETDLRNHFYQFGEIRTITVVQRQQCAFIQFATRQAAEVAAEKSFNKLIVNGRRLNVKWGRSQAARGKEKEKDGTTDSGIKLEPVPGLPGALPPPPAAEEEASANYFNLPPSGPPAVVNIALPPPPGIAPPPPPGFGPHMFHPMGPPPPFMRAPGPIHYPSQDPQRMGAHAGKHSSP

SEQ ID NO: 34652 - protein, 179 aa, Homo sapiens
  ENSP00000428154
MATSLGSNTYNRQNWEDATCLGENPYIRMTKEKYGKECKICARPFTVFRWCPGVRMRFKKTEVCQTCSKLKNVCQTCLLDLEYGLPIQVRDAGLSFKDDMPKSDVNKEYYTQNMEREISNSDGTRPVGMLGKATSTSDMLLKLARTTPYYKRNRPHICSFWVKGECKRGEECPYRHEKP

SEQ ID NO: 34653 - protein, 243 aa, Homo sapiens
  ENSP00000430946
MEGGGEAAHLASWQDRACGAAEGIPGRSQRGGLAWPEQEGGGRSSCGLEGRGLSQGPGTSTLSIPAPSSLLELVFFSPAACRKCRQRPLPRSGRDGLRVPAVPSSPPSLPAPSPPQVSLRCQGLRRVVLNQISHFHQDFPILCQTCLGENPYIRMTKEKYGKECKICARPFTVFRWCPGVRMRFKKTEVCQTCSKLKNVCQTCLLDLEYGLPIQVRDAGLSFKDDMPKSDVNKEYYTQNMERE

SEQ ID NO: 34654 - protein, 236 aa, Homo sapiens
  ENSP00000368341
MHTTQKDTTYTKIFVGGLPYHTTDASLRKYFEVFGEIEEAVVITDRQTGKSRGYGFVTMADRAAAERACKDPNPIIDGRKANVNLAYLGAKPRIMQPGFAFGVQQLHPALIQRPFGIPAHYVYPQAFVQPGVVIPHVQPTAAAASTTPYIDYTGAAYAQYSAAAAAAAAAAAYDQYPYAASPAAAGYVTAGGYGYAVQQPITAAAPGTAAAAAAAAAAAAAFGQYQPQQLQTDRMQ

SEQ ID NO: 34655 - protein, 80 aa, Homo sapiens
  ENSP00000426222
VITDRQTGKSRGYGFVTMADRAAAERACKDPNPIIDGRKANVNLAYLGAKPRIMQPGFAFGVQQLHPALIQRPFGDKQAG

SEQ ID NO: 34656 - protein, 178 aa, Homo sapiens
  ENSP00000396898
MADRAAAERACKDPNPIIDGRKANVNLAYLGAKPRIMQPGFAFGVQQLHPALIQRPFGIPAHYVYPQAFVQPGVVIPHVQPTAAAASTTPYIDYTGAAYAQYSAAAAAAAAAAAYDQYPYAASPAAAGYVTAGGYGYAVQQPITAAAPGTAAAAAAAAAAAAAFGQYQPQQLQTDRMQ

SEQ ID NO: 34657 - protein, 201 aa, Homo sapiens
  ENSP00000421971
  MOD_RES (1)..(1): Any amino acid
XSRTIAIVVGECFRGWERWADVTMADRAAAERACKDPNPIIDGRKANVNLAYLGAKPRIMQPGFAFGVQQLHPALIQRPFGIPAHYVYPQAFVQPGVVIPHVQPTAAAASTTPYIDYTGAAYAQYSAAAAAAAAAAAYDQYPYAASPAAAGYVTAGGYGYAVQQPITAAAPGTAAAAAAAAAAAAAFGQYQPQQLQTDRMQ

SEQ ID NO: 34658 - protein, 191 aa, Homo sapiens
  ENSP00000319551
MYVCLCVSVAKVTMADRAAAERACKDPNPIIDGRKANVNLAYLGAKPRIMQPGFAFGVQQLHPALIQRPFGIPAHYVYPQAFVQPGVVIPHVQPTAAAASTTPYIDYTGAAYAQYSAAAAAAAAAAAYDQYPYAASPAAAGYVTAGGYGYAVQQPITAAAPGTAAAAAAAAAAAAAFGQYQPQQLQTDRMQ

SEQ ID NO: 34659 - protein, 843 aa, Homo sapiens
  ENSP00000261973
MSFPPHLNRPPMGIPALPPGIPPPQFPGFPPPVPPGTPMIPVPMSIMAPAPTVLVPTVSMVGKHLGARKDHPGLKAKENDENCGPTTTVFVGNISEKASDMLIRQLLAKCGLVLSWKRVQGASGKLQAFGFCEYKEPESTLRALRLLHDLQIGEKKLLVKVDAKTKAQLDEWKAKKKASNGNARPETVTNDDEEALDEETKRRDQMIKGAIEVLIREYSSELNAPSQESDSHPRKKKKEKKEDIFRRFPVAPLIPYPLITKEDINAIEMEEDKRDLISREISKFRDTHKKLEEEKGKKEKERQEIEKERRERERERERERERREREREREREREREKEKERERERERDRDRDRTKERDRDRDRERDRDRDRERSSDRNKDRSRSREKSRDREREREREREREREREREREREREREREREREREREKDKKRDREEDEEDAYERRKLERKLREKEAAYQERLKNWEIRERKKTREYEKEAEREEERRREMAKEAKRLKEFLEDYDDDRDDPKYYRGSALQKRLRDREKEMEADERDRKREKEELEEIRQRLLAEGHPDPDAELQRMEQEAERRRQPQIKQEPESEEEEEEKQEKEEKREEPMEEEEEPEQKPCLKPTLRPISSAPSVSSASGNATPNTPGDESPCGIIIPHENSPDQQQPEEHRPKIGLSLKLGASNSPGQPNSVKRKKLPVDSVFNKFEDEDSDDVPRKRKLVPLDYGEDDKNATKGTVNTEEKRKHIKSLIEKIPTAKPELFAYPLDWSIVDSILMERRIRPWINKKIIEYIGEEEATLVDFVCSKVMAHSSPQSILDDVAMVLDEEAEVFIVKMWRLLIYETEAKKIGLVK

SEQ ID NO: 34660 - protein, 843 aa, Homo sapiens; identical to SEQ ID NO: 34659
  ENSP00000431150

SEQ ID NO: 34661 - protein, 243 aa, Homo sapiens
  ENSP00000434333
MSFPPHLNRPPMGIPALPPGIPPPQFPGFPPPVPPGTPMIPVPMSIMAPAPTVLVPTVSMVGKHLGARKDHPGLKAKENDENCGPTTTVFVGNISEKASDMLIRQLLAKCGLVLSWKRVQGASGKLQAFGFCEYKEPESTLRALRLLHDLQIGEKKLLVKVDAKTKAQLDEWKAKKKASNGNARPETVTNDDEEALDEETKRRDQMIKGAIEVLIREYSSELNAPSQESDSHPRKKKKEKKED

SEQ ID NO: 34662 - protein, 300 aa, Homo sapiens
  ENSP00000436868
MSFPPHLNRPPMGIPALPPGIPPPQFPGFPPPVPPGTPMIPVPMSIMAPAPTVLVPTVSMVGKHLGARKDHPGLKAKENDENCGPTTTVFVGNISEKASDMLIRQLLAKCGLVLSWKRVQGASGKLQAFGFCEYKEPESTLRALRLLHDLQIGEKKLLVKVDAKTKAQLDEWKAKKKASNGNARPETVTNDDEEALDEETKRRDQMIKGAIEVLIREYSSELNAPSQESDSHPRKKKKEKKEDIFRRFPVAPLIPYPLITKEDINAIEMEEDKRDLISREISKFRDTHKVVFLSFHLIPI

SEQ ID NO: 34663 - protein, 294 aa, Homo sapiens
  ENSP00000436225
MSFPPHLNRPPMGIPALPPGIPPPQFPGFPPPVPPGTPMIPVPMSIMAPAPTVLVPTVSMVGKHLGARKDHPGLKAKENDENCGPTTTVFVGNISEKASDMLIRQLLAKCGLVLSWKRVQGASGKLQAFGFCEYKEPESTLRALRLLHDLQIGEKKLLVKVDAKTKAQLDEWKAKKKASNGNARPETVTNDDEEALDEETKRRDQMIKGAIEVLIREYSSELNAPSQESDSHPRKKKKEKKEDIFRRFPVAPLIPYPLITKEDINAIEMEEDKRDLISREISKFRDTHKRSYGD

SEQ ID NO: 34664 - protein, 127 aa, Homo sapiens
  ENSP00000434004
MSFPPHLNRPPMGIPALPPGIPPPQFPGFPPPVPPGTPMIPVPMSIMAPAPTVLVPTVSMVGKHLGARKDHPGLKAKENDENCGPTTTVFVGNISEKASDMLIRQLLAKCGLVLSWKRVQGASGKLQ

SEQ ID NO: 34665 - protein, 164 aa, Homo sapiens
  ENSP00000434444
MSFPPHLNRPPMGIPALPPGIPPPQFPGFPPPVPPGTPMIPVPMSIMAPAPTVLVPTVSMVGKHLGARKDHPGLKAKENDENCGPTTTVFVGNISEKASDMLIRQLLAPSDSVSTRSQNLPSVHSDYYMTCKLERKSYSLKLMQRQRHSWMNGKQRRKLLMGLG

SEQ ID NO: 34666 - protein, 73 aa, Homo sapiens
  ENSP00000434950
  MOD_RES (1)..(1): Any amino acid
XNAPSQESDSHPRKKKKEKKEDIFRRFPVAPLIPYPLITKEDINAIEMEEDKRDLISREISKFRDTHKRSYGD

SEQ ID NO: 34667 - protein, 266 aa, Homo sapiens
  ENSP00000439918
MGAAAAEADRTLFVGNLETKVTEELLFELFHQAGPVIKVKIPKDKDGKPKQFAFVNFKHEVSVPYAMNLLNGIKLYGRPIKIQFRSGSSHAPQDVSLSYPQHHVGNSSPTSTSPSRYERTMDNMTSSAQIIQRSFSSPENFQRQAVMNSALRQMSYGGKFGSSPLDQSGFSPSVQSHSHSFNQSSSSQWRQGTPSSQRKVRMNSYPYLADRHYSREQRYTDHGSDHHYRGKRDDFFYEDRNHDDWSHDYDNRRDSSRDGKWRSSRH

SEQ ID NO: 34668 - protein, 267 aa, Homo sapiens
  ENSP00000364639
MGAAAAEADRTLFVGNLETKVTEELLFELFHQAGPVIKVKIPKDKDGKPKQFAFVNFKHEVSVPYAMNLLNGIKLYGRPIKIQFRSGSSHAPQDVSLSYPQHHVGNSSPTSTSPSSRYERTMDNMTSSAQIIQRSFSSPENFQRQAVMNSALRQMSYGGKFGSSPLDQSGFSPSVQSHSHSFNQSSSSQWRQGTPSSQRKVRMNSYPYLADRHYSREQRYTDHGSDHHYRGKRDDFFYEDRNHDDWSHDYDNRRDSSRDGKWRSSRH

SEQ ID NO: 34669 - protein, 149 aa, Homo sapiens
  ENSP00000440949
MGAAAAEADRTLFVGNLETKVTEELLFELFHQAGPVIKVKIPKDKDGKPKQFAFVNFKHEVSVPYAMNLLNGIKLYGRPIKIQFRSGSSHAPQDVSLSYPQHHVGNSSPTSTSPSSRYERTMDNMTSSAQIIQRSFSSPENFQRQAVVG

SEQ ID NO: 34670 - protein, 70 aa, Homo sapiens
  ENSP00000437847
MGAAAAEADRTLFVGNLETKVTEELLFELFHQEVVMPHKMSVCHIPNIMLEIQALPPHLLAAGTKGLWIT

SEQ ID NO: 34671 - protein, 123 aa, Homo sapiens
  ENSP00000437998
MGAAAAEADRTLFVGNLETKVTEELLFELFHQAGPVIKVKIPKDKDGKPKQFAFVNFKHEVSVPYAMNLLNGIKLYGRPIKIQFRSVVMPHKMSVCHIPNIMLEIQALPPHLLAAGTKGLWIT

SEQ ID NO: 34672 - protein, 220 aa, Homo sapiens
  ENSP00000440923
MGAAAAEADRTLFVGNLETKVTEELLFELFHQAGPVIKVKIPKDKDGKPKQFAFVNFKHEVSVPYAMNLLNGIKLYGRPIKIQFRSGSSHAPQDVSLSYPQHHVGNSSPTSTSPSRYERTMDNMTSSAQIIQRSFSSPENFQRQAVVVSSNLYTDQLSHEYGRKPAGLREFSPCATYRFSVLCTGHSSCLCFAGLSAVSSELSEFARLCLPCPPTPHNAA

SEQ ID NO: 34673 - protein, 146 aa, Homo sapiens
  ENSP00000445848
MDNMTSSAQIIQRSFSSPENFQRQAVMNSALRQMSYGGKFGSSPLDQSGFSPSVQSHSHSFNQSSSSQWRQGTPSSQRKVRMNSYPYLADRHYSREQRYTDHGSDHHYRGKRDDFFYEDRNHDDWSHDYDNRRDSSRDGKWRSSRH

SEQ ID NO: 34674 - protein, 146 aa, Homo sapiens; identical to SEQ ID NO: 34673
  ENSP00000485655

SEQ ID NO: 34675 - protein, 503 aa, Homo sapiens
  ENSP00000490271
  MOD_RES (1)..(1): Any amino acid
XRPNGEKGESKRTSANKSSGAPSYSRWSSSQPHQSSSTVRAYQTSKSRVTMSPGFSSQWNSSQPAWNTYSFPRASLHYQSHASYTYCTGHPASYAPAPHPMAPPSPSTNSSSNNSSNNSSGEQLSKTNLYIRGLPPGTTDQDLIKLCQPYGKIVSTKAILDKNTNQCKGYGFVDFDSPAAAQKAVASLKANGVQAQMAKQQEQDPTNLYISNLPISMDEQELENMLKPFGHVISTRILRDANGVSRGVGFARMESTEKCEVVIQHFNGKYLKTPPGIPAPSEPLLCKFADGGQKKRQNQSKYTQNGRPWPREGEAGMALTYDPTAAIQNGFYSSPYSIATNRMIPQTSITPFIAASPVSTYQVQSTSWMPHPPYVMQPTGAVITPTMDHPMSMQPANMMGPLTQQMNHLSLGTTGTIQSQDRIMILHQLLCQYMTAAAPMQGTYIPQYTPVPPTAVSIEGVVADTSPQTVAPSSQDTSGQQQQIAVDTSNEHAPAYSYQQSKP

SEQ ID NO: 34676 - protein, 50 aa, Homo sapiens
  ENSP00000489718
RTSANKSSGAPSYSRWSSSQPHQDQTVNFFCKEASWHLDRNCVDSVDHFV

SEQ ID NO: 34677 - protein, 436 aa, Homo sapiens
  ENSP00000395592
MGKRLDQPQMYPQYTYYYPHYLQTKSYAPAPHPMAPPSPSTNSSSNNSSNNSSGEQLSKTNLYIRGLPPGTTDQDLIKLCQPYGKIVSTKAILDKNTNQCKGYGFVDFDSPAAAQKAVASLKANGVQAQMAKQQEQDPTNLYISNLPISMDEQELENMLKPFGHVISTRILRDANGVSRGVGFARMESTEKCEVVIQHFNGKYLKTPPGIPAPSEPLLCKFADGGQKKRQNQSKYTQNGRPWPREGEAGMALTYDPTAAIQNGFYSSPYSIATNRMIPQTSITPFIAASPVSTYQVQSTSWMPHPPYVMQPTGAVITPTMDHPMSMQPANMMGPLTQQMNHLSLGTTGTIQSQDRIMILHQLLCQYMTAAAPMQGTYIPQYTPVPPTAVSIEGVVADTSPQTVAPSSQDTSGQQQQIAVDTSNEHAPAYSYQQSKP

SEQ ID NO: 34678 - protein, 437 aa, Homo sapiens
  ENSP00000373277
MGKRLDQPQMYPQYTYYYPHYLQTKQSYAPAPHPMAPPSPSTNSSSNNSSNNSSGEQLSKTNLYIRGLPPGTTDQDLIKLCQPYGKIVSTKAILDKNTNQCKGYGFVDFDSPAAAQKAVASLKANGVQAQMAKQQEQDPTNLYISNLPISMDEQELENMLKPFGHVISTRILRDANGVSRGVGFARMESTEKCEVVIQHFNGKYLKTPPGIPAPSEPLLCKFADGGQKKRQNQSKYTQNGRPWPREGEAGMALTYDPTAAIQNGFYSSPYSIATNRMIPQTSITPFIAASPVSTYQVQSTSWMPHPPYVMQPTGAVITPTMDHPMSMQPANMMGPLTQQMNHLSLGTTGTIQSQDRIMILHQLLCQYMTAAAPMQGTYIPQYTPVPPTAVSIEGVVADTSPQTVAPSSQDTSGQQQQIAVDTSNEHAPAYSYQQSKP

SEQ ID NO: 34679 - protein, 264 aa, Homo sapiens
  ENSP00000391934
MGKRLDQPQMYPQYTYYYPHYLQTKQSYAPAPHPMAPPSPSTNSSSNNSSNNSSGEQLSKTNLYIRGLPPGTTDQDLIKLCQPYGKIVSTKAILDKNTNQCKGYGFVDFDSPAAAQKAVASLKANGVQAQMAKQQEQDPTNLYISNLPISMDEQELENMLKPFGHVISTRILRDANGVSRGVGFARMESTEKCEVVIQHFNGKYLKTPPGIPAPSEPLLCKFADGGQKKRQNQSKYTQNGRPWPREGEAGMALTYDPTAAIQNG

SEQ ID NO: 34680 - protein, 420 aa, Homo sapiens
  ENSP00000273139
MGKRLDQPQMYPQYTYYYPHYLQTKQSYAPAPHPMAPPSPSTNSSSNNSSNNSSGEQLSKTNLYIRGLPPGTTDQDLIKLCQPYGKIVSTKAILDKNTNQCKGYGFVDFDSPAAAQKAVASLKANGVQAQMAKQQEQDPTNLYISNLPISMDEQELENMLKPFGHVISTRILRDANGVSRGVGFARMESTEKCEVVIQHFNGKYLKTPPGIPAPSEPLLCKFADGGQKKRQNQSKYTQNGRPWPREGEAGMALTYDPTAAIQNGFYSSPYSIATNRMIPQTSITPFIAASPVSTYQVQSTSWMPHPPYVMQPTGAVITPTMDHPMSMQPANMMGPLTQQMNHLSLGTTGTYMTAAAPMQGTYIPQYTPVPPTAVSIEGVVADTSPQTVAPSSQDTSGQQQQIAVDTSNEHAPAYSYQQSK

SEQ ID NO: 34681 - protein, 419 aa, Homo sapiens
  ENSP00000373276
MGKRLDQPQMYPQYTYYYPHYLQTKSYAPAPHPMAPPSPSTNSSSNNSSNNSSGEQLSKTNLYIRGLPPGTTDQDLIKLCQPYGKIVSTKAILDKNTNQCKGYGFVDFDSPAAAQKAVASLKANGVQAQMAKQQEQDPTNLYISNLPISMDEQELENMLKPFGHVISTRILRDANGVSRGVGFARMESTEKCEVVIQHFNGKYLKTPPGIPAPSEPLLCKFADGGQKKRQNQSKYTQNGRPWPREGEAGMALTYDPTAAIQNGFYSSPYSIATNRMIPQTSITPFIAASPVSTYQGAVITPTMDHPMSMQPANMMGPLTQQMNHLSLGTTGTIQSQDRIMILHQLLCQYMTAAAPMQGTYIPQYTPVPPTAVSIEGVVADTSPQTVAPSSQDTSGQQQQIAVDTSNEHAPAYSYQQSKP

SEQ ID NO: 34682 - protein, 421 aa, Homo sapiens
  ENSP00000397926
MGKRLDQPQMYPQYTYYYPHYLQTKQSYAPAPHPMAPPSPSTNSSSNNSSNNSSGEQLSKTNLYIRGLPPGTTDQDLIKLCQPYGKIVSTKAILDKNTNQCKGYGFVDFDSPAAAQKAVASLKANGVQAQMAKQQEQDPTNLYISNLPISMDEQELENMLKPFGHVISTRILRDANGVSRGVGFARMESTEKCEVVIQHFNGKYLKTPPGIPAPSEPLLCKFADGGQKKRQNQSKYTQNGRPWPREGEAGMALTYDPTAAIQNGFYSSPYSIATNRMIPQTSITPFIAASPVSTYQVQSTSWMPHPPYVMQPTGAVITPTMDHPMSMQPANMMGPLTQQMNHLSLGTTGTYMTAAAPMQGTYIPQYTPVPPTAVSIEGVVADTSPQTVAPSSQDTSGQQQQIAVDTSNEHAPAYSYQQSKP

SEQ ID NO: 34683 - protein, 433 aa, Homo sapiens
  ENSP00000400519
MGKRLDQPQMYPQYTYYYPHYLQTKQSYAPAPHPMAPPSPSTNSSSNNSSNNSSGEQLSKTNLYIRGLPPGTTDQDLIKLCQPYGKIVSTKAILDKNTNQCKGYGFVDFDSPAAAQKAVASLKANGVQAQMAKQQEQDPTNLYISNLPISMDEQELENMLKPFGHVISTRILRDANGVSRGVGFARMESTEKCEVVIQHFNGKYLKTPPGIPAPSEPLLCKFADGGQKKRQNQSKYTQNGRPWPREGEVLRGRTVPRQNREAGMALTYDPTAAIQNGFYSSPYSIATNRMIPQTSITPFIAASPVSTYQVQSTSWMPHPPYVMQPTGAVITPTMDHPMSMQPANMMGPLTQQMNHLSLGTTGTYMTAAAPMQGTYIPQYTPVPPTAVSIEGVVADTSPQTVAPSSQDTSGQQQQIAVDTSNEHAPAYSYQQSK

SEQ ID NO: 34684 - protein, 134 aa, Homo sapiens
  ENSP00000232217
MTRDQNGTWEMESNENFEGYMKALDIDFATRKIAVRLTQTKVIDQDGDNFKTKTTSTFRNYDVDFTVGVEFDEYTKSLDNRHVKALVTWEGDVLVCVQKGEKENRGWKQWIEGDKLYLELTCGDQVCRQVFKKK

SEQ ID NO: 34685 - protein, 103 aa, Homo sapiens
  ENSP00000424333
MTRDQNGTWEMESNENFEGYMKALDIDFATRKIAVRLTQTKVIDQDGDNFKTKTTSTFRNYDVDFTVGVEFDEYTKSLDNRHVKALVTWEGDVLVCVQKGEKE

SEQ ID NO: 34686 - protein, 24 aa, Homo sapiens
  ENSP00000421266
MTRDQNGTWEMESNENFEGYMKAL

SEQ ID NO: 34687 - protein, 516 aa, Homo sapiens
  ENSP00000361828
MDPAGAADPSVPPNPLTHLSLQDRSEMQLQSEADRRSLPGTWTRSSPEHTTILRGGVRRCLQQQCEQTVRILHAKVAQKSYGNEKRFFCPPPCVYLSGPGWRVKPGQDQAHQAGETGPTVCGYMGLDSASGSATETQKLNFEQQPDSREFGCAKTLYISDADKRKHFRLVLRLVLRGGRELGTFHSRLIKVISKPSQKKQSLKNTDLCISSGSKVSLFNRLRSQTVSTRYLSVEDGAFVASARQWAAFTLHLADGHSAQGDFPPREGYVRYGSLVQLVCTVTGITLPPMIIRKVAKQCALLDVDEPISQLHKCAFQFPGSPPGGGGTYLCLATEKVVQFQASPCPKEANRALLNDSSCWTIIGTESVEFSFSTSLACTLEPVTPVPLISTLELSGGGDVATLELHGENFHAGLKVWFGDVEAETMYSPRSLVCVVPDVAAFCSDWRWLRAPITIPMSLVRADGLFYPSAFSFTYTPEYSVRPGHPGVPEPATDADALLESIHQEFTRTNFHLFIQT

SEQ ID NO: 34688 - protein, 471 aa, Homo sapiens
  ENSP00000361826
MDPAGAADPSVPPNPLTHLSLQDRSEMQLQSEADRRSLPGTWTRSSPEHTTILRGGVRRCLQQQCEQTVRILHAKVAQKSYGNEKRFFCPPPCVYLSGPGWRVKPGQDQAHQAGETGPTVCGYMGLDSASGSATETQKLNFEQQPDSREFGCAKTLYISDADKRKHFRLVLRLVLRGGRELGTFHSRLIKVISKPSQKKQSLKNTDLCISSGSKVSLFNRLRSQTVSTRYLSVEDGAFVASARQWAAFTLHLADGHSAQGDFPPREGYVRYGSLVQLVCTVTGITLPPMIIRKVAKQCALLDVDEPISQLHKCAFQFPGSPPGGGGTYLCLATEKVVQFQASPCPKEANRALLNDSSCWTIIGTESVEFSFSTSLACTLEPVTPVPLISTLELSGGGDVATLELHGENFHAGLKVWFGDVEAETMYRYGVEPAVPGVRGAGRGGLLQRLALAARSHHNPHEPGARRRALLP

SEQ ID NO: 34689 - protein, 517 aa, Homo sapiens
  ENSP00000341243
MDPAGAADPSVPPNPLTHLSLQDRSEMQLQSEADRRSLPGTWTRSSPEHTTILRGGVRRCLQQQCEQTVRILHAKVAQKSYGNEKRFFCPPPCVYLSGPGWRVKPGQDQAHQAGETGPTVCGYMGLDSASGSATETQKLNFEQQPDSREFGCAKTLYISDADKRKHFRLVLRLVLRGGRELGTFHSRLIKVISKPSQKKQSLKNTDLCISSGSKVSLFNRLRSQTVSTRYLSVEDGAFVASARQWAAFTLHLADGHSAQGDFPPREGYVRYGSLVQLVCTVTGITLPPMIIRKVAKQCALLDVDEPISQLHKCAFQFPGSPPGGGGTYLCLATEKVVQFQASPCPKEANRALLNDSSCWTIIGTESVEFSFSTSLACTLEPVTPVPLISTLELSGGGDVATLELHGENFHAGLKVWFGDVEAETMYRSPRSLVCVVPDVAAFCSDWRWLRAPITIPMSLVRADGLFYPSAFSFTYTPEYSVRPGHPGVPEPATDADALLESIHQEFTRTNFHLFIQT

SEQ ID NO: 34690 - protein, 184 aa, Homo sapiens
  ENSP00000483978
  MOD_RES (1)..(1): Any amino acid
XDGHSAQGDFPPREGYVRYGSLVQLVCTVTGITLPPMIIRKVAKQCALLDVDEPISQLHKCAFQFPGSPPGGGGTYLCLATEKVVQFQHQPGVYPGAGHSGASHQHPRAERRGRRGHAGAPRRELPRGAQGVVWGRGGRNHVQEPAVPGVRGAGRGGLLQRLALAARSHHNPHEPGARRRALLP

SEQ ID NO: 34691 - protein, 98 aa, Homo sapiens
  ENSP00000456720
MAKSKLMATPNPSNVHPALGAHFIARDPYDLMGAALIPASPEAWAPYPLYTTELTPAISHAAFTYPTATAAAAALHAQVRWYPSSDTTQQGWKYRQFC

SEQ ID NO: 34692 - protein, 209 aa, Homo sapiens
  ENSP00000300069
MSNLKPDGEHGGSTGTGSGAGSGGALEEEVRTLFVSGLPVDIKPRELYLLFRPFKGYEGSLIKLTARQPVGFVIFDSRAGAEAAKNALNGIRFDPENPQTLRLEFAKANTKMAKSKLMATPNPSNVHPALGAHFIARDPYDLMGAALIPASPEAWAPYPLYTTELTPAISHAAFTYPTATAAAAALHAQVRWYPSSDTTQQGWKYRQFC

SEQ ID NO: 34693 - protein, 197 aa, Homo sapiens [sequence omitted]

SEQ ID NO: 34694 - protein, 243 aa, Homo sapiens
  ENSP00000360425
MRGESYFIGMRSPGQQGHVPEDGGLFLLCCIDRDWAVTRCFAEEAFQAITDFNDLPNSLFACNVHQSVFEGEESKEKFEGLFRTYDDCVTFQLFKSFRRVRINFSNPKSAARARIELHETQFRGKKLKLYFAQVQTPETDGDKLHLAPPQPAKQFLISPPSSPPVGWQPINDATPVLNYDLLYAVAKLGPGEKYELHAGTESTPSVVVHVCDSDIEEEEDPKTSPKPKIIQTRRPGLPPSVSN

SEQ ID NO: 34695 - protein, 243 aa, Homo sapiens; identical to SEQ ID NO: 34694
  ENSP00000305223

SEQ ID NO: 34696 - protein, 224 aa, Homo sapiens
  ENSP00000384317
MPAPSMDCDVSTLVACVVDVEVFTNQEVKEKFEGLFRTYDDCVTFQLFKSFRRVRINFSNPKSAARARIELHETQFRGKKLKLYFAQVQTPETDGDKLHLAPPQPAKQFLISPPSSPPVGWQPINDATPVLNYDLLYAVAKLGPGEKYELHAGTESTPSVVVHVCDSDIEEEEDPKTSPKPKIIQTRRPGLPPSVSNAACSFSIIAVSSLSCFFPLLFVKKNCL

SEQ ID NO: 34697 - protein, 58 aa, Homo sapiens
  ENSP00000436482
MLPRDERRFKAADLNGDLTATREEFTAFLHPEEFEHMKEIVVLETLEDIDKNGDGFVD

SEQ ID NO: 34698 - protein, 280 aa, Homo sapiens
  ENSP00000436422
MTGGEGPLPTAKQATCSPPSSRERNPRRRGSRPRKIVDRIDNDGDGFVTTEELKTWIKRVQKRYIFDNVAKVWKDYDRDKDDKISWEEYKQATYGYYLGNPAEFHDSSDHHTFKKMLPRDERRFKAADLNGDLTATREEFTAFLHPEEFEHMKEIVVLETLEDIDKNGDGFVDQDEYIADMFSHEENGPEPDWVLSEREQFNEFRDLNKDGKLDKDEIRHWILPQDYDHAQAEARHLVYESDKNKDEKLTKEEILENWNMFVGSQATNYGEDLTKNHDEL

SEQ ID NO: 34699 - protein, 331 aa, Homo sapiens
  ENSP00000054950
MARGGRGRRLGLALGLLLALVLAPRVLRAKPTVRKERVVRPDSELGERPPEDNQSFQYDHEAFLGKEDSKTFDQLTPDESKERLGKIVDRIDNDGDGFVTTEELKTWIKRVQKRYIFDNVAKVWKDYDRDKDDKISWEEYKQATYGYYLGNPAEFHDSSDHHTFKKMLPRDERRFKAADLNGDLTATREEFTAFLHPEEFEHMKEIVVLETLEDIDKNGDGFVDQDEYIADMFSHEENGPEPDWVLSEREQFNEFRDLNKDGKLDKDEIRHWILPQDYDHAQAEARHLVYESDKNKDEKLTKEEILENWNMFVGSQATNYGEDLTKNHDEL

SEQ ID NO: 34700 - protein, 19 aa, Homo sapiens
  ENSP00000433249
MLPRDERRFKAADLNGDLT

SEQ ID NO: 34701 - protein, 57 aa, Homo sapiens
  ENSP00000436427
  MOD_RES (1)..(1): Any amino acid
XETLEDIDKNGDGFVDQDEYIDKETSGSVTELSQKPGFIFWLLNSVLSTPPHGLHHE

SEQ ID NO: 34702 - protein, 28 aa, Homo sapiens
  ENSP00000433237
EILENWNMFVGSQATNYGEDLTKNHDEL

SEQ ID NO: 34703 - protein, 317 aa, Homo sapiens
  ENSP00000378349
MRLGPRTAALGLLLLCAAAAGAGKAEELHYPLGERRSDYDREALLGVQEDVDEYVKLGHEEQQKRLQAIIKKIDLDSDGFLTESELSSWIQMSFKHYAMQEAKQQFVEYDKNSDDTVTWDEYNIQMYDRVIDFDENTALDDAEEESFRKLHLKDKKRFEKANQDSGPGLSLEEFIAFEHPEEVDYMTEFVIQEALEEHDKNGDGFVSLEEFLGDYRWDPTANEDPEWILVEKDRFVNDYDKDNDGRLDPQELLPWVVPNNQGIAQEEALHLIDEMDLNGDKKLSEEEILENPDLFLTSEATDYGRQLHDDYFYHDEL

SEQ ID NO: 34704 - protein, 335 aa, Homo sapiens
  ENSP00000319739
MRLGPRTAALGLLLLCAAAAGAGKAEELHYPLGERRSDYDREALLGVQEDVDEYVKLGHEEQQKRLQAIIKKIDLDSDGFLTESELSSWIQMSFKHYAMQEAKQQFVEYDKNSDDTVTWDEYNIQMYDRVIDFDENTALDDAEEESFRKEFAICKKQSFCFWLLRFNLHLKDKKRFEKANQDSGPGLSLEEFIAFEHPEEVDYMTEFVIQEALEEHDKNGDGFVSLEEFLGDYRWDPTANEDPEWILVEKDRFVNDYDKDNDGRLDPQELLPWVVPNNQGIAQEEALHLIDEMDLNGDKKLSEEEILENPDLFLTSEATDYGRQLHDDYFYHDEL

SEQ ID NO: 34705 - protein, 216 aa, Homo sapiens
  ENSP00000378347
MRLGPRTAALGLLLLCAAAAGAGKAEELHYPLGERRSDYDREALLGVQLHLKDKKRFEKANQDSGPGLSLEEFIAFEHPEEVDYMTEFVIQEALEEHDKNGDGFVSLEEFLGDYRWDPTANEDPEWILVEKDRFVNDYDKDNDGRLDPQELLPWVVPNNQGIAQEEALHLIDEMDLNGDKKLSEEEILENPDLFLTSEATDYGRQLHDDYFYHDEL

SEQ ID NO: 34706 - protein, 155 aa, Homo sapiens
  ENSP00000453052
  MOD_RES (1)..(1): Any amino acid
XGLLLLCAAAAGAGKAEELHYPLGERRSDYDREALLGVQEDVDEYVKLGHEEQQKRLQAIIKKIDLDSDGFLTESELSSWIQMSFKHYAMQEAKQQFVEYDKNSDDTVTWDEYNIQMYDRVIDFDENTALDDAEEESFRKHQCGGLGLHPQSQSA

SEQ ID NO: 34707 - protein, 971 aa, Homo sapiens
  ENSP00000367202
MATVRASLRGALLLLLAVAGVAEVAGGLAPGSAGALCCNHSKDNQMCRDVCEQIFSSKSESRLKHLLQRAPDYCPETMVEIWNCMNSSLPGVFKKSDGWVGLGCCELAIALECRQACKQASSKNDISKVCRKEYENALFSCISRNEMGSVCCSYAGHHTNCREYCQAIFRTDSSPGPSQIKAVENYCASISPQLIHCVNNYTQSYPMRNPTDSLYCCDRAEDHACQNACKRILMSKKTEMEIVDGLIEGCKTQPLPQDPLWQCFLESSQSVHPGVTVHPPPSTGLDGAKLHCCSKANTSTCRELCTKLYSMSWGNTQSWQEFDRFCEYNPVEVSMLTCLADVREPCQLGCRNLTYCTNFNNRPTELFRSCNAQSDQGAMNDMKLWEKGSIKMPFINIPVLDIKKCQPEMWKAIACSLQIKPCHSKSRGSIICKSDCVEILKKCGDQNKFPEDHTAESICELLSPTDDLKNCIPLDTYLRPSTLGNIVEEVTHPCNPNPCPANELCEVNRKGCPSGDPCLPYFCVQGCKLGEASDFIVRQGTLIQVPSSAGEVGCYKICSCGQSGLLENCMEMHCIDLQKSCIVGGKRKSHGTSFSIDCNVCSCFAGNLVCSTRLCLSEHSSEDDRRTFTGLPCNCADQFVPVCGQNGRTYPSACIARCVGLQDHQFEFGSCMSKDPCNPNPCQKNQRCIPKPQVCLTTFDKFGCSQYECVPRQLACDQVQDPVCDTDHMEHNNLCTLYQRGKSLSYKGPCQPFCRATEPVCGHNGETYSSVCAAYSDRVAVDYYGDCQAVGVLSEHSSVAECASVKCPSLLAAGCKPIIPPGACCPLCAGMLRVLFDKEKLDTIAKVTNKKPITVLEILQKIRMHVSVPQCDVFGYFSIESEIVILIIPVDHYPKALQIEACNKEAEKIESLINSDSPTLASHVPLSALIISQVQVSSSVPSAGVRARPSCHSLLLPLSLGLALHLLWTYN

SEQ ID NO: 34708 - protein, 201 aa, Homo sapiens
  ENSP00000165698
MVSWIISRLVVLIFGTLYPAYYSYKAVKSKDIKEYVKWMMYWIIFALFTTAETFTDIFLCWFPFYYELKIAFVAWLLSPYTKGSSLLYRKFVHPTLSSKEKEIDDCLVQAKDRSYDALVHFGKRGLNVAATAAVMAASKGQGALSERLRSFSMQDLTTIRGDGAPAPSGPPPPGSGRASGKHGQPKMSRSASESASSSGTA

SEQ ID NO: 34709 - protein, 284 aa, Homo sapiens
  ENSP00000438346
MVSWIISRLVVLIFGTLYPAYYSYKAVKSKDIKEYVKWMMYWIIFALFTTAETFTDIFLCWFPFYYELKIAFVAWLLSPYTKGSSLLYRKFVHPTLSSKEKEIDDCLVQAKDRSYDALVHFGKRGLNVAATAAVMAASKGQGALSERLRSFSMQDLTTIRGDGAPAPSGPPPPGSGRASGKHGQPKMSRSASESASSSVCTCCSTCRTWKVVEGDVNEGGMKAWEPHQVQNPLAFSDDEEEDLLDFMYKYKAPRRMELPLEAPPRILRSRFRKKSTSSSATETT

SEQ ID NO: 34710 - protein, 174 aa, Homo sapiens
  ENSP00000437567
MDHLQAGGVKWMMYWIIFALFTTAETFTDIFLCWFPFYYELKIAFVAWLLSPYTKGSSLLYRKFVHPTLSSKEKEIDDCLVQAKDRSYDALVHFGKRGLNVAATAAVMAASKGQGALSERLRSFSMQDLTTIRGDGAPAPSGPPPPGSGRASGKHGQPKMSRSASESASSSGTA

SEQ ID NO: 34711 - protein, 143 aa, Homo sapiens
  ENSP00000442681
MVSWIISRLVVLIFGTLYPAYYSYKAVKSKDIKEYVKWMMYWIIFALFTTAETFTDIFLCWDRVPYRRDCGASACRTSPPSGETAPLLPRAPHHRGLGGPAANTASLRCPGVLLRALAAQAPPRILRSRFRKKSTSSSATETT

SEQ ID NO: 34712 - protein, 208 aa, Homo sapiens
  ENSP00000392197
MQKVLSNGQTEEVRSGSRLIFGTLYPAYYSYKAVKSKDIKEYVKWMMYWIIFALFTTAETFTDIFLCWFPFYYELKIAFVAWLLSPYTKGSSLLYRKFVHPTLSSKEKEIDDCLVQAKDRSYDALVHFGKRGLNVAATAAVMAASKGQGALSERLRSFSMQDLTTIRGDGAPAPSGPPPPGSGRASGKHGQPKMSRSASESASSSGTA

SEQ ID NO: 34713 - protein, 147 aa, Homo sapiens
  ENSP00000475269
  MOD_RES (1)..(1): Any amino acid
XSYKAVKSKDIKEYVKWMMYWIIFALFTTAETFTDIFLCWFPFYYELKIAFVAWLLSPYTKGSSLLYRKFVHPTLSSKEKEIDDCLVQAKDRSYDALVHFGKRGLNVAATAAVMAASKVLCWKYHNYMSLSPSSVPCSSPVRPHRTG

SEQ ID NO: 34714 - protein, 3460 aa, Homo sapiens [sequence omitted]

SEQ ID NO: 34715 - protein, 68 aa, Homo sapiens
  ENSP00000404818
  MOD_RES (1)..(1): Any amino acid
XLRWWQPRHNGTGHDQWALDHVEVVLDEKSYIASKPDQTFMTNHSAACIERHFLTCVIFHYLLSLVFH

SEQ ID NO: 34716 - protein, 3458 aa, Homo sapiens
  ENSP00000345694
MERSGWARQTFLLALLLGATLRARAAAGYYPRFSPFFFLCTHHGELEGDGEQGEVLISLHIAGNPTYYVPGQEYHVTISTSTFFDGLLVTGLYTSTSVQASQSIGGSSAFGFGIMSDHQFGNQFMCSVVASHVSHLPTTNLSFIWIAPPAGTGCVNFMATATHRGQVIFKDALAQQLCEQGAPTDVTVHPHLAEIHSDSIILRDDFDSYHQLQLNPNIWVECNNCETGEQCGAIMHGNAVTFCEPYGPRELITTGLNTTTASVLQFSIGSGSCRFSYSDPSIIVLYAKNNSADWIQLEKIRAPSNVSTIIHILYLPEDAKGENVQFQWKQENLRVGEVYEACWALDNILIINSAHRQVVLEDSLDPVDTGNWLFFPGATVKHSCQSDGNSIYFHGNEGSEFNFATTRDVDLSTEDIQEQWSEEFESQPTGWDVLGAVIGTECGTIESGLSMVFLKDGERKLCTPSMDTTGYGNLRFYFVMGGICDPGNSHENDIILYAKIEGRKEHITLDTLSYSSYKVPSLVSVVINPELQTPATKFCLRQKNHQGHNRNVWAVDFFHVLPVLPSTMSHMIQFSINLGCGTHQPGNSVSLEFSTNHGRSWSLLHTECLPEICAGPHLPHSTVYSSENYSGWNRITIPLPNAALTRNTRIRWRQTGPILGNMWAIDNVYIGPSCLKFCSGRGQCTRHGCKCDPGFSGPACEMASQTFPMFISESFGSSRLSSYHNFYSIRGAEVSFGCGVLASGKALVFNKDGRRQLITSFLDSSQSRFLQFTLRLGSKSVLSTCRAPDQPGEGVLLHYSYDNGITWKLLEHYSYLSYHEPRIISVELPGDAKQFGIQFRWWQPYHSSQREDVWAIDEIIMTSVLFNSISLDFTNLVEVTQSLGFYLGNVQPYCGHDWTLCFTGDSKLASSMRYVETQSMQIGASYMIQFSLVMGCGQKYTPHMDNQVKLEYSTNHGLTWHLVQEECLPSMPSCQEFTSASIYHASEFTQWRRVIVLLPQKTWSSATRFRWSQSYYTAQDEWALDSIYIGQQCPNMCSGHGSCDHGICRCDQGYQGTECHPEAALPSTIMSDFENQNGWESDWQEVIGGEIVKPEQGCGVISSGSSLYFSKAGKRQLVSWDLDTSWVDFVQFYIQIGGESASCNKPDSREEGVLLQYSNNGGIQWHLLAEMYFSDFSKPRFVYLELPAAAKTPCTRFRWWQPVFSGEDYDQWAVDDIIILSEKQKQIIPVINPTLPQNFYEKPAFDYPMNQMSVWLMLANEGMVKNETFCAATPSAMIFGKSDGDRFAVTRDLTLKPGYVLQFKLNIGCANQFSSTAPVLLQYSHDAGMSWFLVKEGCYPASAGKGCEGNSRELSEPTMYHTGDFEEWTRITIVIPRSLASSKTRFRWIQESSSQKNVPPFGLDGVYISEPCPSYCSGHGDCISGVCFCDLGYTAAQGTCVSNVPNHNEMFDRFEGKLSPLWYKITGAQVGTGCGTLNDGKSLYFNGPGKREARTVPLDTRNIRLVQFYIQIGSKTSGITCIKPRTRNEGLIVQYSNDNGILWHLLRELDFMSFLEPQIISIDLPQDAKTPATAFRWWQPQHGKHSAQWALDDVLIGMNDSSQTGFQDKFDGSIDLQANWYRIQGGQVDIDCLSMDTALIFTENIGKPRYAETWDFHVSASTFLQFEMSMGCSKPFSNSHSVQLQYSLNNGKDWHLVTEECVPPTIGCLHYTESSIYTSERFQNWKRITVYLPLSTISPRTRFRWIQANYTVGADSWAIDNVVLASGCPWMCSGRGICDAGRCVCDRGFGGPYCVPVVPLPSILKDDFNGNLHPDLWPEVYGAERGNLNGETIKSGTSLIFKGEGLRMLISRDLDCTNTMYVQFSLRFIAKSTPERSHSILLQFSISGGITWHLMDEFYFPQTTNILFINVPLPYTAQTNATRFRLWQPYNNGKKEEIWIVDDFIIDGNNVNNPVMLLDTFDFGPREDNWFFYPGGNIGLYCPYSSKGAPEEDSAMVFVSNEVGEHSITTRDLNVNENTIIQFEINVGCSTDSSSADPVRLEFSRDFGATWHLLLPLCYHSSSHVSSLCSTEHHPSSTYYAGTMQGWRREVVHFGKLHLCGSVRFRWYQGFYPAGSQPVTWAIDNVYIGPQCEEMCNGQGSCINGTKCICDPGYSGPTCKISTKNPDFLKDDFEGQLESDRFLLMSGGKPSRKCGILSSGNNLFFNEDGLRMLMTRDLDLSHARFVQFFMRLGCGKGVPDPRSQPVLLQYSLNGGLSWSLLQEFLFSNSSNVGRYIALEIPLKARSGSTRLRWWQPSENGHFYSPWVIDQILIGGNISGNTVLEDDFTTLDSRKWLLHPGGTKMPVCGSTGDALVFIEKASTRYVVSTDVAVNEDSFLQIDFAASCSVTDSCYAIELEYSVDLGLSWHPLVRDCLPTNVECSRYHLQRILVSDTFNKWTRITLPLPPYTRSQATRFRWHQPAPFDKQQTWAIDNVYIGDGCIDMCSGHGRCIQGNCVCDEQWGGLYCDDPETSLPTQLKDNFNRAPSSQNWLTVNGGKLSTVCGAVASGMALHFSGGCSRLLVTVDLNLTNAEFIQFYFMYGCLITPNNRNQGVLLEYSVNGGITWNLLMEIFYDQYSKPGFVNILLPPDAKEIATRFRWWQPRHDGLDQNDWAIDNVLISGSADQRTVMLDTFSSAPVPQHERSPADAGPVGRIAFDMFMEDKTSVNEHWLFHDDCTVERFCDSPDGVMLCGSHDGREVYAVTHDLTPTEGWIMQFKISVGCKVSEKIAQNQIHVQYSTDFGVSWNYLVPQCLPADPKCSGSVSQPSVFFPTKGWKRITYPLPESLVGNPVRFRFYQKYSDMQWAIDNFYLGPGCLDNCRGHGDCLREQCICDPGYSGPNCYLTHTLKTFLKERFDSEEIKPDLWMSLEGGSTCTECGILAEDTALYFGGSTVRQAVTQDLDLRGAKFLQYWGRIGSENNMTSCHRPICRKEGVLLDYSTDGGITWTLLHEMDYQKYISVRHDYILLPEDALTNTTRLRWWQPFVISNGIVVSGVERAQWALDNILIGGAEINPSQLVDTFDDEGTSHEENWSFYPNAVRTAGFCGNPSFHLYWPNKKKDKTHNALSSRELIIQPGYMMQFKIVVGCEATSCGDLHSVMLEYTKDARSDSWQLVQTQCLPSSSNSIGCSPFQFHEATIYNSVNSSSWKRITIQLPDHVSSSATQFRWIQKGEETEKQSWAIDHVYIGEACPKLCSGHGYCTTGAICICDESFQGDDCSVFSHDLPSYIKDNFESARVTEANWETIQGGVIGSGCGQLAPYAHGDSLYFNGCQIRQAATKPLDLTRASKIMFVLQIGSMSQTDSCNSDLSGPHAVDKAVLLQYSVNNGITWHVIAQHQPKDFTQAQRVSYNVPLEARMKGVLLRWWQPRHNGTGHDQWALDHVEVVLTRKQNYMMNFSRQHGLRHFYNRRRRSLRRYP

SEQ ID NO: 34717 - protein, 3460 aa, Homo sapiens
  ENSP00000392423
MERSGWARQTFLLALLLGATLRARAAAGYYPRFSPFFFLCTHHGELEGDGEQGEVLISLHIAGNPTYYVPGQEYHVTISTSTFFDGLLVTGLYTSTSVQASQSIGGSSAFGFGIMSDHQFGNQFMCSVVASHVSHLPTTNLSFIWIAPPAGTGCVNFMATATHRGQVIFKDALAQQLCEQGAPTDVTVHPHLAEIHSDSIILRDDFDSYHQLQLNPNIWVECNNCETGEQCGAIMHGNAVTFCEPYGPRELITTGLNTTTASVLQFSIGSGSCRFSYSDPSIIVLYAKNNSADWIQLEKIRAPSNVSTIIHILYLPEDAKGENVQFQWKQENLRVGEVYEACWALDNILIINSAHRQVVLEDSLDPVDTGNWLFFPGATVKHSCQSDGNSIYFHGNEGSEFNFATTRDVDLSTEDIQEQWSEEFESQPTGWDVLGAVIGTECGTIESGLSMVFLKDGERKLCTPSMDTTGYGNLRFYFVMGGICDPGNSHENDIILYAKIEGRKEHITLDTLSYSSYKVPSLVSVVINPELQTPATKFCLRQKNHQGHNRNVWAVDFFHVLPVLPSTMSHMIQFSINLGCGTHQPGNSVSLEFSTNHGRSWSLLHTECLPEICAGPHLPHSTVYSSENYSGWNRITIPLPNAALTRNTRIRWRQTGPILGNMWAIDNVYIGPSCLKFCSGRGQCTRHGCKCDPGFSGPACEMASQTFPMFISESFGSSRLSSYHNFYSIRGAEVSFGCGVLASGKALVFNKDGRRQLITSFLDSSQSRFLQFTLRLGSKSVLSTCRAPDQPGEGVLLHYSYDNGITWKLLEHYSYLSYHEPRIISVELPGDAKQFGIQFRWWQPYHSSQREDVWAIDEIIMTSVLFNSISLDFTNLVEVTQSLGFYLGNVQPYCGHDWTLCFTGDSKLASSMRYVETQSMQIGASYMIQFSLVMGCGQKYTPHMDNQVKLEYSTNHGLTWHLVQEECLPSMPSCQEFTSASIYHASEFTQWRRVIVLLPQKTWSSATRFRWSQSYYTAQDEWALDSIYIGQQCPNMCSGHGSCDHGICRCDQGYQGTECHPEAALPSTIMSDFENQNGWESDWQEVIGGEIVKPEQGCGVISSGSSLYFSKAGKRQLVSWDLDTSWVDFVQFYIQIGGESASCNKPDSREEGVLLQYSNNGGIQWHLLAEMYFSDFSKPRFVYLELPAAAKTPCTRFRWWQPVFSGEDYDQWAVDDIIILSEKQKQIIPVINPTLPQNFYEKPAFDYPMNQMSVWLMLANEGMVKNETFCAATPSAMIFGKSDGDRFAVTRDLTLKPGYVLQFKLNIGCANQFSSTAPVLLQYSHDAGMSWFLVKEGCYPASAGKGCEGNSRELSEPTMYHTGDFEEWTRITIVIPRSLASSKTRFRWIQESSSQKNVPPFGLDGVYISEPCPSYCSGHGDCISGVCFCDLGYTAAQGTCVSNVPNHNEMFDRFEGKLSPLWYKITGAQVGTGCGTLNDGKSLYFNGPGKREARTVPLDTRNIRLVQFYIQIGSKTSGITCIKPRTRNEGLIVQYSNDNGILWHLLRELDFMSFLEPQIISIDLPQDAKTPATAFRWWQPQHGKHSAQWALDDVLIGMNDSSQTGFQDKFDGSIDLQANWYRIQGGQVDIDCLSMDTALIFTENIGKPRYAETWDFHVSASTFLQFEMSMGCSKPFSNSHSVQLQYSLNNGKDWHLVTEECVPPTIGCLHYTESSIYTSERFQNWKRITVYLPLSTISPRTRFRWIQANYTVGADSWAIDNVVLASGCPWMCSGRGICDAGRCVCDRGFGGPYCVPVVPLPSILKDDFNGNLHPDLWPEVYGAERGNLNGETIKSGTSLIFKGEGLRMLISRDLDCTNTMYVQFSLRFIAKSTPERSHSILLQFSISGGITWHLMDEFYFPQTTNILFINVPLPYTAQTNATRFRLWQPYNNGKKEEIWIVDDFIIDGNNVNNPVMLLDTFDFGPREDNWFFYPGGNIGLYCPYSSKGAPEEDSAMVFVSNEVGEHSITTRDLNVNENTIIQFEINVGCSTDSSSADPVRLEFSRDFGATWHLLLPLCYHSSSHVSSLCSTEHHPSSTYYAGTMQGWRREVVHFGKLHLCGSVRFRWYQGFYPAGSQPVTWAIDNVYIGPQCEEMCNGQGSCINGTKCICDPGYSGPTCKISTKNPDFLKDDFEGQLESDRFLLMSGGKPSRKCGILSSGNNLFFNEDGLRMLMTRDLDLSHARFVQFFMRLGCGKGVPDPRSQPVLLQYSLNGGLSWSLLQEFLFSNSSNVGRYIALEIPLKARSGSTRLRWWQPSENGHFYSPWVIDQILIGGNISGNTVLEDDFTTLDSRKWLLHPGGTKMPVCGSTGDALVFIEKASTRYVVSTDVAVNEDSFLQIDFAASCSVTDSCYAIELEYSVDLGLSWHPLVRDCLPTNVECSRYHLQRILVSDTFNKWTRITLPLPPYTRSQATRFRWHQPAPFDKQQTWAIDNVYIGDGCIDMCSGHGRCIQGNCVCDEQWGGLYCDDPETSLPTQLKDNFNRAPSSQNWLTVNGGKLSTVCGAVASGMALHFSGGCSRLLVTVDLNLTNAEFIQFYFMYGCLITPNNRNQGVLLEYSVNGGITWNLLMEIFYDQYSKPGFVNILLPPDAKEIATRFRWWQPRHDGLDQNDWAIDNVLISGSADQRTVMLDTFSSAPVPQHERSPADAGPVGRIAFDMFMEDKTSVNEHWLFHDDCTVERFCDSPDGVMLCGSHDGREVYAVTHDLTPTEGWIMQFKISVGCKVSEKIAQNQIHVQYSTDFGVSWNYLVPQCLPADPKCSGSVSQPSVFFPTKGWKRITYPLPESLVGNPVRFRFYQKYSDMQWAIDNFYLGPGCLDNCRGHGDCLREQCICDPGYSGPNCYLTHTLKTFLKERFDSEEIKPDLWMSLEGGSTCTECGILAEDTALYFGGSTVRQAVTQDLDLRGAKFLQYWGRIGSENNMTSCHRPICRKEGVLLDYSTDGGITWTLLHEMDYQKYISVRHDYILLPEDALTNTTRLRWWQPFVISNGIVVSGVERAQWALDNILIGGAEINPSQLVDTFDDEGTSHEENWSFYPNAVRTAGFCGNPSFHLYWPNKKKDKTHNALSSRELIIQPGYMMQFKIVVGCEATSCGDLHSVMLEYTKDARSDSWQLVQTQCLPSSSNSIGCSPFQFHEATIYNSVNSSSWKRITIQLPDHVSSSATQFRWIQKGEETEKQSWAIDHVYIGEACPKLCSGHGYCTTGAICICDESFQGDDCSVFSHDLPSYIKDNFESARVTEANWETIQGGVIGSGCGQLAPYAHGDSLYFNGCQIRQAATKPLDLTRASKIMFVLQIGSMSQTDSCNSDLSGPHAVDKAVLLQYSVNNGITWHVIAQHQPKDFTQAQRVSYNVPLEARMKGVLLRWWQPRHNGTGHDQWALDHVEVVLVSTRKQNYMMNFSRQHGLRHFYNRRRRSLRRYP

SEQ ID NO: 34718 - protein, 236 aa, Homo sapiens
  ENSP00000310335
MGQKASQQLALKDSKEVPVVCEVVSEAIVHAAQKLKEYLGFEYPPSKLCPAANTLNEIFLIHFITFCQEKGVDEWLTTTKMTKHQAFLFGADWIWTFWGSNKQIKLQLAVQTLQMSSPPPVESKPCDLSNPESRVEESSWKKSRFDKLEEFCNLIGEDCLGLFIIFGMPGKPKDIRGVVLDSVKSQMVRSHLPGGKAVAQFVLETEDCVFIKELLRNCLSKKDGLREVGKVYISIL

SEQ ID NO: 34719 - protein, 146 aa, Homo sapiens
  ENSP00000428562
MLERRCRGPLAMGLAQPRLLSGPSQESPQTLGKESRGLRQQGTSVAQSGAQAPGRAHRCAHCRRHFPGWVALWLHTRRCQARLPLPCPECGRRFRHAPFLALHRQVHAAATPDLGFACHLCGQSFRGWVALVLHLRAHSAAKRPIA

SEQ ID NO: 34720 - protein, 136 aa, Homo sapiens
  ENSP00000420578
MGIGVSLLLQFSLTPGGYRSVGRSRRCSRGSIPRNIPKRSWKKPHPQLCSLQGSSVSVCPASQSCCAARMWHRKQQTQGEGSIRHCREQWPHFLQRKNRCWNVVAGAPWPWAWPSPDSFLGPPRSHPRPWGRSPAG

SEQ ID NO: 34721 - protein, 55 aa, Homo sapiens
  ENSP00000418507
MDGRRVPAQPAAEQRKNRCWNVVAGAPWPWAWPSPDSFLGPPRSHPRPWGRSPAG

SEQ ID NO: 34722 - protein, 624 aa, Homo sapiens
  ENSP00000417291
MGIGVSLLLQFSLTPGGYRSVGRSRRCSRGSIPRNIPKRSWKKPHPQLCSLQAEEEPMLERRCRGPLAMGLAQPRLLSGPSQESPQTLGKESRGLRQQGTSVAQSGAQAPGRAHRCAHCRRHFPGWVALWLHTRRCQARLPLPCPECGRRFRHAPFLALHRQVHAAATPDLGFACHLCGQSFRGWVALVLHLRAHSAAKRPIACPKCERRFWRRKQLRAHLRRCHPPAPEARPFICGNCGRSFAQWDQLVAHKRVHVAEALEEAAAKALGPRPRGRPAVTAPRPGGDAVDRPFQCACCGKRFRHKPNLIAHRRVHTGERPHQCPECGKRFTNKPYLTSHRRIHTGEKPYPCKECGRRFRHKPNLLSHSKIHKRSEGSAQAAPGPGSPQLPAGPQESAAEPTPAVPLKPAQEPPPGAPPEHPQDPIEAPPSLYSCDDCGRSFRLERFLRAHQRQHTGERPFTCAECGKNFGKKTHLVAHSRVHSGERPFACEECGRRFSQGSHLAAHRRDHAPDRPFVCPDCGKAFRHKPYLAAHRRIHTGEKPYVCPDCGKAFSQKSNLVSHRRIHTGERPYACPDCDRSFSQKSNLITHRKSHIRDGAFCCAICGQTFDDEERLLAHQKKHDV

SEQ ID NO: 34723 - protein, 366 aa, Homo sapiens
  ENSP00000419789
MDGRRVPAQPAAEFSLTPGGYRSVGRSRRCSRGSIPRNIPKRSWKKPHPQLCSLQEEEPMLERRCRGPLAMGLAQPRLLSGPSQESPQTLGKESRGLRQQGTSVAQSGAQAPGRAHRCAHCRRHFPGWVALWLHTRRCQARLPLPCPECGRRFRHAPFLALHRQVHAAATPDLGFACHLCGQSFRGWVALVLHLRAHSAAKRPIACPKCERRFWRRKQLRAHLRRCHPPAPEARPFICGNCGRSFAQWDQLVAHKRVHVAEALEEAAAKALGPRPRGRPAVTAPRPGGDAVDRPFQCACCGKRFRHKPNLIAHRRVHTGERPHQCPECGKRFTNKPYLTSHRRIHTGEKPYPCKECGRRFRHKPNL

SEQ ID NO: 34724 - protein, 136 aa, Homo sapiens; identical to SEQ ID NO: 34720
  ENSP00000417982

SEQ ID NO: 34725 - protein, 393 aa, Homo sapiens
  ENSP00000419872
MDGRRVPAQPAAEFSLTPGGYRSVGRSRRCSRGSIPRNIPKRSWKKPHPQLCSLQAEEEPMLERRCRGPLAMGLAQPRLLSGPSQESPQTLGKESRGLRQQGTSVAQSGAQAPGRAHRCAHCRRHFPGWVALWLHTRRCQARLPLPCPECGRRFRHAPFLALHRQVHAAATPDLGFACHLCGQSFRGWVALVLHLRAHSAAKRPIACPKCERRFWRRKQLRAHLRRCHPPAPEARPFICGNCGRSFAQWDQLVAHKRVHVAEALEEAAAKALGPRPRGRPAVTAPRPGGDAVDRPFQCACCGKRFRHKPNLIAHRRVHTGERPHQCPECGKRFTNKPYLTSHRRIHTGEKPYPCKECGRRFRHKPNLLSHSKIHKRSEGSAQAAPGPGSPQLP

SEQ ID NO: 34726 - protein, 47 aa, Homo sapiens
  ENSP00000418279
MDGRRVPAQPAAEVRPGQGRGATAGPRGAAPPAGRVTVRLASLQSEV

SEQ ID NO: 34727 - protein, 136 aa, Homo sapiens
  ENSP00000428129
MDGRRVPAQPAAEVRPGQGRGATAGPRGAAPPAGRVTVSVRDRVRGRTDAGTSLQGPPGHGPGPAPTPFWALPGVTPDPGEGVPRAEATRHVSGPVWCPSPRQGPSLCPLSKALPWLGGSVASHPPVPGPAALALP

SEQ ID NO: 34728 - protein, 47 aa, Homo sapiens; identical to SEQ ID NO: 34726
  ENSP00000427721

SEQ ID NO: 34729 - protein, 87 aa, Homo sapiens
  ENSP00000417786
MGIGVSLLLQFSLTPGGYRSVGRSRRCSRGSIPRNIPKRSWKKPHPQLCSLQGLVIFDVSQLLHLLNRELSVCLSSFSELLCSSDVA

SEQ ID NO: 34730 - protein, 567 aa, Homo sapiens
  ENSP00000388287
MLERRCRGPLAMGLAQPRLLSGPSQESPQTLGKESRGLRQQGTSVAQSGAQAPGRAHRCAHCRRHFPGWVALWLHTRRCQARLPLPCPECGRRFRHAPFLALHRQVHAAATPDLGFACHLCGQSFRGWVALVLHLRAHSAAKRPIACPKCERRFWRRKQLRAHLRRCHPPAPEARPFICGNCGRSFAQWDQLVAHKRVHVAEALEEAAAKALGPRPRGRPAVTAPRPGGDAVDRPFQCACCGKRFRHKPNLIAHRRVHTGERPHQCPECGKRFTNKPYLTSHRRIHTGEKPYPCKECGRRFRHKPNLLSHSKIHKRSEGSAQAAPGPGSPQLPAGPQESAAEPTPAVPLKPAQEPPPGAPPEHPQDPIEAPPSLYSCDDCGRSFRLERFLRAHQRQHTGERPFTCAECGKNFGKKTHLVAHSRVHSGERPFACEECGRRFSQGSHLAAHRRDHAPDRPFVCPDCGKAFRHKPYLAAHRRIHTGEKPYVCPDCGKAFSQKSNLVSHRRIHTGERPYACPDCDRSFSQKSNLITHRKSHIRDGAFCCAICGQTFDDEERLLAHQKKHDV

SEQ ID NO: 34731 - protein, 567 aa, Homo sapiens; identical to SEQ ID NO: 34730
  ENSP00000380451

SEQ ID NO: 34732 - protein, 567 aa, Homo sapiens; identical to SEQ ID NO: 34730
  ENSP00000407714

SEQ ID NO: 34733 - protein, 199 aa, Homo sapiens
  ENSP00000256953
MAKSAEVKLAIFGRAGVGKSALVVRFLTKRFIWEYDPTLESTYRHQATIDDEVVSMEILDTAGQEDTIQREGHMRWGEGFVLVYDITDRGSFEEVLPLKNILDEIKKPKNVTLILVGNKADLDHSRQVSTEEGEKLATELACAFYECSACTGEGNITEIFYELCREVRRRRMVQGKTRRRSSTTHVKQAINKMLTKISS

SEQ ID NO: 34734 - protein, 199 aa, Homo sapiens; identical to SEQ ID NO: 34733
  ENSP00000441505

SEQ ID NO: 34735 - protein, 199 aa, Homo sapiens; identical to SEQ ID NO: 34733
  ENSP00000438280

SEQ ID NO: 34736 - protein, 180 aa, Homo sapiens
  ENSP00000444485
MAKSAEVKLAIFGRAGVGKSESTYRHQATIDDEVVSMEILDTAGQEDTIQREGHMRWGEGFVLVYDITDRGSFEEVLPLKNILDEIKKPKNVTLILVGNKADLDHSRQVSTEEGEKLATELACAFYECSACTGEGNITEIFYELCREVRRRRMVQGKTRRRSSTTHVKQAINKMLTKISS

SEQ ID NO: 34737 - protein, 113 aa, Homo sapiens
  ENSP00000439532
MIRYILQRRRMIHLRNWIVLKERKSITEKGNFKALVVRFLTKRFIWEYDPTLESTYRHQATIDDEVVSMEILDTAGQEDTIQREGHMRWGEGFVLVYDITDRGSFEEVLPLKN

SEQ ID NO: 34738 - protein, 70 aa, Homo sapiens
  ENSP00000441860
MAKSAEVKLAIFGRAGVGKSALVVRFLTKRFIWEYDPTLESTYRHQATIDDEVVSMEILDTAGQVNKEFS

SEQ ID NO: 34739 - protein, 38 aa, Homo sapiens
  ENSP00000440887
MAKSAEVKLAIFGRAGVGKSALVVRFLTKRFIWEYDPT

SEQ ID NO: 34740 - protein, 1114 aa, Homo sapiens
  ENSP00000347942
MAKATSGAAGLRLLLLLLLPLLGKVALGLYFSRDAYWEKLYVDQAAGTPLLYVHALRDAPEEVPSFRLGQHLYGTYRTRLHENNWICIQEDTGLLYLNRSLDHSSWEKLSVRNRGFPLLTVYLKVFLSPTSLREGECQWPGCARVYFSFFNTSFPACSSLKPRELCFPETRPSFRIRENRPPGTFHQFRLLPVQFLCPNISVAYRLLEGEGLPFRCAPDSLEVSTRWALDREQREKYELVAVCTVHAGAREEVVMVPFPVTVYDEDDSAPTFPAGVDTASAVVEFKRKEDTVVATLRVFDADVVPASGELVRRYTSTLLPGDTWAQQTFRVEHWPNETSVQANGSFVRATVHDYRLVLNRNLSISENRTMQLAVLVNDSDFQGPGAGVLLLHFNVSVLPVSLHLPSTYSLSVSRRARRFAQIGKVCVENCQAFSGINVQYKLHSSGANCSTLGVVTSAEDTSGILFVNDTKALRRPKCAELHYMVVATDQQTSRQAQAQLLVTVEGSYVAEEAGCPLSCAVSKRRLECEECGGLGSPTGRCEWRQGDGKGITRNFSTCSPSTKTCPDGHCDVVETQDINICPQDCLRGSIVGGHEPGEPRGIKAGYGTCNCFPEEEKCFCEPEDIQDPLCDELCRTVIAAAVLFSFIVSVLLSAFCIHCYHKFAHKPPISSAEMTFRRPAQAFPVSYSSSGARRPSLDSMENQVSVDAFKILEDPKWEFPRKNLVLGKTLGEGEFGKVVKATAFHLKGRAGYTTVAVKMLKENASPSELRDLLSEFNVLKQVNHPHVIKLYGACSQDGPLLLIVEYAKYGSLRGFLRESRKVGPGYLGSGGSRNSSSLDHPDERALTMGDLISFAWQISQGMQYLAEMKLVHRDLAARNILVAEGRKMKISDFGLSRDVYEEDSYVKRSQGRIPVKWMAIESLFDHIYTTQSDVWSFGVLLWEIVTLGGNPYPGIPPERLFNLLKTGHRMERPDNCSEEMYRLMLQCWKQEPDKRPVFADISKDLEKMMVKRRDYLDLAASTPSDSLIYDDGLSEEETPLVDCNNAPLPRALPSTWIENKLYGMSDPNWPGESPVPLTRADGTNTGFPRYPNDSVYANWMLSPSAAKLMDTFDS

SEQ ID NO: 34741 - protein, 181 aa, Homo sapiens
  ENSP00000419080
MAKATSGAAGLRLLLLLLLPLLGKDVAEEAGCPLSCAVSKRRLECEECGGLGSPTGRCEWRQGDGKGITRNFSTCSPSTKTCPDGHCDVVETQDINICPQDCLRGSIVGGHEPGEPRGIKAGYGTCNCFPEEEKCFCEPEDIQDPLCDELCRTVIAAAVLFSFIVSVLLSAFCIHCYHKFA

SEQ ID NO: 34742 - protein, 1072 aa, Homo sapiens
  ENSP00000344798
MAKATSGAAGLRLLLLLLLPLLGKVALGLYFSRDAYWEKLYVDQAAGTPLLYVHALRDAPEEVPSFRLGQHLYGTYRTRLHENNWICIQEDTGLLYLNRSLDHSSWEKLSVRNRGFPLLTVYLKVFLSPTSLREGECQWPGCARVYFSFFNTSFPACSSLKPRELCFPETRPSFRIRENRPPGTFHQFRLLPVQFLCPNISVAYRLLEGEGLPFRCAPDSLEVSTRWALDREQREKYELVAVCTVHAGAREEVVMVPFPVTVYDEDDSAPTFPAGVDTASAVVEFKRKEDTVVATLRVFDADVVPASGELVRRYTSTLLPGDTWAQQTFRVEHWPNETSVQANGSFVRATVHDYRLVLNRNLSISENRTMQLAVLVNDSDFQGPGAGVLLLHFNVSVLPVSLHLPSTYSLSVSRRARRFAQIGKVCVENCQAFSGINVQYKLHSSGANCSTLGVVTSAEDTSGILFVNDTKALRRPKCAELHYMVVATDQQTSRQAQAQLLVTVEGSYVAEEAGCPLSCAVSKRRLECEECGGLGSPTGRCEWRQGDGKGITRNFSTCSPSTKTCPDGHCDVVETQDINICPQDCLRGSIVGGHEPGEPRGIKAGYGTCNCFPEEEKCFCEPEDIQDPLCDELCRTVIAAAVLFSFIVSVLLSAFCIHCYHKFAHKPPISSAEMTFRRPAQAFPVSYSSSGARRPSLDSMENQVSVDAFKILEDPKWEFPRKNLVLGKTLGEGEFGKVVKATAFHLKGRAGYTTVAVKMLKENASPSELRDLLSEFNVLKQVNHPHVIKLYGACSQDGPLLLIVEYAKYGSLRGFLRESRKVGPGYLGSGGSRNSSSLDHPDERALTMGDLISFAWQISQGMQYLAEMKLVHRDLAARNILVAEGRKMKISDFGLSRDVYEEDSYVKRSQGRIPVKWMAIESLFDHIYTTQSDVWSFGVLLWEIVTLGGNPYPGIPPERLFNLLKTGHRMERPDNCSEEMYRLMLQCWKQEPDKRPVFADISKDLEKMMVKRRDYLDLAASTPSDSLIYDDGLSEEETPLVDCNNAPLPRALPSTWIENKLYGRISHAFTRF

SEQ ID NO: 34743 - protein, 114 aa, Homo sapiens
  ENSP00000491505
  MOD_RES (1)..(1): Any amino acid
XDAYWEKLYVDQAAGTPLLYVHALRDAPEEVPSFRLGQHLYGTYRTRLHENNWICIQEDTGLLYLNRSLDHSSWEKLSVRNVADAPTDLTSLCRPRLSPAHRLPQGLPVTHIPS

SEQ ID NO: 34744 - protein, 191 aa, Homo sapiens
  ENSP00000492728
  MOD_RES (1)..(1): Any amino acid
XDAYWEKLYVDQAAGTPLLYVHALRDAPEEVPSFRLGQHLYGTYRTRLHENNWICIQEDTGLLYLNRSLDHSSWEKLSVRTCSSLKPRELCFPETRPSFRIRENRPPGTFHQFRLLPVQFLCPNISVAYRLLEGECRPCGAAPQCLLLLVLLCEPLTQAIWFILHLHAISSFNIPEVPLACLPGARYCSRS

SEQ ID NO: 34745 - protein, 458 aa, Homo sapiens
  ENSP00000480088
MAKATSGAAGLRLLLLLLLPLLGKVALGLYFSRDAYWEKLYVDQAAGTPLLYVHALRDAPEEVPSFRLGQHLYGTYRTRLHENNWICIQEDTGLLYLNRSLDHSSWEKLSVRNRGFPLLTVYLKVFLSPTSLREGECQWPGCARVYFSFFNTSFPACSSLKPRELCFPETRPSFRIRENRPPGTFHQFRLLPVQFLCPNISVAYRLLEGEGLPFRCAPDSLEVSTRWALDREQREKYELVAVCTVHAGAREEVVMVPFPVTVYDEDDSAPTFPAGVDTASAVVEFKRKEDTVVATLRVFDADVVPASGELVRRYTSTLLPGDTWAQQTFRVEHWPNETSVQANGSFVRATVHDYRLVLNRNLSISENRTMQLAVLVNDSDFQGPGAGVLLLHFNVSVLPVSLHLPSTYSLSVSRRARRFAQIGKVCVENCLADLTGDAVSGRDEARSSGLGSQKHPGS

SEQ ID NO: 34746 - protein, 88 aa, Homo sapiens
  ENSP00000475367
VQTDYVPLLNSLAAYGWQLTCVLPTPVVKTTSEGSVSTKQIVFLQRPCLPQKIKKKESKFQWRFSREEMHNRQMRKSKVTYGNKSSMS

SEQ ID NO: 34747 - protein, 542 aa, Homo sapiens
  ENSP00000403926
MYCDGAVDLDAAAELPGSSAVRLASLRDLPAQLLELYQQGFSLAALHPFVQPTHEREKTPLEHIFRAILIKKTDRSQKTDLHNEGYILELDCCSSLDHPTDQKLIPEFIKKIQEAASQGLKFVGVIPQYHSSVNSAGSSAPVSTANSTEDARDAKNARGDHASLENEKPGTGDVCSAPAGRNQSPEPSSGPRGEVPLAKQPSSPSGEGDGGELSPQGVSKTLDGPESNPLEVHEEPLSGKMEIFTLFNKPKSHQKCRQYYPVTIPLHVSKNGQTVSGLDANWLEHMSDHFRKGGMLVNAVFYLGIVNDSLHGLTDGVFIFEAVSTEDSKTIQGYDAIVVEQWTVLEGVEVQTDYVPLLNSLAAYGWQLTCVLPTPVVKTTSEGSVSTKQIVFLQRPCLPQKIKKKESKFQWRFSREEMHNRQMRKSKGKLSARDKQQAEENEKNLEDQSSKAGDMGNCVSGQQQEGGVSEEMKGPVQEDKGEQLSPGGLLCGVGVEGEAVQNGPASHSRALVGICTGHSNPGEDARDGDAEEVRELGTVEEN

SEQ ID NO: 34748 - protein, 578 aa, Homo sapiens
  ENSP00000334153
MGCGLNKLEKRDEKRPGNIYSTLKRPQVETKIDVSYEYRFLEFTTLSAAELPGSSAVRLASLRDLPAQLLELYQQGFSLAALHPFVQPTHEREKTPLEHIFRAILIKKTDRSQKTDLHNEGYILELDCCSSLDHPTDQKLIPEFIKKIQEAASQGLKFVGVIPQYHSSVNSAGSSAPVSTANSTEDARDAKNARGDHASLENEKPGTGDVCSAPAGRNQSPEPSSGPRGEVPLAKQPSSPSGEGDGGELSPQGVSKTLDGPESNPLEVHEEPLSGKMEIFTLFNKPKSHQKCRQYYPVTIPLHVSKNGQTVSGLDANWLEHMSDHFRKGGMLVNAVFYLGIVNDSLHGLTDGVFIFEAVSTEDSKTIQGYDAIVVEQWTVLEGVEVQTDYVPLLNSLAAYGWQLTCVLPTPVVKTTSEGSVSTKQIVFLQRPCLPQKIKKKESKFQWRFSREEMHNRQMRKSKGKLSARDKQQAEENEKNLEDQSSKAGDMGNCVSGQQQEGGVSEEMKGPVQEDKGEQLSPGGLLCGVGVEGEAVQNGPASHSRALVGICTGHSNPGEDARDGDAEEVRELGTVEEN

SEQ ID NO: 34749 - protein, 275 aa, Homo sapiens
  ENSP00000403997
MGCGLNKLEKRDEKRPGNIYSTLKRPQVETKIDVSYEYRFLEFTTLSAAELPGSSAVRLASLRDLPAQLLELYQQGFSLAALHPFVQPTHEREKTPLEHIFRAILIKKTDRSQKTDLHNEGYILELDCCSSLDHPTDQKLIPEFIKKIQEAASQGLKFVGVIPQYHSSVNSAGSSAPVSTANSTEDARDAKNARGDHASLENEKPGTGDVCSAPAGRNQSPEPSSGPRGEVPLAKQPSSPSGEGDGGELSPQGVSKTLDGPESNPLEVHEEPLSG

SEQ ID NO: 34750 - protein, 149 aa, Homo sapiens
  ENSP00000409427
MGCGLNKLEKRDEKRPGNIYSTLKRPQVETKIDVSYEYRFLEFTTLSAAELPGSSAVRLASLRDLPAQLLELYQQGFSLAALHPFVQPTHEREKTPLEHIFRAILIKKTDRSQKTDLHNEGYILELDCCSSLDHPTDQKLIPEFIKKIQ

SEQ ID NO: 34751 - protein, 149 aa, Homo sapiens; identical to SEQ ID NO: 34750
  ENSP00000388718

SEQ ID NO: 34752 - protein, 117 aa, Homo sapiens
  ENSP00000410493
MGCGLNKLEKRDEKRPGNIYSTLKRPQVETKIDVSYEYRFLEFTTLSAAELPGSSAVRLASLRDLPAQLLELYQQGFSLAALHPFVQPTHEREKTPLEHIFRAILIKKTDRKSHLCQ

SEQ ID NO: 34753 - protein, 114 aa, Homo sapiens
  ENSP00000393216
MGCGLNKLEKRDEKRPGNIYSTLKRPQVETKIDVSYEYRFLEFTTLSAAELPGSSAVRLASLRDLPAQLLELYQQGFSLAALHPFVQPTHEREKTPLEHIFRAILIKKTDRSQK

SEQ ID NO: 34754 - protein, 735 aa, Homo sapiens
  ENSP00000376585
MHCGLLEEPDMDSTESWIERCLNESENKRYSSHTSLGNVSNDENEEKENNRASKPHSTPATLQWLEENYEIAEGVCIPRSALYMHYLDFCEKNDTQPVNAASFGKIIRQQFPQLTTRRLGTRGQSKYHYYGIAVKESSQYYDVMYSKKGAAWVSETGKKEVSKQTVAYSPRSKLGTLLPEFPNVKDLNLPASLPEEKVSTFIMMYRTHCQRILDTVIRANFDEVQSFLLHFWQGMPPHMLPVLGSSTVVNIVGVCDSILYKAISGVLMPTVLQALPDSLTQVIRKFAKQLDEWLKVALHDLPENLRNIKFELSRRFSQILRRQTSLNHLCQASRTVIHSADITFQMLEDWRNVDLNSITKQTLYTMEDSRDEHRKLITQLYQEFDHLLEEQSPIESYIEWLDTMVDRCVVKVAAKRQGSLKKVAQQFLLMWSCFGTRVIRDMTLHSAPSFGSFHLIHLMFDDYVLYLLESLHCQERANELMRAMKGEGSTAEVREEIILTEAAAPTPSPVPSFSPAKSATSVEVPPPSSPVSNPSPEYTGLSTTGAMQSYTWSLTYTVTTAAGSPAENSQQLPCMRNTHVPSSSVTHRIPVYPHREEHGYTGSYNYGSYGNQHPHPMQSQYPALPHDTAISGPLHYAPYHRSSAQYPFNSPTSRMEPCLMSSTPRLHPTPVTPRWPEVPSANTCYTSPSVHSARYGNSSDMYTPLTTRRNSEYEHMQHFPGFAYINGEASTGWAK

SEQ ID NO: 34755 - protein, 77 aa, Homo sapiens
  ENSP00000447423
MHCGLLEEPDMDSTDEEKENNRASKPHSTPATLQWLEENYEIAEGVCIPRSALYMHYLDFCEKNDTQPVNAASFGKQ

SEQ ID NO: 34756 - protein, 59 aa, Homo sapiens
  ENSP00000447735
MHYLDFCEKNDTQPVNAASFGKIIRQQFPQLTTRRLGTRGQSKYHYYGIAVKESSQYYD

SEQ ID NO: 34757 - protein, 145 aa, Homo sapiens
  ENSP00000473326
MPPHMLPVLGSSTVVNIVGVCDSILYKAISGVLMPTVLQALPDSLTQVIRKFAKQLDEWLKVALHDLPENLRNIKFELSRRFSQILRRQTSLNHLCQASRTVIHSADITFQMLEDWRNVDLNSITKQTLYTMEDSRDEHRKLITQ

SEQ ID NO: 34758 - protein, 744 aa, Homo sapiens
  ENSP00000350552
MIKRRAHPGAGGDRTRPRRRRSTESWIERCLNESENKRYSSHTSLGNVSNDENEEKENNRASKPHSTPATLQWLEENYEIAEGVCIPRSALYMHYLDFCEKNDTQPVNAASFGKIIRQQFPQLTTRRLGTRGQSKYHYYGIAVKESSQYYDVMYSKKGAAWVSETGKKEVSKQTVAYSPRSKLGTLLPEFPNVKDLNLPASLPEEKVSTFIMMYRTHCQRILDTVIRANFDEVQSFLLHFWQGMPPHMLPVLGSSTVVNIVGVCDSILYKAISGVLMPTVLQALPDSLTQVIRKFAKQLDEWLKVALHDLPENLRNIKFELSRRFSQILRRQTSLNHLCQASRTVIHSADITFQMLEDWRNVDLNSITKQTLYTMEDSRDEHRKLITQLYQEFDHLLEEQSPIESYIEWLDTMVDRCVVKVAAKRQGSLKKVAQQFLLMWSCFGTRVIRDMTLHSAPSFGSFHLIHLMFDDYVLYLLESLHCQERANELMRAMKGEGSTAEVREEIILTEAAAPTPSPVPSFSPAKSATSVEVPPPSSPVSNPSPEYTGLSTTGAMQSYTWSLTYTVTTAAGSPAENSQQLPCMRNTHVPSSSVTHRIPVYPHREEHGYTGSYNYGSYGNQHPHPMQSQYPALPHDTAISGPLHYAPYHRSSAQYPFNSPTSRMEPCLMSSTPRLHPTPVTPRWPEVPSANTCYTSPSVHSARYGNSSDMYTPLTTRRNSEYEHMQHFPGFAYINGEASTGWAK

SEQ ID NO: 34759 - protein, 247 aa, Homo sapiens
  ENSP00000444163
MIKRRAHPGAGGDRTRPRRRRSTESWIERCLNESENKRYSSHTSLGNVSNDENEEKENNRASKPHSTPATLQWLEENYEIAEGVCIPRSALYMHYLDFCEKNDTQPVNAASFGKIIRQQFPQLTTRRLGTRGQSKYHYYGIAVKESSQYYDVMYSKKGAAWVSETGKKEVSKQTVAYSPRSKLGTLLPEFPNVKDLNLPASLPEEKVSTFIMMYRTHCQRILDTVIRANFDEECRPTCCLCWAPPRW

SEQ ID NO: 34760 - protein, 256 aa, Homo sapiens
  ENSP00000448694
MTSATDGERLEENYEIAEGVCIPRSALYMHYLDFCEKNDTQPVNAASFGKIIRQQFPQLTTRRLGTRGQSKYHYYGIAVKESSQYYDVMYSKKGAAWVSETGKKEVSKQTVAYSPRSKLGTLLPEFPNVKDLNLPASLPEEKVSTFIMMYRTHCQRILDTVIRANFDEVQSFLLHFWQGMPPHMLPVLGSSTVVNIVGVCDSILYKAISGVLMPTVLQALPDSLTQVIRKFAKQLDEWLKVALHDLPENLRNIKFE

SEQ ID NO: 34761 - protein, 641 aa, Homo sapiens
  ENSP00000229387
MNWAAFGGSEFFIPEGIQIDSRCPLSRNITEWYHYYGIAVKESSQYYDVMYSKKGAAWVSETGKKEVSKQTVAYSPRSKLGTLLPEFPNVKDLNLPASLPEEKVSTFIMMYRTHCQRILDTVIRANFDEVQSFLLHFWQGMPPHMLPVLGSSTVVNIVGVCDSILYKAISGVLMPTVLQALPDSLTQVIRKFAKQLDEWLKVALHDLPENLRNIKFELSRRFSQILRRQTSLNHLCQASRTVIHSADITFQMLEDWRNVDLNSITKQTLYTMEDSRDEHRKLITQLYQEFDHLLEEQSPIESYIEWLDTMVDRCVVKVAAKRQGSLKKVAQQFLLMWSCFGTRVIRDMTLHSAPSFGSFHLIHLMFDDYVLYLLESLHCQERANELMRAMKGEGSTAEVREEIILTEAAAPTPSPVPSFSPAKSATSVEVPPPSSPVSNPSPEYTGLSTTGAMQSYTWSLTYTVTTAAGSPAENSQQLPCMRNTHVPSSSVTHRIPVYPHREEHGYTGSYNYGSYGNQHPHPMQSQYPALPHDTAISGPLHYAPYHRSSAQYPFNSPTSRMEPCLMSSTPRLHPTPVTPRWPEVPSANTCYTSPSVHSARYGNSSDMYTPLTTRRNSEYEHMQHFPGFAYINGEASTGWAK

SEQ ID NO: 34762 - protein, 39 aa, Homo sapiens
  ENSP00000449732
MNWAAFGGSEFFIPEGIQIDSRCPLSRNITECERKLPIL

SEQ ID NO: 34763 - protein, 137 aa, Homo sapiens
  ENSP00000368664
MKPPAAQGSPAAAAAAAPALDSAAAEDLSDALCEFDAVLADFASPFHERHFHYEEHLERMKRRSSASVSDSSGFSDSESADSLYRNSFSFSDEKLNSPTDSTPALLSATVTPQKAKLGDTKELEAFIADLDKTLASM

SEQ ID NO: 34764 - protein, 411 aa, Homo sapiens
  ENSP00000457408
METPEVPVGSLIDFGPEAPTSSPLEAPPPVLQDGDGSLGDGASESETTESADSENDMGESPSHPSWDQDRRSSSNESFSSNQSTESTQDEETLALRDFMRGYVEKIFSGGEDLDQEEKAKFGEYCSSENGKGREWFARYVSAQRCNSKCVSEATFYRLVQSFAVVLFECHQMDDFGPAKNLMTMCFTYYHIGKPQLLPPESREKPAGSIDSYLKSANSWLAEKKDIAERLLKNTSARTENVKGFFGGLETKLKGPLARRNEEDENKPQEKRPRAVTAYSPEDEKKGEKIYLYTHLKQQPIWHTLRFWNAAFFDAVHCERTKRSPTTRGDAGEEEEKREKWCHMTQEERDDSLRFNENITFGQLGTFTHNMLAFGLNKKLCNDFLKKQAVIGNLDEEQYKLLSDHIEQMATE

SEQ ID NO: 34765 - protein, 301 aa, Homo sapiens
  ENSP00000455544
METPEVPVGSLIDFGPEAPTSSPLEAPPPVLQDGDGSLGDGASESETTESADSENDMGESPSHPSWDQDRRSSSNESFSSNQSTESTQDEETLALRDFMRGYVEKIFSGGEDLDQEEKAKFGEYCSSENGKGREWFARYVSAQRCNSKCVSEATFYRLVQSFAVVLFECHQMDDFGPAKNLMTMCFTYYHIGKPQLLPPESREKPAGSIDSYLKSANSWLAEKKDIAERLLKNTSARTENVKGFFGGLETKLKGPLARRNEEDENKPQEKRPRAVTAYSPEDEKKGEKIYLYTHLKQQPIW

SEQ ID NO: 34766 - protein, 198 aa, Homo sapiens
  ENSP00000454547
KPAGSIDSYLKSANSWLAEKKDIAERLLKNTSARTENVKGFFGGLETKLKGPLARRNEEDENKPQEKRPRAVTAYSPEDEKKGEKIYLYTHLKQQPIWHTLRFWNAAFFDAVHCERTKRSPTTREKWCHMTQEERDDSLRFNENITFGQLGTFTHNMLAFGLNKKLCNDFLKKQAVIGNLDEEQYKLLSDHIEQMATE

SEQ ID NO: 34767 - protein, 113 aa, Homo sapiens
  ENSP00000454758
DENKPQEKRPRAVTAYSPEDEKKGEKIYLYTHLKQQPIWEKWCHMTQEERDDSLRFNENITFGQLGTFTHNMLAFGLNKKLCNDFLKKQAVIGNLDEEQYKLLSDHIEQMATE

SEQ ID NO: 34768 - protein, 411 aa, Homo sapiens; identical to SEQ ID NO: 34764
  ENSP00000258180

SEQ ID NO: 34769 - protein, 401 aa, Homo sapiens
  ENSP00000446439
METPEVPVGSLIDFGPEAPTSSPLEAPPPVLQDGDGSLGDGASESETTESADSENDMGESPSHPSWDQDRRSSSNESFSSNQSTESTQDEETLALRDFMRGYVEKIFSGGEDLDQEEKAKFGEYCSSENGKGREWFARYVSAQRCNSKCVSEATFYRLVQSFAVVLFECHQMDDFGPAKNLMTMCFTYYHIGKPQLLPPESREKPAGSIDSYLKSANSWLAEKKDIAERLLKNTSARTENVKGFFGGLETKLKGPLARRNEEDENKPQEKRPRAVTAYSPEDEKKGEKIYLYTHLKQQPIWHTLRFWNAAFFDAVHCERTKRSPTTREKWCHMTQEERDDSLRFNENITFGQLGTFTHNMLAFGLNKKLCNDFLKKQAVIGNLDEEQYKLLSDHIEQMATE

SEQ ID NO: 34770 - protein, 250 aa, Homo sapiens
  ENSP00000454678
  MOD_RES (1)..(1): Any amino acid
XRTAGKELALAPLQDWGEETEDGAVYSVSLRRQRSQRRSPAEGPGGSQAPSPIANTFLHYRTSKVRVLRAARLERLVGELVFGDREQDPSFMPAFLATYRTFVPTACLLGFLLPPMPPPPPPGVEIKKTAVQDLSFNKNLRAVVSVLGSWLQDHPQDFRDHPAHSDLGSVRTFLGWAAPGSAEAQKAEKLLEDFLEEAEREQEEEPPQDLPELPKLLTQTLQRPARRKRKGSCLKVPSSWTSAWTRWPSS

SEQ ID NO: 34771 - protein, 181 aa, Homo sapiens
  ENSP00000455922
MERTAGKELALAPLQDWGEETEDGAVYSVSLRRQRSQRRSPAEGPGGSQAPSPIANTFLHYRTSKVRVLRAARLERLVGELVFGDREQDPSFMPAFLATYRTFVPTACLLGFLLPPMPPPPPPGDQEDSGTRSELQQEPEGCGVSAGLLAAGPPSGFPRPPCPFGPGQCPNLSGLGGPREC

SEQ ID NO: 34772 - protein, 710 aa, Homo sapiens
  ENSP00000369823
MERTAGKELALAPLQDWGEETEDGAVYSVSLRRQRSQRRSPAEGPGGSQAPSPIANTFLHYRTSKVRVLRAARLERLVGELVFGDREQDPSFMPAFLATYRTFVPTACLLGFLLPPMPPPPPPGVEIKKTAVQDLSFNKNLRAVVSVLGSWLQDHPQDFRDHPAHSDLGSVRTFLGWAAPGSAEAQKAEKLLEDFLEEAEREQEEEPPQVWTGPPRVAQTSDPDSSEACAEEEEGLMPQGPQLLDFSVDEVAEQLTLIDLELFSKVRLYECLGSVWSQRDRPGAAGASPTVRATVAQFNTVTGCVLGSVLGAPGLAAPQRAQRLEKWIRIAQRCRELRNFSSLRAILSALQSNPIYRLKRSWGAVSREPLSTFRKLSQIFSDENNHLSSREILFQEEATEGSQEEDNTPGSLPSKPPPGPVPYLGTFLTDLVMLDTALPDMLEGDLINFEKRRKEWEILARIQQLQRRCQSYTLSPHPPILAALHAQNQLTEEQSYRLSRVIEPPAASCPSSPRIRRRISLTKRLSAKLAREKSSSPSGSPGDPSSPTSSVSPGSPPSSPRSRDAPAGSPPASPGPQGPSTKLPLSLDLPSPRPFALPLGSPRIPLPAQQSSEARVIRVSIDNDHGNLYRSILLTSQDKAPSVVRRALQKHNVPQPWACDYQLFQVLPGDRVLLIPDNANVFYAMSPVAPRDFMLRRKEGTRNTLSVSPS

SEQ ID NO: 34773 - protein, 716 aa, Homo sapiens
  ENSP00000377075
MERTAGKELALAPLQDWGEETEDGAVYSVSLRRQRSQRRSPAEGPGGSQAPSPIANTFLHYRTSKVRVLRAARLERLVGELVFGDREQDPSFMPAFLATYRTFVPTACLLGFLLPPMPPPPPPGVEIKKTAVQDLSFNKNLRAVVSVLGSWLQDHPQDFRDHPAHSDLGSVRTFLGWAAPGSAEAQKAEKLLEDFLEEAEREQEEEPPQVWTGPPRVAQTSDPDSSEACAEEEEGLMPQGPQLLDFSVDEVAEQLTLIDLELFSKVRLYECLGSVWSQRDRPGAAGASPTVRATVAQFNTVTGCVLGSVLGAPGLAAPQRAQRLEKWIRIAQRCRELRNFSSLRAILSALQSNPIYRLKRSWGAVSREPLSTFRKLSQIFSDENNHLSSREILFQEEATEGSQEEDNTPGSLPSKPPPGPVPYLGTFLTDLVMLDTALPDMLEGDLINFEKRRKEWEILARIQQLQRRCQSYTLSPHPPILAALHAQNQLTEEQSYRLSRVIEPPAASCPSSPRIRRRISLTKRLSAKLAREKSSSPSGSPGDPSSPTSSLCISPSVSPGSPPSSPRSRDAPAGSPPASPGPQGPSTKLPLSLDLPSPRPFALPLGSPRIPLPAQQSSEARVIRVSIDNDHGNLYRSILLTSQDKAPSVVRRALQKHNVPQPWACDYQLFQVLPGDRVLLIPDNANVFYAMSPVAPRDFMLRRKEGTRNTLSVSPS

SEQ ID NO: 34774 - protein, 77 aa, Homo sapiens
  ENSP00000466669
  MOD_RES (1)..(1): Any amino acid
XLGSVWSQRDRPGAAGASPTVRATVAQFNTVTGCVLGSVLGAPGLAAPQRAQRLEKWIRIAQGTAIYFQETFADFLR

SEQ ID NO: 34775 - protein, 176 aa, Homo sapiens
  ENSP00000464876
MRRPGRKGTGGGQAPSPIANTFLHYRTSKVRVLRAARLERLVGELVFGDREQDPSFMPAFLATYRTFVPTACLLGFLLPPMPPPPPPGVEIKKTAVQDLSFNKNLRAVVSVLGSWLQDHPQDFRDHPAHSDLGSVRTFLGWAAPGSAEAQKAEKLLEDFLEEAEREQEEEPPQVWT

SEQ ID NO: 34776 - protein, 167 aa, Homo sapiens
  ENSP00000456429
MERTAGKELALAPLQDWGEETEDGAVYSVSLRRQRSQRRSPAEGPGGSQAPSPIANTFLHYRTSKVRVLRAARLERLVGELVFGDREQDPSFMPAFLATYRTFVPTACLLGFLLPPMPPPPPPGVEIKKTAVQDLSFNKNLRTTLRISETTLPIRTWAVSEPFWAGR

SEQ ID NO: 34777 - protein, 450 aa, Homo sapiens
  ENSP00000330005
MQPPRERLVVTGRAGWMGMGRGAGRSALGFWPTLAFLLCSFPAATSPCKILKCNSEFWSATSGSHAPASDDTPEFCAALRSYALCTRRTARTCRGDLAYHSAVHGIEDLMSQHNCSKDGPTSQPRLRTLPPAGDSQERSDSPEICHYEKSFHKHSATPNYTHCGLFGDPHLRTFTDRFQTCKVQGAWPLIDNNYLNVQVTNTPVLPGSAATATSKLTIIFKNFQECVDQKVYQAEMDELPAAFVDGSKNGGDKHGANSLKITEKVSGQHVEIQAKYIGTTIVVRQVGRYLTFAVRMPEEVVNAVEDWDSQGLYLCLRGCPLNQQIDFQAFHTNAEGTGARRLAAASPAPTAPETFPYETAVAKCKEKLPVEDLYYQACVFDLLTTGDVNFTLAAYYALEDVKMLHSNKDKLHLYERTRDLPGRAAAGLPLAPRPLLGALVPLLALLPVFC

SEQ ID NO: 34778 - protein, 434 aa, Homo sapiens
  ENSP00000440025
MGMGRGAGRSALGFWPTLAFLLCSFPAATSPCKILKCNSEFWSATSGSHAPASDDTPEFCAALRSYALCTRRTARTCRGDLAYHSAVHGIEDLMSQHNCSKDGPTSQPRLRTLPPAGDSQERSDSPEICHYEKSFHKHSATPNYTHCGLFGDPHLRTFTDRFQTCKVQGAWPLIDNNYLNVQVTNTPVLPGSAATATSKLTIIFKNFQECVDQKVYQAEMDELPAAFVDGSKNGGDKHGANSLKITEKVSGQHVEIQAKYIGTTIVVRQVGRYLTFAVRMPEEVVNAVEDWDSQGLYLCLRGCPLNQQIDFQAFHTNAEGTGARRLAAASPAPTAPETFPYETAVAKCKEKLPVEDLYYQACVFDLLTTGDVNFTLAAYYALEDVKMLHSNKDKLHLYERTRDLPGRAAAGLPLAPRPLLGALVPLLALLPVFC

SEQ ID NO: 34779 - protein, 61 aa, Homo sapiens
  ENSP00000451505
MGMGRGAGRSALGFWPTLAFLLCSFPAAIKRSPGSFCAALEMRRLWNLMSWKERRVQKPLM

SEQ ID NO: 34780 - protein, 458 aa, Homo sapiens
  ENSP00000452126
MGGLGPRRAGTSRERLVVTGRAGWMGMGRGAGRSALGFWPTLAFLLCSFPAATSPCKILKCNSEFWSATSGSHAPASDDTPEFCAALRSYALCTRRTARTCRGDLAYHSAVHGIEDLMSQHNCSKDGPTSQPRLRTLPPAGDSQERSDSPEICHYEKSFHKHSATPNYTHCGLFGDPHLRTFTDRFQTCKVQGAWPLIDNNYLNVQVTNTPVLPGSAATATSKLTIIFKNFQECVDQKVYQAEMDELPAAFVDGSKNGGDKHGANSLKITEKVSGQHVEIQAKYIGTTIVVRQVGRYLTFAVRMPEEVVNAVEDWDSQGLYLCLRGCPLNQQIDFQAFHTNAEGTGARRLAAASPAPTAPETFPYETAVAKCKEKLPVEDLYYQACVFDLLTTGDVNFTLAAYYALEDVKMLHSNKDKLHLYERTRDLPGRAAAGLPLAPRPLLGALVPLLALLPVFC

SEQ ID NO: 34781 - protein, 46 aa, Homo sapiens
  ENSP00000452170
MGMGRGAGRSALGFWPTLAFLLCSFPAAHHHLQELPGVCGPEGVPG

SEQ ID NO: 34782 - protein, 341 aa, Homo sapiens
  ENSP00000456290
MSQHNCSKDGPTSQPRLRTLPPAGDSQERSDSPEICHYEKSFHKHSATPNYTHCGLFGDPHLRTFTDRFQTCKVQGAWPLIDNNYLNVQVTNTPVLPGSAATATSKLTIIFKNFQECVDQKVYQAEMDELPAAFVDGSKNGGDKHGANSLKITEKVSGQHVEIQAKYIGTTIVVRQVGRYLTFAVRMPEEVVNAVEDWDSQGLYLCLRGCPLNQQIDFQAFHTNAEGTGARRLAAASPAPTAPETFPYETAVAKCKEKLPVEDLYYQACVFDLLTTGDVNFTLAAYYALEDVKMLHSNKDKLHLYERTRDLPGRAAAGLPLAPRPLLGALVPLLALLPVFC

SEQ ID NO: 34783 - protein, 90 aa, Homo sapiens
  ENSP00000451709
MGMGRGAGRSALGFWPTLAFLLCSFPAATSPCKILKCNSEFWSATSGSHAPASDDTPEFCAALRSYALCTRRTARTCRGDLAYHSAVHGI

SEQ ID NO: 34784 - protein, 10 aa, Homo sapiens
  ENSP00000452350
MGMGRGAGRS

SEQ ID NO: 34785 - protein, 434 aa, Homo sapiens; identical to SEQ ID NO: 34778
  ENSP00000404442

SEQ ID NO: 34786 - protein, 434 aa, Homo sapiens; identical to SEQ ID NO: 34778
  ENSP00000442498

SEQ ID NO: 34787 - protein, 478 aa, Homo sapiens
  ENSP00000308219
MIRKKRKRSAPPGPCRSHGPRPATAPAPPPSPEPTRPAWTGMGLRAAPSSAAAAAAEVEQRRSPGLCPPPLELLLLLLFSLGLLHAGDCQQPAQCRIQKCTTDFVSLTSHLNSAVDGFDSEFCKALRAYAGCTQRTSKACRGNLVYHSAVLGISDLMSQRNCSKDGPTSSTNPEVTHDPCNYHSHAGAREHRRGDQNPPSYLFCGLFGDPHLRTFKDNFQTCKVEGAWPLIDNNYLSVQVTNVPVVPGSSATATNKITIIFKAHHECTDQKVYQAVTDDLPAAFVDGTTSGGDSDAKSLRIVERESGHYVEMHARYIGTTVFVRQVGRYLTLAIRMPEDLAMSYEESQDLQLCVNGCPLSERIDDGQGQVSAILGHSLPRTSLVQAWPGYTLETANTQCHEKMPVKDIYFQSCVFDLLTTGDANFTAAAHSALEDVEALHPRKERWHIFPSSGNGTPRGGSDLSVSLGLTCLILIVFL

SEQ ID NO: 34788 - protein, 437 aa, Homo sapiens
  ENSP00000423256
MGLRAAPSSAAAAAAEVEQRRSPGLCPPPLELLLLLLFSLGLLHAGDCQQPAQCRIQKCTTDFVSLTSHLNSAVDGFDSEFCKALRAYAGCTQRTSKACRGNLVYHSAVLGISDLMSQRNCSKDGPTSSTNPEVTHDPCNYHSHAGAREHRRGDQNPPSYLFCGLFGDPHLRTFKDNFQTCKVEGAWPLIDNNYLSVQVTNVPVVPGSSATATNKITIIFKAHHECTDQKVYQAVTDDLPAAFVDGTTSGGDSDAKSLRIVERESGHYVEMHARYIGTTVFVRQVGRYLTLAIRMPEDLAMSYEESQDLQLCVNGCPLSERIDDGQGQVSAILGHSLPRTSLVQAWPGYTLETANTQCHEKMPVKDIYFQSCVFDLLTTGDANFTAAAHSALEDVEALHPRKERWHIFPSSGNGTPRGGSDLSVSLGLTCLILIVFL

SEQ ID NO: 34789 - protein, 202 aa, Homo sapiens
  ENSP00000356529
MCRTLAAFPTTCLERAKEFKTRLGIFLHKSELGCDTGSTGKFEWGSKHSKENRNFSEDVLGWRESFDLLLSSKNGVAAFHAFLKTEFSEENLEFWLACEEFKKIRSATKLASRAHQIFEEFICSEAPKEVNIDHETHELTRMNLQTATATCFDAAQGKTRTLMEKDSYPRFLKSPAYRDLAAQASAASATLSSCSLDEPSHT

SEQ ID NO: 34790 - protein, 211 aa, Homo sapiens
  ENSP00000235382
MQSAMFLAVQHDCRPMDKSAGSGHKSEEKREKMKRTLLKDWKTRLSYFLQNSSTPGKPKTGKKSKQQAFIKPSPEEAQLWSEAFDELLASKYGLAAFRAFLKSEFCEENIEFWLACEDFKKTKSPQKLSSKARKIYTDFIEKEAPKEINIDFQTKTLIAQNIQEATSGCFTTAQKRVYSLMENNSYPRFLESEFYQDLCKKPQITTEPHAT

SEQ ID NO: 34791 - protein, 388 aa, Homo sapiens
  ENSP00000297313
MPQLSQDNQECLQKHFSRPSIWTQFLPLFRAQRYNTDIHQITENEGDLRAVPDIKSFPPAQLPDSPAAPKLFGLLSSPLSSLARFFSHLLRRPPPEAPRRRLDFSPLLPALPAARLSRGHEELPGRLSLLLGAALALPGRPSGGRPLRPPHPVAKPREEDATAGQSSPMPQMGSERMEMRKRQMPAAQDTPGAAPGQPGAGSRGSNACCFCWCCCCSCSCLTVRNQEDQRPTIASHELRADLPTWEESPAPTLEEVNAWAQSFDKLMVTPAGRNAFREFLRTEFSEENMLFWMACEELKKEANKNIIEEKARIIYEDYISILSPKEVSLDSRVREVINRNMVEPSQHIFDDAQLQIYTLMHRDSYPRFMNSAVYKDLLQSLSEKSIEA

SEQ ID NO: 34792 - protein, 58 aa, Homo sapiens
  ENSP00000428795
MPQLSQDNQECLQKHFSRPSIWTQFLPLFRAQRYNTDIHQITENEGDLRAVPDIKSHC

SEQ ID NO: 34793 - protein, 273 aa, Homo sapiens
  ENSP00000344630
MPQLSQDNQECLQKHFSRPSIWTQFLPLFRAQRYNTDIHQITENEGDLRAVPDIKQMGSERMEMRKRQMPAAQDTPGAAPGQPGAGSRGSNACCFCWCCCCSCSCLTVRNQEDQRPTIASHELRADLPTWEESPAPTLEEVNAWAQSFDKLMVTPAGRNAFREFLRTEFSEENMLFWMACEELKKEANKNIIEEKARIIYEDYISILSPKEVSLDSRVREVINRNMVEPSQHIFDDAQLQIYTLMHRDSYPRFMNSAVYKDLLQSLSEKSIEA

SEQ ID NO: 34794 - protein, 70 aa, Homo sapiens
  ENSP00000429897
MPQLSQDNQECLQKHFSRPSIWTQFLPLFRAQRYNTDIHQITENEGDLRAVPDIKPCSYSGRSQRLGSVI

SEQ ID NO: 34795 - protein, 122 aa, Homo sapiens
  ENSP00000430627
MVTPAGRNAFREFLRTEFSEENMLFWMACEELKKEANKNIIEEKARIIYEDYISILSPKEVSLDSRVREVINRNMVEPSQHIFDDAQLQIYTLMHRDSYPRFMNSAVYKDLLQSLSEKSIEA

SEQ ID NO: 34796 - protein, 241 aa, Homo sapiens
  ENSP00000276500
MRTADGGEPAGASSPAGRVDGGLQMGSERMEMRKRQMPAAQDTPGAAPGQPGAGSRGSNACCFCWCCCCSCSCLTVRNQEDQRPTIASHELRADLPTWEESPAPTLEEVNAWAQSFDKLMVTPAGRNAFREFLRTEFSEENMLFWMACEELKKEANKNIIEEKARIIYEDYISILSPKEVSLDSRVREVINRNMVEPSQHIFDDAQLQIYTLMHRDSYPRFMNSAVYKDLLQSLSEKSIEA

SEQ ID NO: 34797 - protein, 302 aa, Homo sapiens
  ENSP00000397181
MYNMMLLIQKRKGIGSQLLRAGEAEGDRGAGTAERSSDWLDGRSWAIKETPTGLAGRRSEDSDNIFTGEEAKYAQSRSHSSSCRISFLLANSKLLNKMCKGLAGLPASCLRSAKDMKHRLGFLLQKSDSCEHNSSHNKKDKVVICQRVSQEEVKKWAESLENLISHECGLAAFKAFLKSEYSEENIDFWISCEEYKKIKSPSKLSPKAKKIYNEFISVQATKEVNLDSCTREETSRNMLEPTITCFDEAQKKIFNLMEKDSYRRFLKSRFYLDLVNPSSCGAEKQKGAKSSADCASLVPQCA

SEQ ID NO: 34798 - protein, 205 aa, Homo sapiens
  ENSP00000356885
MCKGLAGLPASCLRSAKDMKHRLGFLLQKSDSCEHNSSHNKKDKVVICQRVSQEEVKKWAESLENLISHECGLAAFKAFLKSEYSEENIDFWISCEEYKKIKSPSKLSPKAKKIYNEFISVQATKEVNLDSCTREETSRNMLEPTITCFDEAQKKIFNLMEKDSYRRFLKSRFYLDLVNPSSCGAEKQKGAKSSADCASLVPQCA

SEQ ID NO: 34799 - protein, 113 aa, Homo sapiens
  ENSP00000436106
MCKGLAGLPASCLRSAKDMKHRLGFLLQKSDSCEHNSSHNKKDKVVICQRVSQEEVKKWAESLENLISHECGLAAFKAFLKSEYSEENIDFWISCEEYKKIKSPSKLSPKAKY

SEQ ID NO: 34800 - protein, 187 aa, Homo sapiens
  ENSP00000433261
MKHRLGFLLQKSDSCEHNSSHNKKDKVVICQRVSQEEVKKWAESLENLISHECGLAAFKAFLKSEYSEENIDFWISCEEYKKIKSPSKLSPKAKKIYNEFISVQATKEVNLDSCTREETSRNMLEPTITCFDEAQKKIFNLMEKDSYRRFLKSRFYLDLVNPSSCGAEKQKGAKSSADCASLVPQCA

SEQ ID NO: 34801 - protein, 93 aa, Homo sapiens
  ENSP00000356884
MCKGLAGLPASCLRSAKDMKHRLGFLLQKSDSCEHNSSHNKKDKVVICQRVSQEEVKKWAESLENLISHECEPGFLHQGRDKPEHARAYNNLL

SEQ ID NO: 34802 - protein, 187 aa, Homo sapiens; identical to SEQ ID NO: 34800
  ENSP00000356882

SEQ ID NO: 34803 - protein, 143 aa, Homo sapiens
  ENSP00000432194
MKHRLGFLLQKSDSCEHNSSHNKKDKVVICQRVSQEEVKKWAESLENLISHECGLAAFKAFLKSEYSEENIDFWISCEEYKKIKSPSKLSPKAKKIYNEFISVQATKEVNLDSCTREETSRNMLEPTITCFDEAQKKIFNLME

SEQ ID NO: 34804 - protein, 490 aa, Homo sapiens
  ENSP00000451030
MAQGSGDQRAVGVADPEESSPNMIVYCKIEDIITKMQDDKTGGVPIRTVKSFLSKIPSVVTGTDIVQWLMKNLSIEDPVEAIHLGSLIAAQGYIFPISDHVLTMKDDGTFYRFQAPYFWPSNCWEPENTDYAIYLCKRTMQNKARLELADYEAENLARLQRAFARKWEFIFMQAEAQVKIDRKKDKTERKILDSQERAFWDVHRPVPGCVNTTEMDIRKCRRLKNPQKVKKSVYGVTEESQAQSPVHVLSQPIRKTTKEDIRKQITFLNAQIDRHCLKMSKVAESLIAYTEQYVEYDPLITPAEPSNPWISDDVALWDIEMSKEPSQQRVKRWGFSFDEILKDQVGRDQFLRFLESEFSSENLRFWLAVQDLKKQPLQDVAKRVEEIWQEFLAPGAPSAINLDSHSYEITSQNVKDGGRYTFEDAQEHIYKLMKSDSYARFLRSNAYQDLLLAKKKPESEQGRRTSLEKFTRSVGKSLAGKRLTGLMQSS

SEQ ID NO: 34805 - protein, 472 aa, Homo sapiens
  ENSP00000450936
MAQGSGDQRAVGVADPEESSPNMIVYCKIEDIITKMQDDKTGGVPIRTVKSFLSKIPSVVTGTDIVQWLMKNLSIEDPVEAIHLGSLIAAQGYIFPISDHVLTMKDDGTFYRFQAPYFWPSNCWEPENTDYAIYLCKRTMQNKARLELADYEAENLARLQRAFARKWEFIFMQAEAQVKIDRKKDKTERKILDSQERAFWDVHRPVPGCVNTTEMDIRKCRRLKNPQKVKKSVYGVTEESQAQSPVHVLSQPIRKTTKEDIRKQITFLNAQIDRHCLKMSKVAESLIAYTEQYVEYDPLITPAEPSNPWISDDVALWDIEMSKEPSQQRVKRWGFSFDEILKDQVGRDQFLRFLESEFSSENLRFWLAVQDLKKQPLQDVAKRVEEIWQEFLAPGAPSAINLDSHSYEITSQNVKDGGRYTFEDAQEHIYKLMKSDSYARFLRSNAYQDLLLAKKKGKSLAGKRLTGLMQSS

SEQ ID NO: 34806 - protein, 472 aa, Homo sapiens; identical to SEQ ID NO: 34805
  ENSP00000452331

SEQ ID NO: 34807 - protein, 465 aa, Homo sapiens
  ENSP00000450858
MAQGSGDQRAVGVADPEESSPNMIVYCKIEDIITKMQDDKTGGVPIRTVKSFLSKIPSVVTGTDIVQWLMKNLSIEDPVEAIHLGSLIAAQGYIFPISDHVLTMKDDGTFYRFQAPYFWPSNCWEPENTDYAIYLCKRTMQNKARLELADYEAENLARLQRAFARKWEFIFMQAEAQVKIDRKKDKTERKILDSQERAFWDVHRPVPGCVNTTEMDIRKCRRLKNPQKVKKSVYGVTEESQAQSPVHVLSQPIRKTTKEDIRKQITFLNAQIDRHCLKMSKVAESLIAYTEQYVEYDPLITPAEPSNPWISDDVALWDIEMSKEPSQQRVKRWGFSFDEILKDQVGRDQFLRFLESEFSSENLRFWLAVQDLKKQPLQDVAKRVEEIWQEFLAPGAPSAINLDSHSYEITSQNVKDGGRYTFEDAQEHIYKLMKSDSYARFLRSNAYQDLLLAKKKKVSKVVELP

SEQ ID NO: 34808 - protein, 490 aa, Homo sapiens; identical to SEQ ID NO: 34804
  ENSP00000451855

SEQ ID NO: 34809 - protein, 460 aa, Homo sapiens
  ENSP00000347699
MAQGSGDQRAVGVADPEESSPNMIVYCKIEDIITKMQDDKTGGVPIRTVKSFLSKIPSVVTGTDIVQWLMKNLSIEDPVEAIHLGSLIAAQGYIFPISDHVLTMKDDGTFYRFQAPYFWPSNCWEPENTDYAIYLCKRTMQNKARLELADYEAENLARLQRAFARKWEFIFMQAEAQVKIDRKKDKTERKILDSQERAFWDVHRPVPGCVNTTEMDIRKCRRLKNPQKVKKSVYGVTEESQAQSPVHVLSQPIRKTTKEDIRKQITFLNAQIDRHCLKMSKVAESLIAYTEQYVEYDPLITPAEPSNPWISDDVALWDIEMSKEPSQQRVKRWGFSFDEILKDQVGRDQFLRFLESEFSSENLRFWLAVQDLKKQPLQDVAKRVEEIWQEFLAPGAPSAINLDSHSYEITSQNVKDGGRYTFEDAQEHIYKLMKSDSYARFLRSNAYQDLLLAKKKVWLL

SEQ ID NO: 34810 - protein, 480 aa, Homo sapiens
  ENSP00000385243
MAQGSGDQRAVGVADPEESSPNMIVYCKIEDIITKMQDDKTGGVPIRTVKSFLSKIPSVVTGTDIVQWLMKNLSIEDPVEAIHLGSLIAAQGYIFPISDHVLTMKDDGTFYRFQAPYFWPSNCWEPENTDYAIYLCKRTMQNKARLELADYEAENLARLQRAFARKWEFIFMQAEAQVKIDRKKDKTERKILDSQERAFWDVHRPVPGCVNTTEMDIRKCRRLKNPQKVKKSVYGVTEESQAQSPVHVLSQPIRKTTKEDIRKQITFLNAQIDRHCLKMSKVAESLIAYTEQYVEYDPLITPAEPSNPWISDDVALWDIEMSKEPSQQRVKRWGFSFDEILKDQVGRDQFLRFLESEFSSENLRFWLAVQDLKKQPLQDVAKRVEEIWQEFLAPGAPSAINLDSHSYEITSQNVKDGGRYTFEDAQEHIYKLMKSDSYARFLRSNAYQDLLLAKKKPESEQGRRTSLEKFTRSVCLQLLF

SEQ ID NO: 34811 - protein, 475 aa, Homo sapiens
  ENSP00000384218
MAQGSGDQRAVGVADPEESSPNMIVYCKIEDIITKMQDDKTGGVPIRTVKSFLSKIPSVVTGTDIVQWLMKNLSIEDPVEAIHLGSLIAAQGYIFPISDHVLTMKDDGTFYRFQAPYFWPSNCWEPENTDYAIYLCKRTMQNKARLELADYEAENLARLQRAFARKWEFIFMQAEAQVKIDRKKDKTERKILDSQERAFWDVHRPVPGCVNTTEMDIRKCRRLKNPQKVKKSVYGVTEESQAQSPVHVLSQPIRKTTKEDIRKQITFLNAQIDRHCLKMSKVAESLIAYTEQYVEYDPLITPAEPSNPWISDDVALWDIEMSKEPSQQRVKRWGFSFDEILKDQVGRDQFLRFLESEFSSENLRFWLAVQDLKKQPLQDVAKRVEEIWQEFLAPGAPSAINLDSHSYEITSQNVKDGGRYTFEDAQEHIYKLMKSDSYARFLRSNAYQDLLLAKKKPESEQGRRTSLEKFTRSVG

SEQ ID NO: 34812 - protein, 477 aa, Homo sapiens
  ENSP00000384612
MAQGSGDQRAVGVADPEESSPNMIVYCKIEDIITKMQDDKTGGVPIRTVKSFLSKIPSVVTGTDIVQWLMKNLSIEDPVEAIHLGSLIAAQGYIFPISDHVLTMKDDGTFYRFQAPYFWPSNCWEPENTDYAIYLCKRTMQNKARLELADYEAENLARLQRAFARKWEFIFMQAEAQVKIDRKKDKTERKILDSQERAFWDVHRPVPGCVNTTEMDIRKCRRLKNPQKVKKSVYGVTEESQAQSPVHVLSQPIRKTTKEDIRKQITFLNAQIDRHCLKMSKVAESLIAYTEQYVEYDPLITPAEPSNPWISDDVALWDIEMSKEPSQQRVKRWGFSFDEILKDQVGRDQFLRFLESEFSSENLRFWLAVQDLKKQPLQDVAKRVEEIWQEFLAPGAPSAINLDSHSYEITSQNVKDGGRYTFEDAQEHIYKLMKSDSYARFLRSNAYQDLLLAKKKPESEQGRRTSLEKFTRSVLLF

SEQ ID NO: 34813 - protein, 539 aa, Homo sapiens
  ENSP00000412144
MKNLSIEDPVEAIHLGSLIAAQGYIFPISDHVLTMKDDGTFYRFQAPYFWPSNCWEPENTDYAIYLCKRTMQNKARLELADYEAENLARLQRAFARKWEFIFMQAEAQVKIDRKKDKTERKILDSQERAFWDVHRPVPGCVNTTEMDIRKCRRLKNPQKVKKSVYGVTEESQAQSPVHVLSQPIRKTTKEDIRKQITFLNAQIDRHCLKMSKVAESLIAYTEQYVEYDPLITPAEPSNPWISDDVALWDIEMSKEPSQQRVKRWGFSFDEILKDQVGRDQFLRFLESEFSSENLRFWLAVQDLKKQPLQDVAKRVEEIWQEFLAPGAPSAINLDSHSYEITSQNVKDGGRYTFEDAQEHIYKLMKSDSYARFLRSNAYQDLLLAKKKPESEQGRRTSLEKFTRSVNVQNTRPAGAWSIFMAALPMAVWLRTPRSCHGLSESRLLGLPSLHDGLREGQSLPQSCPGSSSTAAEGARERASNGRSLARRQHCQCHGQGEETQLCLWSRLESSKRSQRASSLRTSKAKKKRQTVKQGPKAWP

SEQ ID NO: 34814 - protein, 346 aa, Homo sapiens
  ENSP00000451912
MQNKARLELADYEAENLARLQRAFARKWEFIFMQAEAQVKIDRKKDKTERKILDSQERAFWDVHRPVPGCVNTTEMDIRKCRRLKNPQKVKKSVYGVTEESQAQSPVHVLSQPIRKTTKEDIRKQITFLNAQIDRHCLKMSKVAESLIAYTEQYVEYDPLITPAEPSNPWISDDVALWDIEMSKEPSQQRVKRWGFSFDEILKDQVGRDQFLRFLESEFSSENLRFWLAVQDLKKQPLQDVAKRVEEIWQEFLAPGAPSAINLDSHSYEITSQNVKDGGRYTFEDAQEHIYKLMKSDSYARFLRSNAYQDLLLAKKKPESEQGRRTSLEKFTRSVLYSNTPLAKRP

SEQ ID NO: 34815 - protein, 437 aa, Homo sapiens
  ENSP00000383953
MQDDKTGGVPIRTVKSFLSKIPSVVTGTDIVQWLMKNLSIEDPVEAIHLGSLIAAQGYIFPISDHVLTMKDDGTFYRFQAPYFWPSNCWEPENTDYAIYLCKRTMQNKARLELADYEAENLARLQRAFARKWEFIFMQAEAQVKIDRKKDKTERKILDSQERAFWDVHRPVPGCVNTTEMDIRKCRRLKNPQKVKKSVYGVTEESQAQSPVHVLSQPIRKTTKEDIRKQITFLNAQIDRHCLKMSKVAESLIAYTEQYVEYDPLITPAEPSNPWISDDVALWDIEMSKEPSQQRVKRWGFSFDEILKDQVGRDQFLRFLESEFSSENLRFWLAVQDLKKQPLQDVAKRVEEIWQEFLAPGAPSAINLDSHSYEITSQNVKDGGRYTFEDAQEHIYKLMKSDSYARFLRSNAYQDLLLAKKKGKSLAGKRLTGLMQSS

SEQ ID NO: 34816 - protein, 455 aa, Homo sapiens
  ENSP00000478186
MQDDKTGGVPIRTVKSFLSKIPSVVTGTDIVQWLMKNLSIEDPVEAIHLGSLIAAQGYIFPISDHVLTMKDDGTFYRFQAPYFWPSNCWEPENTDYAIYLCKRTMQNKARLELADYEAENLARLQRAFARKWEFIFMQAEAQVKIDRKKDKTERKILDSQERAFWDVHRPVPGCVNTTEMDIRKCRRLKNPQKVKKSVYGVTEESQAQSPVHVLSQPIRKTTKEDIRKQITFLNAQIDRHCLKMSKVAESLIAYTEQYVEYDPLITPAEPSNPWISDDVALWDIEMSKEPSQQRVKRWGFSFDEILKDQVGRDQFLRFLESEFSSENLRFWLAVQDLKKQPLQDVAKRVEEIWQEFLAPGAPSAINLDSHSYEITSQNVKDGGRYTFEDAQEHIYKLMKSDSYARFLRSNAYQDLLLAKKKPESEQGRRTSLEKFTRSVGKSLAGKRLTGLMQSS

SEQ ID NO: 34817 - protein, 418 aa, Homo sapiens
  ENSP00000341199
MQDDKTGGVPIRTVKSFLSKIPSVVTGTDIVQWLMKNLSIEDPVEAIHLGSLIAAQGYIFPISDHVLTMKDDGTFYRFQAPYFWPSNCWEPENTDYAIYLCKRTMQNKARLELADYEAENLARLQRAFARKWEFIFMQAEAQVKIDRKKDKTERKILDSQERAFWDVHRPVPGCVNTTEMDIRKCRRLKNPQKVKKSVYGVTEESQAQSPVHVLSQPIRKTTKEDIRKQITFLNAQIDRHCLKMSKVAESKEPSQQRVKRWGFSFDEILKDQVGRDQFLRFLESEFSSENLRFWLAVQDLKKQPLQDVAKRVEEIWQEFLAPGAPSAINLDSHSYEITSQNVKDGGRYTFEDAQEHIYKLMKSDSYARFLRSNAYQDLLLAKKKPESEQGRRTSLEKFTRSVGKSLAGKRLTGLMQSS

SEQ ID NO: 34818 - protein, 257 aa, Homo sapiens
  ENSP00000334851
MSSAPNGRKKRPSRSTRSSIFQISKPPLQSGDWERRGSGSESAHKTQRALDDCKMLVQEFNTQVALYRELVISIGDVSVSCPSLRAEMHKTRTKGCEMARQAHQKLAAISGPEDGEIHPEICRLYIQLQCCLEMYTTEMLKSICLLGSLQFHRKGKEPGGGTKSLDCKIEESAETPALEDSSSSPVDSQQHSWQVSTDIENTERDMREMKNLLSKLRETMPLPLKNQDDSSLLNLTPYPLVRRRKRRFFGLCCLISS

SEQ ID NO: 34819 - protein, 198 aa, Homo sapiens
  ENSP00000258302
MWNTLTRSLSDHPVGKDPQAMRTGQRQNKGMRTRLGCLSHKSDSCSDFTAILPDKPNRALKRLSTEEATRWADSFDVLLSHKYGVAAFRAFLKTEFSEENLEFWLACEEFKKTRSTAKLVSKAHRIFEEFVDVQAPREVNIDFQTREATRKNLQEPSLTCFDQAQGKVHSLMEKDSYPRFLRSKMYLDLLSQSQRRLS

SEQ ID NO: 34820 - protein, 180 aa, Homo sapiens
  ENSP00000426289
MAALLMPRRNKGMRTRLGCLSHKSDSCSDFTAILPDKPNRALKRLSTEEATRWADSFDVLLSHKYGVAAFRAFLKTEFSEENLEFWLACEEFKKTRSTAKLVSKAHRIFEEFVDVQAPREVNIDFQTREATRKNLQEPSLTCFDQAQGKVHSLMEKDSYPRFLRSKMYLDLLSQSQRRLS

SEQ ID NO: 34821 - protein, 180 aa, Homo sapiens; identical to SEQ ID NO: 34820
  ENSP00000356528

SEQ ID NO: 34822 - protein, 180 aa, Homo sapiens; identical to SEQ ID NO: 34820
  ENSP00000356527

SEQ ID NO: 34823 - protein, 57 aa, Homo sapiens
  ENSP00000427076
MAALLMPRRNKGMRTRLGCLSHKSDSCSDFTAILPDKPNRALKRLSTEEATRWADSF

SEQ ID NO: 34824 - protein, 674 aa, Homo sapiens
  ENSP00000490658
MTIRYQGRQYRLRMAFLQKIEALVKDMQNPETGVRMQNQRVLVTSVPHAMTGSDVLQWIVQRLWISSLEAQNLGNFIVRYGYIYPLQDPKNLILKPDGSLYRFQTPYFWPTQQWPAEDTDYAIYLAKRNIKKKGILEEYEKENYNFLNQKMNYKWDFVIMQAKEQYRAGKERNKADRYALDCQEKAYWLVHRCPPGMDNVLDYGLDRVTNPNEVKVNQKQTVVAVKKEIMYYQQALMRSTVKSSVSLGGIVKYSEQFSSNDAIMSGCLPSNPWITDDTQFWDLNAKLVEIPTKMRVERWAFNFSELIRDPKGRQSFQYFLKKEFSGENLGFWEACEDLKYGDQSKVKEKAEEIYKLFLAPGARRWINIDGKTMDITVKGLKHPHRYVLDAAQTHIYMLMKKDSYARYLKSPIYKDMLAKAIEPQETTKKSSTLPFMRRHLRSSPSPVILRQLEEEAKAREAANTVDITQPGQHMAPSPHLTVYTGTCMPPSPSSPFSSSCRSPRKPFASPSRFIRRPSTTICPSPIRVALESSSGLEQKGECSGSMAPRGPSVTESSEASLDTSWPRSRPRAPPKARMALSFSRFLRRGCLASPVFARLSPKCPAVSHGRVQPLGDVGQQLPRLKSKRVANFFQIKMDVPTGSGTCLMDSEDAGTGESGDRATEKEVICPWESL

SEQ ID NO: 34825 - protein, 628 aa, Homo sapiens
  ENSP00000405814
MTIRHQGQQYRPRMAFLQKIEALVKDMQNPETGVRMQNQRVLVTSVPHAMTGSDVLQWIVQRLWISSLEAQNLGNFIVRYGYIYPLQDPKNLILKPDGSLYRFQTPYFWPTQQWPAEDTDYAIYLAKRNIKKKGILEEYEKENYNFLNQKMNYKWDFVIMQAKEQYRAGKERNKADRYALDCQEKAYWLVHRCPPGMDNVLDYGLDRVTNPNEVKKQTVVAVKKEIMYYQQALMRSTVKSSVSLGGIVKYSEQFSSNDAIMSGCLPSNPWITDDTQFWDLNAKLVEIPTKMRVERWAFNFSELIRDPKGRQSFQYFLKKEFSGENLGFWEACEDLKYGDQSKVKEKAEEIYKLFLAPGARRWINIDGKTMDITVKGLKHPHRYVLDAAQTHIYMLMKKDSYARYLKSPIYKDMLAKAIEPQETTKKSSTLPFMRRHLRSSPSPVILRQLEEEAKAREAANTVDITQPGQHMAPSPHLTVYTGTCMPPSPSSPFSSSCRSPRKPFASPSRFIRRPSTTICPSPIRVALESSSGLEQKGECSGSMAPRGPSVTESSEASLDTSWPRSRPRAPPKARMALSFSRFLRRGCLASPVFARLSPKCPAVSHGRVQPLGDVGQQLPRLKSKRVAK

SEQ ID NO: 34826 - protein, 494 aa, Homo sapiens
  ENSP00000463410
MTIRHQGQQYRPRMAFLQKIEALVKDMQNPETGVRMQNQRVLVTSVPHAMTGSDVLQWIVQRLWISSLEAQNLGNFIVRYGYIYPLQDPKNLILKPDGSLYRFQTPYFWPTQQWPAEDTDYAIYLAKRNIKKKGILEEYEKENYNFLNQKMNYKWDFVIMQAKEQYRAGKERNKADRYALDCQEKAYWLVHRCPPGMDNVLDYGLDRVTNPNEVKVNQKQTVVAVKKEIMYYQQALMRSTVKSSVSLGGIVKYSEQFSSNDAIMSGCLPSNPWITDDTQFWDLNAKLVEIPTKMRVERWAFNFSELIRDPKGRQSFQYFLKKEFSGENLGFWEACEDLKYGDQSKVKEKAEEIYKLFLAPGARRWINIDGKTMDITVKGLKHPHRYVLDAAQTHIYMLMKKDSYARYLKSPIYKDMLAKAIEPQETTKKRQLHPPFYAASPALQPKPCHPETAGRGSQGPRSSQHCGHHPAGPAHGSQPPSDRVHRDLHAPVSF

SEQ ID NO: 34827 - protein, 671 aa, Homo sapiens
  ENSP00000396329
MTIRHQGQQYRPRMAFLQKIEALVKDMQNPETGVRMQNQRVLVTSVPHAMTGSDVLQWIVQRLWISSLEAQNLGNFIVRYGYIYPLQDPKNLILKPDGSLYRFQTPYFWPTQQWPAEDTDYAIYLAKRNIKKKGILEEYEKENYNFLNQKMNYKWDFVIMQAKEQYRAGKERNKADRYALDCQEKAYWLVHRCPPGMDNVLDYGLDRVTNPNEVKKQTVVAVKKEIMYYQQALMRSTVKSSVSLGGIVKYSEQFSSNDAIMSGCLPSNPWITDDTQFWDLNAKLVEIPTKMRVERWAFNFSELIRDPKGRQSFQYFLKKEFSGENLGFWEACEDLKYGDQSKVKEKAEEIYKLFLAPGARRWINIDGKTMDITVKGLKHPHRYVLDAAQTHIYMLMKKDSYARYLKSPIYKDMLAKAIEPQETTKKSSTLPFMRRHLRSSPSPVILRQLEEEAKAREAANTVDITQPGQHMAPSPHLTVYTGTCMPPSPSSPFSSSCRSPRKPFASPSRFIRRPSTTICPSPIRVALESSSGLEQKGECSGSMAPRGPSVTESSEASLDTSWPRSRPRAPPKARMALSFSRFLRRGCLASPVFARLSPKCPAVSHGRVQPLGDVGQQLPRLKSKRVANFFQIKMDVPTGSGTCLMDSEDAGTGESGDRATEKEVICPWESL

SEQ ID NO: 34828 - protein, 674 aa, Homo sapiens
  ENSP00000262406
MTIRHQGQQYRPRMAFLQKIEALVKDMQNPETGVRMQNQRVLVTSVPHAMTGSDVLQWIVQRLWISSLEAQNLGNFIVRYGYIYPLQDPKNLILKPDGSLYRFQTPYFWPTQQWPAEDTDYAIYLAKRNIKKKGILEEYEKENYNFLNQKMNYKWDFVIMQAKEQYRAGKERNKADRYALDCQEKAYWLVHRCPPGMDNVLDYGLDRVTNPNEVKVNQKQTVVAVKKEIMYYQQALMRSTVKSSVSLGGIVKYSEQFSSNDAIMSGCLPSNPWITDDTQFWDLNAKLVEIPTKMRVERWAFNFSELIRDPKGRQSFQYFLKKEFSGENLGFWEACEDLKYGDQSKVKEKAEEIYKLFLAPGARRWINIDGKTMDITVKGLKHPHRYVLDAAQTHIYMLMKKDSYARYLKSPIYKDMLAKAIEPQETTKKSSTLPFMRRHLRSSPSPVILRQLEEEAKAREAANTVDITQPGQHMAPSPHLTVYTGTCMPPSPSSPFSSSCRSPRKPFASPSRFIRRPSTTICPSPIRVALESSSGLEQKGECSGSMAPRGPSVTESSEASLDTSWPRSRPRAPPKARMALSFSRFLRRGCLASPVFARLSPKCPAVSHGRVQPLGDVGQQLPRLKSKRVANFFQIKMDVPTGSGTCLMDSEDAGTGESGDRATEKEVICPWESL

SEQ ID NO: 34829 - protein, 97 aa, Homo sapiens
  ENSP00000389836
MAGSPSRAAGRRLQLPLLCLFLQGATAVLFAVFVRYNHKTDAALWHRSNHSNADNEFYFRYPNGVSLLLPRLECNGTISAHHNLCLPGSSDSPASVS

SEQ ID NO: 34830 - protein, 458 aa, Homo sapiens
  ENSP00000441197
MAGSPSRAAGRRLQLPLLCLFLQGATAVLFAVFVRYNHKTDAALWHRSNHSNADNEFYFRYPSFQDVHAMVFVGFGFLMVFLQRYGFSSVGFTFLLAAFALQWSTLVQGFLHSFHGGHIHVGVESMINADFCAGAVLISFGAVLGKTGPTQLLLMALLEVVLFGINEFVLLHLLGVRDAGGSMTIHTFGAYFGLVLSRVLYRPQLEKSKHRQGSVYHSDLFAMIGTIFLWIFWPSFNAALTALGAGQHRTALNTYYSLAASTLGTFALSALVGEDGRLDMVHIQNAALAGGVVVGTSSEMMLTPFGALAAGFLAGTVSTLGYKFFTPILESKFKVQDTCGVHNLHGMPGVLGALLGVLVAGLATHEAYGDGLESVFPLIAEGQRSATSQAMHQLFGLFVTLMFASVGGGLGGLLLKLPFLDSPPDSQHYEDQVHWQVPGEHEDKAQRPLRVEEADTQA

SEQ ID NO: 34831 - protein, 97 aa, Homo sapiens; identical to SEQ ID NO: 34829
  ENSP00000483178

SEQ ID NO: 34832 - protein, 153 aa, Homo sapiens
  ENSP00000477836
MAGSPSRAAGRRLQLPLLCLFLQGATAVLFAVFVRYNHKTDAALWHRSNHSNADNEFYFRYPKESHSVAQAGVQRRNLGSLQPSPPRLPGRACHGLRGLWLPHGLPAALRLQQRGLHLPPGRLCPAVVHTGPGLSPLLPRWPHPCWRGEHDQC

SEQ ID NO: 34833 - protein, 97 aa, Homo sapiens
  ENSP00000478851
  MOD_RES (1)..(1): Any amino acid
XAGSPSRAAGRRLQLPLLCLFLQGATAVLFAVFVRYNHKTDAALWHRSNHSNADNEFYFRYPNGVSLLLPRLECNGTISAHHNLCLPGSSDSPASVS

SEQ ID NO: 34834 - protein, 331 aa, Homo sapiens
  ENSP00000453588
MAWNTNLRWRLPLTCLLLQVIMVILFGVFVRYDFEADAHWWSERTHKNLSDMENEFYYRYPSFQDVHVMVFVGFGFLMTFLQRYGFSAVGFNFLLAAFGIQWALLMQGWFHFLQDRYIVVGVENLINADFCVASVCVAFGAVLGKVSPIQLLIMTFFQVTLFAVNEFILLNLLKVKDAGGSMTIHTFGAYFGLTVTRILYRRNLEQSKERQNSVYQSDLFAMIGTLFLWMYWPSFNSAISYHGDSQHRAAINTYCSLAACVLTSVAISSALHKKGKLDMVHIQNATLAGGVAVGTAAEMMLMPYGALIIGFVCGIISTLGFVYLTAASWVL

SEQ ID NO: 34835 - protein, 479 aa, Homo sapiens
  ENSP00000268122
MAWNTNLRWRLPLTCLLLQVIMVILFGVFVRYDFEADAHWWSERTHKNLSDMENEFYYRYPSFQDVHVMVFVGFGFLMTFLQRYGFSAVGFNFLLAAFGIQWALLMQGWFHFLQDRYIVVGVENLINADFCVASVCVAFGAVLGKVSPIQLLIMTFFQVTLFAVNEFILLNLLKVKDAGGSMTIHTFGAYFGLTVTRILYRRNLEQSKERQNSVYQSDLFAMIGTLFLWMYWPSFNSAISYHGDSQHRAAINTYCSLAACVLTSVAISSALHKKGKLDMVHIQNATLAGGVAVGTAAEMMLMPYGALIIGFVCGIISTLGFVYLTPFLESRLHIQDTCGINNLHGIPGIIGGIVGAVTAASASLEVYGKEGLVHSFDFQGFNGDWTARTQGKFQIYGLLVTLAMALMGGIIVGLILRLPFWGQPSDENCFEDAVYWEMPEGNSTVYIPEDPTFKPSGPSVPSVPMVSPLPMASSVPLVP

SEQ ID NO: 34836 - protein, 237 aa, Homo sapiens
  ENSP00000453496
  MOD_RES (1)..(1): Any amino acid
XDSQHRAAINTYCSLAACVLTSVAISSALHKKGKLDMVHIQNATLAGGVAVGTAAEMMLMPYGALIIGFVCGIISTLGFVYLTPFLESRLHIQDTCGINNLHGIPGIIGGIVGAVTAASASLEVYGKEGLVHSFDFQGFNGDWTARTQGKFQIYGLLVTLAMALMGGIIVGLILRLPFWGQPSDENCFEDAVYWEMPEGNSTVYIPEDPTFKPSGPSVPSVPMVSPLPMASSVPLVP

SEQ ID NO: 34837 - protein, 233 aa, Homo sapiens
  ENSP00000452899
MAWNTNLRWRLPLTCLLLQVIMVILFGVFVRYDFEADAHWWSERTHKNLSDMENEFYYRYPSFQDVHVMVFVGFGFLMTFLQRYGFSAVGFNFLLAAFGIQWALLMQGWFHFLQDRYIVVGVENLINADFCVASVCVAFGAVLGKVSPIQLLIMTFFQAPSSCGCTGPASTQPYPTMGTASTEPPSTPTAPWQPACLPRWQYPVPCTRRASWTWCTSRMPRSQEGWPWVPLLR

SEQ ID NO: 34838 - protein, 136 aa, Homo sapiens
  ENSP00000453716
MAWNTNLRWRLPLTCLLLQVIMVILFGVFVRYDFEADAHWWSERTHKNLSDMENEFYYRYPSFQDVHVMVFVGFGFLMTFLQRYGFSAVGFNFLLAAFGIQWALLMQGWFHFLQDRYIVVGVENDSPGWESSKCHT

SEQ ID NO: 34839 - protein, 184 aa, Homo sapiens
  ENSP00000262187
MPQSKSRKIAILGYRSVGKSSLTIQFVEGQFVDSYDPTIENTFTKLITVNGQEYHLQLVDTAGQDEYSIFPQTYSIDINGYILVYSVTSIKSFEVIKVIHGKLLDMVGKVQIPIMLVGNKKDLHMERVISYEEGKALAESWNAAFLESSAKENQTAVDVFRRIILEAEKMDGAASQGKSSCSVM

SEQ ID NO: 34840 - protein, 79 aa, Homo sapiens
  ENSP00000420726
MVGKVQIPIMLVGNKKDLHMERVISYEEGKALAESWNAAFLESSAKENQTAVDVFRRIILEAEKMDGAASQGKSSCSVM

SEQ ID NO: 34841 - protein, 47 aa, Homo sapiens
  ENSP00000417802
MPQSKSRKIAILGYRSVGSSSQDLRTCCEWCYSSAGRTGASPWAHLI

SEQ ID NO: 34842 - protein, 79 aa, Homo sapiens; identical to SEQ ID NO: 34840
  ENSP00000418161

SEQ ID NO: 34843 - protein, 19 aa, Homo sapiens
  ENSP00000417212
MVGKVQIPIMLVGNKKDLH

SEQ ID NO: 34844 - protein, 196 aa, Homo sapiens
  ENSP00000272233
MAAIRKKLVVVGDGACGKTCLLIVFSKDEFPEVYVPTVFENYVADIEVDGKQVELALWDTAGQEDYDRLRPLSYPDTDVILMCFSVDSPDSLENIPEKWVPEVKHFCPNVPIILVANKKDLRSDEHVRTELARMKQEPVRTDDGRAMAVRIQAYDYLECSAKTKEGVREVFETATRAALQKRYGSQNGCINCCKVL

SEQ ID NO: 34845 - protein, 696 aa, Homo sapiens
  ENSP00000338671
MDADMDYERPNVETIKCVVVGDNAVGKTRLICARACNTTLTQYQLLATHVPTVWAIDQYRVCQEVLERSRDVVDEVSVSLRLWDTFGDHHKDRRFAYGRSDVVVLCFSIANPNSLNHVKSMWYPEIKHFCPRTPVILVGCQLDLRYADLEAVNRARRPLARPIKRGDILPPEKGREVAKELGLPYYETSVFDQFGIKDVFDNAIRAALISRRHLQFWKSHLKKVQKPLLQAPFLPPKAPPPVIKIPECPSMGTNEAACLLDNPLCADVLFILQDQEHIFAHRIYLATSSSKFYDLFLMECEESPNGSEGACEKEKQSRDFQGRILSVDPEEEREEGPPRIPQADQWKSSNKSLVEALGLEAEGAVPETQTLTGWSKGFIGMHREMQVNPISKRMGPMTVVRMDASVQPGPFRTLLQFLYTGQLDEKEKDLVGLAQIAEVLEMFDLRMMVENIMNKEAFMNQEITKAFHVRKANRIKECLSKGTFSDVTFKLDDGAISAHKPLLICSCEWMAAMFGGSFVESANSEVYLPNINKISMQAVLDYLYTKQLSPNLDLDPLELIALANRFCLPHLVALAEQHAVQELTKAATSGVGIDGEVLSYLELAQFHNAHQLAAWCLHHICTNYNSVCSKFRKEIKSKSADNQEYFERHRWPPVWYLKEEDHYQRVKREREKEDIALNKHRSRRKWCFWNSSPAVA

SEQ ID NO: 34846 - protein, 696 aa, Homo sapiens; identical to SEQ ID NO: 34845
  ENSP00000350595

SEQ ID NO: 34847 - protein, 180 aa, Homo sapiens
  ENSP00000423688
MRKRQTWSIHIVALGNEGDTFHQDNRPSGLIRTYLGRSPLVSGDESSLLLNAASTVARPVFTEYQASAFGNVKLVVHDCPVWDIFDSDWYTSRNLIGGADIIVIKYNVNDKFSFHEVKDNYIPVIKRALNSVPVIIAAVGTRQNEELPCTCPLCTSDRGSCVSTTEGIQLAKELGATYLE

SEQ ID NO: 34848 - protein, 104 aa, Homo sapiens
  ENSP00000426479
MSIHIVALGNEGDTFHQDNRPSGLIRTYLGRSPLVSGDESSLLLNAASTVARPVFTEYQASAFGNVKLVVHDCPVWVRKSSCSALRLKKLFFPFFSPSPFCPLP

SEQ ID NO: 34849 - protein, 611 aa, Homo sapiens
  ENSP00000369318
MSIHIVALGNEGDTFHQDNRPSGLIRTYLGRSPLVSGDESSLLLNAASTVARPVFTEYQASAFGNVKLVVHDCPVWDIFDSDWYTSRNLIGGADIIVIKYNVNDKFSFHEVKDNYIPVIKRALNSVPVIIAAVGTRQNEELPCTCPLCTSDRGSCVSTTEGIQLAKELGATYLELHSLDDFYIGKYFGGVLEYFMIQALNQKTSEKMKKRKMSNSFHGIRPPQLEQPEKMPVLKAEASHYNSDLNNLLFCCQCVDVVFYNPNLKKVVEAHKIVLCAVSHVFMLLFNVKSPTDIQDSSIIRTTQDLFAINRDTAFPGASHESSGNPPLRVIVKDALFCSCLSDILRFIYSGAFQWEELEEDIRKKLKDSGDVSNVIEKVKCILKTPGKINCLRNCKTYQARKPLWFYNTSLKFFLNKPMLADVVFEIQGTTVPAHRAILVARCEVMAAMFNGNYMEAKSVLIPVYGVSKETFLSFLEYLYTDSCCPAGIFQAMCLLICAEMYQVSRLQHICELFIITQLQSMPSRELASMNLDIVDLLKKAKFHHSDCLSTWLLHFIATNYLIFSQKPEFQDLSVEERSFVEKHRWPSNMYLKQLAEYRKYIHSRKCRCLVM

SEQ ID NO: 34850 - protein, 72 aa, Homo sapiens
  ENSP00000423652
LVSGDESSLLLNAASTVARPVFTEYQASAFGNVKLVVHDCPVWKSYLVHAHYVPQTEGAVLVQLKGSNLQKN

SEQ ID NO: 34851 - protein, 103 aa, Homo sapiens
  ENSP00000421875
  MOD_RES (1)..(1): Any amino acid
XDIIVIKYNVNDKFSFHEVKDNYIPVIKRALNSVPVIIAAVGTRQNEELPCTCPLCTSDRGSCVSTTEGIQLAKELGATYLELHSLDDFYIGKYFGGVKKCLS

SEQ ID NO: 34852 - protein, 242 aa, Homo sapiens
  ENSP00000422360
MPKRAVLFTDRQPIQFLKINCLRNCKTYQARKPLWFYNTSLKFFLNKPMLADVVFEIQGTTVPAHRAILVARCEVMAAMFNGNYMEAKSVLIPVYGVSKETFLSFLEYLYTDSCCPAGIFQAMCLLICAEMYQVSRLQHICELFIITQLQSMPSRELASMNLDIVDLLKKAKFHHSDCLSTWLLHFIATNYLIFSQKPEFQDLSVEERSFVEKHRWPSNMYLKQLAEYRKYIHSRKCRCLVM

SEQ ID NO: 34853 - protein, 172 aa, Homo sapiens
  ENSP00000424844
  MOD_RES (1)..(1): Any amino acid
XADVVFEIQGTTVPAHRAILVARCEVMAAMFNGNYMEAKSVLIPVYGVSKETFLSFLEYLYTDSCCPAGIFQAMCLLICAEMYQVSRLQHICELFIITQLQSMPSRELASMNLDIVDLLKKAKFHHSDCLSTWLLHFIATNYLIFSQKPEFQDLSGRLLISVLKRKLYVLCS

SEQ ID NO: 34854 - protein, 117 aa, Homo sapiens
  ENSP00000426390
  MOD_RES (1)..(1): Any amino acid
XEMYQVSRLQHICELFIITQLQSMPSRELASMNLDIVDLLKKAKFHHSDCLSTWLLHFIATNYLIFSQKPEFQDLSVEERSFVEKHRWPSNMYLKQLAEYRKYIHSRKCRCLVIKRH

SEQ ID NO: 34855 - protein, 76 aa, Homo sapiens
  ENSP00000425342
  MOD_RES (1)..(1): Any amino acid
XYLIFSQKPEFQDLSGSFMVKPEYLQRGGAKARAGHHDCHVRGIPSILRSREGKKIHSQKQLFTVTLIVTRIKMAK

SEQ ID NO: 34856 - protein, 37 aa, Homo sapiens
  ENSP00000424700
  MOD_RES (1)..(1): Any amino acid
XIFSQKPEFQDLSVFFLKLQWKNAVLLKSTDGRRICT

SEQ ID NO: 34857 - protein, 210 aa, Homo sapiens
  ENSP00000308576
MTAAQAAGEEAPPGVRSVKVVLVGDGGCGKTSLLMVFADGAFPESYTPTVFERYMVNLQVKGKPVHLHIWDTAGQDDYDRLRPLFYPDASVLLLCFDVTSPNSFDNIFNRWYPEVNHFCKKVPIIVVGCKTDLRKDKSLVNKLRRNGLEPVTYHRGQEMARSVGAVAYLECSARLHDNVHAVFQEAAEVALSSRGRNFWRRITQGFCVVT

SEQ ID NO: 34858 - protein, 144 aa, Homo sapiens
  ENSP00000432003
MTAAQAAGEEAPPGVRSVKVVLVGDGGCGKTSLLMVFADGAFPEWYPEVNHFCKKVPIIVVGCKTDLRKDKSLVNKLRRNGLEPVTYHRGQEMARSVGAVAYLECSARLHDNVHAVFQEAAEVALSSRGRNFWRRITQGFCVVT

SEQ ID NO: 34859 - protein, 153 aa, Homo sapiens
  ENSP00000451796
MNCKEGTDSSCGCRGNDEKKMLKCVVVGDGAVGKTCLLMSYANDAFPEEYVPTVFDHYAVTVTVGGKQHLLGLYDTAGQEDYNQLRPLSYPNTDVFLICFSVVWDLPPPHPGMRMAANLCGQAPAKKEGTTRKELPLHGGLPHHPLSPPNTAH

SEQ ID NO: 34860 - protein, 214 aa, Homo sapiens
  ENSP00000316729
MNCKEGTDSSCGCRGNDEKKMLKCVVVGDGAVGKTCLLMSYANDAFPEEYVPTVFDHYAVTVTVGGKQHLLGLYDTAGQEDYNQLRPLSYPNTDVFLICFSVVNPASYHNVQEEWVPELKDCMPHVPYVLIGTQIDLRDDPKTLARLLYMKEKPLTYEHGVKLAKAIGAQCYLECSALTQKGLKAVFDEAILTIFHPKKKKKRCSEGHSCCSII

SEQ ID NO: 34861 - protein, 178 aa, Homo sapiens
  ENSP00000451643
MNCKEGTDSSCGCRGNDEKKMLKCVVVGDGAVGKTCLLMSYANDAFPEEYVPTVFDHYAVTVTVGGKQHLLGLYDTAGQEDYNQLRPLSYPNTDVFLICFSVVNPASYHNVQEEWVPELKDCMPHVPYVLIGTQIDLRDDPKTLARLLYMKEKPLTYEHGVKLAKAVQSDLNFILNVC

SEQ ID NO: 34862 - protein, 258 aa, Homo sapiens
  ENSP00000355652
MPPQQGDPAFPDRCEAPPVPPRRERGGRGGRGPGEPGGRGRAGGAEGRGVKCVLVGDGAVGKTSLVVSYTTNGYPTEYIPTAFDNFSAVVSVDGRPVRLQLCDTAGQDEFDKLRPLCYTNTDIFLLCFSVVSPSSFQNVSEKWVPEIRCHCPKAPIILVGTQSDLREDVKVLIELDKCKEKPVPEEAAKLCAEEIKAASYIECSALTQKNLKEVFDAAIVAGIQYSDTQQQPKKSKSRTPDKMKNLSKSWWKKYCCFV

SEQ ID NO: 34863 - protein, 686 aa, Homo sapiens
  ENSP00000254260
MTDALLPAAPQPLEKENDGYFRKGCNPLAQTGRSKLQNQRAALNQQILKAVRMRTGAENLLKVATNSKVREQVRLELSFVNSDLQMLKEELEGLNISVGVYQNTEEAFTIPLIPLGLKETKDVDFAVVLKDFILEHYSEDGYLYEDEIADLMDLRQACRTPSRDEAGVELLMTYFIQLGFVESRFFPPTRQMGLLFTWYDSLTGVPVSQQNLLLEKASVLFNTGALYTQIGTRCDRQTQAGLESAIDAFQRAAGVLNYLKDTFTHTPSYDMSPAMLSVLVKMMLAQAQESVFEKISLPGIRNEFFMLVKVAQEAAKVGEVYQQLHAAMSQAPVKENIPYSWASLACVKAHHYAALAHYFTAILLIDHQVKPGTDLDHQEKCLSQLYDHMPEGLTPLATLKNDQQRRQLGKSHLRRAMAHHEESVREASLCKKLRSIEVLQKVLCAAQERSRLTYAQHQEEDDLLNLIDAPSVVAKTEQEVDIILPQFSKLTVTDFFQKLGPLSVFSANKRWTPPRSIRFTAEEGDLGFTLRGNAPVQVHFLDPYCSASVAGAREGDYIVSIQLVDCKWLTLSEVMKLLKSFGEDEIEMKVVSLLDSTSSMHNKSATYSVGMQKTYSMICLAIDDDDKTDKTKKISKKLSFLSWGTNKNRQKSASTLCLPSVGAARPQVKKKLPSPFSLLNSDSSWY

SEQ ID NO: 34864 - protein, 128 aa, Homo sapiens
  ENSP00000465898
MTDALLPAAPQPLEKENDGYFRKGCNPLAQTGRSKLQNQRAALNQQILKAVRMRTGAENLLKVATNSKVREQVRLELSFVNSDLQMLKEELEGLNISVGVYQNTEILSWNITVKMAIYMKMKLQILWI

SEQ ID NO: 34865 - protein, 1052 aa, Homo sapiens
  ENSP00000261655
MREAAERRQQLQLEHDQALAVLSAKQQEIDLLQKSKVRELEEKCRTQSEQFNLLSRDLEKFRQHAGKIDLLGGSAVAPLDISTAPSKPFPQFMNGLATSLGKGQESAIGGSSAIGEYIRPLPQPGDRPEPLSAKPTFLSRSGSARCRSESDMENERNSNTSKQRYSGKVHLCVARYSYNPFDGPNENPEAELPLTAGKYLYVYGDMDEDGFYEGELLDGQRGLVPSNFVDFVQDNESRLASTLGNEQDQNFINHSGIGLEGEHILDLHSPTHIDAGITDNSAGTLDVNIDDIGEDIVPYPRKITLIKQLAKSVIVGWEPPAVPPGWGTVSSYNVLVDKETRMNLTLGSRTKALIEKLNMAACTYRISVQCVTSRGSSDELQCTLLVGKDVVVAPSHLRVDNITQISAQLSWLPTNSNYSHVIFLNEEEFDIVKAARYKYQFFNLRPNMAYKVKVLAKPHQMPWQLPLEQREKKEAFVEFSTLPAGPPAPPQDVTVQAGVTPATIRVSWRPPVLTPTGLSNGANVTGYGVYAKGQRVAEVIFPTADSTAVELVRLRSLEAKGVTVRTLSAQGESVDSAVAAVPPELLVPPTPHPRPAPQSKPLASSGVPETKDEHLGPHARMDEAWEQSRAPGPVHGHMLEPPVGPGRRSPSPSRILPQPQGTPVSTTVAKAMAREAAQRVAESSRLEKRSVFLERSSAGQYAASDEEDAYDSPDFKRRGASVDDFLKGSELGKQPHCCHGDEYHTESSRGSDLSDIMEEDEEELYSEMQLEDGGRRRPSGTSHNALKILGNPASAGRVDHMGRRFPRGSAGPQRSRPVTVPSIDDYGRDRLSPDFYEESETDPGAEELPARIFVALFDYDPLTMSPNPDAAEEELPFKEGQIIKVYGDKDADGFYRGETCARLGLIPCNMVSEIQADDEEMMDQLLRQGFLPLNTPVEKIERSRRSGRRHSVSTRRMVALYDYDPRESSPNVDVEAELTFCTGDIITVFGEIDEDGFYYGELNGQKGLVPSNFLEEVPDDVEVYLSDAPSHYSQDTPMRSKAKRKKSVHFTP

SEQ ID NO: 34866 - protein, 62 aa, Homo sapiens
  ENSP00000439437
  MOD_RES (1)..(1): Any amino acid
XREAGEVAGVIRYRRGEWWPCMTTTPEKARPTSMSRPNLHFAQEILLQFLVKLMKMDFIMGS

SEQ ID NO: 34867 - protein, 157 aa, Homo sapiens
  ENSP00000439030
MSPNPDAAEEELPFKEGQIIKVYGDKDADGFYRGETCARLGLIPCNMVSEIQADDEEMMDQLLRQGFLPLNTPVEKIERSRRSGRRHSVSTRRMVALYDYDPRESSPNVDVEAELTFCTGDIITVFGEIDEDGFYYGELNGQKGLVPSNFLEEVPDD

SEQ ID NO: 34868 - protein, 645 aa, Homo sapiens
  ENSP00000440347
MNGLATSLGKGQESAIGGSSAIGEYIRPLPQPGDRPEPLSAKPTFLSRSGSARCRSESDMENERNSNTSKQRYSGKVHLCVARYSYNPFDGPNENPEAELPLTAGKYLYVYGDMDEDGFYEGELLDGQRGLVPSNFVDFVQDNESRLASTLGNEQDQNFINHSGIGLEGEHILDLHSPTHIDAGITDNSAGTLDVNIDDIGEDIVPYPRKITLIKQLAKSVIVGWEPPAVPPGWGTVSSYNVLVDKETRMNLTLGSRTKALIEKLNMAACTYRISVQCVTSRGSSDELQCTLLVGKDVVVAPSHLRVDNITQISAQLSWLPTNSNYSHVIFLNEEEFDIVKAARYKYQFFNLRPNMAYKVKVLAKPHQMPWQLPLEQREKKEAFVEFSTLPAGPPAPPQDVTVQAGVTPATIRVSWRPPVLTPTGLSNGANVTGYGVYAKGQRVAEVIFPTADSTAVELVRLRSLEAKGVTVRTLSAQGESVDSAVAAVPPELLVPPTPHPRPAPQSKPLASSGVPETKDEHLGPHARMDEAWEQSRAPGPVHGHMLEPPVGPGRRSPSPSRILPQPQGTPVSTTVAKAMAREAAQRVAESSRLEKRSVFLERSSAGQYAASDEEDAYDSPDFKRRGASVDDFLKGSELGKQMVS

SEQ ID NO: 34869 - protein, 1481 aa, Homo sapiens
  ENSP00000430101
MSSAVGPRGPRPPTVPPPMQELPDLSHLTEEERNIIMAVMDRQKEEEEKEEAMLKCVVRDMAKPAACKTPRNAENQPHQPSPRLHQQFESYKEQVRKIGEEARRYQGEHKDDAPTCGICHKTKFADGCGHLCSYCRTKFCARCGGRVSLRSNNEDKVVMWVCNLCRKQQEILTKSGAWFFGSGPQQTSQDGTLSDTATGAGSEVPREKKARLQERSRSQTPLSTAAASSQDAAPPSAPPDRSKGAEPSQQALGPEQKQASSRSRSEPPRERKKTPGLSEQNGKGALKSERKRVPKTSAQPVEGAVEERERKERRESRRLEKGRSQDYPDTPEKRDEGKAADEEKQRKEEDYQTRYRSDPNLARYPVKPPPEEQQMRMHARVSRARHERRHSDVALPRTEAGAALPEGKAGKRAPAAARASPPDSPRAYSAERTAETRAPGAKQLTNHSPPAPRHGPVPAEAPELKAQEPLRKQSRLDPSSAVLMRKAKREKVETMLRNDSLSSDQSESVRPSPPKPHRSKRGGKKRQMSVSSSEEEGVSTPEYTSCEDVELESESVSEKGDLDYYWLDPATWHSRETSPISSHPVTWQPSKEGDRLIGRVILNKRTTMPKDSGALLGLKVVGGKMTDLGRLGAFITKVKKGSLADVVGHLRAGDEVLEWNGKPLPGATNEEVYNIILESKSEPQVEIIVSRPIGDIPRIPESSHPPLESSSSSFESQKMERPSISVISPTSPGALKDAPQVLPGQLSVKLWYDKVGHQLIVNVLQATDLPARVDGRPRNPYVKMYFLPDRSDKSKRRTKTVKKILEPKWNQTFVYSHVHRRDFRERMLEITVWDQPRVQEEESEFLGEILIELETALLDDEPHWYKLQTHDESSLPLPQPSPFMPRRHIHGESSSKKLQRSQRISDSDISDYEVDDGIGVVPPVGYRSSARESKSTTLTVPEQQRTTHHRSRSVSPHRGNDQGKPRSRLPNVPLQRSLDEIHPTRRSRSPTRHHDASRSPVDHRTRDVDSQYLSEQDSELLMLPRAKRGRSAECLHTTSELQPFLDRARSASTNCLRPDTSLHSPERERMHRQRSPTQSPPADTSFSSRRGRQLPQVPVRSGSIEQASLVVEERTRQMKMKVHRFKQTTGSGSSQELDREQYSKYNIHKDQYRSCDNVSAKSSDSDVSDVSAISRTSSASRLSSTSFMSEQSERPRGRISSFTPKMQGRRMGTSGRSIMKSTSVSGEMYTLEHNDGSQSDTAVGTVGAGGKKRRSSLSAKVVAIVSRRSRSTSQLSQTESGHKKLKSTIQRSTETGMAAEMRKMVRQPSRESTDGSINSYSSEGNLIFPGVRLGADSQFSDFLDGLGPAQLVGRQTLATPAMAPYVKVYLLENGACIAKKKTRIARKTLDPLYQQSLVFDESPQGKVLQVIVWGDYGRMDHKCFMGVAQILLEELDLSSMVIGWYKLFPPSSLVDPTLTPLTRRASQSSLESSTGPPCIRS

SEQ ID NO: 34870 - protein, 1475 aa, Homo sapiens
  ENSP00000429959
MSSAVGPRGPRPPTVPPPMQELPDLSHLTEEERNIIMAVMDRQKEEEEKEEAMLKCVVRDMAKPAACKTPRNAENQPHQPSPRLHQQFESYKEQVRKIGEEARRYQGEHKDDAPTCGICHKTKFADGCGHLCSYCRTKFCARCGGRVSLRSNNEDKVVMWVCNLCRKQQEILTKSGAWFFGSGPQQTSQDGTLSDTATGAGSEVPREKKARLQERSRSQTPLSTAAASSQDAAPPSAPPDRSKGAEPSQQALGPEQKQASSRSRSEPPRERKKTPGLSEQNGKGALKSERKRVPKTSAQPVEGAVEERERKERRESRRLEKGRSQDYPDTPEKRDEGKAADEEKQRKEEDYQTRYRSDPNLARYPVKPPPEEQQMRMHARVSRARHERRHSDVALPRTEAGAALPEGKAGKRAPAAARASPPDSPRAYSAERTAETRAPGAKQLTNHSPPAPRHGPVPAEAPELKAQEPLRKQSRLDPSSAVLMRKAKREKVETMLRNDSLSSDQSESVRPSPPKPHRSKRGGKKRQMSVSSSEEEGVSTPEYTSCEDVELESESVSEKGDLDYYWLDPATWHSRETSPISSHPVTWQPSKEGDRLIGRVILNKRTTMPKDSGALLGLKVVGGKMTDLGRLGAFITKVKKGSLADVVGHLRAGDEVLEWNGKPLPGATNEEVYNIILESKSEPQVEIIVSRPIGDIPRIPESSHPPLESSSSSFESQKMERPSISVISPTSPGALKDAPQVLPGQLSVKLWYDKVGHQLIVNVLQATDLPARVDGRPRNPYVKMYFLPDRSDKSKRRTKTVKKILEPKWNQTFVYSHVHRRDFRERMLEITVWDQPRVQEEESEFLGEILIELETALLDDEPHWYKLQTHDESSLPLPQPSPFMPRRHIHGESSSKKLQRSQRISDSDISDYEVDDGIGVVPPGYRSSARESKSTTLTVPEQQRTTHHRSRSVSPHRGNDQGKPRSRLPNVPLQRSLDEIHPTRRSRSPTRHHDASRSPVDHRTRDVDSQYLSEQDSELLMLPRAKRGRSAECLHTTRMHRQRSPTQSPPADTSFSSRRGRQLPQVPVRSGSIEQASLVVEERTRQMKMKVHRFKQTTGSGSSQELDREQYSKYNIHKDQYRSCDNVSAKSSDSDVSDVSAISRTSSASRLSSTSFMSEQSERPRGRIRRMGTSGRSIMKSTSVSGEMYTLEHNDGSQSDTAVGTVGAGGKKRRSSLSAKVVAIVSRRSRSTSQLSQTESGHKKLKSTIQRSTETGMAAEMRKMVRQPSRESTDGSINSYSSEGNLIFPGVRLGADSQFSDFLDGLGPAQLVGRQTLATPAMGDIQIGMEDKKGQLEVEVIRARSLTQKPGSKSTPAPYVKVYLLENGACIAKKKTRIARKTLDPLYQQSLVFDESPQGKVLQVIVWGDYGRMDHKCFMGVAQILLEELDLSSMVIGWYKLFPPSSLVDPTLTPLTRRASQSSLESSTGPPCIRS

SEQ ID NO: 34871 - protein, 1371 aa, Homo sapiens
  ENSP00000430408
MSSAVGPRGPRPPTVPPPMQELPDLSHLTEEERNIIMAVMDRQKEEEEKEEAMLKCVVRDMAKPAACKTPRNAENQPHQPSPRLHQQFESYKEQVRKIGEEARRYQGEHKDDAPTCGICHKTKFADGCGHLCSYCRTKFCARCGGRVSLRSNNEDKVVMWVCNLCRKQQEILTKSGAWFFGSGPQQTSQDGTLSDTATGAGSEVPREKKARLQERSRSQTPLSTAAASSQDAAPPSAPPDRSKGAEPSQQALGPEQKQASSRSRSEPPRERKKTPGLSEQNGKGALKSERKRVPKTSAQPVEGAVEERERKERRESRRLEKGRSQDYPDTPEKRDEGKAADEEKQRKEEDYQTRYRSDPNLARYPVKPPPEEQQMRMHARVSRARHERRHSDVALPRTEAGAALPEGKAGKRAPAAARASPPDSPRAYSAERTAETRAPGAKQLTNHSPPAPRHGPVPAEAPELKAQEPLRKQSRLDPSSAVLMRKAKREKVETMLRNDSLSSDQSESVRPSPPKPHRSKRGGKKRQMSVSSSEEEGVSTPEYTSCEDVELESESVSEKGDLDYYWLDPATWHSRETSPISSHPVTWQPSKEGDRLIGRVILNKRTTMPKDSGALLGLKVVGGKMTDLGRLGAFITKVKKGSLADVVGHLRAGDEVLEWNGKPLPGATNEEVYNIILESKSEPQVEIIVSRPIGDIPRIPESSHPPLESSSSSFESQKMERPSISVISPTSPGALKDAPQVLPGQLSVKLWYDKVGHQLIVNVLQATDLPARVDGRPRNPYVKMYFLPDRSDKSKRRTKTVKKILEPKWNQTFVYSHVHRRDFRERMLEITVWDQPRVQEEESEFLGEILIELETALLDDEPHWYKLQTHDESSLPLPQPSPFMPRRHIHGESSSKKLQRSQRISDSDISDYEVDDGIGVVPPVGYRSSARESKSTTLTVPEQQRTTHHRSRSVSPHRGNDQGKPRSRLPNVPLQRSLDEIHPTRRSRSPTRHHDASRSPVDHRTRDVDSQYLSEQDSELLMLPRAKRGRSAECLHTTSELQPFLDRARSASTNCLRPDTSLHSPERERGRWSPSLDRRRPPSPRIQIQHASPENDRMHRQRSPTQSPPADTSFSSRRGRQLPQVPVRSGSIEQESGHKKLKSTIQRSTETGMAAEMRKMVRQPSRESTDGSINSYSSEGNLIFPGVRLGADSQFSDFLDGLGPAQLVGRQTLATPAMGDIQIGMEDKKGQLEVEVIRARSLTQKPGSKSTPAPYVKVYLLENGACIAKKKTRIARKTLDPLYQQSLVFDESPQGKVLQVIVWGDYGRMDHKCFMGVAQILLEELDLSSMVIGWYKLFPPSSLVDPTLTPLTRRASQSSLESSTGPPCIRS

SEQ ID NO: 34872 - protein, 1291 aa, Homo sapiens
  ENSP00000430932
MSSAVGPRGPRPPTVPPPMQELPDLSHLTEEERNIIMAVMDRQKEEEEKEEAMLKCVVRDMAKPAACKTPRNAENQPHQPSPRLHQQFESYKEQVRKIGEEARRYQGEHKDDAPTCGICHKTKFADGCGHLCSYCRTKFCARCGGRVSLRSNNEDKVVMWVCNLCRKQQEILTKSGAWFFGSGPQQTSQDGTLSDTATGAGSEVPREKKARLQERSRSQTPLSTAAASSQDAAPPSAPPDRSKGAEPSQQALGPEQKQASSRSRSEPPRERKKTPGLSEQNGKGALKSERKRVPKTSAQPVEGAVEERERKERRESRRLEKGRSQDYPDTPEKRDEGKAADEEKQRKEEDYQTRYRSDPNLARYPVKPPPEEQQMRMHARVSRARHERRHSDVALPRTEAGAALPEGKAGKRAPAAARASPPDSPRAYSAERTAETRAPGAKQLTNHSPPAPRHGPVPAEAPELKAQEPLRKQSRLDPSSAVLMRKAKREKVETMLRNDSLSSDQSESVRPSPPKPHRSKRGGKKRQMSVSSSEEEGVSTPEYTSCEDVELESESVSEKGDLDYYWLDPATWHSRETSPISSHPVTWQPSKEGDRLIGRVILNKRTTMPKDSGALLGLKVVGGKMTDLGRLGAFITKVKKGSLADVVGHLRAGDEVLEWNGKPLPGATNEEVYNIILESKSEPQVEIIVSRPIGDIPRIPESSHPPLESSSSSFESQKMERPSISVISPTSPGALKDAPQVLPGQLSVKLWYDKVGHQLIVNVLQATDLPARVDGRPRNPYVKMYFLPDRSDKSKRRTKTVKKILEPKWNQTFVYSHVHRRDFRERMLEITVWDQPRVQEEESEFLGEILIELETALLDDEPHWYKLQTHDESSLPLPQPSPFMPRRHIHGESSSKKLQRSQRISDSDISDYEVDDGIGVVPPGYRSSARESKSTTLTVPEQQRTTHHRSRSVSPHRGNDQGKPRSRLPNVPLQRSLDEIHPTRRSRSPTRHHDASRSPVDHRTRDVDSQYLSEQDRMHRQRSPTQSPPADTSFSSRRGRQLPQVPVRSGSIEQESGHKKLKSTIQRSTETGMAAEMRKMVRQPSRESTDGSINSYSSEGNLIFPGVRLGADSQFSDFLDGLGPAQLVGRQTLATPAMGDIQIGMEDKKGQLEVEVIRARSLTQKPGSKSTPAPYVKVYLLENGACIAKKKTRIARKTLDPLYQQSLVFDESPQGKVLQVIVWGDYGRMDHKCFMGVAQILLEELDLSSMVIGWYKLFPPSSLVDPTLTPLTRRASQSSLESSTGPPCIRS

SEQ ID NO: 34873 - protein, 1692 aa, Homo sapiens
  ENSP00000428417
MSSAVGPRGPRPPTVPPPMQELPDLSHLTEEERNIIMAVMDRQKEEEEKEEAMLKCVVRDMAKPAACKTPRNAENQPHQPSPRLHQQFESYKEQVRKIGEEARRYQGEHKDDAPTCGICHKTKFADGCGHLCSYCRTKFCARCGGRVSLRSNNEDKVVMWVCNLCRKQQEILTKSGAWFFGSGPQQTSQDGTLSDTATGAGSEVPREKKARLQERSRSQTPLSTAAASSQDAAPPSAPPDRSKGAEPSQQALGPEQKQASSRSRSEPPRERKKTPGLSEQNGKGALKSERKRVPKTSAQPVEGAVEERERKERRESRRLEKGRSQDYPDTPEKRDEGKAADEEKQRKEEDYQTRYRSDPNLARYPVKPPPEEQQMRMHARVSRARHERRHSDVALPRTEAGAALPEGKAGKRAPAAARASPPDSPRAYSAERTAETRAPGAKQLTNHSPPAPRHGPVPAEAPELKAQEPLRKQSRLDPSSAVLMRKAKREKVETMLRNDSLSSDQSESVRPSPPKPHRSKRGGKKRQMSVSSSEEEGVSTPEYTSCEDVELESESVSEKGDLDYYWLDPATWHSRETSPISSHPVTWQPSKEGDRLIGRVILNKRTTMPKDSGALLGLKVVGGKMTDLGRLGAFITKVKKGSLADVVGHLRAGDEVLEWNGKPLPGATNEEVYNIILESKSEPQVEIIVSRPIGDIPRIPESSHPPLESSSSSFESQKMERPSISVISPTSPGALKDAPQVLPGQLSVKLWYDKVGHQLIVNVLQATDLPARVDGRPRNPYVKMYFLPDRSDKSKRRTKTVKKILEPKWNQTFVYSHVHRRDFRERMLEITVWDQPRVQEEESEFLGEILIELETALLDDEPHWYKLQTHDESSLPLPQPSPFMPRRHIHGESSSKKLQRSQRISDSDISDYEVDDGIGVVPPVGYRSSARESKSTTLTVPEQQRTTHHRSRSVSPHRGNDQGKPRSRLPNVPLQRSLDEIHPTRRSRSPTRHHDASRSPVDHRTRDVDSQYLSEQDSELLMLPRAKRGRSAECLHTTRHLVRHYKTLPPKMPLLQSSSHWNIYSSILPAHTKTKSVTRQDISLHHECFNSTVLRFTDEILVSELQPFLDRARSASTNCLRPDTSLHSPERERGRWSPSLDRRRPPSPRIQIQHASPENDRHSRKSERSSIQKQTRKGTASDAERVLPTCLSRRGHAAPRATDQPVIRGKHPARSRSSEHSSIRTLCSMHHLVPGGSAPPSPLLTRMHRQRSPTQSPPADTSFSSRRGRQLPQVPVRSGSIEQASLVVEERTRQMKMKVHRFKQTTGSGSSQELDREQYSKYNIHKDQYRSCDNVSAKSSDSDVSDVSAISRTSSASRLSSTSFMSEQSERPRGRISSFTPKMQGRRMGTSGRSIMKSTSVSGEMYTLEHNDGSQSDTAVGTVGAGGKKRRSSLSAKVVAIVSRRSRSTSQLSQTESGHKKLKSTIQRSTETGMAAEMRKMVRQPSRESTDGSINSYSSEGNLIFPGVRLGADSQFSDFLDGLGPAQLVGRQTLATPAMGDIQIGMEDKKGQLEVEVIRARSLTQKPGSKSTPAPYVKVYLLENGACIAKKKTRIARKTLDPLYQQSLVFDESPQGKVLQVIVWGDYGRMDHKCFMGVAQILLEELDLSSMVIGWYKLFPPSSLVDPTLTPLTRRASQSSLESSTGPPCIRS

SEQ ID NO: 34874 - protein, 1342 aa, Homo sapiens
  ENSP00000430502
MSSAVGPRGPRPPTVPPPMQELPDLSHLTEEERNIIMAVMDRQKEEEEKEEAMLKCVVRDMAKPAACKTPRNAENQPHQPSPRLHQQFESYKEQVRKIGEEARRYQGEHKDDAPTCGICHKTKFADGCGHLCSYCRTKFCARCGGRVSLRSNNEDKVVMWVCNLCRKQQEILTKSGAWFFGSGPQQTSQDGTLSDTATGAGSEVPREKKARLQERSRSQTPLSTAAASSQDAAPPSAPPDRSKGAEPSQQALGPEQKQASSRSRSEPPRERKKTPGLSEQNGKGALKSERKRVPKTSAQPVEGAVEERERKERRESRRLEKGRSQDYPDTPEKRDEGKAADEEKQRKEEDYQTRYRSDPNLARYPVKPPPEEQQMRMHARVSRARHERRHSDVALPRTEAGAALPEGKAGKRAPAAARASPPDSPRAYSAERTAETRAPGAKQLTNHSPPAPRHGPVPAEAPELKAQEPLRKQSRLDPSSAVLMRKAKREKVETMLRNDSLSSDQSESVRPSPPKPHRSKRGGKKRQMSVSSSEEEGVSTPEYTSCEDVELESESVSEKGDLDYYWLDPATWHSRETSPISSHPVTWQPSKEGDRLIGRVILNKRTTMPKDSGALLGLKVVGGKMTDLGRLGAFITKVKKGSLADVVGHLRAGDEVLEWNGKPLPGATNEEVYNIILESKSEPQVEIIVSRPIGDIPRIPESSHPPLESSSSSFESQKMERPSISVISPTSPGALKDAPQVLPGQLSVKLWYDKVGHQLIVNVLQATDLPARVDGRPRNPYVKMYFLPDRSDKSKRRTKTVKKILEPKWNQTFVYSHVHRRDFRERMLEITVWDQPRVQEEESEFLGEILIELETALLDDEPHWYKLQTHDESSLPLPQPSPFMPRRHIHGESSSKKLQRSQRISDSDISDYEVDDGIGVVPPGYRSSARESKSTTLTVPEQQRTTHHRSRSVSPHRGNDQGKPRSRLPNVPLQRSLDEIHPTRRSRSPTRHHDASRSPVDHRTRDVDSQYLSEQDSELLMLPRAKRGRSAECLHTTSELQPFLDRARSASTNCLRPDTSLHSPERERMHRQRSPTQSPPADTSFSSRRGRQLPQVPVRSGSIEQESGHKKLKSTIQRSTETGMAAEMRKMVRQPSRESTDGSINSYSSEGNLIFPGVRLGADSQFSDFLDGLGPAQLVGRQTLATPAMGDIQIGMEDKKGQLEVEVIRARSLTQKPGSKSTPAPYVKVYLLENGACIAKKKTRIARKTLDPLYQQSLVFDESPQGKVLQVIVWGDYGRMDHKCFMGVAQILLEELDLSSMVIGWYKLFPPSSLVDPTLTPLTRRASQSSLESSTGPPCIRS

SEQ ID NO: 34875 - protein, 1541 aa, Homo sapiens
  ENSP00000264839
MSSAVGPRGPRPPTVPPPMQELPDLSHLTEEERNIIMAVMDRQKEEEEKEEAMLKCVVRDMAKPAACKTPRNAENQPHQPSPRLHQQFESYKEQVRKIGEEARRYQGEHKDDAPTCGICHKTKFADGCGHLCSYCRTKFCARCGGRVSLRSNNEDKVVMWVCNLCRKQQEILTKSGAWFFGSGPQQTSQDGTLSDTATGAGSEVPREKKARLQERSRSQTPLSTAAASSQDAAPPSAPPDRSKGAEPSQQALGPEQKQASSRSRSEPPRERKKTPGLSEQNGKGALKSERKRVPKTSAQPVEGAVEERERKERRESRRLEKGRSQDYPDTPEKRDEGKAADEEKQRKEEDYQTRYRSDPNLARYPVKPPPEEQQMRMHARVSRARHERRHSDVALPRTEAGAALPEGKAGKRAPAAARASPPDSPRAYSAERTAETRAPGAKQLTNHSPPAPRHGPVPAEAPELKAQEPLRKQSRLDPSSAVLMRKAKREKVETMLRNDSLSSDQSESVRPSPPKPHRSKRGGKKRQMSVSSSEEEGVSTPEYTSCEDVELESESVSEKGDLDYYWLDPATWHSRETSPISSHPVTWQPSKEGDRLIGRVILNKRTTMPKDSGALLGLKVVGGKMTDLGRLGAFITKVKKGSLADVVGHLRAGDEVLEWNGKPLPGATNEEVYNIILESKSEPQVEIIVSRPIGDIPRIPESSHPPLESSSSSFESQKMERPSISVISPTSPGALKDAPQVLPGQLSVKLWYDKVGHQLIVNVLQATDLPARVDGRPRNPYVKMYFLPDRSDKSKRRTKTVKKILEPKWNQTFVYSHVHRRDFRERMLEITVWDQPRVQEEESEFLGEILIELETALLDDEPHWYKLQTHDESSLPLPQPSPFMPRRHIHGESSSKKLQRSQRISDSDISDYEVDDGIGVVPPVGYRSSARESKSTTLTVPEQQRTTHHRSRSVSPHRGNDQGKPRSRLPNVPLQRSLDEIHPTRRSRSPTRHHDASRSPVDHRTRDVDSQYLSEQDSELLMLPRAKRGRSAECLHTTRHLVRHYKTLPPKMPLLQSSSHWNIYSELQPFLDRARSASTNCLRPDTSLHSPERERMHRQRSPTQSPPADTSFSSRRGRQLPQVPVRSGSIEQASLVVEERTRQMKMKVHRFKQTTGSGSSQELDREQYSKYNIHKDQYRSCDNVSAKSSDSDVSDVSAISRTSSASRLSSTSFMSEQSERPRGRISSFTPKMQGRRMGTSGRSIMKSTSVSGEMYTLEHNDGSQSDTAVGTVGAGGKKRRSSLSAKVVAIVSRRSRSTSQLSQTESGHKKLKSTIQRSTETGMAAEMRKMVRQPSRESTDGSINSYSSEGNLIFPGVRLGADSQFSDFLDGLGPAQLVGRQTLATPAMGDIQIGMEDKKGQLEVEVIRARSLTQKPGSKSTPAPYVKVYLLENGACIAKKKTRIARKTLDPLYQQSLVFDESPQGKVLQVIVWGDYGRMDHKCFMGVAQILLEELDLSSMVIGWYKLFPPSSLVDPTLTPLTRRASQSSLESSTGPPCIRS

SEQ ID NO: 34876 - protein, 1038 aa, Homo sapiens
  ENSP00000430359
  MOD_RES (1)..(1): Any amino acid
XYSAERTAETRAPGAKQLTNHSPPAPRHGPVPAEAPELKAQEPLRKQSRLDPSSAVLMRKAKREKVETMLRNDSLSSDQSESVRPSPPKPHRSKRGGKKRQMSVSSSEEEGVSTPEYTSCEDVELESESVSEKGDLDYYWLDPATWHSRETSPISSHPVTWQPSKEGDRLIGRVILNKRTTMPKDSGALLGLKVVGGKMTDLGRLGAFITKVKKGSLADVVGHLRAGDEVLEWNGKPLPGATNEEVYNIILESKSEPQVEIIVSRPIGDIPRIPESSHPPLESSSSSFESQKMERPSISVISPTSPGALKDAPQVLPGQLSVKLWYDKVGHQLIVNVLQATDLPARVDGRPRNPYVKMYFLPDRSDKSKRRTKTVKKILEPKWNQTFVYSHVHRRDFRERMLEITVWDQPRVQEEESEFLGEILIELETALLDDEPHWYKLQTHDESSLPLPQPSPFMPRRHIHGESSSKKLQRSQRISDSDISDYEVDDGIGVVPPVGYRSSARESKSTTLTVPEQQRTTHHRSRSVSPHRGNDQGKPRSRLPNVPLQRSLDEIHPTRRSRSPTRHHDASRSPVDHRTRDVDSQYLSEQDRMHRQRSPTQSPPADTSFSSRRGRQLPQVPVRSGSIEQASLVVEERTRQMKMKVHRFKQTTGSGSSQELDREQYSKYNIHKDQYRSCDNVSAKSSDSDVSDVSAISRTSSASRLSSTSFMSEQSERPRGRISSFTPKMQGRRMGTSGRSIMKSTSVSGEMYTLEHNDGSQSDTAVGTVGAGGKKRRSSLSAKVVAIVSRRSRSTSQLSQTESGHKKLKSTIQRSTETGMAAEMRKMVRQPSRESTDGSINSYSSEGNLIFPGVRLGADSQFSDFLDGLGPAQLVGRQTLATPAMGDIQIGMEDKKGQLEVEVIRARSLTQKPGSKSTPAPYVKVYLLENGACIAKKKTRIARKTLDPLYQQSLVFDESPQGKVLQVIVWGDYGRMDHKCFMGVAQILLEELDLSSMVIGWYKLFPPSSLVDPTLTPLTRRASQSSLESSTGPPCIRS

SEQ ID NO: 34877 - protein, 1012 aa, Homo sapiens
  ENSP00000385649
MCAPGIHVSSEGWEEVRSVDSEEGTIEARRAVAGDLDYYWLDPATWHSRETSPISSHPVTWQPSKEGDRLIGRVILNKRTTMPKDSGALLGLKVVGGKMTDLGRLGAFITKVKKGSLADVVGHLRAGDEVLEWNGKPLPGATNEEVYNIILESKSEPQVEIIVSRPIGDIPRIPESSHPPLESSSSSFESQKMERPSISVISPTSPGALKDAPQVLPGQLSVKLWYDKVGHQLIVNVLQATDLPARVDGRPRNPYVKMYFLPDRSDKSKRRTKTVKKILEPKWNQTFVYSHVHRRDFRERMLEITVWDQPRVQEEESEFLGEILIELETALLDDEPHWYKLQTHDESSLPLPQPSPFMPRRHIHGESSSKKLQRSQRISDSDISDYEVDDGIGVVPPGYRSSARESKSTTLTVPEQQRTTHHRSRSVSPHRGNDQGKPRSRLPNVPLQRSLDEIHPTRRSRSPTRHHDASRSPVDHRTRDVDSQYLSEQDSELLMLPRAKRGRSAECLHTTSELQPFLDRARSASTNCLRPDTSLHSPERERHSRKSERSSIQKQTRKGTASDAERMHRQRSPTQSPPADTSFSSRRGRQLPQVPVRSGSIEQASLVVEERTRQMKMKVHRFKQTTGSGSSQELDREQYSKYNIHKDQYRSCDNVSAKSSDSDVSDVSAISRTSSASRLSSTSFMSEQSERPRGRISSFTPKMQGRRMGTSGRSIMKSTSVSGEMYTLEHNDGSQSDTAVGTVGAGGKKRRSSLSAKVVAIVSRRSRSTSQLSQTESGHKKLKSTIQRSTETGMAAEMRKMVRQPSRESTDGSINSYSSEGNLIFPGVRLGADSQFSDFLDGLGPAQLVGRQTLATPAMGDIQIGMEDKKGQLEVEVIRARSLTQKPGSKSTPAPYVKVYLLENGACIAKKKTRIARKTLDPLYQQSLVFDESPQGKVLQVIVWGDYGRMDHKCFMGVAQILLEELDLSSMVIGWYKLFPPSSLVDPTLTPLTRRASQSSLESSTGPPCIRS

SEQ ID NO: 34878 - protein, 817 aa, Homo sapiens
  ENSP00000428328
MCAPGIHVSSEGWEEVRSVDSEEGTIEARRAVAGDLDYYWLDPATWHSRETSPISSHPVTWQPSKEGDRLIGRVILNKRTTMPKDSGALLGLKVVGGKMTDLGRLGAFITKVKKGSLADVVGHLRAGDEVLEWNGKPLPGATNEEVYNIILESKSEPQVEIIVSRPIGDIPRIPESSHPPLESSSSSFESQKMERPSISVISPTSPGALKDAPQVLPGQLSVKLWYDKVGHQLIVNVLQATDLPARVDGRPRNPYVKMYFLPDRSDKSKRRTKTVKKILEPKWNQTFVYSHVHRRDFRERMLEITVWDQPRVQEEESEFLGEILIELETALLDDEPHWYKLQTHDESSLPLPQPSPFMPRRHIHGESSSKKLQRSQRISDSDISDYEVDDGIGVVPPVGYRSSARESKSTTLTVPEQQRTTHHRSRSVSPHRGNDQGKPRSRLPNVPLQRSLDEIHPTRRSRSPTRHHDASRSPVDHRTRDVDSQYLSEQDSELLMLPRAKRGRSAECLHTTSELQPFLDRARSASTNCLRPDTSLHSPERERMHRQRSPTQSPPADTSFSSRRGRQLPQVPVRSGSIEQESGHKKLKSTIQRSTETGMAAEMRKMVRQPSRESTDGSINSYSSEGNLIFPGVRLGADSQFSDFLDGLGPAQLVGRQTLATPAMGDIQIGMEDKKGQLEVEVIRARSLTQKPGSKSTPAPYVKVYLLENGACIAKKKTRIARKTLDPLYQQSLVFDESPQGKVLQVIVWGDYGRMDHKCFMGVAQILLEELDLSSMVIGWYKLFPPSSLVDPTLTPLTRRASQSSLESSTGPPCIRS

SEQ ID NO: 34879 - protein, 760 aa, Homo sapiens
  ENSP00000411235
MPKDSGALLGLKVVGGKMTDLGRLGAFITKVKKGSLADVVGHLRAGDEVLEWNGKPLPGATNEEVYNIILESKSEPQVEIIVSRPIGDIPRIPESSHPPLESSSSSFESQKMERPSISVISPTSPGALKDAPQVLPGQLSVKLWYDKVGHQLIVNVLQATDLPARVDGRPRNPYVKMYFLPDRSDKSKRRTKTVKKILEPKWNQTFVYSHVHRRDFRERMLEITVWDQPRVQEEESEFLGEILIELETALLDDEPHWYKLQTHDESSLPLPQPSPFMPRRHIHGESSSKKLQRSQRISDSDISDYEVDDGIGVVPPVGYRSSARESKSTTLTVPEQQRTTHHRSRSVSPHRGNDQGKPRSRLPNVPLQRSLDEIHPTRRSRSPTRHHDASRSPVDHRTRDVDSQYLSEQDSELLMLPRAKRGRSAECLHTTSELQPFLDRARSASTNCLRPDTSLHSPERERHSRKSERSSIQKQTRKGTASDAERMHRQRSPTQSPPADTSFSSRRGRQLPQVPVRSGSIEQESGHKKLKSTIQRSTETGMAAEMRKMVRQPSRESTDGSINSYSSEGNLIFPGVRLGADSQFSDFLDGLGPAQLVGRQTLATPAMGDIQIGMEDKKGQLEVEVIRARSLTQKPGSKSTPAPYVKVYLLENGACIAKKKTRIARKTLDPLYQQSLVFDESPQGKVLQVIVWGDYGRMDHKCFMGVAQILLEELDLSSMVIGWYKLFPPSSLVDPTLTPLTRRASQSSLESSTGPPCIRS

SEQ ID NO: 34880 - protein, 753 aa, Homo sapiens
  ENSP00000389503
MPKDSGALLGLKVVGGKMTDLGRLGAFITKVKKGSLADVVGHLRAGDEVLEWNGKPLPGATNEEVYNIILESKSEPQVEIIVSRPIGDIPRIPESSHPPLESSSSSFESQKMERPSISVISPTSPGALKDAPQVLPGQLSVKLWYDKVGHQLIVNVLQATDLPARVDGRPRNPYVKMYFLPDRSDKSKRRTKTVKKILEPKWNQTFVYSHVHRRDFRERMLEITVWDQPRVQEEESEFLGEILIELETALLDDEPHWYKLQTHDESSLPLPQPSPFMPRRHIHGESSSKKLQRSQRISDSDISDYEVDDGIGVVPPVGYRSSARESKSTTLTVPEQQRTTHHRSRSVSPHRGNDQGKPRSRLPNVPLQRSLDEIHPTRRSRSPTRHHDASRSPVDHRTRDVDSQYLSEQDRMHRQRSPTQSPPADTSFSSRRGRQLPQVPVRSGSIEQASLVVEERTRQMKMKVHRFKQTTGSGSSQELDREQYSKYNIHKDQYRSCDNVSAKSSDSDVSDVSAISRTSSASRLSSTSFMSEQSERPRGRISSFTPKMQGRRMGTSGRSIMKSTSVSGEMYTLEHNDGSQSDTAVGTVGAGGKKRRSSLSAKVVAIVSRRSRSTSQLSQTESGHKKLKSTIQRSTETGMAAEMRKMVRQPSRESTDGSINSYSSEGNLIFPGVRLGADSQFSDFLDGLGPAQLVGRQTLATPAMGDIQIGMEDKKGQLEVEVIRARSLTQKPGSKSTPAPYVKVYLLENGACI

SEQ ID NO: 34881 - protein, 826 aa, Homo sapiens
  ENSP00000428367
MFAGFLQFLLLHTLHSGTGDLDYYWLDPATWHSRETSPISSHPVTWQPSKEGDRLIGRVILNKRTTMPKDSGALLGLKVVGGKMTDLGRLGAFITKVKKGSLADVVGHLRAGDEVLEWNGKPLPGATNEEVYNIILESKSEPQVEIIVSRPIGDIPRIPESSHPPLESSSSSFESQKMERPSISVISPTSPGALKDAPQVLPGQLSVKLWYDKVGHQLIVNVLQATDLPARVDGRPRNPYVKMYFLPDRSDKSKRRTKTVKKILEPKWNQTFVYSHVHRRDFRERMLEITVWDQPRVQEEESEFLGEILIELETALLDDEPHWYKLQTHDESSLPLPQPSPFMPRRHIHGESSSKKLQRSQRISDSDISDYEVDDGIGVVPPVGYRSSARESKSTTLTVPEQQRTTHHRSRSVSPHRGNDQGKPRSRLPNVPLQRSLDEIHPTRRSRSPTRHHDASRSPVDHRTRDVDSQYLSEQDSELLMLPRAKRGRSAECLHTTSELQPFLDRARSASTNCLRPDTSLHSPERERHSRKSERSSIQKQTRKGTASDAERMHRQRSPTQSPPADTSFSSRRGRQLPQVPVRSGSIEQESGHKKLKSTIQRSTETGMAAEMRKMVRQPSRESTDGSINSYSSEGNLIFPGVRLGADSQFSDFLDGLGPAQLVGRQTLATPAMGDIQIGMEDKKGQLEVEVIRARSLTQKPGSKSTPAPYVKVYLLENGACIAKKKTRIARKTLDPLYQQSLVFDESPQGKVLQVIVWGDYGRMDHKCFMGVAQILLEELDLSSMVIGWYKLFPPSSLVDPTLTPLTRRASQSSLESSTGPPCIRS

SEQ ID NO: 34882 - protein, 740 aa, Homo sapiens
  ENSP00000359448
RPRNPYVKMYFLPDRSDKSKRRTKTVKKILEPKWNQTFVYSHVHRRDFRERMLEITVWDQPRVQEEESEFLGEILIELETALLDDEPHWYKLQTHDESSLPLPQPSPFMPRRHIHGESSSKKLQRSQRISDSDISDYEVDDGIGVVPPVGYRSSARESKSTTLTVPEQQRTTHHRSRSVSPHRGNDQGKPRSRLPNVPLQRSLDEIHPTRRSRSPTRHHDASRSPVDHRTRDVDSQYLSEQDSELLMLPRAKRGRSAECLHTTSELQPFLDRARSASTNCLRPDTSLHSPERERMHRQRSPTQSPPADTSFSSRRGRQLPQVPVRSGSIEQASLVVEERTRQMKMKVHRFKQTTGSGSSQELDREQYSKYNIHKDQYRSCDNVSAKSSDSDVSDVSAISRTSSASRLSSTSFMSEQSERPRGRISSFTPKMQGRRMGTSGRSIMKSTSVSGEMYTLEHNDGSQSDTAVGTVGAGGKKRRSSLSAKVVAIVSRRSRSTSQLSQTESGHKKLKSTIQRSTETGMAAEMRKMVRQPSRESTDGSINSYSSEGNLIFPGVRLGADSQFSDFLDGLGPAQLVGRQTLATPAMGDIQIGMEDKKGQLEVEVIRARSLTQKPGSKSTPAPYVKVYLLENGACIAKKKTRIARKTLDPLYQQSLVFDESPQGKVLQVIVWGDYGRMDHKCFMGVAQILLEELDLSSMVIGWYKLFPPSSLVDPTLTPLTRRASQSSLESSTGPPCIRS

SEQ ID NO: 34883 - protein, 610 aa, Homo sapiens
  ENSP00000429338
  MOD_RES (1)..(1): Any amino acid
XDYEVDDGIGVVPPVGYRSSARESKSTTLTVPEQQRTTHHRSRSVSPHRGNDQGKPRSRLPNVPLQRSLDEIHPTRRSRSPTRHHDASRSPVDHRTRDVDSQYLSEQDSELLMLPRAKRGRSAECLHTTRHSRKSERSSIQKQTRKGTASDAERMHRQRSPTQSPPADTSFSSRRGRQLPQVPVRSGSIEQEQEKYNSSTKASLVVEERTRQMKMKVHRFKQTTGSGSSQELDREQYSKYNIHKDQYRSCDNVSAKSSDSDVSDVSAISRTSSASRLSSTSFMSEQSERPRGRISSFTPKMQGRRMGTSGRSIMKSTSVSGEMYTLEHNDGSQSDTAVGTVGAGGKKRRSSLSAKVVAIVSRRSRSTSQLSQTESGHKKLKSTIQRSTETGMAAEMRKMVRQPSRESTDGSINSYSSEGNLIFPGVRLGADSQFSDFLDGLGPAQLVGRQTLATPAMGDIQIGMEDKKGQLEVEVIRARSLTQKPGSKSTPAPYVKVYLLENGACIAKKKTRIARKTLDPLYQQSLVFDESPQGKVLQVIVWGDYGRMDHKCFMGVAQILLEELDLSSMVIGWYKLFPPSSLVDPTLTPLTRRASQSSLESSTGPPCIRS

SEQ ID NO: 34884 - protein, 219 aa, Homo sapiens
  ENSP00000402273
MAAEMRKMVRQPSRESTDGSINSYSSEGNLIFPGVRLGADSQFSDFLDGLGPAQLVGRQTLATPAMGDIQIGMEDKKGQLEVEVIRARSLTQKPGSKSTPAPYVKVYLLENGACIAKKKTRIARKTLDPLYQQSLVFDESPQGKVLQVIVWGDYGRMDHKCFMGVAQILLEELDLSSMVIGWYKLFPPSSLVDPTLTPLTRRASQSSLESSTGPPCIRS

SEQ ID NO: 34885 - protein, 308 aa, Homo sapiens
  ENSP00000361769
MFNGEPGPASSGASRNVVRSSSISGEICGSQQAGGGAGTTTAKKRRSSLGAKMVAIVGLTQWSKSTLQLPQPEGATKKLRSNIRRSTETGIAVEMRSRVTRQGSRESTDGSTNSNSSDGTFIFPTTRLGAESQFSDFLDGLGPAQIVGRQTLATPPMGDVHIAIMDRSGQLEVEVIEARGLTPKPGSKSLPATYIKVYLLENGACLAKKKTKMTKKTCDPLYQQALLFDEGPQGKVLQVIVWGDYGRMDHKCFMGMAQIMLDELDLSAAVTGWYKLFPTSSVADSTLGSLTRRLSQSSLESATSPSCS

SEQ ID NO: 34886 - protein, 308 aa, Homo sapiens; identical to SEQ ID NO: 34885
  ENSP00000361768

SEQ ID NO: 34887 - protein, 269 aa, Homo sapiens
  ENSP00000361942
MERSQSRLSLSASFEALAIYFPCMNSFDDEDAGDSRRLKGAIQRSTETGLAVEMPSRTLRQASHESIEDSMNSYGSEGNLNYGGVCLASDAQFSDFLGSMGPAQFVGRQTLATTPMGDVEIGLQERNGQLEVDIIQARGLTAKPGSKTLPAAYIKAYLLENGICIAKKKTKVARKSLDPLYNQVLLFPESPQGKVLQVIVWGNYGRMERKQFMGVARVLLEELDLTTLAVGWYKLFPTSSMVDPATGPLLRQASQLSLESTVGPCGERS

SEQ ID NO: 34888 - protein, 270 aa, Homo sapiens
  ENSP00000439287
MERSQSRLSLSASFEALAIYFPCMNSFDDEDAEGDSRRLKGAIQRSTETGLAVEMPSRTLRQASHESIEDSMNSYGSEGNLNYGGVCLASDAQFSDFLGSMGPAQFVGRQTLATTPMGDVEIGLQERNGQLEVDIIQARGLTAKPGSKTLPAAYIKAYLLENGICIAKKKTKVARKSLDPLYNQVLLFPESPQGKVLQVIVWGNYGRMERKQFMGVARVLLEELDLTTLAVGWYKLFPTSSMVDPATGPLLRQASQLSLESTVGPCGERS

SEQ ID NO: 34889 - protein, 944 aa, Homo sapiens
  ENSP00000255006
MLDSFSQESTLPFREARKRTSFQPVQVWRNFTASQTTESPACSGASLGEMTAWTMGARGLDKRGSFFKLIDTIASEIGELKQEMVRTDVNLENGLEPAETHSMVRHKDGGYSEEEDVKTCARDSGYDSLSNRLSILDRLLHTHPIWLQLSLSEEEAAEVLQAQPPGIFLVHKSTKMQKKVLSLRLPCEFGAPLKEFAIKESTYTFSLEGSGISFADLFRLIAFYCISRDVLPFTLKLPYAISTAKSEAQLEELAQMGLNFWSSPADSKPPNLPPPHRPLSSDGVCPASLRQLCLINGVHSIKTRTPSELECSQTNGALCFINPLFLKVHSQDLSGGLKRPSTRTPNANGTERTRSPPPRPPPPAINSLHTSPRLARTETQTSMPETVNHNKHGNVALPGTKPTPIPPPRLKKQASFLEAEGGAKTLSGGRPGAGPELELGTAGSPGGAPPEAAPGDCTRAPPPSSESRPPCHGGRQRLSDMSISTSSSDSLEFDRSMPLFGYEADTNSSLEDYEGESDQETMAPPIKSKKKRSSSFVLPKLVKSQLQKVSGVFSSFMTPEKRMVRRIAELSRDKCTYFGCLVQDYVSFLQENKECHVSSTDMLQTIRQFMTQVKNYLSQSSELDPPIESLIPEDQIDVVLEKAMHKCILKPLKGHVEAMLKDFHMADGSWKQLKENLQLVRQRNPQELGVFAPTPDFVDVEKIKVKFMTMQKMYSPEKKVMLLLRVCKLIYTVMENNSGRMYGADDFLPVLTYVIAQCDMLELDTEIEYMMELLDPSLLHGEGGYYLTSAYGALSLIKNFQEEQAARLLSSETRDTLRQWHKRRTTNRTIPSVDDFQNYLRVAFQEVNSGCTGKTLLVRPYITTEDVCQICAEKFKVGDPEEYSLFLFVDETWQQLAEDTYPQKIKAELHSRPQPHIFHFVYKRIKNDPYGIIFQNGEEDLTTS

SEQ ID NO: 34890 - protein, 462 aa, Homo sapiens
  ENSP00000391239
MTAWTMGARGLDKRGSFFKLIDTIASEIGELKQEMVRTDVNLENGLEPAETHSMVRHKDGGYSEEEDVKTCARDSGYDSLSNRLSILDRLLHTHPIWLQLSLSEEEAAEVLQAQPPGIFLVHKSTKMQKKVLSLRLPCEFGAPLKEFAIKESTYNVVLEKAMHKCILKPLKGHVEAMLKDFHMADGSWKQLKENLQLVRQRNPQELGVFAPTPDFVDVEKIKVKFMTMQKMYSPEKKVMLLLRVCKLIYTVMENNSGRMYGADDFLPVLTYVIAQCDMLELDTEIEYMMELLDPSLLHGEGGYYLTSAYGALSLIKNFQEEQAARLLSSETRDTLRQWHKRRTTNRTIPSVDDFQNYLRVAFQEVNSGCTGKTLLVRPYITTEDVCQICAEKFKVGDPEEYSLFLFVDETWQQLAEDTYPQKIKAELHSRPQPHIFHFVYKRIKNDPYGIIFQNGEEDLTTS

SEQ ID NO: 34891 - protein, 217 aa, Homo sapiens
  ENSP00000321805
MEVENEASCSPGSASGGSREYKVVMLGAGGVGKSAMTMQFISHQFPDYHDPTIEDAYKTQVRIDNEPAYLDILDTAGQAEFTAMREQYMRGGEGFIICYSVTDRQSFQEAAKFKELIFQVRHTYEIPLVLVGNKIDLEQFRQVSTEEGLSLAQEYNCGFFETSAALRFCIDDAFHGLVREIRKKESMPSLMEKKLKRKDSLWKKLKGSLKKKRENMT

SEQ ID NO: 34892 - protein, 153 aa, Homo sapiens
  ENSP00000467217
MEVENEASCSPGSASGGSREYKVVMLGAGGVGKSAMTMQFISHQFPDYHDPTIEDAYKTQVRIDNEPAYLDILDTAGQAEFTAMREQYMRGGEGFIICYSVTDRQSFQEAAKFKELIFQVRHTYEIPLVLVGNKIDLEQFRQPTLKEFGREEF

SEQ ID NO: 34893 - protein, 169 aa, Homo sapiens
  ENSP00000466620
MEVENEASCSPGSASGGSREYKVVMLGAGGVGKSAMTMQFISHQFPDYHDPTIEDAYKTQVRIDNEPAYLDILDTAGQLCDWLKHRWEVELWEIRRTEKQNSQPCGSSTCEVGKASSSATPSLTVNHFRRLPSLKSSFFRSATPMKFPWCWWVTKLIWNSSARFLQKKA

SEQ ID NO: 34894 - protein, 317 aa, Homo sapiens
  ENSP00000268125
MSEGVGTFRMVPEEEQELRAQLEQLTTKDHGPVFGPCSQLPRHTLQKAKDELNEREETREEAVRELQEMVQAQAASGEELAVAVAERVQEKDSGFFLRFIRARKFNVGRAYELLRGYVNFRLQYPELFDSLSPEAVRCTIEAGYPGVLSSRDKYGRVVMLFNIENWQSQEITFDEILQAYCFILEKLLENEETQINGFCIIENFKGFTMQQAASLRTSDLRKMVDMLQDSFPARFKAIHFIHQPWYFTTTYNVVKPFLKSKLLERVFVHGDDLSGFYQEIDENILPSDFGGTLPKYDGKAVAEQLFGPQAQAENTAF

SEQ ID NO: 34895 - protein, 108 aa, Homo sapiens
  ENSP00000454740
  MOD_RES (1)..(1): Any amino acid
XNGFCIIENFKGFTMQQAASLRTSDLRKMVDMLQPWYFTTTYNVVKPFLKSKLLERVFVHGDDLSGFYQEIDENILPSDFGGTLPKYDGKAVAEQLFGPQAQAENTAF

SEQ ID NO: 34896 - protein, 71 aa, Homo sapiens
  ENSP00000457251
MSEGVGTFRMVPEEEQELRAQLEQLTTKDHGPVFGPCSQLPRHTLQKAKDELNEREETREEPVPRGCPLHH

SEQ ID NO: 34897 - protein, 1914 aa, Homo sapiens
  ENSP00000361857
MADGKGDAAAVAGAGAEAPAVAGAGDGVETESMVRGHRPVSPAPGASGLRPCLWQLETELREQEVSEVSSLNYCRSFCQTLLQYASNKNASEHIVYLLEVYRLAIQSFASARPYLTTECEDVLLVLGRLVLSCFELLLSVSESELPCEVWLPFLQSLQESHDALLEFGNNNLQILVHVTKEGVWKNPVLLKILSQQPVETEEVNKLIAQEGPSFLQMRIKHLLKSNCIPQATALSKLCAESKEISNVSSFQQAYITCLCSMLPNEDAIKEIAKVDCKEVLDIICNLESEGQDNTAFVLCTTYLTQQLQTASVYCSWELTLFWSKLQRRIDPSLDTFLERCRQFGVIAKTQQHLFCLIRVIQTEAQDAGLGVSILLCVRALQLRSSEDEEMKASVCKTIACLLPEDLEVRRACQLTEFLIEPSLDGFNMLEELYLQPDQKFDEENAPVPNSLRCELLLALKAHWPFDPEFWDWKTLKRHCHQLLGQEASDSDDDLSGYEMSINDTDVLESFLSDYDEGKEDKQYRRRDLTDQHKEKRDKKPIGSSERYQRWLQYKFFCLLCKRECIEARILHHSKMHMEDGIYTCPVCIKKFKRKEMFVPHVMEHVKMPPSRRDRSKKKLLLKGSQKGICPKSPSAIPEQNHSLNDQAKGESHEYVTFSKLEDCHLQDRDLYPCPGTDCSRVFKQFKYLSVHLKAEHQNNDENAKHYLDMKNRREKCTYCRRHFMSAFHLREHEQVHCGPQPYMCVSIDCYARFGSVNELLNHKQKHDDLRYKCELNGCNIVFSDLGQLYHHEAQHFRDASYTCNFLGCKKFYYSKIEYQNHLSMHNVENSNGDIKKSVKLEESATGEKQDCINQPHLLNQTDKSHLPEDLFCAESANSQIDTETAENLKENSDSNSSDQLSHSSSASMNEELIDTLDHSETMQDVLLSNEKVFGPSSLKEKCSSMAVCFDGTKFTCGFDGCGSTYKNARGMQKHLRKVHPYHFKPKKIKTKDLFPSLGNEHNQTTEKLDAEPKPCSDTNSDSPDEGLDHNIHIKCKREHQGYSSESSICASKRPCTEDTMLELLLRLKHLSLKNSITHGSFSGSLQGYPSSGAKSLQSVSSISDLNFQNQDENMPSQYLAQLAAKPFFCELQGCKYEFVTREALLMHYLKKHNYSKEKVLQLTMFQHRYSPFQCHICQRSFTRKTHLRIHYKNKHQIGSDRATHKLLDNEKCDHEGPCSVDRLKGDCSAELGGDPSSNSEKPHCHPKKDECSSETDLESSCEETESKTSDISSPIGSHREEQEGREGRGSRRTVAKGNLCYILNKYHKPFHCIHKTCNSSFTNLKGLIRHYRTVHQYNKEQLCLEKDKARTKRELVKCKKIFACKYKECNKRFLCSKALAKHCSDSHNLDHIEEPKVLSEAGSAARFSCNQPQCPAVFYTFNKLKHHLMEQHNIEGEIHSDYEIHCDLNGCGQIFTHRSNYSQHVYYRHKDYYDDLFRSQKVANERLLRSEKVCQTADTQGHEHQTTRRSFNAKSKKCGLIKEKKAPISFKTRAEALHMCVEHSEHTQYPCMVQGCLSVVKLESSIVRHYKRTHQMSSAYLEQQMENLVVCVKYGTKIKEEPPSEADPCIKKEENRSCESERTEHSHSPGDSSAPIQNTDCCHSSERDGGQKGCIESSSVFDADTLLYRGTLKCNHSSKTTSLEQCNIVQPPPPCKIENSIPNPNGTESGTYFTSFQLPLPRIKESETRQHSSGQENTVKNPTHVPKENFRKHSQPRSFDLKTYKPMGFESSFLKFIQESEEKEDDFDDWEPSEHLTLSNSSQSSNDLTGNVVANNMVNDSEPEVDIPHSSSDSTIHENLTAIPPLIVAETTTVPSLENLRVVLDKALTDCGELALKQLHYLRPVVVLERSKFSTPILDLFPTKKTDELCVGSS

SEQ ID NO: 34898 - protein, 123 aa, Homo sapiens
  ENSP00000464134
MPRPALSVTSFCHRLGKRERKQSFMGNSGNSWSHTPFPKLELGLGPQPMAPRELPTCSICLERLRDPISLDCGHDFCIRCFSTHRLPGCEPPCCPECRKICKQKRGLRSLGEKMKLLPQRPLP

SEQ ID NO: 34899 - protein, 631 aa, Homo sapiens
  ENSP00000454919
MPRPALSVTSFCHRLGKRERKQSFMGNSGNSWSHTPFPKLELGLGPQPMAPRELPTCSICLERLRDPISLDCGHDFCIRCFSTHRLPGCEPPCCPECRKICKQKRGLRSLGEKMKLLPQRPLPPALQETCPVRAEPLLLVRINASGGLILRMGAINRCLKHPLARDTPVCLLAVLGEQHSGKSFLLNHLLQGLPGLESGEGGRPRGGEASLQGCRWGANGLARGIWMWSHPFLLGKEGKKVAVFLVDTGDAMSPELSRETRIKLCALTTMLSSYQILSTSQELKDTDLDYLEMFVHVAEVMGKHYGMVPIQHLDLLVRDSSHPNKAGQGHVGNIFQRLSGRYPKVQELLQGKRARCCLLPAPGRRRMNQGHASPGDTDDDFRHLLGAYVSDVLSAAPQHAKSRCQGYWNEGRAVARGDRRLLTGQQLAQEIKNLSGWMGRTGPGFTSPDEMAAQLHDLRKVEAAKREFEEYVRQQDVATKRIFSALRVLPDTMRNLLSTQKDAILARHGVALLCKGRDQTLEALEAELQATAKAFMDSYTMRFCGHLAAVGGAVGAGLMGLAGGVVGAGMAAAALAAEAGMVAAGAAVGATGAAVVGGGVGAGLAATVGCMEKEEDERLLEGDREPLLQEE

SEQ ID NO: 34900 - protein, 155 aa, Homo sapiens
  ENSP00000256257
MHPFQWCNGCFCGLGLVSTNKSCSMPPISFQDLPLNIYMVIFGTGIFVFMLSLIFCCYFISKLRNQAQSERYGYKEVVLKGDAKKLQLYGQTCAVCLEDFKGKDELGVLPCQHAFHRKCLVKWLEVRCVCPMCNKPIASPSEATQNIGILLDELV

SEQ ID NO: 34901 - protein, 664 aa, Homo sapiens
  ENSP00000304051
MAAVGPPQQQVRMAHQQVWAALEVALRVPCLYIIDAIFNSYPDSSQSRFCIVLQIFLRLFGVFASSIVLILSQRSLFKFYTYSSAFLLAATSVLVNYYASLHIDFYGAYNTSAFGIELLPRKGPSLWMALIVLQLTFGIGYVTLLQIHSIYSQLIILDLLVPVIGLITELPLHIRETLLFTSSLILTLNTVFVLAVKLKWFYYSTRYVYLLVRHMYRIYGLQLLMEDTWKRIRFPDILRVFWLTRVTAQATVLMYILRMANETDSFFISWDDFWDLICNLIISGCDSTLTVLGMSAVISSVAHYLGLGILAFIGSTEEDDRRLGFVAPVLFFILALQTGLSGLRPEERLIRLSRNMCLLLTAVLHFIHGMTDPVLMSLSASHVSSFRRHFPVLFVSACLFILPVLLSYVLWHHYALNTWLFAVTAFCVELCLKVIVSLTVYTLFMIDGYYNVLWEKLDDYVYYVRSTGSIIEFIFGVVMFGNGAYTMMFESGSKIRAFMMCLHAYFNIYLQAKNGWKTFMNRRTAVKKINSLPEIKGSRLQEINDVCAICYHEFTTSARITPCNHYFHALCLRKWLYIQDTCPMCHQKVYIEDDIKDNSNVSNNNGFIPPNETPEEAVREAAAESDRELNEDDSTDCDDDVQRERNGVIQHTGAAAEEFNDDTD

SEQ ID NO: 34902 - protein, 68 aa, Homo sapiens
  ENSP00000429836
MALIVLQLTFGIGYVTLLQIHSIYSQLIILDLLVPVIGLITELPLHIRETLLFTSSLILTLNTVFVLA

SEQ ID NO: 34903 - protein, 203 aa, Homo sapiens
  ENSP00000316628
METLSQDSLLECQICFNYYSPRRRPKLLDCKHTCCSVCLQQMRTSQKDVRCPWCRGVTKLPPGFSVSQLPDDPEVLAVIAIPHTSEHTPVFIKLPSNGCYMLPLPISKERALLPGDMGCRLLPGSQQKSVTVVTIPAEQQPLQGGAPQEAVEEEQDRRGVVKSSTWSGVCTVILVACVLVFLLGIVLHNMSCISKRFTVISCG

SEQ ID NO: 34904 - protein, 114 aa, Homo sapiens
  ENSP00000466492
METLSQDSLLECQICFNYYSPRRRPKLLDCKHTCCSVCLQQMRTSQKDVRCPWCRGVTKLPPGFSVSQLPDDPEVLAVIAIPHTSEHTPVFIKLPSNGCYMLPLPISKERALLP

SEQ ID NO: 34905 - protein, 1623 aa, Homo sapiens
  ENSP00000255324
MAAEASKTGPSRSSYQRMGRKSQPWGAAEIQCTRCGRRVSRSSGHHCELQCGHAFCELCLLMTEECTTIICPDCEVATAVNTRQRYYPMAGYIKEDSIMEKLQPKTIKNCSQDFKKTADQLTTGLERSASTDKTLLNSSAVMLDTNTAEEIDEALNTAHHSFEQLSIAGKALEHMQKQTIEERERVIEVVEKQFDQLLAFFDSRKKNLCEEFARTTDDYLSNLIKAKSYIEEKKNNLNAAMNIARALQLSPSLRTYCDLNQIIRTLQLTSDSELAQVSSPQLRNPPRLSVNCSEIICMFNNMGKIEFRDSTKCYPQENEIRQNVQKKYNNKKELSCYDTYPPLEKKKVDMSVLTSEAPPPPLQPETNDVHLEAKNFQPQKDVATASPKTIAVLPQMGSSPDVIIEEIIEDNVESSAELVFVSHVIDPCHFYIRKYSQIKDAKVLEKKVNEFCNRSSHLDPSDILELGARIFVSSIKNGMWCRGTITELIPIEGRNTRKPCSPTRLFVHEVALIQIFMVDFGNSEVLIVTGVVDTHVRPEHSAKQHIALNDLCLVLRKSEPYTEGLLKDIQPLAQPCSLKDIVPQNSNEGWEEEAKVEFLKMVNNKAVSMKVFREEDGVLIVDLQKPPPNKISSDMPVSLRDALVFMELAKFKSQSLRSHFEKNTTLHYHPPILPKEMTDVSVTVCHINSPGDFYLQLIEGLDILFLLKTIEEFYKSEDGENLEILCPVQDQACVAKFEDGIWYRAKVIGLPGHQEVEVKYVDFGNTAKITIKDVRKIKDEFLNAPEKAIKCKLAYIEPYKRTMQWSKEAKEKFEEKAQDKFMTCSVIKILEDNVLLVELFDSLGAPEMTTTSINDQLVKEGLASYEIGYILKDNSQKHIEVWDPSPEEIISNEVHNLNPVSAKSLPNENFQSLYNKELPVHICNVISPEKIYVQWLLTENLLNSLEEKMIAAYENSKWEPVKWENDMHCAVKIQDKNQWRRGQIIRMVTDTLVEVLLYDVGVELVVNVDCLRKLEENLKTMGRLSLECSLVDIRPAGGSDKWTATACDCLSLYLTGAVATIILQVDSEENNTTWPLPVKIFCRDEKGERVDVSKYLIKKGLALRERRINNLDNSHSLSEKSLEVPLEQEDSVVTNCIKTNFDPDKKTADIISEQKVSEFQEKILEPRTTRGYKPPAIPNMNVFEATVSCVGDDGTIFVVPKLSEFELIKMTNEIQSNLKCLGLLEPYFWKKGEACAVRGSDTLWYRGKVMEVVGGAVRVQYLDHGFTEKIPQCHLYPILLYPDIPQFCIPCQLHNTTPVGNVWQPDAIEVLQQLLSKRQVDIHIMELPKNPWEKLSIHLYFDGMSLSYFMAYYKYCTSEHTEEMLKEKPRSDHDKKYEEEQWEIRFEELLSAETDTPLLPPYLSSSLPSPGELYAVQVKHVVSPNEVYICLDSIETSNQSNQHSDTDDSGVSGESESESLDEALQRVNKKVEALPPLTDFRTEMPCLAEYDDGLWYRAKIVAIKEFNPLSILVQFVDYGSTAKLTLNRLCQIPSHLMRYPARAIKVLLAGFKPPLRDLGETRIPYCPKWSMEALWAMIDCLQGKQLYAVSMAPAPEQIVTLYDDEQHPVHMPLVEMGLADKDE

SEQ ID NO: 34906 - protein, 653 aa, Homo sapiens
  ENSP00000255325
MAAEASKTGPSRSSYQRMGRKSQPWGAAEIQCTRCGRRVSRSSGHHCELQCGHAFCELCLLMTEECTTIICPDCEVATAVNTRQRYYPMAGYIKEDSIMEKLQPKTIKNCSQDFKKTADQLTTGLERSASTDKTLLNSSAVMLDTNTAEEIDEALNTAHHSFEQLSIAGKALEHMQKQTIEERERVIEVVEKQFDQLLAFFDSRKKNLCEEFARTTDDYLSNLIKAKSYIEEKKNNLNAAMNIARALQLSPSLRTYCDLNQIIRTLQLTSDSELAQVSSPQLRNPPRLSVNCSEIICMFNNMGKIEFRDSTKCYPQENEIRQNVQKKYNNKKELSCYDTYPPLEKKKVDMSVLTSEAPPPPLQPETNDVHLEAKNFQPQKDVATASPKTIAVLPQMGSSPDVIIEEIIEDNVESSAELVFVSHVIDPCHFYIRKYSQIKDAKVLEKKVNEFCNRSSHLDPSDILELGARIFVSSIKNGMWCRGTITELIPIEGRNTRKPCSPTRLFVHEVALIQIFMVDFGNSEVLIVTGVVDTHVRPEHSAKQHIALNDLCLVLRKSEPYTEGLLKDIQPLAQPCSLKDIVPQNSNEGWEEEAKVEFLKMVNNKAVSMKVFREEDGVLIVDLQKPPPNKISSDMPVSLRDALVFMELAKDLI

SEQ ID NO: 34907 - protein, 855 aa, Homo sapiens
  ENSP00000388892
MTDVSVTVCHINSPGDFYLQLIEGLDILFLLKTIEEFYKSEDGENLEILCPVQDQACVAKFEDGIWYRAKVIGLPGHQEVEVKYVDFGNTAKITIKDVRKIKDEFLNAPEKAIKCKLAYIEPYKRTMQWSKEAKEKFEEKAQDKFMTCSVIKILEDNVLLVELFDSLGAPEMTTTSINDQLVKEGLASYEIGYILKDNSQKHIEVWDPSPEEIISNEVHNLNPVSAKSLPNENFQSLYNKELPVHICNVISPEKIYVQWLLTENLLNSLEEKMIAAYENSKWEPVKWENDMHCAVKIQDKNQWRRGQIIRMVTDTLVEVLLYDVGVELVVNVDCLRKLEENLKTMGRLSLECSLVDIRPAGGSDKWTATACDCLSLYLTGAVATIILQVDSEENNTTWPLPVKIFCRDEKGERVDVSKYLIKKGLALRERRINNLDNSHSLSEKSLEVPLEQEDSVVTNCIKTNFDPDKKTADIISEQKVSEFQEKILEPRTTRGYKPPAIPNMNVFEATVSCVGDDGTIFVVPKLSEFELIKMTNEIQSNLKCLGLLEPYFWKKGEACAVRGSDTLWYRGKVMEVVGGAVRVQYLDHGFTEKIPQCHLYPILLYPDIPQFCIPCQLHNTTPVGNVWQPDAIEVLQQLLSKRQVDIHIMELPKNPWEKLSIHLYFDGMSLSYFMAYYKYCTSEHTEEMLKEKPRSDHDKKYEEEQWEIRFEELLSAETDTPLLPPYLSSSLPSPGELYAVQVKHVVSPNEVYICLDSIETSNQSNQHSDTDDSGVSGESESESLDEALQRVNKKVEALPPLTDFRTEMPCLAEYDDGLWYRAKIVAIKEFNPLSILVQFVDYGSTAKLTLNRLKI

SEQ ID NO: 34908 - protein, 633 aa, Homo sapiens
  ENSP00000344776
MIAAYENSKWEPVKWENDMHCAVKIQDKNQWRRGQIIRMVTDTLVEVLLYDVGVELVVNVDCLRKLEENLKTMGRLSLECSLVDIRPAGGSDKWTATACDCLSLYLTGAVATIILQVDSEENNTTWPLPVKIFCRDEKGERVDVSKYLIKKGLALRERRINNLDNSHSLSEKSLEVPLEQEDSVVTNCIKTNFDPDKKTADIISEQKVSEFQEKILEPRTTRGYKPPAIPNMNVFEATVSCVGDDGTIFVVPKLSEFELIKMTNEIQSNLKCLGLLEPYFWKKGEACAVRGSDTLWYRGKVMEVVGGAVRVQYLDHGFTEKIPQCHLYPILLYPDIPQFCIPCQLHNTTPVGNVWQPDAIEVLQQLLSKRQVDIHIMKPRSDHDKKYEEEQWEIRFEELLSAETDTPLLPPYLSSSLPSPGELYAVQVKHVVSPNEVYICLDSIETSNQSNQHSDTDDSGVSGESESESLDEALQRVNKKVEALPPLTDFRTEMPCLAEYDDGLWYRAKIVAIKEFNPLSILVQFVDYGSTAKLTLNRLCQIPSHLMRYPARAIKVLLAGFKPPLRDLGETRIPYCPKWSMEALWAMIDCLQGKQLYAVSMAPAPEQIVTLYDDEQHPVHMPLVEMGLADKDE

SEQ ID NO: 34909 - protein, 51 aa, Homo sapiens
  ENSP00000417500
MASQPPEDTAESQASDELECKICYNRYNLKQRKPKVLECCHRVCAKCLYKI

SEQ ID NO: 34910 - protein, 247 aa, Homo sapiens
  ENSP00000420465
MASQPPEDTAESQASDELECKICYNRYNLKQRKPKVLECCHRVCAKCLYKIIDFGDSPQGVIVCPFCRFETCLPDDEVSSLPDDNNILVNLTCGGKGKKCLPENPTELLLTPKRLASLVSPSHTSSNCLVITIMEVQRESSPSLSSTPVVEFYRPASFDSVTTVSHNWTVWNCTSLLFQTSIRVLVWLLGLLYFSSLPLGIYLLVSKKVTLGVVFVSLVPSSLVILMVYGFCQCVCHEFLDCMAPPS

SEQ ID NO: 34911 - protein, 162 aa, Homo sapiens
  ENSP00000419329
MASQPPEDTAESQASDELECKICYNRYNLKQRKPKVLECCHRVCAKCLYKIIDFGDSPQGVIVCPFCRFETCLPDDEVSSLPDDNNILVNLTCGGKGKKCLPENPTELLLTPKRLASLVSPSHTSSNCLVITIMEVQRESSPSLSSTPVVEFYRPASFDSVT

SEQ ID NO: 34912 - protein, 13 aa, Homo sapiens
  ENSP00000417514
MASQPPEDTAESQ

SEQ ID NO: 34913 - protein, 82 aa, Homo sapiens
  ENSP00000418717
MASQPPEDTAESQASDELECKICYNRYNLKQRKPKVLECCHRVCAKCLYKIIDFGDSPQGVIVCPFCRFETCLPDDEVSSLP

SEQ ID NO: 34914 - protein, 247 aa, Homo sapiens; identical to SEQ ID NO: 34910
  ENSP00000443228

SEQ ID NO: 34915 - protein, 247 aa, Homo sapiens; identical to SEQ ID NO: 34910
  ENSP00000442021

SEQ ID NO: 34916 - protein, 247 aa, Homo sapiens; identical to SEQ ID NO: 34910
  ENSP00000441271

SEQ ID NO: 34917 - protein, 634 aa, Homo sapiens
  ENSP00000367173
MSGAIFGPLEGPSSLDAPSIHPLVCPLCHVQYERPCLLDCFHDFCAGCLRGRATDGRLTCPLCQHQTVLKGPSGLPPVDRLLQFLVDSSGDGVEAVRCANCDLECSEQDVETTYFCNTCGQPLCARCRDETHRARMFARHDIVALGQRSRDVPQKCTLHAEPYLLFSTDKKLLLCIRCFRDMQKESRAHCVDLESAYVQGCERLEQAVLAVKALQTATREAIALLQAMVEEVRHSAAEEEDAIHALFGSMQDRLAERKALLLQAVQSQYEEKDKAFKEQLSHLATLLPTLQVHLVICSSFLSLANKAEFLDLGYELMERLQGIVTRPHHLRPIQSSKIASDHRAEFARCLEPLLLLGPRRVAAAASGANTLAGGLGPKALTGPHCPSPVGKMSGSPVQKPTLHRSISTKVLLAEGENTPFAEHCRHYEDSYRHLQAEMQSLKDQVQELHRDLTKHHSLIKAEIMGDVLHKSLQLDVQIASEHASLEGMRVVFQEIWEEAYQRVANEQEIYEAQLHDLLQLRQENAYLTTITKQITPYVRSIAKVKERLEPRFQAPVDEQSESLQNTHDDSRNNAASARNNPGSVPEKREKTSEPKGNSWAPNGLSEEPLLKNMDHHRSKQKNGGDVPTWREHPT

SEQ ID NO: 34918 - protein, 52 aa, Homo sapiens
  ENSP00000425843
MANWVFCNRCFQPPHRTSCFSLTNCGHVYCDACLGKDRRRYPGILHEHRQSV

SEQ ID NO: 34919 - protein, 232 aa, Homo sapiens
  ENSP00000372428
MANWVFCNRCFQPPHRTSCFSLTNCGHVYCDACLGKGKKNECLICKAPCRTVLLSKHTDADIQAFFMSIDSLCKKYSRETSQILEFQEKHRKRLLAFYREKISRLEESLRKSVLQIEQLQSMRSSQQTAFSTIKSSVSTKPHGCLLPPHSSAPDRLESMEVDLSPSPIRKSEIAAGPARISMISPPQDGRMAPCARRVCHFQRFTMFLHRRLSSLAAPPSVQFWKARGTHQL

SEQ ID NO: 34920 - protein, 297 aa, Homo sapiens
  ENSP00000389709
MANWVFCNRCFQPPHRTSCFSLTNCGHVYCDACLGKGKKNECLICKAPCRTVLLSKHTDADIQAFFMSIDSLCKKYSRETSQILEFQEKHRKRLLAFYREKISRLEESLRKSVLQIEQLQSMRSSQQTAFSTIKSSVSTKPHGCLLPPHSSAPDRLESMEVDLSPSPIRKSEIAAGPARISMISPPQDGRMGPHLTASFCFIPWLTLSKPPVPGECVISRGSPCFCIDVCPHWLLLLAFSSGRHGELTNSKTLPIYAEVQRAVLFPFQQAEGTLDTFRTPAVSVVFPLCQFERKKSF

SEQ ID NO: 34921 - protein, 123 aa, Homo sapiens
  ENSP00000426115
MANWVFCNRCFQPPHRTSCFSLTNCGHVYCDACLGKGKKNECLICKAPCRTVLLSKHTDADIQAFFMSIDSLCKKYSRETSQILEFQEKHRKRLLAFYREKISRLEESLRKSVLQIEQLQSLR

SEQ ID NO: 34922 - protein, 52 aa, Homo sapiens; identical to SEQ ID NO: 34918
  ENSP00000423030

SEQ ID NO: 34923 - protein, 115 aa, Homo sapiens
  ENSP00000423560
MANWVFCNRCFQPPHRTSCFSLTNCGHVYCDACLGKGKKNECLICKAPCRTVLLSKHRPFPVSDSESPTARLYSCVRRAPWIPHRGTRVRLRRRTLWTRLLCTRVDFLHSLRPLP

SEQ ID NO: 34924 - protein, 273 aa, Homo sapiens
  ENSP00000327481
MANWVFCNRCFQPPHRTSCFSLTNCGHVYCDACLGKGKKNECLICKAPCRTVLLSKHTDADIQAFFMSIDSLCKKYSRETSQYLRLSRGCCRLKLCPATSSKEVPRGSTHGSQAAARDPQEHWVSTTRAPRPGCRRSQSQPEAQGNTIQDAPHPLTLLHPSRTLIHTKSPWGQKLLEFIKHVCYHRHQSHRPCAPGWFCQVLQRPGAVSGEKTQQTRPAPPATCLLCLSCLSGFRHGPWRSQALPSDLVAPLFVSYTVEVSITNAGWSFPAAV

SEQ ID NO: 34925 - protein, 58 aa, Homo sapiens
  ENSP00000487588
HRDCVDPWLMLQQTCPLCKFNVLGEHQGWGPSAYSACSSPDASLPVLLPLPCREPLLR

SEQ ID NO: 34926 - protein, 30 aa, Homo sapiens
  ENSP00000485721
HRDCVDPWLMLQQTCPLCKFNVLGNRYSDD

SEQ ID NO: 34927 - protein, 30 aa, Homo sapiens; identical to SEQ ID NO: 34926
  ENSP00000486757

SEQ ID NO: 34928 - protein, 34 aa, Homo sapiens
  ENSP00000396278
DCVDPWLMLQQTCPLCKFNVLDGGSPMARKVDGL

SEQ ID NO: 34929 - protein, 377 aa, Homo sapiens
  ENSP00000371800
MGPAARPALRSPPPPPPPPPSPLLLLLPLLPLWLGLAGPGAAADGSEPAAGAGRGGARAVRVDVRLPRQDALVLEGVRIGSEADPAPLLGGRLLLMDIVDAEQEAPVEGWIAVAYVGKEQAAQFHQENKGSGPQAYPKALVQQMRRALFLGASALLLLILNHNVVRELDISQLLLRPVIVLHYSSNVTKLLDALLQRTQATAEITSGESLSANIEWKLTLWTTCGLSKDGYGGWQDLVCLGGSRAQEQKPLQQLWNAILLVAMLLCTGLVVQAQRQASRQSQRELGGQVDLFKRRVVRRLASLKTRRCRLSRAAQGLPDPGAETCAVCLDYFCNKQWLRVLPCKHEFHRDCVDPWLMLQQTCPLCKFNVLGNRYSDD

SEQ ID NO: 34930 - protein, 343 aa, Homo sapiens
  ENSP00000215798
  MOD_RES (1)..(1): Any amino acid
XVRLPRQDALVLEGVRIGSEADPAPLLGGRLLLMDIVDAEQEAPVEGWIAVAYVGKEQAAQFHQENKGSGPQAYPKALVQQMRRALFLGASALLLLILNHNVVRELDISQLLLRPVIVLHYSSNVTKLLDALLQRTQATAEITSGESLSANIEWKLTLWTTCGLSKDGYGGWQDLVCLGGSRAQEQKPLQQLWNAILLVAMLLCTGLVVQAQRQASRQSQRELGGQVDLFKRRVVRRLASLKTRRCRLSRAAQGLPDPGAETCAVCLDYFCNKQWLRVLPCKHEFHRDCVDPWLMLQQTCPLCKFNVLGEHQGWGPSAYSACSSPDASLPVLLPLPCREPLLR

SEQ ID NO: 34931 - protein, 99 aa, Homo sapiens
  ENSP00000404738
MDIVDAEQEAPVEGWIAVAYVGKEQAAQFHQENKGSGPQAYPKALVQQMRRALFLGASALLLLILNHNVVRELDISQLLLRPVIVLHYSSNVTKLLDAL

SEQ ID NO: 34932 - protein, 135 aa, Homo sapiens
  ENSP00000486180
MLPSGSRSPGELLPLLVQFPAMGNSYGAMTCLTRWLRRGQKGLDDVSRAANCTSSCQLCKRICPSALGVWRGWENPGHLISNPVPRWVPSTPMPWGPGQWAAGGCVLGTSPMVWFGDPFQEPRRGTHRSRARISM

SEQ ID NO: 34933 - protein, 542 aa, Homo sapiens
  ENSP00000428698
MGEEQSTVSGGGGPQESQTLASGTAGHPEPPRPQGDSARAPPLRAASAEPSGGGCGSDWGCADTSAPEPARSLGPPGWSKSRAPAQPAGLALTGPLNPQTLPLQLELEEEEEEAGDRKEGGDEQQEAPPGEELEPRTRVGAADGLVLDVLGQRRPSLAKRQVFCSVYCVESDLPEAPASEQLSPPASPPGAPPVLNPPSTRSSFPSPRLSLPTDSLSPDGGSIELEFYLAPEPFSMPSLLGAPPYSGLGGVGDPYVPLMVLMCRVCLEDKPIKPLPCCKKAVCEECLKVYLSAQVQLGQVEIKCPITECFEFLEETTVVYNLTHEDSIKYKYFLELGRIDSSTKPCPQCKHFTTFKKKGHIPTPSRSESKYKIQCPTCQFVWCFKCHSPWHEGVNCKEYKKGDKLLRHWASEIEHGQRNAQKCPKCKIHIQRTEGCDHMTCSQCNTNFCYRCGERYRQLRFFGDHTSNLSIFGCKYRYLPERPHLRRLVRGSVCAGKLFIAPLIMVLGLALGAIAVVIGLFVFPIYCLCKKQRKRSRTGMHW

SEQ ID NO: 34934 - protein, 78 aa, Homo sapiens
  ENSP00000429012
  MOD_RES (1)..(1): Any amino acid
XVPLMVLMCRVCLEDKPIKPLPCCKKAVCEECLKVYLSAQAGVQWHDLGSRKPPHPRFKRFSCLSLPSSWDYRYNLAK

SEQ ID NO: 34935 - protein, 2 aa, Homo sapiens
  ENSP00000427711
MK

SEQ ID NO: 34936 - protein, 104 aa, Homo sapiens
  ENSP00000357399
MTCSQCNTNFCYRCGERYRQLRFFGDHTSNLSIFGCKYRYLPERPHLRRLVRGSVCAGKLFIAPLIMVLGLALGAIAVVIGLFVFPIYCLCKKQRKRSRTGMHW

SEQ ID NO: 34937 - protein, 275 aa, Homo sapiens
  ENSP00000352734
MKVQLGQVEIKCPITECFEFLEETTVVYNLTHEDSIKYKYFLELGRIDSSTKPCPQCKHFTTFKKKGHIPTPSRSESKYKIQCPTCQFVWCFKCHSPWHEGVNCKEYKKGDKLLRHWASEIEHGQRNAQKCPKCKIHIQRTEGCDHMTCSQCNTNFCYRCGERYRQLRFFGDHTSNLSIFGCKYRYLPERPHLRRLVRGSVCAGKLFIAPLIMVLGLALGAIAVVIVEEIKTYWNLISGRTRNQTQHLAPQPVLLSDMLYCLKQVFICISYLLPL

SEQ ID NO: 34938 - protein, 65 aa, Homo sapiens
  ENSP00000404282
  MOD_RES (1)..(1): Any amino acid
XDSIKYKYFLELGRIDSSTKPCPQCKHFTTFKKKGHIPTPSRSESKYKQNGRMKWFQRLFGVISI

SEQ ID NO: 34939 - protein, 306 aa, Homo sapiens
  ENSP00000452812
MCRVCLEDKPIKPLPCCKKAVCEECLKVYLSAQVQLGQVEIKCPITECFEFLEETTVVYNLTHEDSIKYKYFLELGRIDSSTKPCPQCKHFTTFKKKGHIPTPSRSESKYKIQCPTCQFVWCFKCHSPWHEGVNCKEYKKGDKLLRHWASEIEHGQRNAQKCPKCKIHIQRTEGCDHMTCSQCNTNFCYRCGERYRQLRFFGDHTSNLSIFGCKYRYLPERPHLRRLVRGSVCAGKLFIAPLIMVLGLALGAIAVVIVEEIKTYWNLISGRTRNQTQHLAPQPVLLSDMLYCLKQVFICISYLLPL

SEQ ID NO: 34940 - protein, 566 aa, Homo sapiens
  ENSP00000347548
MDLHRAAFKMENSSYLPNPLASPALMVLASTAEASRDASIPCQQPRPFGVPVSVDKDVHIPFTNGSYTFASMYHRQGGVPGTFANRDFPPSLLHLHPQFAPPNLDCTPISMLNHSGVGAFRPFASTEDRESYQSAFTPAKRLKNCHDTESPHLRFSDADGKEYDFGTQLPSSSPGSLKVDDTGKKIFAVSGLISDREASSSPEDRNDRCKKKAAALFDSQAPICPICQVLLRPSELQEHMEQELEQLAQLPSSKNSLLKDAMAPGTPKSLLLSASIKREGESPTASPHSSATDDLHHSDRYQTFLRVRANRQTRLNARIGKMKRRKQDEGQREGSCMAEDDAVDIEHENNNRFEEYEWCGQKRIRATTLLEGGFRGSGFIMCSGKENPDSDADLDVDGDDTLEYGKPQYTEADVIPCTGEEPGEAKEREALRGAVLNGGPPSTRITPEFSKWASDEMPSTSNGESSKQEAMQKTCKNSDIEKITEDSAVTTFEALKARVRELERQLSRGDRYKCLICMDSYSMPLTSIQCWHVHCEECWLRTLGAKKLCPQCNTITAPGDLRRIYL

SEQ ID NO: 34941 - protein, 566 aa, Homo sapiens; identical to SEQ ID NO: 34940
  ENSP00000354872

SEQ ID NO: 34942 - protein, 121 aa, Homo sapiens
  ENSP00000411541
  MOD_RES (1)..(1): Any amino acid
XEGESPTASPHSSATDDLHHSDRYQTFLRVRANRQTRLNARIGKMKRRKQDEGQVCPLCNRPLAGSEQEMSRHVEHCLSKREGSCMAEDDAVDIEHENNNRFEEYEWCGQKRIRATTLLEG

SEQ ID NO: 34943 - protein, 260 aa, Homo sapiens
  ENSP00000335580
MPRARSGRRSRGAGGREETFLRVRANRQTRLNARIGKMKRRKQDEGQVCPLCNRPLAGSEQEMSRHVEHCLSKREGSCMAEDDAVDIEHENNNRFEEYEWCGQKRIRATTLLEGGFRGSGFIMCSGKENPDSDADLDVDGDDTLEYGKPQYTEADVIPCTGEEPGEAKEREALRGAVLNGGPPSTRITPEFSKWASDEMPSTSNGESSKQEAMQKTCKNSDIEKITEDSAVTTFEALKARVRELERQLSRGDRYKCLICM

SEQ ID NO: 34944 - protein, 259 aa, Homo sapiens
  ENSP00000388533
MPRARSGRRSRGAGGREETFLRVRANRQTRLNARIGKMKRRKQDEGQREGSCMAEDDAVDIEHENNNRFEEYEWCGQKRIRATTLLEGGFRGSGFIMCSGKENPDSDADLDVDGDDTLEYGKPQYTEADVIPCTGEEPGEAKEREALRGAVLNGGPPSTRITPEFSKWASDEMPSTSNGESSKQEAMQKTCKNSDIEKITEDSAVTTFEALKARVRELERQLSRGDRYKCLICMDSYSMPLTSIQCWHVHCEECWLRTL

SEQ ID NO: 34945 - protein, 45 aa, Homo sapiens
  ENSP00000475383
MPRARSGRRSRGAGGREEVDLSASTSQPADPTECSDWENETEEAR

SEQ ID NO: 34946 - protein, 566 aa, Homo sapiens; identical to SEQ ID NO: 34940
  ENSP00000361321

SEQ ID NO: 34947 - protein, 354 aa, Homo sapiens
  ENSP00000391822
MWWRDLTRLRLWLKREAIPGEGRKAAKVNAGVGEKGIYTASSRGGPPSARSKAVTVVAEGAASRSWLSMDAPELGPGLVERLEQLATCPLCGGSFEDPVLLACEHSFCRACLARRWGTPPATGTEASPTACPCCGLPCPRRSLRSNVRLAVEVRISRELREKLAEPGARAGRRRGGRIPTMGCLDLPGEDMRKTWRRFEVPTSKSSNSEDDLPEDYPVVKKMLHRLTADLTLDPGTAHRRLLISADRRSVQLAPPGTPAPPDGPKRFDQLPAVLGAQGFGAGRHCWEVETADAASCRDSSGEDADDEESHYAVGAAGESVQRKGCAPGPLGERIFPLFCTCDPRAPLRIVPAES

SEQ ID NO: 34948 - protein, 420 aa, Homo sapiens
  ENSP00000398512
MWWRDLTRLRLWLKREAIPGEGRKAAKVNAGVGEKGIYTASSRGGPPSARSKAVTVVAEGAASRSWLSMDAPELGPGLVERLEQLATCPLCGGSFEDPVLLACEHSFCRACLARRWGTPPATGTEASPTACPCCGLPCPRRSLRSNVRLAVEVRISRELREKLAEPGARAGRRRGGRIPTMGCLDLPGEDMRKTWRRFEVPTSKSSNSEDDLPEDYPVVKKMLHRLTADLTLDPGTAHRRLLISADRRSVQLAPPGTPAPPDGPKRFDQLPAVLGAQGFGAGRHCWEVETADAASCRDSSGEDADDEESHYAVGAAGESVQRKGCVRLCPAGAVWAVEGRGGRLWALTAPEPTLLGGVEPPPRRIRVDLDWERGRVAFYDGRSLDLLYAFQAPGPLGERIFPLFCTCDPRAPLRIVPAES

SEQ ID NO: 34949 - protein, 420 aa, Homo sapiens; identical to SEQ ID NO: 34948
  ENSP00000393560

SEQ ID NO: 34950 - protein, 354 aa, Homo sapiens; identical to SEQ ID NO: 34947
  ENSP00000401131

SEQ ID NO: 34951 - protein, 354 aa, Homo sapiens; identical to SEQ ID NO: 34947
  ENSP00000392508

SEQ ID NO: 34952 - protein, 420 aa, Homo sapiens; identical to SEQ ID NO: 34948
  ENSP00000407291

SEQ ID NO: 34953 - protein, 354 aa, Homo sapiens
  ENSP00000407248
MWWRDLTRLRLWLKREAIPGEGRKAAKVNAGVGEKGIYTASSRGGPPSARSKAVTVVAEGAASRSWLSMDAPELGPGLVERLEQLATCPLCGGSFEDPVLLACEHSFCRACLARRWGTPPATGTEASPTACPCCGLPCPRRSLRSNVRLAVEVRISRELREKLAEPGARAGRRRGGRIPTMGCLDLPGEDMRKTWRRFEVPTSKSSNSEDDLPEDYPVVKKMLHRLTADLTLDPGTAHRRLLISADRRSVQLAPPGTPAPPDGPKRFNQLPAVLGAQGFGAGRHCWEVETADAASCRDSSGEDADDEESHYAVGAAGESVQRKGCAPGPLGERIFPLFCTCDPRAPLRIVPAES

SEQ ID NO: 34954 - protein, 420 aa, Homo sapiens
  ENSP00000408539
MWWRDLTRLRLWLKREAIPGEGRKAAKVNAGVGEKGIYTASSRGGPPSARSKAVTVVAEGAASRSWLSMDAPELGPGLVERLEQLATCPLCGGSFEDPVLLACEHSFCRACLARRWGTPPATGTEASPTACPCCGLPCPRRSLRSNVRLAVEVRISRELREKLAEPGARAGRRRGGRIPTMGCLDLPGEDMRKTWRRFEVPTSKSSNSEDDLPEDYPVVKKMLHRLTADLTLDPGTAHRRLLISADRRSVQLAPPGTPAPPDGPKRFNQLPAVLGAQGFGAGRHCWEVETADAASCRDSSGEDADDEESHYAVGAAGESVQRKGCVRLCPAGAVWAVEGRGGRLWALTAPEPTLLGGVEPPPRRIRVDLDWERGRVAFYDGRSLDLLYAFQAPGPLGERIFPLFCTCDPRAPLRIVPAES

SEQ ID NO: 34955 - protein, 354 aa, Homo sapiens
  ENSP00000365941
MWWRDLTRLRLWLKREAIPGEGRKAAKVNAGVGEKGIYTASSRGGPPSARSKAVTVVAEGAASRSWLSMDAPELGPGLVERLEQLATCPLCGGSFEDPVLLACEHSFCRACLARRWGTPPATGTEASPTACPCCGLPCPRRSLRSNVRLAVEVRISRELREKLAEPGARAGRRRGGRIPTMGCLDLPGEDMRKTWRRFEVPTPKSSNSEDDLPEDYPVVKKMLHRLTADLTLDPGTAHRRLLISTDRRSVQLAPPGTPAPPDGPKRFDQLPAVLGAQGFGAGRHCWEVETADAASCRDSSGEDEDDEESHYAVGAAGESVQRKGCAPGPLGERIFPLFCTCDPRAPLRIVPAES

SEQ ID NO: 34956 - protein, 420 aa, Homo sapiens
  ENSP00000373106
MWWRDLTRLRLWLKREAIPGEGRKAAKVNAGVGEKGIYTASSRGGPPSARSKAVTVVAEGAASRSWLSMDAPELGPGLVERLEQLATCPLCGGSFEDPVLLACEHSFCRACLARRWGTPPATGTEASPTACPCCGLPCPRRSLRSNVRLAVEVRISRELREKLAEPGARAGRRRGGRIPTMGCLDLPGEDMRKTWRRFEVPTPKSSNSEDDLPEDYPVVKKMLHRLTADLTLDPGTAHRRLLISTDRRSVQLAPPGTPAPPDGPKRFDQLPAVLGAQGFGAGRHCWEVETADAASCRDSSGEDEDDEESHYAVGAAGESVQRKGCVRLCPAGAVWAVEGRGGRLWALTAPEPTLLGGVEPPPRRIRVDLDWERGRVAFYDGRSLDLLYAFQAPGPLGERIFPLFCTCDPRAPLRIVPAES

SEQ ID NO: 34957 - protein, 354 aa, Homo sapiens; identical to SEQ ID NO: 34947
  ENSP00000365942

SEQ ID NO: 34958 - protein, 420 aa, Homo sapiens; identical to SEQ ID NO: 34948
  ENSP00000244360

SEQ ID NO: 34959 - protein, 420 aa, Homo sapiens; identical to SEQ ID NO: 34948
  ENSP00000395696

SEQ ID NO: 34960 - protein, 354 aa, Homo sapiens; identical to SEQ ID NO: 34947
  ENSP00000415281

SEQ ID NO: 34961 - protein, 354 aa, Homo sapiens; identical to SEQ ID NO: 34947
  ENSP00000405340

SEQ ID NO: 34962 - protein, 420 aa, Homo sapiens
  ENSP00000387930
MWWRDLTRLRLWLKREAIPGEGRKAAKVNAGVGEKGIYTASSRGGPPSARSKAVTVVAEGAASRSWLSMDAPELGPGLVERLEQLATCPLCGGSFEDPVLLACEHSFCRACLARRWGTPPATGTEASPTACPCCGLPCPRRSLRSNVRLAVEVRISRELREKLAEPGARAGRRRGGRIPTMGCLDLPGEDMRKTWRRFEVPTSKSSNSEDDLPEDYPVVKKMLHRLTADLTLDPGTAHRRLLISADRRSVQLAPPGTPAPPDGPKRFDQLPAVLGAQGFGAGRHCWEVETADAASCRDSSGEDADDEESHYAVGAAGESVQRKGCVRLCPAGAVWAVGGRGGRLWALTAPEPTLLGGVEPPPRRIRVDLDWERGRVAFYDGRSLDLLYAFQAPGPLGERIFPLFCTCDPRAPLRIVPAES

SEQ ID NO: 34963 - protein, 783 aa, Homo sapiens
  ENSP00000385328
MSGGHQLQLAALWPWLLMATLQAGFGRTGLVLAAAVESERSAEQKAIIRVIPLKMDPTGKLNLTLEGVFAGVAEITPAEGKLMQSHPLYLCNASDDDNLEPGFISIVKLESPRRAPRPCLSLASKARMAGERGASAVLFDITEDRAAAEQLQQPLGLTWPVVLIWGNDAEKLMEFVYKNQKAHVRIELKEPPAWPDYDVWILMTVVGTIFVIILASVLRIRCRPRHSRPDPLQQRTAWAISQLATRRYQASCRQARGEWPDSGSSCSSAPVCAICLEEFSEGQELRVISCLHEFHRNCVDPWLHQHRTCPLCMFNITEGDSFSQSLGPSRSYQEPGRRLHLIRQHPGHAHYHLPAAYLLGPSRSAVARPPRPGPFLPSQEPGMGPRHHRFPRAAHPRAPGEQQRLAGAQHPYAQGWGLSHLQSTSQHPAACPVPLRRARPPDSSGSGESYCTERSGYLADGPASDSSSGPCHGSSSDSVVNCTDISLQGVHGSSSTFCSSLSSDFDPLVYCSPKGDPQRVDMQPSVTSRPRSLDSVVPTGETQVSSHVHYHRHRHHHYKKRFQWHGRKPGPETGVPQSRPPIPRTQPQPEPPSPDQQVTRSNSAAPSGRLSNPQCPRALPEPAPGPVDASSICPSTSSLFNLQKSSLSARHPQRKRRGGPSEPTPGSRPQDATVHPACQIFPHYTPSVAYPWSPEAHPLICGPPGLDKRLLPETPGPCYSNSQPVWLCLTPRQPLEPHPPGEGPSEWSSDTAEGRPCPYPHCQVLSAQPGSEEELEELCEQAV

SEQ ID NO: 34964 - protein, 742 aa, Homo sapiens
  ENSP00000462502
MSGGHQLQLAALWPWLLMATLQAGFGRTGLVLAAAVESERSAEQKAIIRVIPLKMDPTGKLNLTLEGVFAGVAEITPAEGKLMQARMAGERGASAVLFDITEDRAAAEQLQQPLGLTWPVVLIWGNDAEKLMEFVYKNQKAHVRIELKEPPAWPDYDVWILMTVVGTIFVIILASVLRIRCRPRHSRPDPLQQRTAWAISQLATRRYQASCRQARGEWPDSGSSCSSAPVCAICLEEFSEGQELRVISCLHEFHRNCVDPWLHQHRTCPLCMFNITEGDSFSQSLGPSRSYQEPGRRLHLIRQHPGHAHYHLPAAYLLGPSRSAVARPPRPGPFLPSQEPGMGPRHHRFPRAAHPRAPGEQQRLAGAQHPYAQGWGLSHLQSTSQHPAACPVPLRRARPPDSSGSGESYCTERSGYLADGPASDSSSGPCHGSSSDSVVNCTDISLQGVHGSSSTFCSSLSSDFDPLVYCSPKGDPQRVDMQPSVTSRPRSLDSVVPTGETQVSSHVHYHRHRHHHYKKRFQWHGRKPGPETGVPQSRPPIPRTQPQPEPPSPDQQVTRSNSAAPSGRLSNPQCPRALPEPAPGPVDASSICPSTSSLFNLQKSSLSARHPQRKRRGGPSEPTPGSRPQDATVHPACQIFPHYTPSVAYPWSPEAHPLICGPPGLDKRLLPETPGPCYSNSQPVWLCLTPRQPLEPHPPGEGPSEWSSDTAEGRPCPYPHCQVLSAQPGSEEELEELCEQAV

SEQ ID NO: 34965 - protein, 783 aa, Homo sapiens; identical to SEQ ID NO: 34963
  ENSP00000463069

SEQ ID NO: 34966 - protein, 783 aa, Homo sapiens; identical to SEQ ID NO: 34963
  ENSP00000462764

SEQ ID NO: 34967 - protein, 656 aa, Homo sapiens
  ENSP00000463716
MAGERGASAVLFDITEDRAAAEQLQQPLGLTWPVVLIWGNDAEKLMEFVYKNQKAHVRIELKEPPAWPDYDVWILMTVVGTIFVIILASVLRIRCRPRHSRPDPLQQRTAWAISQLATRRYQASCRQARGEWPDSGSSCSSAPVCAICLEEFSEGQELRVISCLHEFHRNCVDPWLHQHRTCPLCMFNITEGDSFSQSLGPSRSYQEPGRRLHLIRQHPGHAHYHLPAAYLLGPSRSAVARPPRPGPFLPSQEPGMGPRHHRFPRAAHPRAPGEQQRLAGAQHPYAQGWGLSHLQSTSQHPAACPVPLRRARPPDSSGSGESYCTERSGYLADGPASDSSSGPCHGSSSDSVVNCTDISLQGVHGSSSTFCSSLSSDFDPLVYCSPKGDPQRVDMQPSVTSRPRSLDSVVPTGETQVSSHVHYHRHRHHHYKKRFQWHGRKPGPETGVPQSRPPIPRTQPQPEPPSPDQQVTRSNSAAPSGRLSNPQCPRALPEPAPGPVDASSICPSTSSLFNLQKSSLSARHPQRKRRGGPSEPTPGSRPQDATVHPACQIFPHYTPSVAYPWSPEAHPLICGPPGLDKRLLPETPGPCYSNSQPVWLCLTPRQPLEPHPPGEGPSEWSSDTAEGRPCPYPHCQVLSAQPGSEEELEELCEQAV

SEQ ID NO: 34968 - protein, 742 aa, Homo sapiens
  ENSP00000462447
MAGERGASAVLFDITEDRAAAEQLQQPLGLTWPVVLIWGNDAEKLMEFVYKNQKAHVRIELKEPPAWPDYDVWILMTVVGTIFVIILASVLRIRCRPRHSRPDPLQQRTAWAISQLATRRYQASCRQARGEWPDSGSSCSSAPVCAICLEEFSEGQELRVISCLHEFHRNCVDPWLHQHRTCPLCMFNITEGDSFSQSLGPSRSYQEPGRRLHLIRQHPGHAHYHLPAAYLLGPSRSAVARPPRPGPFLPSQEPGMGPRHHRFPRAAHPRAPGEQQRLAGAQHPYAQGWGLSHLQSTSQHPAACPVPLRRARPPDSSGSGESYCTERSGYLADGPASDSSSGPCHGSSSDSVVNCTDISLQGVHGSSSTFCSSLSSDFDPLVYCSPKGDPQRVDMQPSVTSRPRSLDSVVPTGETQVSSHVHYHRHRHHHYKKRFQWHGRKPGPETGVPQSRPPIPRTQPQPEPPSPDQQVTRSNSAAPSGRLSNPQCPRALPEPAPGPVDASSICPSTSSLFNLQKSSLSARHPQRKRRGGPSEPTPGSRPQDATVHPACQIFPHYTPSVAYPWSPEAHPLICGPPGLDKRLLPETPGPCYSNSQPVWLCLTPRQPLEPHPPGEGPSEWSSDTAEGRPCPYPHCQVLSAQPGEFSEGSGCGRERRLQLNISGQVKSANKGLMEAEKDTAEMTTKILNHRDSVSCWLECRNTPPLPGATPLVGRSQGGPREVLVWLRHQKGTWKAGCDGSCL

SEQ ID NO: 34969 - protein, 1394 aa, Homo sapiens
  ENSP00000417335
MARRHERVTRRMWTWAPGLLMMTVVFWGHQGNGQGQGSRLRQEDFPPRIVEHPSDVIVSKGEPTTLNCKAEGRPTPTIEWYKDGERVETDKDDPRSHRMLLPSGSLFFLRIVHGRRSKPDEGSYVCVARNYLGEAVSRNASLEVALLRDDFRQNPTDVVVAAGEPAILECQPPRGHPEPTIYWKKDKVRIDDKEERISIRGGKLMISNTRKSDAGMYTCVGTNMVGERDSDPAELTVFERPTFLRRPINQVVLEEEAVEFRCQVQGDPQPTVRWKKDDADLPRGRYDIKDDYTLRIKKTMSTDEGTYMCIAENRVGKMEASATLTVRAPPQFVVRPRDQIVAQGRTVTFPCETKGNPQPAVFWQKEGSQNLLFPNQPQQPNSRCSVSPTGDLTITNIQRSDAGYYICQALTVAGSILAKAQLEVTDVLTDRPPPIILQGPANQTLAVDGTALLKCKATGDPLPVISWLKEGFTFPGRDPRATIQEQGTLQIKNLRISDTGTYTCVATSSSGETSWSAVLDVTESGATISKNYDLSDLPGPPSKPQVTDVTKNSVTLSWQPGTPGTLPASAYIIEAFSQSVSNSWQTVANHVKTTLYTVRGLRPNTIYLFMVRAINPQGLSDPSPMSDPVRTQDISPPAQGVDHRQVQKELGDVLVRLHNPVVLTPTTVQVTWTVDRQPQFIQGYRVMYRQTSGLQATSSWQNLDAKVPTERSAVLVNLKKGVTYEIKVRPYFNEFQGMDSESKTVRTTEEAPSAPPQSVTVLTVGSYNSTSISVSWDPPPPDHQNGIIQEYKIWCLGNETRFHINKTVDAAIRSVIIGGLFPGIQYRVEVAASTSAGVGVKSEPQPIIIGRRNEVVITENNNSITEQITDVVKQPAFIAGIGGACWVILMGFSIWLYWRRKKRKGLSNYAVTFQRGDGGLMSNGSRPGLLNAGDPSYPWLADSWPATSLPVNNSNSGPNEIGNFGRGDVLPPVPGQGDKTATMLSDGAIYSSIDFTTKTSYNSSSQITQATPYATTQILHSNSIHELAVDLPDPQWKSSIQQKTDLMGFGYSLPDQNKGNNGGKGGKKKKNKNSSKPQKNNGSTWANVPLPPPPVQPLPGTELEHYAVEQQENGYDSDSWCPPLPVQTYLHQGLEDELEEDDDRVPTPPVRGVASSPAISFGQQSTATLTPSPREEMQPMLQAHLDELTRAYQFDIAKQTWHIQSNNQPPQPPVPPLGYVSGALISDLETDVADDDADDEEEALEIPRPLRALDQTPGSSMDNLDSSVTGKAFTSSQRPRPTSPFSTDSNTSAALSQSQRPRPTKKHKGGRMDQQPALPHRREGMTDEEALVPYSKPSFPSPGGHSSSGTASSKGSTGPRKTEVLRAGHQRNASDLLDIGYMGSNSQGQFTGEL

SEQ ID NO: 34970 - protein, 1070 aa, Homo sapiens
  ENSP00000473268
MARRHERVTRRMWTWAPGLLMMTVVFWGHQGNGQGQGSRLRQEDFPPRIVEHPSDVIVSKGEPTTLNCKAEGRPTPTIEWYKDGERVETDKDDPRSHRMLLPSGSLFFLRIVHGRRSKPDEGSYVCVARNYLGEAVSRNASLEVALLRDDFRQNPTDVVVAAGEPAILECQPPRGHPEPTIYWKKDKVRIDDKEERISIRGGKLMISNTRKSDAGMYTCVGTNMVGERDSDPAELTVFERPTFLRRPINQVVLEEEAVEFRCQVQGDPQPTVRWKKDDADLPRGRYDIKDDYTLRIKKTMSTDEGTYMCIAENRVGKMEASATLTVRARPVAPPQFVVRPRDQIVAQGRTVTFPCETKGNPQPAVFWQKEGSQNLLFPNQPQQPNSRCSVSPTGDLTITNIQRSDAGYYICQALTVAGSILAKAQLEVTDVLTDRPPPIILQGPANQTLAVDGTALLKCKATGDPLPVISWLKEGFTFPGRDPRATIQEQGTLQIKNLRISDTGTYTCVATSSSGETSWSAVLDVTESGATISKNYDLSDLPGPPSKPQVTDVTKNSVTLSWQPGTPGTLPASAYIIEAFSQSVSNSWQTVANHVKTTLYTVRGLRPNTIYLFMVRAINPQGLSDPSPMSDPVRTQDISPPAQGVDHRQVQKELGDVLVRLHNPVVLTPTTVQVTWTVDRQPQFIQGYRVMYRQTSGLQATSSWQNLDAKVPTERSAVLVNLKKGVTYEIKVRPYFNEFQGMDSESKTVRTTEEAPSAPPQSVTVLTVGSYNSTSISVSWDPPPPDHQNGIIQEYKIWCLGNETRFHINKTVDAAIRSVIIGGLFPGIQYRVEVAASTSAGVGVKSEPQPIIIGRRNEVVITENNNSITEQITDVVKQPAFIAGIGGACWVILMGFSIWLYWRRKKRKGLSNYAVTFQRGDGGLMSNGSRPGLLNAGDPSYPWLADSWPATSLPVNNSNSGPNEIGNFGRGDVLPPVPGQGDKTATMLSDGAIYSSIDFTTKTSYNSSSQITQATPYATTQILHSNSIHELAVDLPDPQWKSSIQQKTDLMGFGYSLPDQNKGNNGGKGG

SEQ ID NO: 34971 - protein, 1378 aa, Homo sapiens
  ENSP00000417164
MSLLMFTQLLLCGFLYVRVDGSRLRQEDFPPRIVEHPSDVIVSKGEPTTLNCKAEGRPTPTIEWYKDGERVETDKDDPRSHRMLLPSGSLFFLRIVHGRRSKPDEGSYVCVARNYLGEAVSRNASLEVALLRDDFRQNPTDVVVAAGEPAILECQPPRGHPEPTIYWKKDKVRIDDKEERISIRGGKLMISNTRKSDAGMYTCVGTNMVGERDSDPAELTVFERPTFLRRPINQVVLEEEAVEFRCQVQGDPQPTVRWKKDDADLPRGRYDIKDDYTLRIKKTMSTDEGTYMCIAENRVGKMEASATLTVRAPPQFVVRPRDQIVAQGRTVTFPCETKGNPQPAVFWQKEGSQNLLFPNQPQQPNSRCSVSPTGDLTITNIQRSDAGYYICQALTVAGSILAKAQLEVTDVLTDRPPPIILQGPANQTLAVDGTALLKCKATGDPLPVISWLKEGFTFPGRDPRATIQEQGTLQIKNLRISDTGTYTCVATSSSGETSWSAVLDVTESGATISKNYDLSDLPGPPSKPQVTDVTKNSVTLSWQPGTPGTLPASAYIIEAFSQSVSNSWQTVANHVKTTLYTVRGLRPNTIYLFMVRAINPQGLSDPSPMSDPVRTQDISPPAQGVDHRQVQKELGDVLVRLHNPVVLTPTTVQVTWTVDRQPQFIQGYRVMYRQTSGLQATSSWQNLDAKVPTERSAVLVNLKKGVTYEIKVRPYFNEFQGMDSESKTVRTTEEAPSAPPQSVTVLTVGSYNSTSISVSWDPPPPDHQNGIIQEYKIWCLGNETRFHINKTVDAAIRSVIIGGLFPGIQYRVEVAASTSAGVGVKSEPQPIIIGRRNEVVITENNNSITEQITDVVKQPAFIAGIGGACWVILMGFSIWLYWRRKKRKGLSNYAVTFQRGDGGLMSNGSRPGLLNAGDPSYPWLADSWPATSLPVNNSNSGPNEIGNFGRGDVLPPVPGQGDKTATMLSDGAIYSSIDFTTKTSYNSSSQITQATPYATTQILHSNSIHELAVDLPDPQWKSSIQQKTDLMGFGYSLPDQNKGNNGGKGGKKKKNKNSSKPQKNNGSTWANVPLPPPPVQPLPGTELEHYAVEQQENGYDSDSWCPPLPVQTYLHQGLEDELEEDDDRVPTPPVRGVASSPAISFGQQSTATLTPSPREEMQPMLQAHLDELTRAYQFDIAKQTWHIQSNNQPPQPPVPPLGYVSGALISDLETDVADDDADDEEEALEIPRPLRALDQTPGSSMDNLDSSVTGKAFTSSQRPRPTSPFSTDSNTSAALSQSQRPRPTKKHKGGRMDQQPALPHRREGMTDEEALVPYSKPSFPSPGGHSSSGTASSKGSTGPRKTEVLRAGHQRNASDLLDIGYMGSNSQGQFTGEL

SEQ ID NO: 34972 - protein, 1439 aa, Homo sapiens
  ENSP00000327536
MSLLMFTQLLLCGFLYVRVDGSRLRQEDFPPRIVEHPSDVIVSKGEPTTLNCKAEGRPTPTIEWYKDGERVETDKDDPRSHRMLLPSGSLFFLRIVHGRRSKPDEGSYVCVARNYLGEAVSRNASLEVALLRDDFRQNPTDVVVAAGEPAILECQPPRGHPEPTIYWKKDKVRIDDKEERISIRGGKLMISNTRKSDAGMYTCVGTNMVGERDSDPAELTVFERPTFLRRPINQVVLEEEAVEFRCQVQGDPQPTVRWKKDDADLPRGRYDIKDDYTLRIKKTMSTDEGTYMCIAENRVGKMEASATLTVRAPPQFVVRPRDQIVAQGRTVTFPCETKGNPQPAVFWQKEGSQNLLFPNQPQQPNSRCSVSPTGDLTITNIQRSDAGYYICQALTVAGSILAKAQLEVTDVLTDRPPPIILQGPANQTLAVDGTALLKCKATGDPLPVISWLKEGFTFPGRDPRATIQEQGTLQIKNLRISDTGTYTCVATSSSGETSWSAVLDVTESGATISKNYDLSDLPGPPSKPQVTDVTKNSVTLSWQPGTPGTLPASAYIIEAFSQSVSNSWQTVANHVKTTLYTVRGLRPNTIYLFMVRAINPQGLSDPSPMSDPVRTQDISPPAQGVDHRQVQKELGDVLVRLHNPVVLTPTTVQVTWTVDRQPQFIQGYRVMYRQTSGLQATSSWQNLDAKVPTERSAVLVNLKKGVTYEIKVRPYFNEFQGMDSESKTVRTTEEAPSAPPQSVTVLTVGSYNSTSISVSWDPPPPDHQNGIIQEYKIWCLGNETRFHINKTVDAAIRSVIIGGLFPGIQYRVEVAASTSAGVGVKSEPQPIIIGRRNEVVITENNNSITEQITDVVKQPAFIAGIGGACWVILMGFSIWLYWRRKKRKGLSNYAVTFQRGDGGLMSNGSRPGLLNAGDPSYPWLADSWPATSLPVNNSNSGPNEIGNFGRGDVLPPVPGQGDKTATMLSDGAIYSSIDFTTKTSYNSSSQITQATPYATTQILHSNSIHELAVDLPDPQWKSSIQQKTDLMGFGYSLPDQNKGNNGGKGGKKKKNKNSSKPQKNNGSTWANVPLPPPPVQPLPGTELEHYAVEQQENGYDSDSWCPPLPVQTYLHQGLEDELEEDDDRVPTPPVRGVASSPAISFGQQSTATLTPSPREEMQPMLQAHLDELTRAYQFDIAKQTWHIQSNNQPPQPPVPPLGYVSGALISDLETDVADDDADDEEEALEIPRPLRALDQTPGSSMDNLDSSVTGSMVNGWGSASDEDRNFSSHRSSVGSSSDGSIFASGSFAQALVAAADKAGFRLDGTSLTRTGKAFTSSQRPRPTSPFSTDSNTSAALSQSQRPRPTKKHKGGRMDQQPALPHRREGMTDEEALVPYSKPSFPSPGGHSSSGTASSKGSTGPRKTEVLRAGHQRNASDLLDIGYMGSNSQGQFTGEL

SEQ ID NO: 34973 - protein, 564 aa, Homo sapiens
  ENSP00000418117
MSLLMFTQLLLCGFLYVRVDGSRLRQEDFPPRIVEHPSDVIVSKGEPTTLNCKAEGRPTPTIEWYKDGERVETDKDDPRSHRMLLPSGSLFFLRIVHGRRSKPDEGSYVCVARNYLGEAVSRNASLEVALLRDDFRQNPTDVVVAAGEPAILECQPPRGHPEPTIYWKKDKVRIDDKEERISIRGGKLMISNTRKSDAGMYTCVGTNMVGERDSDPAELTVFERPTFLRRPINQVVLEEEAVEFRCQVQGDPQPTVRWKKDDADLPRGRYDIKDDYTLRIKKTMSTDEGTYMCIAENRVGKMEASATLTVRAPPQFVVRPRDQIVAQGRTVTFPCETKGNPQPAVFWQKEGSQNLLFPNQPQQPNSRCSVSPTGDLTITNIQRSDAGYYICQALTVAGSILAKAQLEVTDVLTDRPPPIILQGPANQTLAVDGTALLKCKATGDPLPVISWLKEGFTFPGRDPRATIQEQGTLQIKNLRISDTGTYTCVATSSSGETSWSAVLDVTESGATISKNYDLSDLPGPPSKPQVTDVTKNSVTLSWQPGTPGTLPASAYIIEAFRYVV

SEQ ID NO: 34974 - protein, 342 aa, Homo sapiens
  ENSP00000418344
  MOD_RES (1)..(1): Any amino acid
XNNSITEQITDVVKQPAFIAGIGGACWVILMGFSIWLYWRRKKRKGLSNYAVTFQRGDGGLMSNGSRPGLLNAGDPSYPWLADSWPATSLPVNNSNSGPNEIGNFGRGDVLPPVPGQGDKTATMLSDGAIYSSIDFTTKTSYNSSSQITQATPYATTQILHSNSIHELAVDLPDPQWKSSIQQKTDLMGFGYSLPDQNKGNNGGKGGKKKKNKNSSKPQKNNGSTWANVPLPPPPVQPLPGTELEHYAVEQQENGYDSDSWCPPLPVQTYLHQGLEDELEEDDDRVPTPPVRGVASSPAISFGQQSTATLTPSPREEMQPMLQAHLDELTRAYQFDIAKQTW

SEQ ID NO: 34975 - protein, 214 aa, Homo sapiens
  ENSP00000418190
  MOD_RES (1)..(1): Any amino acid
XSWPATSLPVNNSNSGPNEIGNFGRGDVLPPVPGQGDKTATMLSDGAIYSSIDFTTKTSYNSSSQITQATPYATTQILHSNSIHELAVDLPDPQWKSSIQQKTDLMGFGYSLPDQNKGNNALLYIPDYRLAEGLSNRMPHNQSQDFSTTSSHNSSERSGSLSGGKGGKKKKNKNSSKPQKNNGSTWANVPLPPPPVQPLPGTELEHYAVEQQEN

SEQ ID NO: 34976 - protein, 208 aa, Homo sapiens
  ENSP00000418446
  MOD_RES (1)..(1): Any amino acid
XDELTRAYQFDIAKQTWHIQSNNQPPQPPVPPLGYVSGALISDLETDVADDDADDEEEALEIPRPLRALDQTPGSSMDNLDSSVTGKAFTSSQRPRPTSPFSTDSNTSAALSQSQRPRPTKKHKGGRMDQQPALPHRREGMTDEEALVPYSKPSFPSPGGHSSSGTASSKGSTGPRKTEVLRAGHQRNASDLLDIGYMGSNSQGQFTE

SEQ ID NO: 34977 - protein, 198 aa, Homo sapiens
  ENSP00000417471
  MOD_RES (1)..(1): Any amino acid
XSNTSAALSQSQRPRPTKKHKGGRMDQQPALPHRREGMTDDLPPPPDPPPGQGLRQQIGPSQQAGNVENSAERKGSSLERQHASSLEDTKSSLDCPARTSLEWQRQTQEWISSTERQEDIRKAPHKQGVGSEEALVPYSKPSFPSPGGHSSSGTASSKGSTGPRKTEVLRAGHQRNASDLLDIGYMGSNSQGQFTGEL

SEQ ID NO: 34978 - protein, 1250 aa, Homo sapiens [sequence omitted]

SEQ ID NO: 34979 - protein, 1386 aa, Homo sapiens
  ENSP00000380903
MLRYLLKTLLQMNLFADSLAGDISNSSELLLGFNSSLAALNHTLLPPGDPSLNGSRVGPEDAMPRIVEQPPDLLVSRGEPATLPCRAEGRPRPNIEWYKNGARVATVREDPRAHRLLLPSGALFFPRIVHGRRARPDEGVYTCVARNYLGAAASRNASLEVAVLRDDFRQSPGNVVVAVGEPAVLECVPPRGHPEPSVSWRKDGARLKEEEGRITIRGGKLMMSHTLKSDAGMYVCVASNMAGERESAAAEVMVLERPSFLRRPVNQVVLADAPVTFLCEVKGDPPPRLRWRKEDGELPTGRYEIRSDHSLWIGHVSAEDEGTYTCVAENSVGRAEASGSLSVHVPPQLVTQPQDQMAAPGESVAFQCETKGNPPPAIFWQKEGSQVLLFPSQSLQPTGRFSVSPRGQLNITAVQRGDAGYYVCQAVSVAGSILAKALLEIKGASLDGLPPVILQGPANQTLVLGSSVWLPCRVTGNPQPSVRWKKDGQWLQGDDLQFKTMANGTLYIANVQEMDMGFYSCVAKSSTGEATWSGWLKMREDWGVSPDPPTEPSSPPGAPSQPVVTEITKNSITLTWKPNPQTGAAVTSYVIEAFSPAAGNTWRTVADGVQLETHTVSGLQPNTIYLFLVRAVGAWGLSEPSPVSEPVRTQDSSPSRPVEDPWRGQQGLAEVAVRLQEPIVLGPRTLQVSWTVDGPVQLVQGFRVSWRVAGPEGGSWTMLDLQSPSQQSTVLRGLPPGTQIQIKVQAQGQEGLGAESLSVTRSIPEEAPSGPPQGVAVALGGDGNSSITVSWEPPLPSQQNGVITEYQIWCLGNESRFHLNRSAAGWARSAMLRGLVPGLLYRTLVAAATSAGVGVPSAPVLVQLPSPPDLEPGLEVGAGLAVRLARVLREPAFLAGSGAACGALLLGLCAALYWRRKQRKELSHYTASFAYTPAVSFPHSEGLSGASSRPPMGLGPAPYSWLADSWPHPSRSPSAQEPRGSCCPSNPDPDDRYYNEAGISLYLAQTARGTAAPGEGPVYSTIDPAGEELQTFHGGFPQHPSGDLGPWSQYAPPEWSQGDSGAKGGKVKLLGKPVQMPSLNWPEALPPPPPSCELSCLEGPEEELEGSSEPEEWCPPMPERSHLTEPSSSGGCLVTPSRRETPSPTPSYGQQSTATLTPSPPDPPQPPTDMPHLHQMPRRVPLGPSSPLSVSQPMLGIREARPAGLGAGPAASPHLSPSPAPSTASSAPGRTWQGNGEMTPPLQGPRARFRKKPKALPYRRENSPGDLPPPPLPPPEEEASWALELRAAGSMSSLERERSGERKAVQAVPLAAQRVLHPDEEAWLPYSRPSFLSRGQGTSTCSTAGSNSSRGSSSSRGSRGPGRSRSRSQSRSQSQRPGQKRREEPR

SEQ ID NO: 34980 - protein, 1364 aa, Homo sapiens
  ENSP00000441797
MERPEDSLSLWSLNLSPQFPCLNALRHPLSPGSRVGPEDAMPRIVEQPPDLLVSRGEPATLPCRAEGRPRPNIEWYKNGARVATVREDPRAHRLLLPSGALFFPRIVHGRRARPDEGVYTCVARNYLGAAASRNASLEVAVLRDDFRQSPGNVVVAVGEPAVLECVPPRGHPEPSVSWRKDGARLKEEEGRITIRGGKLMMSHTLKSDAGMYVCVASNMAGERESAAAEVMVLERPSFLRRPVNQVVLADAPVTFLCEVKGDPPPRLRWRKEDGELPTGRYEIRSDHSLWIGHVSAEDEGTYTCVAENSVGRAEASGSLSVHVPPQLVTQPQDQMAAPGESVAFQCETKGNPPPAIFWQKEGSQVLLFPSQSLQPTGRFSVSPRGQLNITAVQRGDAGYYVCQAVSVAGSILAKALLEIKGASLDGLPPVILQGPANQTLVLGSSVWLPCRVTGNPQPSVRWKKDGQWLQGDDLQFKTMANGTLYIANVQEMDMGFYSCVAKSSTGEATWSGWLKMREDWGVSPDPPTEPSSPPGAPSQPVVTEITKNSITLTWKPNPQTGAAVTSYVIEAFSPAAGNTWRTVADGVQLETHTVSGLQPNTIYLFLVRAVGAWGLSEPSPVSEPVRTQDSSPSRPVEDPWRGQQGLAEVAVRLQEPIVLGPRTLQVSWTVDGPVQLVQGFRVSWRVAGPEGGSWTMLDLQSPSQQSTVLRGLPPGTQIQIKVQAQGQEGLGAESLSVTRSIPEEAPSGPPQGVAVALGGDGNSSITVSWEPPLPSQQNGVITEYQIWCLGNESRFHLNRSAAGWARSAMLRGLVPGLLYRTLVAAATSAGVGVPSAPVLVQLPSPPDLEPGLEVGAGLAVRLARVLREPAFLAGSGAACGALLLGLCAALYWRRKQRKELSHYTASFAYTPAVSFPHSEGLSGASSRPPMGLGPAPYSWLADSWPHPSRSPSAQEPRGSCCPSNPDPDDRYYNEAGISLYLAQTARGTAAPGEGPVYSTIDPAGEELQTFHGGFPQHPSGDLGPWSQYAPPEWSQGDSGAKGGKVKLLGKPVQMPSLNWPEALPPPPPSCELSCLEGPEEELEGSSEPEEWCPPMPERSHLTEPSSSGGCLVTPSRRETPSPTPSYGQQSTATLTPSPPDPPQPPTDMPHLHQMPRRVPLGPSSPLSVSQPMLGIREARPAGLGAGPAASPHLSPSPAPSTASSAPGRTWQGNGEMTPPLQGPRARFRKKPKALPYRRENSPGDLPPPPLPPPEEEASWALELRAAGSMSSLERERSGERKAVQAVPLAAQRVLHPDEEAWLPYSRPSFLSRGQGTSTCSTAGSNSSRGSSSSRGSRGPGRSRSRSQSRSQSQRPGQKRREEPR

SEQ ID NO: 34981 - protein, 149 aa, Homo sapiens
  ENSP00000438799
MTPPLQGPRARFRKKPKALPYRRENSPGDLPPPPLPPPEEEASWALELRAAGSMSSLERERSGERKAVQAVPLAAQRVLHPDEEAWLPYSRPSFLSRGQGTSTCSTAGSNSSRGSSSSRGSRGPGRSRSRSQSRSQSQRPGQKRREEPR

SEQ ID NO: 34982 - protein, 523 aa, Homo sapiens
  ENSP00000335087
MESAPAAPDPAASEPGSSGADAAAGSRETPLNQESARKSEPPAPVRRQSYSSTSRGISVTKKTHTSQIEIIPCKICGDKSSGIHYGVITCEGCKGFFRRSQQSNATYSCPRQKNCLIDRTSRNRCQHCRLQKCLAVGMSRDAVKFGRMSKKQRDSLYAEVQKHRMQQQQRDHQQQPGEAEPLTPTYNISANGLTELHDDLSNYIDGHTPEGSKADSAVSSFYLDIQPSPDQSGLDINGIKPEPICDYTPASGFFPYCSFTNGETSPTVSMAELEHLAQNISKSHLETCQYLREELQQITWQTFLQEEIENYQNKQREVMWQLCAIKITEAIQYVVEFAKRIDGFMELCQNDQIVLLKAGSLEVVFIRMCRAFDSQNNTVYFDGKYASPDVFKSLGCEDFISFVFEFGKSLCSMHLTEDEIALFSAFVLMSADRSWLQEKVKIEKLQQKIQLALQHVLQKNHREDGILTKLICKVSTLRALCGRHTEKLMAFKAIYPDIVRLHFPPLYKELFTSEFEPAMQIDG

SEQ ID NO: 34983 - protein, 548 aa, Homo sapiens
  ENSP00000309753
MNEGAPGDSDLETEARVPWSIMGHCLRTGQARMSATPTPAGEGARSSSTCSSLSRLFWSQLEHINWDGATAKNFINLREFFSFLLPALRKAQIEIIPCKICGDKSSGIHYGVITCEGCKGFFRRSQQSNATYSCPRQKNCLIDRTSRNRCQHCRLQKCLAVGMSRDAVKFGRMSKKQRDSLYAEVQKHRMQQQQRDHQQQPGEAEPLTPTYNISANGLTELHDDLSNYIDGHTPEGSKADSAVSSFYLDIQPSPDQSGLDINGIKPEPICDYTPASGFFPYCSFTNGETSPTVSMAELEHLAQNISKSHLETCQYLREELQQITWQTFLQEEIENYQNKQREVMWQLCAIKITEAIQYVVEFAKRIDGFMELCQNDQIVLLKAGSLEVVFIRMCRAFDSQNNTVYFDGKYASPDVFKSLGCEDFISFVFEFGKSLCSMHLTEDEIALFSAFVLMSADRSWLQEKVKIEKLQQKIQLALQHVLQKNHREDGILTKLICKVSTLRALCGRHTEKLMAFKAIYPDIVRLHFPPLYKELFTSEFEPAMQIDG

SEQ ID NO: 34984 - protein, 556 aa, Homo sapiens
  ENSP00000261523
MNEGAPGDSDLETEARVPWSIMGHCLRTGQARMSATPTPAGEGARRDELFGILQILHQCILSSGDAFVLTGVCCSWRQNGKPPYSQKEDKEVQTGYMNAQIEIIPCKICGDKSSGIHYGVITCEGCKGFFRRSQQSNATYSCPRQKNCLIDRTSRNRCQHCRLQKCLAVGMSRDAVKFGRMSKKQRDSLYAEVQKHRMQQQQRDHQQQPGEAEPLTPTYNISANGLTELHDDLSNYIDGHTPEGSKADSAVSSFYLDIQPSPDQSGLDINGIKPEPICDYTPASGFFPYCSFTNGETSPTVSMAELEHLAQNISKSHLETCQYLREELQQITWQTFLQEEIENYQNKQREVMWQLCAIKITEAIQYVVEFAKRIDGFMELCQNDQIVLLKAGSLEVVFIRMCRAFDSQNNTVYFDGKYASPDVFKSLGCEDFISFVFEFGKSLCSMHLTEDEIALFSAFVLMSADRSWLQEKVKIEKLQQKIQLALQHVLQKNHREDGILTKLICKVSTLRALCGRHTEKLMAFKAIYPDIVRLHFPPLYKELFTSEFEPAMQIDG

SEQ ID NO: 34985 - protein, 468 aa, Homo sapiens
  ENSP00000402971
MMYFVIAAMKAQIEIIPCKICGDKSSGIHYGVITCEGCKGFFRRSQQSNATYSCPRQKNCLIDRTSRNRCQHCRLQKCLAVGMSRDAVKFGRMSKKQRDSLYAEVQKHRMQQQQRDHQQQPGEAEPLTPTYNISANGLTELHDDLSNYIDGHTPEGSKADSAVSSFYLDIQPSPDQSGLDINGIKPEPICDYTPASGFFPYCSFTNGETSPTVSMAELEHLAQNISKSHLETCQYLREELQQITWQTFLQEEIENYQNKQREVMWQLCAIKITEAIQYVVEFAKRIDGFMELCQNDQIVLLKAGSLEVVFIRMCRAFDSQNNTVYFDGKYASPDVFKSLGCEDFISFVFEFGKSLCSMHLTEDEIALFSAFVLMSADRSWLQEKVKIEKLQQKIQLALQHVLQKNHREDGILTKLICKVSTLRALCGRHTEKLMAFKAIYPDIVRLHFPPLYKELFTSEFEPAMQIDG

SEQ ID NO: 34986 - protein, 62 aa, Homo sapiens
  ENSP00000449482
  MOD_RES (1)..(1): Any amino acid
XPLNQESARKSEPPAPVRRQSYSSTSRGISVTKKTHTWQAWYRALPCTALPMSSSLARRDPL

SEQ ID NO: 34987 - protein, 153 aa, Homo sapiens
  ENSP00000453322
MRVTVAPQTKPVFSTNELAHLSPPSAPASQRESGVGLRASCPTEWGQKVVRGAFRGALRAEKRPAATAQIEIIPCKICGDKSSGIHYGVITCEGCKGFFRRSQQSNATYSCPRQKNCLIDRTSRNRCQHCRLQKCLAVGMSRDAVKFGRMSKK

SEQ ID NO: 34988 - protein, 38 aa, Homo sapiens
  ENSP00000484955
AAAGSRETPLNQESARKSEPPAPVRRQSYSSTSRDWHA

SEQ ID NO: 34989 - protein, 124 aa, Homo sapiens
  ENSP00000461733
MQKGDTNIKPILQVINIRPITTGNSPPRYRLLMSDGLNTLSSFMLATQLNPLVEEEQLSSNCVCQIHRFIVNTLKDGRRVVILMELEVLKSAEAVGVKIGNPVPYNEGLGQPQVAPPAPAASPA

SEQ ID NO: 34990 - protein, 153 aa, Homo sapiens
  ENSP00000459788
MQKGDTNIKPILQVINIRPITTGNSPPRYRLLMSDGLNTLSSFMLATQLNPLVEEEQLSSNCVCQIHRFIVNTLKDGRRVVILMELEVLKSAEAVGVKIGNPVPYNEGLGQPQVAPPAPAASPAASSRPQPQNGSSGMGSTVSKAYGASKTFG

SEQ ID NO: 34991 - protein, 616 aa, Homo sapiens
  ENSP00000254719
MVGQLSEGAIAAIMQKGDTNIKPILQVINIRPITTGNSPPRYRLLMSDGLNTLSSFMLATQLNPLVEEEQLSSNCVCQIHRFIVNTLKDGRRVVILMELEVLKSAEAVGVKIGNPVPYNEGLGQPQVAPPAPAASPAASSRPQPQNGSSGMGSTVSKAYGASKTFGKAAGPSLSHTSGGTQSKVVPIASLTPYQSKWTICARVTNKSQIRTWSNSRGEGKLFSLELVDESGEIRATAFNEQVDKFFPLIEVNKVYYFSKGTLKIANKQFTAVKNDYEMTFNNETSVMPCEDDHHLPTVQFDFTGIDDLENKSKDSLVDIIGICKSYEDATKITVRSNNREVAKRNIYLMDTSGKVVTATLWGEDADKFDGSRQPVLAIKGARVSDFGGRSLSVLSSSTIIANPDIPEAYKLRGWFDAEGQALDGVSISDLKSGGVGGSNTNWKTLYEVKSENLGQGDKPDYFSSVATVVYLRKENCMYQACPTQDCNKKVIDQQNGLYRCEKCDTEFPNFKYRMILSVNIADFQENQWVTCFQESAEAILGQNAAYLGELKDKNEQAFEEVFQNANFRSFIFRVRVKVETYNDESRIKATVMDVKPVDYREYGRRLVMSIRRSALM

SEQ ID NO: 34992 - protein, 313 aa, Homo sapiens
  ENSP00000461466
FFPLIEVNKVYYFSKGTLKIANKQFTAVKNDYEMTFNNETSVMPCEDDHHLPTVQFDFTGIDDLENKSKDSLVDIIGICKSYEDATKITVRSNNREVAKRNIYLMDTSGKVVTATLWGEDADKFDGSRQPVLAIKGARVSDFGGRSLSVLSSSTIIANPDIPEAYKLRGWFDAEGQALDGVSISDLKSGGVGGSNTNWKTLYEVKSENLGQGDKVNIADFQENQWVTCFQESAEAILGQNAAYLGELKDKNEQAFEEVFQNANFRSFIFRVRVKVETYNDESRIKATVMDVKPVDYREYGRRLVMSIRRSALM

SEQ ID NO: 34993 - protein, 39 aa, Homo sapiens
  ENSP00000446789
MTDTVFSNSSNRWMYPSDRPLQSNDKEQLQAGWSVHPGG

SEQ ID NO: 34994 - protein, 104 aa, Homo sapiens
  ENSP00000446570
MTDTVFSNSSNRWMYPSDRPLQSNDKEQLQAGWSVHPGGQPDRQRKQEELTDEEKEIINRVIARAEKMEEMEQERIGRLVDRLENMRKNVAGDGVNRCILCGEQ

SEQ ID NO: 34995 - protein, 94 aa, Homo sapiens
  ENSP00000449705
MTDTVFSNSSNRWMYPSDRPLQSNDKEQLQAGWSVHPGGQPDRQRKQEELTDEEKEIINRVIARAEKMEEMEQERIGRLVDRLENMRKNVAGDG

SEQ ID NO: 34996 - protein, 694 aa, Homo sapiens
  ENSP00000440384
MTDTVFSNSSNRWMYPSDRPLQSNDKEQLQAGWSVHPGGQPDRQRKQEELTDEEKEIINRVIARAEKMEEMEQERIGRLVDRLENMRKNVAGDGVNRCILCGEQLGMLGSACVVCEDCKKNVCTKCGVETNNRLHSVWLCKICIEQREVWKRSGAWFFKGFPKQVLPQPMPIKKTKPQQPVSEPAAPEQPAPEPKHPARAPARGDSEDRRGPGQKTGPDPASAPGRGNYGPPVRRASEARMSSSSRDSESWDHSGGAGDSSRSPAGLRRANSVQASRPAPGSVQSPAPPQPGQPGTPGGSRPGPGPAGRFPDQKPEVAPSDPGTTAPPREERTGGVGGYPAVGAREDRMSHPSGPYSQASAAAPQPAAARQPPPPEEEEEEANSYDSDEATTLGALEFSLLYDQDNSSLQCTIIKAKGLKPMDSNGLADPYVKLHLLPGASKSNKLRTKTLRNTRNPIWNETLVYHGITDEDMQRKTLRISVCDEDKFGHNEFIGETRFSLKKLKPNQRKNFNICLERVIPMKRAGTTGSARGMALYEEEQVERVGDIEERGKILVSLMYSTQQGGLIVGIIRCVHLAAMDANGYSDPFVKLWLKPDMGKKAKHKTQIKKKTLNPEFNEEFFYDIKHSDLAKKSLDISVWDYDIGKSNDYIGGCQLGISAKGERLKHWYECLKNKDKKIERWHQLQNENHVSSD

SEQ ID NO: 34997 - protein, 181 aa, Homo sapiens
  ENSP00000446780
MTDTVFSNSSNRWMYPSDRPLQSNDKEQLQAGWSVHPGGQPDRQRKQEELTDEEKEIINRVIARAEKMEEMEQERIGRLVDRLENMRKNVAGDGVNRCILCGEQLGMLGSACVVCEDCKKNVCTKCGVETNNRLHSVWLCKICIEQREVWKRSGAWFFKGFPKQVLPQPMPIKKTKPQQPV

SEQ ID NO: 34998 - protein, 12 aa, Homo sapiens
  ENSP00000447639
MTDTVFSNSSNR

SEQ ID NO: 34999 - protein, 94 aa, Homo sapiens; identical to SEQ ID NO: 34995
  ENSP00000447306

SEQ ID NO: 35000 - protein, 83 aa, Homo sapiens
  ENSP00000446556
MTDTVFSNSSNRWMYPSDRPLQSNDKEQLQAGWSVHPGGQPDRQRKQEELTDEEKEIINRVIARAEKMEEMEQERIGRLVDRL

SEQ ID NO: 35001 - protein, 127 aa, Homo sapiens
  ENSP00000450382
MTDTVFSNSSNRWMYPSDRPLQSNDKEQLQAGWSVHPGGQPDRQRKQEELTDEEKEIINRVIARAEKMEEMEQERIGRLVDRLENMRKNVAGDGVNRCILCGEQLGMLGSACVVCEDCKKNVCTKCG

SEQ ID NO: 35002 - protein, 163 aa, Homo sapiens
  ENSP00000449613
MTDTVFSNSSNRWMYPSDRPLQSNDKEQLQAGWSVHPGGQPDRQRKQEELTDEEKEIINRVIARAEKMEEMEQERIGRLVDRLENMRKNVAGDGVNRCILCGEQLGMLGSACVVCEDCKKNVCTKCGVETNNRLHSVWLCKICIEQREVWKRSGAWFFKGFPK

SEQ ID NO: 35003 - protein, 115 aa, Homo sapiens
  ENSP00000447505
MTDTVFSNSSNRWMYPSDRPLQSNDKEQLQAGWSVHPGGQPDRQRKQEELTDEEKEIINRVIARAEKMEEMEQERIGRLVDRLENMRKNVAGDGVNRCILCGEQLGMLGSACVVC

SEQ ID NO: 35004 - protein, 120 aa, Homo sapiens
  ENSP00000449650
MTDTVFSNSSNRWMYPSDRPLQSNDKEQLQAGWSVHPGGQPDRQRKQEELTDEEKEIINRVIARAEKMEEMEQERIGRLVDRLENMRKNVAGDGVNRCILCGEQLGMLGSACVVCEDCKK

SEQ ID NO: 35005 - protein, 694 aa, Homo sapiens; identical to SEQ ID NO: 34996
  ENSP00000374036

SEQ ID NO: 35006 - protein, 80 aa, Homo sapiens
  ENSP00000448100
MEEMEQERIGRLVDRLENMRKNVAGDGVNRCILCGEQLGMLGSACVVCEDCKKNVCTKCGVETNNRLHSVWLCKICIEQR

SEQ ID NO: 35007 - protein, 125 aa, Homo sapiens
  ENSP00000447083
MTDTVFSNSSNRWMYPSDRPLQSNDKEQLQAGWSVHPGGQPDRQRKQEELTDEEKEIINRVIARAEKMEEMEQERIGRLVDRLENMRKNVAGDGVNRCILCGEQLGMLGSACVVCEDCKKNVCTK

SEQ ID NO: 35008 - protein, 690 aa, Homo sapiens
  ENSP00000448297
MTDTVFSNSSNRWMYPSDRPLQSKLQAGWSVHPGGQPDRQRKQEELTDEEKEIINRVIARAEKMEEMEQERIGRLVDRLENMRKNVAGDGVNRCILCGEQLGMLGSACVVCEDCKKNVCTKCGVETNNRLHSVWLCKICIEQREVWKRSGAWFFKGFPKQVLPQPMPIKKTKPQQPVSEPAAPEQPAPEPKHPARAPARGDSEDRRGPGQKTGPDPASAPGRGNYGPPVRRASEARMSSSSRDSESWDHSGGAGDSSRSPAGLRRANSVQASRPAPGSVQSPAPPQPGQPGTPGGSRPGPGPAGRFPDQKPEVAPSDPGTTAPPREERTGGVGGYPAVGAREDRMSHPSGPYSQASAAAPQPAAARQPPPPEEEEEEANSYDSDEATTLGALEFSLLYDQDNSSLQCTIIKAKGLKPMDSNGLADPYVKLHLLPGASKSNKLRTKTLRNTRNPIWNETLVYHGITDEDMQRKTLRISVCDEDKFGHNEFIGETRFSLKKLKPNQRKNFNICLERVIPMKRAGTTGSARGMALYEEEQVERVGDIEERGKILVSLMYSTQQGGLIVGIIRCVHLAAMDANGYSDPFVKLWLKPDMGKKAKHKTQIKKKTLNPEFNEEFFYDIKHSDLAKKSLDISVWDYDIGKSNDYIGGCQLGISAKGERLKHWYECLKNKDKKIERWHQLQNENHVSSD

SEQ ID NO: 35009 - protein, 694 aa, Homo sapiens; identical to SEQ ID NO: 34996
  ENSP00000405357

SEQ ID NO: 35010 - protein, 133 aa, Homo sapiens
  ENSP00000450216
MTDTVFSNSSNRWMYPSDRPLQSNDKEQLQAGWSVHPGGQPDRQRKQEELTDEEKEIINRVIARAEKMEEMEQERIGRLVDRLENMRKNVAGDGVNRCILCGEQLGMLGSACVVCEDCKKNVCTKCGVETNNR

SEQ ID NO: 35011 - protein, 645 aa, Homo sapiens
  ENSP00000450347
MTDTVFSNSSNRWMYPSDRPLQSNDKEQRLVDRLENMRKNVAGDGVNRCILCGEQLGMLGSACVVCEDCKKNVCTKCGVETNNRLHSVWLCKICIEQREVWKRSGAWFFKGFPKQVLPQPMPIKKTKPQQPVSEPAAPEQPAPEPKHPARAPARGDSEDRRGPGQKTGPDPASAPGRGNYGPPVRRASEARMSSSSRDSESWDHSGGAGDSSRSPAGLRRANSVQASRPAPGSVQSPAPPQPGQPGTPGGSRPGPGPAGRFPDQKPEVAPSDPGTTAPPREERTGGVGGYPAVGAREDRMSHPSGPYSQASAAAPQPAAARQPPPPEEEEEEANSYDSDEATTLGALEFSLLYDQDNSSLQCTIIKAKGLKPMDSNGLADPYVKLHLLPGASKSNKLRTKTLRNTRNPIWNETLVYHGITDEDMQRKTLRISVCDEDKFGHNEFIGETRFSLKKLKPNQRKNFNICLERVIPMKRAGTTGSARGMALYEEEQVERVGDIEERGKILVSLMYSTQQGGLIVGIIRCVHLAAMDANGYSDPFVKLWLKPDMGKKAKHKTQIKKKTLNPEFNEEFFYDIKHSDLAKKSLDISVWDYDIGKSNDYIGGCQLGISAKGERLKHWYECLKNKDKKIERWHQLQNENHVSSD

SEQ ID NO: 35012 - protein, 60 aa, Homo sapiens
  ENSP00000448662
MTDTVFSNSSNRWMYPSDRPLQSKLQHSRWTLKDWLCFQVSVKSLKPTNCPSSVDGFSFH

SEQ ID NO: 35013 - protein, 214 aa, Homo sapiens
  ENSP00000358832
MGRRPARCYRYCKNKPYPKSRFCRGVPDAKIRIFDLGRKKAKVDEFPLCGHMVSDEYEQLSSEALEAARICANKYMVKSCGKDGFHIRVRLHPFHVIRINKMLSCAGADRLQTGMRGAFGKPQGTVARVHIGQVIMSIRTKLQNKEHVIEALRRAKFKFPGRQKIHISKKWGFTKFNADEFEDMVAEKRLIPDGCGVKYIPSRGPLDKWRALHS

SEQ ID NO: 35014 - protein, 200 aa, Homo sapiens
  ENSP00000388600
MGRRPARCYRYCKNKPYPKSRFCRGVPDAKIRIFDLGRKKAKVDEFPLCGHMVSDEYEQLSSEALEAARICANKYMVKSCGKDGFHIRVRLHPFHVIRINKMLSCAGADRLQTGMRGAFGKPQGTVARVHIGQVIMSIRTKLQNKEHVIEALRRAKFKFPGRQKIHISKKWGFTKFNADEFEDMVAEKRLIPDGCGVKYI

SEQ ID NO: 35015 - protein, 214 aa, Homo sapiens; identical to SEQ ID NO: 35013
  ENSP00000341730

SEQ ID NO: 35016 - protein, 181 aa, Homo sapiens
  ENSP00000395025
MGRRPARCYRYCKNKPYPKSRFCRGVPDAKIRIFDLGRKKAKVDEFPLCGHMVSDEYEQLSSEALEAARICANKYMVKSCGKDGFHIRVRLHPFHVIRINKMLSCAGADRSTSQRSGASPSSMLMNLKTWWLKSGSSQMAVGSSTSPVVALWTSGGPCTHEGFQCAAPLLILTNKFYFLST

SEQ ID NO: 35017 - protein, 163 aa, Homo sapiens
  ENSP00000385621
MVSDEYEQLSSEALEAARICANKYMVKSCGKDGFHIRVRLHPFHVIRINKMLSCAGADRLQTGMRGAFGKPQGTVARVHIGQVIMSIRTKLQNKEHVIEALRRAKFKFPGRQKIHISKKWGFTKFNADEFEDMVAEKRLIPDGCGVKYIPSRGPLDKWRALHS

SEQ ID NO: 35018 - protein, 108 aa, Homo sapiens
  ENSP00000406125
PKSRFCRGVPDAKIRIFDLGRKKAKVDEFPLCGHMVSDEYEQLSSEALEAARICANKYMVKSCGKDGFHIRVRLHPFHVIRINKMLSCAGADRPTLLCQCWETSRNTS

SEQ ID NO: 35019 - protein, 28 aa, Homo sapiens
  ENSP00000407754
LHPFHVIRINKMLSCAGADSPIPSPPPR

SEQ ID NO: 35020 - protein, 131 aa, Homo sapiens
  ENSP00000405064
LHPFHVIRINKMLSCAGADRLQTGMRGAFGKPQGTVARVHIGQVIMSIRTKLQNKEHVIEALRRAKFKFPGRQKAYLALPVLGDLQKHIVEGVQLLLYGLRSGVQRDQHQAGKDCKAQGPRAAIHSWTFSP

SEQ ID NO: 35021 - protein, 91 aa, Homo sapiens
  ENSP00000398047
LHPFHVIRINKMLSCAGADRLQTGMRGAFGKPQGTVARVHIGQVIMSIRTKLQNKEHVIEALRRAKFKFPGRQKGAPIPAQTSLSPSLPHP

SEQ ID NO: 35022 - protein, 214 aa, Homo sapiens; identical to SEQ ID NO: 35013
  ENSP00000413436

SEQ ID NO: 35023 - protein, 178 aa, Homo sapiens
  ENSP00000479103
MGRRPARCYRYCKNKPYPKSRFCRGVPALEAARICANKYMVKSCGKDGFHIRVRLHPFHVIRINKMLSCAGADRLQTGMRGAFGKPQGTVARVHIGQVIMSIRTKLQNKEHVIEALRRAKFKFPGRQKIHISKKWGFTKFNADEFEDMVAEKRLIPDGCGVKYIPSRGPLDKWRALHS

SEQ ID NO: 35024 - protein, 109 aa, Homo sapiens
  ENSP00000314946
MNPALGNQTDVAGLFLANSSEALERAVRCCTQASVVTDDGFAEGGPDERSLYIMRVVQIAVMCVLSLTVVFGIFFLGCNLLIKSEGMINFLVKDRRPSKEVEAVVVGPY

SEQ ID NO: 35025 - protein, 263 aa, Homo sapiens
  ENSP00000250784
MARGPKKHLKRVAAPKHWMLDKLTGVFAPRPSTGPHKLRECLPLIVFLRNRLKYALTGDEVKKICMQRFIKIDGKVRVDVTYPAGFMDVISIEKTGEHFRLVYDTKGRFAVHRITVEEAKYKLCKVRKITVGVKGIPHLVTHDARTIRYPDPVIKVNDTVQIDLGTGKIINFIKFDTGNLCMVIGGANLGRVGVITNRERHPGSFDVVHVKDANGNSFATRLSNIFVIGNGNKPWISLPRGKGIRLTVAEERDKRLATKQSSG

SEQ ID NO: 35026 - protein, 262 aa, Homo sapiens
  ENSP00000415317
MLGRPAKFSKARGPKKHLKRVAAPKHWMLDKLTGVFAPRPSTGPHKLRECLPLIVFLRNRLKYALTGDEVKKICMQRFIKIDGKVRVDVTYPAGFMDVISIEKTGEHFRLVYDTKGRFAVHRITVEEAKYKLCKVRKITVGVKGIPHLVTHDARTIRYPDPVIKVNDTVQIDLGTGKIINFIKFDTGNLCMVIGGANLGRVGVITNRERHPGSFDVVHVKDANGNSFATRLSNIFVIGNGNKPWISLPRGKGIRLTVAEERD

SEQ ID NO: 35027 - protein, 56 aa, Homo sapiens
  ENSP00000485797
MPLAQLKEPWPLMELVPLDPEKQLLTSLEGSVAPVPKRAEGHLFLCLLTPGSRSSP

SEQ ID NO: 35028 - protein, 52 aa, Homo sapiens
  ENSP00000486119
MPLAQLKEPWPLMELVPLDPENGQTSGEEAGLQPSKYVTASGPRWRETSWLM

SEQ ID NO: 35029 - protein, 735 aa, Homo sapiens
  ENSP00000486881
MPLAQLKEPWPLMELVPLDPENGQTSGEEAGLQPSKDEGVLKEISITHHVKAGSEKADPSHFELLKVLGQGSFGKVFLVRKVTRPDSGHLYAMKVLKKATLKVRDRVRTKMERDILADVNHPFVVKLHYAFQTEGKLYLILDFLRGGDLFTRLSKEVMFTEEDVKFYLAELALGLDHLHSLGIIYRDLKPENILLDEEGHIKLTDFGLSKEAIDHEKKAYSFCGTVEYMAPEVVNRQGHSHSADWWSYGVLMFEMLTGSLPFQGKDRKETMTLILKAKLGMPQFLSTEAQSLLRALFKRNPANRLGSGPDGAEEIKRHVFYSTIDWNKLYRREIKPPFKPAVAQPDDTFYFDTEFTSRTPKDSPGIPPSAGAHQLFRGFSFVATGLMEDDGKPRAPQAPLHSVVQQLHGKNLVFSDGYVVKETIGVGSYSECKRCVHKATNMEYAVKVIDKSKRDPSEEIEILLRYGQHPNIITLKDVYDDGKHVYLVTELMRGGELLDKILRQKFFSEREASFVLHTIGKTVEYLHSQGVVHRDLKPSNILYVDESGNPECLRICDFGFAKQLRAENGLLMTPCYTANFVAPEVLKRQGYDEGCDIWSLGILLYTMLAGYTPFANGPSDTPEEILTRIGSGKFTLSGGNWNTVSETAKDLVSKMLHVDPHQRLTAKQVLQHPWVTQKDKLPQSQLSHQDLQLVKGAMAATYSALNSSKPTPQLKPIESSILAQRRVRKLPSTTL

SEQ ID NO: 35030 - protein, 724 aa, Homo sapiens
  ENSP00000486031
MPLAQLKEPWPLMELVPLDPENGQTSGEEAGLQPSKDEGVLKEISITHHVKAGSEKADPSHFELLKVLGQGSFGKVFLVRKVTRPDSGHLYAMKVLKKATLKVRDRVRTKMERDILADVNHPFVVKLHYAFQTEGKLYLILDFLRGGDLFTRLSKEVMFTEEDVKFYLAELALGLDHLHSLGIIYRDLKPENILLDEEGHIKLTDFGLSKEAIDHEKKAYSFCGTVEYMAPEVVNRQGHSHSADWWSYGVLMGKDRKETMTLILKAKLGMPQFLSTEAQSLLRALFKRNPANRLGSGPDGAEEIKRHVFYSTIDWNKLYRREIKPPFKPAVAQPDDTFYFDTEFTSRTPKDSPGIPPSAGAHQLFRGFSFVATGLMEDDGKPRAPQAPLHSVVQQLHGKNLVFSDGYVVKETIGVGSYSECKRCVHKATNMEYAVKVIDKSKRDPSEEIEILLRYGQHPNIITLKDVYDDGKHVYLVTELMRGGELLDKILRQKFFSEREASFVLHTIGKTVEYLHSQGVVHRDLKPSNILYVDESGNPECLRICDFGFAKQLRAENGLLMTPCYTANFVAPEVLKRQGYDEGCDIWSLGILLYTMLAGYTPFANGPSDTPEEILTRIGSGKFTLSGGNWNTVSETAKDLVSKMLHVDPHQRLTAKQVLQHPWVTQKDKLPQSQLSHQDLQLVKGAMAATYSALNSSKPTPQLKPIESSILAQRRVRKLPSTTL

SEQ ID NO: 35031 - protein, 643 aa, Homo sapiens
  ENSP00000487166
MKVLKKATLKVRDRVRTKMERDILADVNHPFVVKLHYAFQTEGKLYLILDFLRGGDLFTRLSKEVMFTEEDVKFYLAELALGLDHLHSLGIIYRDLKPENILLDEEGHIKLTDFGLSKEAIDHEKKAYSFCGTVEYMAPEVVNRQGHSHSADWWSYGVLMFEMLTGSLPFQGKDRKETMTLILKAKLGMPQFLSTEAQSLLRALFKRNPANRLGSGPDGAEEIKRHVFYSTIDWNKLYRREIKPPFKPAVAQPDDTFYFDTEFTSRTPKDSPGIPPSAGAHQLFRGFSFVATGLMEDDGKPRAPQAPLHSVVQQLHGKNLVFSDGYVVKETIGVGSYSECKRCVHKATNMEYAVKVIDKSKRDPSEEIEILLRYGQHPNIITLKDVYDDGKHVYLVTELMRGGELLDKILRQKFFSEREASFVLHTIGKTVEYLHSQGVVHRDLKPSNILYVDESGNPECLRICDFGFAKQLRAENGLLMTPCYTANFVAPEVLKRQGYDEGCDIWSLGILLYTMLAGYTPFANGPSDTPEEILTRIGSGKFTLSGGNWNTVSETAKDLVSKMLHVDPHQRLTAKQVLQHPWVTQKDKLPQSQLSHQDLQLVKGAMAATYSALNSSKPTPQLKPIESSILAQRRVRKLPSTTL

SEQ ID NO: 35032 - protein, 112 aa, Homo sapiens
  ENSP00000487239
MKVLKKATLKVRDRVRTKMERDILADVNHPFVVKLHYAFQTEGKLYLILDFLRGGDLFTRLSKEVMFTEEDVKFYLAELALGLDHLHSLGIIYRDLKPENILLDEEGHIKLT

SEQ ID NO: 35033 - protein, 719 aa, Homo sapiens
  ENSP00000487553
MQTPADFPRVERDLVPCPRKDEGVLKEISITHHVKAGSEKADPSHFELLKVLGQGSFGKVFLVRKVTRPDSGHLYAMKVLKKATLKVRDRVRTKMERDILADVNHPFVVKLHYAFQTEGKLYLILDFLRGGDLFTRLSKEVMFTEEDVKFYLAELALGLDHLHSLGIIYRDLKPENILLDEEGHIKLTDFGLSKEAIDHEKKAYSFCGTVEYMAPEVVNRQGHSHSADWWSYGVLMFEMLTGSLPFQGKDRKETMTLILKAKLGMPQFLSTEAQSLLRALFKRNPANRLGSGPDGAEEIKRHVFYSTIDWNKLYRREIKPPFKPAVAQPDDTFYFDTEFTSRTPKDSPGIPPSAGAHQLFRGFSFVATGLMEDDGKPRAPQAPLHSVVQQLHGKNLVFSDGYVVKETIGVGSYSECKRCVHKATNMEYAVKVIDKSKRDPSEEIEILLRYGQHPNIITLKDVYDDGKHVYLVTELMRGGELLDKILRQKFFSEREASFVLHTIGKTVEYLHSQGVVHRDLKPSNILYVDESGNPECLRICDFGFAKQLRAENGLLMTPCYTANFVAPEVLKRQGYDEGCDIWSLGILLYTMLAGYTPFANGPSDTPEEILTRIGSGKFTLSGGNWNTVSETAKDLVSKMLHVDPHQRLTAKQVLQHPWVTQKDKLPQSQLSHQDLQLVKGAMAATYSALNSSKPTPQLKPIESSILAQRRVRKLPSTTL

SEQ ID NO: 35034 - protein, 111 aa, Homo sapiens
  ENSP00000487154
MQTPADFPRVERDLVPCPRKVQQQEPTALPLTPSWGSLPCCLPVCLPGVRPICPRMRASSRRSPSRTTSRLALRRLIHPISSSSRFWARDPLAKSSWCGKSPGLTVGTCML

SEQ ID NO: 35035 - protein, 204 aa, Homo sapiens
  ENSP00000486849
MEQDPKPPRLRLWALIPWLPRKQRPRISQTSLPVPGPGSGPQRDSDEGVLKEISITHHVKAGSEKADPSHFELLKVLGQGSFGKVFLVRKVTRPDSGHLYAMKVLKKATLKVRDRVRTKMERDILADVNHPFVVKLHYAFQTEGKLYLILDFLRGGDLFTRLSKEVIYMIQKKNIHEEVFLPPQPPLFPSIGDVHGGGCEVLPG

SEQ ID NO: 35036 - protein, 744 aa, Homo sapiens
  ENSP00000487349
MEQDPKPPRLRLWALIPWLPRKQRPRISQTSLPVPGPGSGPQRDSDEGVLKEISITHHVKAGSEKADPSHFELLKVLGQGSFGKVFLVRKVTRPDSGHLYAMKVLKKATLKVRDRVRTKMERDILADVNHPFVVKLHYAFQTEGKLYLILDFLRGGDLFTRLSKEVMFTEEDVKFYLAELALGLDHLHSLGIIYRDLKPENILLDEEGHIKLTDFGLSKEAIDHEKKAYSFCGTVEYMAPEVVNRQGHSHSADWWSYGVLMFEMLTGSLPFQGKDRKETMTLILKAKLGMPQFLSTEAQSLLRALFKRNPANRLGSGPDGAEEIKRHVFYSTIDWNKLYRREIKPPFKPAVAQPDDTFYFDTEFTSRTPKDSPGIPPSAGAHQLFRGFSFVATGLMEDDGKPRAPQAPLHSVVQQLHGKNLVFSDGYVVKETIGVGSYSECKRCVHKATNMEYAVKVIDKSKRDPSEEIEILLRYGQHPNIITLKDVYDDGKHVYLVTELMRGGELLDKILRQKFFSEREASFVLHTIGKTVEYLHSQGVVHRDLKPSNILYVDESGNPECLRICDFGFAKQLRAENGLLMTPCYTANFVAPEVLKRQGYDEGCDIWSLGILLYTMLAGYTPFANGPSDTPEEILTRIGSGKFTLSGGNWNTVSETAKDLVSKMLHVDPHQRLTAKQVLQHPWVTQKDKLPQSQLSHQDLQLVKGAMAATYSALNSSKPTPQLKPIESSILAQRRVRKLPSTTL

SEQ ID NO: 35037 - protein, 166 aa, Homo sapiens
  ENSP00000486179
AQPDDTFYFDTEFTSRTPKDSPGIPPSAGAHQLFRGFSFVATGLMEDDGKPRAPQAPLHSVVQVIDKSKRDPSEEIEILLRYGQHPNIITLKDVYDDGKHVYLVTELMRGGELLDKILRQKFFSEREASFVLHTIGKTVEYLHSQGVVHRDLKPSNILYVDESGNP

SEQ ID NO: 35038 - protein, 115 aa, Homo sapiens
  ENSP00000487207
NTVSETAKDLVSKMLHVDPHQRLTAKQVLQHPWVTQKDKLPQSQLSHQDLQLVKGAMAATYSALNSSKPTPQLKPIESSILAQRRVRKLPSTTLMDSSRLRLCWWKAIHCINFFL

SEQ ID NO: 35039 - protein, 56 aa, Homo sapiens; identical to SEQ ID NO: 35027
  ENSP00000434616

SEQ ID NO: 35040 - protein, 52 aa, Homo sapiens; identical to SEQ ID NO: 35028
  ENSP00000436990

SEQ ID NO: 35041 - protein, 735 aa, Homo sapiens; identical to SEQ ID NO: 35029
  ENSP00000363283

SEQ ID NO: 35042 - protein, 724 aa, Homo sapiens; identical to SEQ ID NO: 35030
  ENSP00000363281

SEQ ID NO: 35043 - protein, 643 aa, Homo sapiens; identical to SEQ ID NO: 35031
  ENSP00000431651

SEQ ID NO: 35044 - protein, 112 aa, Homo sapiens; identical to SEQ ID NO: 35032
  ENSP00000433039

SEQ ID NO: 35045 - protein, 719 aa, Homo sapiens; identical to SEQ ID NO: 35033
  ENSP00000432281

SEQ ID NO: 35046 - protein, 111 aa, Homo sapiens; identical to SEQ ID NO: 35034
  ENSP00000355831

SEQ ID NO: 35047 - protein, 204 aa, Homo sapiens; identical to SEQ ID NO: 35035
  ENSP00000363278

SEQ ID NO: 35048 - protein, 744 aa, Homo sapiens; identical to SEQ ID NO: 35036
  ENSP00000435412

SEQ ID NO: 35049 - protein, 166 aa, Homo sapiens; identical to SEQ ID NO: 35037
  ENSP00000383967

SEQ ID NO: 35050 - protein, 115 aa, Homo sapiens; identical to SEQ ID NO: 35038
  ENSP00000403548

SEQ ID NO: 35051 - protein, 802 aa, Homo sapiens
  ENSP00000479667
MEEEGGSSGGAAGTSADGGDGGEQLLTVKHELRTANLTGHAEKVGIENFELLKVLGTGAYGKVFLVRKISGHDTGKLYAMKVLKKATIVQKAKTTEHTRTERQVLEHIRQSPFLVTLHYAFQTETKLHLILDYINGGELFTHLSQRERFTEHEVQIYVGEIVLALEHLHKLGIIYRDIKLENILLDSNGHVVLTDFGLSKEFVADETERAYSFCGTIEYMAPDIVRGGDSGHDKAVDWWSLGVLMYELLTGASPFTVDGEKNSQAEISRRILKSEPPYPQEMSALAKDLIQRLLMKDPKKRLGCGPRDADEIKEHLFFQKINWDDLAAKKVPAPFKPVIRDELDVSNFAEEFTEMDPTYSPAALPQSSEKLFQGYSFVAPSILFKRNAAVIDPLQFHMGVERPGVTNVARSAMMKDSPFYQHYDLDLKDKPLGEGSFSICRKCVHKKSNQAFAVKIISKRMEANTQKEITALKLCEGHPNIVKLHEVFHDQLHTFLVMELLNGGELFERIKKKKHFSETEASYIMRKLVSAVSHMHDVGVVHRDLKPENLLFTDENDNLEIKIIDFGFARLKPPDNQPLKTPCFTLHYAAPELLNQNGYDESCDLWSLGVILYTMLSGQVPFQSHDRSLTCTSAVEIMKKIKKGDFSFEGEAWKNVSQEAKDLIQGLLTVDPNKRLKMSGLRYNEWLQDGSQLSSNPLMTPDILGSSGAAVHTCVKATFHAFNKYKREGFCLQNVDKAPLAKRRKMKKTSTSTETRSSSSESSHSSSSHSHGKTTPTKTLQPSNPADSNNPETLFQFSDSVA

SEQ ID NO: 35052 - protein, 723 aa, Homo sapiens
  ENSP00000442803
MKVLKKATIVQKAKTTEHTRTERQVLEHIRQSPFLVTLHYAFQTETKLHLILDYINGGELFTHLSQRERFTEHEVQIYVGEIVLALEHLHKLGIIYRDIKLENILLDSNGHVVLTDFGLSKEFVADETERAYSFCGTIEYMAPDIVRGGDSGHDKAVDWWSLGVLMYELLTGASPFTVDGEKNSQAEISRRILKSEPPYPQEMSALAKDLIQRLLMKDPKKRLGCGPRDADEIKEHLFFQKINWDDLAAKKVPAPFKPVIRDELDVSNFAEEFTEMDPTYSPAALPQSSEKLFQGYSFVAPSILFKRNAAVIDPLQFHMGVERPGVTNVARSAMMKDSPFYQHYDLDLKDKPLGEGSFSICRKCVHKKSNQAFAVKIISKRMEANTQKEITALKLCEGHPNIVKLHEVFHDQLHTFLVMELLNGGELFERIKKKKHFSETEASYIMRKLVSAVSHMHDVGVVHRDLKPENLLFTDENDNLEIKIIDFGFARLKPPDNQPLKTPCFTLHYAAPELLNQNGYDESCDLWSLGVILYTMLSGQVPFQSHDRSLTCTSAVEIMKKIKKGDFSFEGEAWKNVSQEAKDLIQGLLTVDPNKRLKMSGLRYNEWLQDGSQLSSNPLMTPDILGSSGAAVHTCVKATFHAFNKYKREGFCLQNVDKAPLAKRRKMKKTSTSTETRSSSSESSHSSSSHSHGKTTPTKTLQPSNPADSNNPETLFQFSDSVA

SEQ ID NO: 35053 - protein, 79 aa, Homo sapiens
  ENSP00000451305
  MOD_RES (1)..(1): Any amino acid
XYGKVFLVRKISGHDTGKLYAMKVLKKATIVQKAKTTEHTRTERQVLEHIRQSPFLVTLHYAFQTETKLHLILVGDYIS

SEQ ID NO: 35054 - protein, 549 aa, Homo sapiens
  ENSP00000402787
MEEEGGSSGGAAGTSADGGDGGEQLLTVKHELRTANLTGHAEKVGIENFELLKVLGTGAYGKVFLVRKISGHDTGKLYAMKVLKKATIVQKAKTTEHTRTERQVLEHIRQSPFLVTLHYAFQTETKLHLILDYINGGELFTHLSQRERFTEHEVQIYVGEIVLALEHLHKLGIIYRDIKLENILLDSNGHVVLTDFGLSKEFVADETERAYSFCGTIEYMAPDIVRGGDSGHDKAVDWWSLGVLMYELLTGASPFTVDGEKNSQAEISRRILKSEPPYPQEMSALAKDLIQRLLMKDPKKRLGCGPRDADEIKEHLFFQKINWDDLAAKKVPAPFKPVIRDELDVSNFAEEFTEMDPTYSPAALPQSSEKLFQGYSFVAPSILFKRNAAVIDPLQFHMGVERPGVTNVARSAMMKDSPFYQHYDLDLKDKPLGEGSFSICRKCVHKKSNQAFAVKIISKRMEANTQKEITALKLCEGHPNIVKLHEVFHDQLHTFLVMELLNGGELFERIKKKKHFSETEASYIMRKLVSAVSHMHDVGVVHRDLKPEV

SEQ ID NO: 35055 - protein, 219 aa, Homo sapiens
  ENSP00000450591
MEEEGGSSGGAAGTSADGGDGGEQLLTVKHELRTANLTGHAEKVGIENFELLKVLGTGAYGKVFLVRKISGHDTGKLYAMKVLKKATIVQKAKTTEHTRTERQVLEHIRQSPFLVTLHYAFQTETKLHLILDYINGGELFTHLSQRERFTEHEVQIYVGEIVLALEHLHKLGIIYRDIKLENILLDSNGHVVLTDFGLSKEFVADELEIKSLFCLFVQD

SEQ ID NO: 35056 - protein, 83 aa, Homo sapiens
  ENSP00000451736
MEEEGGSSGGAAGTSADGGDGGEQLLTVKHELRTETSLLCCPGWSVVLISAHYNLRLLGSSDSPASASQVAGITGTHYHTQLI

SEQ ID NO: 35057 - protein, 144 aa, Homo sapiens
  ENSP00000405054
  MOD_RES (1)..(1): Any amino acid
XAVTDGIPAASEGKIQAALKLEHIDGVNLTVPVKAPSRKDILEGVKKTLSHFRVVATGSGCALVQLQPLTVFSSQLQVHMVLQLCPVLGDHMYSARVGTVLGQRFLLPAENNKPQRQVLQPTCLLLSEGWRERSWMKPSSDAST

SEQ ID NO: 35058 - protein, 336 aa, Homo sapiens
  ENSP00000398921
MRAVLAREMDGRRVLGRFWSGWRRGLGVRPVPEDAGFGTEARHQRQPRGSCQRSGPLGDQPFAGLLPKNLSREELVDALRAAVVDRKGKPGELTLFSVLPELSQSLGLREQELQVVRASGKESSGLVLLSSCPQTASRLQKYFTHARRAQRPTATYCAVTDGIPAASEGKIQAALKLEHIDGVNLTVPVKAPSRKDILEGVKKTLSHFRVVATGSGCALVQLQPLTVFSSQLQVHMVLQLCPVLGDHMYSARVGTVLGQRFLLPAENNKPQRQVLDEALLRRLHLTPSQAAQLPLHLHLHRLLLPGTRARDTPVELLAPLPPYFSRTLQCLGLRLQ

SEQ ID NO: 35059 - protein, 351 aa, Homo sapiens
  ENSP00000373331
MRAVLAREMDGRRVLGRFWSGWRRGLGVRPVPEDAGFGTEARHQRQPRGSCQRSGPLGDQPFAGLLPKNLSREELVDALRAAVVDRKGPLVTLNKPQGLPVTGKPGELTLFSVLPELSQSLGLREQELQVVRASGKESSGLVLLSSCPQTASRLQKYFTHARRAQRPTATYCAVTDGIPAASEGKIQAALKLEHIDGVNLTVPVKAPSRKDILEGVKKTLSHFRVVATGSGCALVQLQPLTVFSSQLQVHMVLQLCPVLGDHMYSARVGTVLGQRFLLPAENNKPQRQVLDEALLRRLHLTPSQAAQLPLHLHLHRLLLPGTRARDTPVELLAPLPPYFSRTLQCLGLRLQ

SEQ ID NO: 35060 - protein, 212 aa, Homo sapiens
  ENSP00000408693
MGPVVPEFSRHQRQPRGSCQRSGPLGDQPFAGLLPKNLSREELVDALRAAVVDRKGPLVTLNKPQGLPVTGKPGELTLFSVLPELSQSLGLREQELQVVRASGKESSGLVLLSSCPQTASRLQKYFTHARRAQRPTATYCAVTDGIPAASEGKIQAALKLEHIDGVNLTVPVKAPSRKDILEGVKKTLSHFRVVATGSGCALVQLQPLTGPG

SEQ ID NO: 35061 - protein, 280 aa, Homo sapiens
  ENSP00000400397
  MOD_RES (1)..(1): Any amino acid
XGRRVLGRFWSGWRRGLGVRPVPEDAGFGTEARHQRQPRGSCQRSGPLGDQPFAGLLPKNLSREELVDALRAAVVDRKGPLVTLNKPQGLPVTGKPGELTLFSVLPELSQSLGLREQELQVVRASGKESSGLVLLSSCPQTASRLQKYFTHARRAQRPTATYCAVTDGIPAASEGKIQAALKLEHIDGVNLACSLLAGTTDSSSEGPIPKGHPGRCQEDSQSLSCGSHRLWLCPGPAAATDSVLQSTTGAHGTTALPCAWGPHVLCPCGHCPGPAISAAS

SEQ ID NO: 35062 - protein, 246 aa, Homo sapiens
  ENSP00000415616
LAREMDGRRVLGRFWSGWRRGLGVRPVPEDAGFGTEARHQRQPRGSCQRSGPLGDQPFAGLLPKNLSREELVDALRAAVVDRKGPLVTLNKPQGLPVTGKPGELTLFSVLPELSQSLGLREQELQVVRASGKESSGLVLLSSCPQTASRLQKYFTHARRAQRPTATYCAVTDGIPAASEGKIQAALKLEHIDGVNLTVPVKAPSRKDILEGVKKTLSHFRVVATGSGCALVQLQPLTGRSGTLASL

SEQ ID NO: 35063 - protein, 151 aa, Homo sapiens
  ENSP00000395446
NQRAGWSAGLPLWTHMRAVLAREMDGRRVLGRFWSGWRRGLGVRPVPEDAGFGTEARHQRQPRGSCQRSGPLGDQPFAGLLPKNLSREELVDALRAAVVDRKGPLVTLNKPQGLPVTGKPGELTLFSVLPELSQSLGLREQELQVVRASGK

SEQ ID NO: 35064 - protein, 102 aa, Homo sapiens
  ENSP00000396405
  MOD_RES (1)..(1): Any amino acid
XVLGRFWSGWRRGLGVRPVPEDAGFGTEARTSSDVEQATGSTSDRKTRRADVVLSAARAEPVPRAQGAGASGCPSIWEVSGRGDRKLGVQASICGGETAAWG

SEQ ID NO: 35065 - protein, 36 aa, Homo sapiens
  ENSP00000395492
  MOD_RES (1)..(1): Any amino acid
XEMDGRRVLGRFWSGWRRGLGVRPVPEDAGFGTEAR

SEQ ID NO: 35066 - protein, 277 aa, Homo sapiens
  ENSP00000357201
MPGISARGLSHEGRKQLAVNLTRVLALYRSILDAYIIEFFTDNLWDTLPCSWQEALDGLKPPQLATMLLGMPGEGEVVRYRSVWPLTLLALKSTACALAFTRMPGFQTPSEFLENPSQSSRLTAPFRKHVRPKKQHEIRRLGELVKKLSDFTGCTQVVDVGSGQGHLSRFMALGLGLMVKSIEGDQRLVERAQRLDQELLQALEKEEKRNPQICAAGATASGARSPAATESGCPSGPRGPGEPCGGLLQPGSTACPTGGDAYSTGPAAVPSGTGFPC

SEQ ID NO: 35067 - protein, 475 aa, Homo sapiens
  ENSP00000357199
MPGISARGLSHEGRKQLAVNLTRVLALYRSILDAYIIEFFTDNLWDTLPCSWQEALDGLKPPQLATMLLGMPGEGEVVRYRSVWPLTLLALKSTACALAFTRMPGFQTPSEFLENPSQSSRLTAPFRKHVRPKKQHEIRRLGELVKKLSDFTGCTQVVDVGSGQGHLSRFMALGLGLMVKSIEGDQRLVERAQRLDQELLQALEKEEKRNPQVVQTSPRHSPHHVVRWVDPTALCEELLLPLENPCQGRARLLLTGLHACGDLSVALLRHFSCCPEVVALASVGCCYMKLSDPGGYPLSQWVAGLPGYELPYRLREGACHALEEYAERLQKAGPGLRTHCYRAALETVIRRARPELRRPGVQGIPRVHELKIEEYVQRGLQRVGLDPQLPLNLAALQAHVAQENRVVAFFSLALLLAPLVETLILLDRLLYLQEQGFHAELLPIFSPELSPRNLVLVATKMPLGQALSVLETEDS

SEQ ID NO: 35068 - protein, 345 aa, Homo sapiens
  ENSP00000429756
MPGISARGLSHEGRKQLAVNLTRVLALYRSILDAYIIEFFTDNLWDTLPCSWQEALDGLKPPQLATMLLGMPGEGEVVRYRSVWPLTLLALKSTACALAFTRMPGFQTPSEFLENPSQSSRLTAPFRKHVRPKKQHEIRRLGEGHLSRFMALGLGLMVKSIEGDQRLVERAQRLDQELLQALEKEEKRNPQVVQTSPRHSPHHVVRWVDPTALCEELLLPLENPCQGRARLLLTGLHACGDLSVALLRHFSCCPEVVALASVGCCYMKLSDPGGYPLSQWVAGLPGYELPYRLREGACHALEEYAERLQKAGPGLRTHCYRAALETVIRRARPELRRPGVQGIPR

SEQ ID NO: 35069 - protein, 94 aa, Homo sapiens
  ENSP00000429389
MPGISARGLSHEGRKQLAVNLTRVLALYRSILDAYIIVQVSVATHPAGPEVHGVCPGLYPDAWLSDPLRIPGEPQPELPTNSSIPETCQAQEAA

SEQ ID NO: 35070 - protein, 100 aa, Homo sapiens
  ENSP00000429053
MPGFQTPSEFLENPSQSSRLTAPFRKHVRPKKQHEIRRLGELVKKLSDFTGCTQVVDVGSGQGHLSRFMALGLGLMVKSIEGDQRLVERAQRLDQELLQA

SEQ ID NO: 35071 - protein, 154 aa, Homo sapiens
  ENSP00000430787
MPGFQTPSEFLENPSQSSRLTAPFRKHVRPKKQHEIRRLGEGHLSRFMALGLGLMVKSIEGDQRLVERAQRLDQELLQALEKEEKRNPQICAAGATASGARSPAATESGCPSGPRGPGEPCGGLLQPGSTACPTGGDAYSTGPAAVPSGTGFPC

SEQ ID NO: 35072 - protein, 139 aa, Homo sapiens
  ENSP00000429800
  MOD_RES (1)..(1): Any amino acid
XNPSQSSRLTAPFRKHVRPKKQHEIRRLGELVKKLSDFTGCTQVVDVGSGQGHLSRFMALGLGLMVKSIEGDQRLVERAQRLDQELLQALEKEEKRNPQVVQTSPRHSPHHVVRYVQRGLQRVGLDPQLPLNLAALQAH

SEQ ID NO: 35073 - protein, 236 aa, Homo sapiens
  ENSP00000481178
MIFRVSAEGSQACAKGCELCSEVNGCLKCSPKLFILLERNDIRQVGVCLPSCPPGYFDARNPDMNKCIKCKIEHCEACFSHNFCTKCKEGLYLHKGRCYPACPEGSSAANGTMECSSPAQCEMSEWSPWGPCSKKQQLCGFRRGSEERTRRVLHAPVGDHAACSDTKETRRCTVRRVPCPEGQKRRKGGQGRRENANRNLARKESKEAGAGSRRRKGQQQQQQQGTVGPLTSAGPA

SEQ ID NO: 35074 - protein, 200 aa, Homo sapiens
  ENSP00000479832
MRLGLCVVALVLSWTHLTISSRGIKGKRQRRISAEGSQACAKGCELCSEVNGCLKCSPKLFILLERNDIRQVGVCLPSCPPGYFDARNPDMNKCIKCKIEHCEACFSHNFCTKCKEGLYLHKGRCYPACPEGSSAANGTMECSSPGQKRRKGGQGRRENANRNLARKESKEAGAGSRRRKGQQQQQQQGTVGPLTSAGPA

SEQ ID NO: 35075 - protein, 263 aa, Homo sapiens
  ENSP00000348944
MRLGLCVVALVLSWTHLTISSRGIKGKRQRRISAEGSQACAKGCELCSEVNGCLKCSPKLFILLERNDIRQVGVCLPSCPPGYFDARNPDMNKCIKCKIEHCEACFSHNFCTKCKEGLYLHKGRCYPACPEGSSAANGTMECSSPAQCEMSEWSPWGPCSKKQQLCGFRRGSEERTRRVLHAPVGDHAACSDTKETRRCTVRRVPCPEGQKRRKGGQGRRENANRNLARKESKEAGAGSRRRKGQQQQQQQGTVGPLTSAGPA

SEQ ID NO: 35076 - protein, 263 aa, Homo sapiens; identical to SEQ ID NO: 35075
  ENSP00000383846

SEQ ID NO: 35077 - protein, 176 aa, Homo sapiens
  ENSP00000428940
MRQYGECLHSCPSGYYGHRAPDMNRCARCRIENCDSCFSKDFCTKCKVGFYLHRGRCFDECPDGFAPLEETMECVEGCEVGHWSEWGTCSRNNRTCGFKWGLETRTRQIVKKPVKDTILCPTIAESRRCKMTMRHCPGGKRTPKAKEKRNKKKKRKLIERAQEQHSVFLATDRANQ

SEQ ID NO: 35078 - protein, 179 aa, Homo sapiens
  ENSP00000427937
MQFRLFSFALIILNCMDYSHCQGNRWRRSKRGCRIENCDSCFSKDFCTKCKVGFYLHRGRCFDECPDGFAPLEETMECVGCEVGHWSEWGTCSRNNRTCGFKWGLETRTRQIVKKPVKDTILCPTIAESRRCKMTMRHCPGGKRTPKAKEKRNKKKKRKLIERAQEQHSVFLATDRANQ

SEQ ID NO: 35079 - protein, 243 aa, Homo sapiens
  ENSP00000276659
MQFRLFSFALIILNCMDYSHCQGNRWRRSKRASYVSNPICKGCLSCSKDNGCSRCQQKLFFFLRREGMRQYGECLHSCPSGYYGHRAPDMNRCARCRIENCDSCFSKDFCTKCKVGFYLHRGRCFDECPDGFAPLEETMECVEGCEVGHWSEWGTCSRNNRTCGFKWGLETRTRQIVKKPVKDTILCPTIAESRRCKMTMRHCPGGKRTPKAKEKRNKKKKRKLIERAQEQHSVFLATDRANQ

SEQ ID NO: 35080 - protein, 168 aa, Homo sapiens
  ENSP00000428614
MRQYGECLHSCPSGYYGHRAPDMNRCARCRIENCDSCFSKDFCTKCKVGFYLHRGRCFDECPDGFAPLEETMECVEGCEVGHWSEWGTCSRNNRTCGFKWGLETRTRQIVKKPVKDTILCPTIAESRRCKMTMRHCPGGKRTPKAKEKRNKKKKRKLIERAQEQHSVF

SEQ ID NO: 35081 - protein, 89 aa, Homo sapiens
  ENSP00000430485
MRQYGECLHSCPSGYYGHRAPDMNRCARCRIENCDSCFSKDFCTKCKVGFYLHRGRCFDECPDGFAPLEETMECVEGCEVGHWSEWGTC

SEQ ID NO: 35082 - protein, 121 aa, Homo sapiens
  ENSP00000430010
MQFRLFSFALIILNCMDYSHCQGNRWRRSKRASYVSNPICKGCLSCSKDNGCSRCQQKLFFFLRREGMRQYGECLHSCPSGYYGHRAPDMNRCARCRIENCDSCFSKDFCTKCKVGFYLHR

SEQ ID NO: 35083 - protein, 89 aa, Homo sapiens
  ENSP00000429159
MDLASYVSNPICKGCLSCSKDNGCSRCQQKLFFFLRREGMRQYGECLHSCPSGYYGHRAPDMNRCARCRIENCDSCFSKDFCTKCKVGF

SEQ ID NO: 35084 - protein, 76 aa, Homo sapiens
  ENSP00000430973
MQFRLFSFALIILNCMDYSHCQGNRWRRSKRASYVSNPICKGCLSCSKDNGCSRCQQKLFFFLRREGMRQYGECLH

SEQ ID NO: 35085 - protein, 234 aa, Homo sapiens
  ENSP00000217260
MRAPLCLLLLVAHAVDMLALNRRKKQVGTGLGGNCTGCIICSEENGCSTCQQRLFLFIRREGIRQYGKCLHDCPPGYFGIRGQEVNRCKKCGATCESCFSQDFCIRCKRQFYLYKGKCLPTCPPGTLAHQNTRECQGECELGPWGGWSPCTHNGKTCGSAWGLESRVREAGRAGHEEAATCQVLSESRKCPIQRPCPGERSPGQKKGRKDRRPRKDRKLDRRLDVRPRQPGLQP

SEQ ID NO: 35086 - protein, 172 aa, Homo sapiens
  ENSP00000383475
MRAPLCLLLLVAHAVDMLALNRRKKQVGTGLGGNCTGCIICSEENGCSTCQQRLFLFIRREGIRQYGKCLHDCPPGYFGIRGQEVNRCKKCGATCESCFSQDFCIRCKRQFYLYKGKCLPTCPPGTLAHQNTRECQERSPGQKKGRKDRRPRKDRKLDRRLDVRPRQPGLQP

SEQ ID NO: 35087 - protein, 193 aa, Homo sapiens
  ENSP00000378525
MPFLPAIDLLYWRDIKQTGIVFGSFLLLLFSLTQFSVVSVVAYLALAALSATISFRIYKSVLQAVQKTDEGHPFKAYLELEITLSQEQIQKYTDCLQFYVNSTLKELRRLFLVQDLVDSLKFAVLMWLLTYVGALFNGLTLLLMAVVSMFTLPVVYVKHQAQIDQYLGLVRTHINAVVAKIQAKIPGAKRHAE

SEQ ID NO: 35088 - protein, 208 aa, Homo sapiens
  ENSP00000340716
MQATADSTKMDCVWSNWKSQAIDLLYWRDIKQTGIVFGSFLLLLFSLTQFSVVSVVAYLALAALSATISFRIYKSVLQAVQKTDEGHPFKAYLELEITLSQEQIQKYTDCLQFYVNSTLKELRRLFLVQDLVDSLKFAVLMWLLTYVGALFNGLTLLLMAVVSMFTLPVVYVKHQAQIDQYLGLVRTHINAVVAKIQAKIPGAKRHAE

SEQ ID NO: 35089 - protein, 776 aa, Homo sapiens
  ENSP00000267484
MAAPGDPQDELLPLAGPGSQWLRHRGEGENEAVTPKGATPAPQAGEPSPGLGARAREAASREAGSGPARQSPVAMETASTGVAGVSSAMDHTFSTTSKDGEGSCYTSLISDICYPPQEDSTYFTGILQKENGHVTISESPEELGTPGPSLPDVPGIESRGLFSSDSGIEMTPAESTEVNKILADPLDQMKAEAYKYIDITRPEEVKHQEQHHPELEDKDLDFKNKDTDISIKPEGVREPDKPAPVEGKIIKDHLLEESTFAPYIDDLSEEQRRAPQITTPVKITLTEIEPSVETTTQEKTPEKQDICLKPSPDTVPTVTVSEPEDDSPGSITPPSSGTEPSAAESQGKGSISEDELITAIKEAKGLSYETAENPRPVGQLADRPEVKARSGPPTIPSPLDHEASSAESGDSEIELVSEDPMAAEDALPSGYVSFGHVGGPPPSPASPSIQYSILREEREAELDSELIIESCDASSASEESPKREQDSPPMKPSALDAIREETGVRAEERAPSRRGLAEPGSFLDYPSTEPQPGPELPPGDGALEPETPMLPRKPEEDSSSNQSPAATKGPGPLGPGAPPPLLFLNKQKAIDLLYWRDIKQTGIVFGSFLLLLFSLTQFSVVSVVAYLALAALSATISFRIYKSVLQAVQKTDEGHPFKAYLELEITLSQEQIQKYTDCLQFYVNSTLKELRRLFLVQDLVDSLKFAVLMWLLTYVGALFNGLTLLLMAVVSMFTLPVVYVKHQAQIDQYLGLVRTHINAVVAKIQAKIPGAKRHAE

SEQ ID NO: 35090 - protein, 702 aa, Homo sapiens
  ENSP00000483039
METASTGVAGVSSAMDHTFSTTSKDGEGSCYTSLISDICYPPQEDSTYFTGILQKENGHVTISESPEELGTPGPSLPDVPGIESRGLFSSDSGIEMTPAESTEVNKILADPLDQMKAEAYKYIDITRPEEVKHQEQHHPELEDKDLDFKNKDTDISIKPEGVREPDKPAPVEGKIIKDHLLEESTFAPYIDDLSEEQRRAPQITTPVKITLTEIEPSVETTTQEKTPEKQDICLKPSPDTVPTVTVSEPEDDSPGSITPPSSGTEPSAAESQGKGSISEDELITAIKEAKGLSYETAENPRPVGQLADRPEVKARSGPPTIPSPLDHEASSAESGDSEIELVSEDPMAAEDALPSGYVSFGHVGGPPPSPASPSIQYSILREEREAELDSELIIESCDASSASEESPKREQDSPPMKPSALDAIREETGVRAEERAPSRRGLAEPGSFLDYPSTEPQPGPELPPGDGALEPETPMLPRKPEEDSSSNQSPAATKGPGPLGPGAPPPLLFLNKQKAIDLLYWRDIKQTGIVFGSFLLLLFSLTQFSVVSVVAYLALAALSATISFRIYKSVLQAVQKTDEGHPFKAYLELEITLSQEQIQKYTDCLQFYVNSTLKELRRLFLVQDLVDSLKFAVLMWLLTYVGALFNGLTLLLMAVVSMFTLPVVYVKHQAQIDQYLGLVRTHINAVVAKIQAKIPGAKRHAE

SEQ ID NO: 35091 - protein, 193 aa, Homo sapiens; identical to SEQ ID NO: 35087
  ENSP00000378525

SEQ ID NO: 35092 - protein, 208 aa, Homo sapiens; identical to SEQ ID NO: 35088
  ENSP00000340716

SEQ ID NO: 35093 - protein, 776 aa, Homo sapiens; identical to SEQ ID NO: 35089
  ENSP00000267484

SEQ ID NO: 35094 - protein, 702 aa, Homo sapiens; identical to SEQ ID NO: 35090
  ENSP00000483039

SEQ ID NO: 35095 - protein, 493 aa, Homo sapiens
  ENSP00000396872
  MOD_RES (1)..(1): Any amino acid
XYRGWVGVSGRLHPSLTVWAQNLPFLRGSRLLAWVLWLQAWQVAAPCPGACVCYNEPKVTTSCPQQGLQAVPVGIPAASQRIFLHGNRISHVPAASFRACRNLTILWLHSNVLARIDAAAFTGLALLEQLDLSDNAQLRSVDPATFHGLGRLHTLHLDRCGLQELGPGLFRGLAALQYLYLQDNALQALPDDTFRDLGNLTHLFLHGNRISSVPERAFRGLHSLDRLLLHQNRVAHVHPHAFRDLGRLMTLYLFANNLSALPTEALAPLRALQYLRLNDNPWVCDCRARPLWAWLQKFRGSSSEVPCSLPQRLAGRDLKRLAANDLQGCAVATGPYHPIWTGRATDEEPLGLPKCCQPDAADKASVLEPGRPASAGNALKGRVPPGDSPPGNGSGPRHINDSPFGTLPGSAEPPLTAVRPEGSEPPGFPTSGPRRRPGCSRKNRTRSHCRLGQAGSGGGGTGDSEGSGALPSLTCSLTPLGLALVLWTVLGPC

SEQ ID NO: 35096 - protein, 473 aa, Homo sapiens
  ENSP00000043402
MKRASAGGSRLLAWVLWLQAWQVAAPCPGACVCYNEPKVTTSCPQQGLQAVPVGIPAASQRIFLHGNRISHVPAASFRACRNLTILWLHSNVLARIDAAAFTGLALLEQLDLSDNAQLRSVDPATFHGLGRLHTLHLDRCGLQELGPGLFRGLAALQYLYLQDNALQALPDDTFRDLGNLTHLFLHGNRISSVPERAFRGLHSLDRLLLHQNRVAHVHPHAFRDLGRLMTLYLFANNLSALPTEALAPLRALQYLRLNDNPWVCDCRARPLWAWLQKFRGSSSEVPCSLPQRLAGRDLKRLAANDLQGCAVATGPYHPIWTGRATDEEPLGLPKCCQPDAADKASVLEPGRPASAGNALKGRVPPGDSPPGNGSGPRHINDSPFGTLPGSAEPPLTAVRPEGSEPPGFPTSGPRRRPGCSRKNRTRSHCRLGQAGSGGGGTGDSEGSGALPSLTCSLTPLGLALVLWTVLGPC

SEQ ID NO: 35097 - protein, 559 aa, Homo sapiens
  ENSP00000403535
  MOD_RES (1)..(1): Any amino acid
XVEEGAGCLGGCGTRLLLSPGHTCPPPPPSGIQAPVFEIDVPRGTPAPLQCFLGPVGGTPTGTPRGLLQCGLCVHWSPEEVPAVTSVHSRRPSRSRLLAWVLWLQAWQVAAPCPGACVCYNEPKVTTSCPQQGLQAVPVGIPAASQRIFLHGNRISHVPAASFRACRNLTILWLHSNVLARIDAAAFTGLALLEQLDLSDNAQLRSVDPATFHGLGRLHTLHLDRCGLQELGPGLFRGLAALQYLYLQDNALQALPDDTFRDLGNLTHLFLHGNRISSVPERAFRGLHSLDRLLLHQNRVAHVHPHAFRDLGRLMTLYLFANNLSALPTEALAPLRALQYLRLNDNPWVCDCRARPLWAWLQKFRGSSSEVPCSLPQRLAGRDLKRLAANDLQGCAVATGPYHPIWTGRATDEEPLGLPKCCQPDAADKASVLEPGRPASAGNALKGRVPPGDSPPGNGSGPRHINDSPFGTLPGSAEPPLTAVRPEGSEPPGFPTSGPRRRPGCSRKNRTRSHCRLGQAGSGGGGTGDSEGSGALPSLTCSLTPLGLALVLWTVLGPC

SEQ ID NO: 35098 - protein, 441 aa, Homo sapiens
  ENSP00000330631
MLRKGCCVELLLLLVAAELPLGGGCPRDCVCYPAPMTVSCQAHNFAAIPEGIPVDSERVFLQNNRIGLLQPGHFSPAMVTLWIYSNNITYIHPSTFEGFVHLEELDLGDNRQLRTLAPETFQGLVKLHALYLYKCGLSALPAGVFGGLHSLQYLYLQDNHIEYLQDDIFVDLVNLSHLFLHGNKLWSLGPGTFRGLVNLDRLLLHENQLQWVHHKAFHDLRRLTTLFLFNNSLSELQGECLAPLGALEFLRLNGNPWDCGCRARSLWEWLQRFRGSSSAVPCVSPGLRHGQDLKLLRAEDFRNCTGPASPHQIKSHTLTTTDRAARKEHHSPHGPTRSKGHPHGPRPGHRKPGKNCTNPRNRNQISKAGAGKQAPELPDYAPDYQHKFSFDIMPTARPKRKGKCARRTPIRAPSGVQQASSASSLGASLLAWTLGLAVTLR

SEQ ID NO: 35099 - protein, 420 aa, Homo sapiens
  ENSP00000335397
MLPGLRRLLQAPASACLLLMLLALPLAAPSCPMLCTCYSSPPTVSCQANNFSSVPLSLPPSTQRLFLQNNLIRTLRPGTFGSNLLTLWLFSNNLSTIYPGTFRHLQALEELDLGDNRHLRSLEPDTFQGLERLQSLHLYRCQLSSLPGNIFRGLVSLQYLYLQENSLLHLQDDLFADLANLSHLFLHGNRLRLLTEHVFRGLGSLDRLLLHGNRLQGVHRAAFRGLSRLTILYLFNNSLASLPGEALADLPSLEFLRLNANPWACDCRARPLWAWFQRARVSSSDVTCATPPERQGRDLRALREADFQACPPAAPTRPGSRARGNSSSNHLYGVAEAGAPPADPSTLYRDLPAEDSRGRQGGDAPTEDDYWGGYGGEDQRGEQMCPGAACQAPPDSRGPALSAGLPSPLLCLLLLVPHHL

SEQ ID NO: 35100 - protein, 204 aa, Homo sapiens
  ENSP00000435606
MLPGLRRLLQAPASACLLLMLLALPLAAPSCPMLCTCYSSPPTVSCQANNFSSVPLSLPPSTQRLFLQNNLIRTLRPGTFGSNLLTLWLFSNNLSTIYPGTFRHLQALEELDLGDNRHLRSLEPDTFQGLERLQSLHLYRCQLSSLPGNIFRGLVSLQYLYLQENSLLHLQGKKEKGKSLLCSWRMDALKMEGIPVIVIHCYYY

SEQ ID NO: 35101 - protein, 193 aa, Homo sapiens
  ENSP00000378552
MLPGLRRLLQAPASACLLLMLLALPLAAPSCPMLCTCYSSPPTVSCQANNFSSVPLSLPPSTQRLFLQNNLIRTLRPGTFGSNLLTLWLFSNNLSTIYPGTFRHLQALEELDLGDNRHLRSLEPDTFQGLERLQSLHLYRCQLSSLPGNIFRGLVSLQYLYLQENSLLHLQGPLPKGLCSCFSHPPSSLPTSR

SEQ ID NO: 35102 - protein, 662 aa, Homo sapiens
  ENSP00000374558
MVSQSTVRQDSPVEPWEGISDHSGIIDGSPRLLNTDHPPCQLDIRLMRHKAVWINPQDVQQQPQDLQSQVPAAGNSGTHFVTDAASPSGPSPSCLGDSLAETTLSEDTTDSVGSASPHGSSEKSSSFSLSSTEVHMVRPGYSHRVSLPTSPGILATSPYPETDSAFFEPSHLTSAADEGAVQVSRRTISSNSFSPEVFVLPVDVEKENAHFYVADMIISAMEKMKCNILSQQQTESWSKEVSGLLGSDQPDSEMTFDTNIKQESGSSTSSYSGYEGCAVLQVSPVTETRTYHDVKEICKCDVDEFVILELGDFNDITETCSCSCSSSKSVTYEPDFNSAELLAKELYRVFQKCWILSVVNSQLAGSLSAAGSIVVNEECVRKDFESSMNVVQEIKFKSRIRGTEDWAPPRFQIIFNIHPPLKRDLVVAAQNFFCAGCGTPVEPKFVKRLRYCEYLGKYFCDCCHSYAESCIPARILMMWDFKKYYVSNFSKQLLDSIWHQPIFNLLSIGQSLYAKAKELDRVKEIQEQLFHIKKLLKTCRFANSALKEFEQVPGHLTDELHLFSLEDLVRIKKGLLAPLLKDILKASLAHVAGCELCQGKGFICEFCQNTTVIFPFQTATCRRCSACRACFHKQCFQSSECPRCARITARRKLLESVASAAT

SEQ ID NO: 35103 - protein, 595 aa, Homo sapiens
  ENSP00000368061
MVSNHYFLLCVNLPLREIHTPGPSPSCLGDSLAETTLSEDTTDSVGSASPHGSSEKSSSFSLSSTEVHMVRPGYSHRVSLPTSPGILATSPYPETDSAFFEPSHLTSAADEGAVQVSRRTISSNSFSPEVFVLPVDVEKENAHFYVADMIISAMEKMKCNILSQQQTESWSKEVSGLLGSDQPDSEMTFDTNIKQESGSSTSSYSGYEGCAVLQVSPVTETRTYHDVKEICKCDVDEFVILELGDFNDITETCSCSCSSSKSVTYEPDFNSAELLAKELYRVFQKCWILSVVNSQLAGSLSAAGSIVVNEECVRKDFESSMNVVQEIKFKSRIRGTEDWAPPRFQIIFNIHPPLKRDLVVAAQNFFCAGCGTPVEPKFVKRLRYCEYLGKYFCDCCHSYAESCIPARILMMWDFKKYYVSNFSKQLLDSIWHQPIFNLLSIGQSLYAKAKELDRVKEIQEQLFHIKKLLKTCRFANSALKEFEQVPGHLTDELHLFSLEDLVRIKKGLLAPLLKDILKASLAHVAGCELCQGKGFICEFCQNTTVIFPFQTATCRRCSACRACFHKQCFQSSECPRCARITARRKLLESVASAAT

SEQ ID NO: 35104 - protein, 287 aa, Homo sapiens
  ENSP00000412507
MVSQSTVRQDSPVEPWEGISDHSGIIDGSPRLLNTDHPPCQLDIRLMRHKAVWINPQDVQQQPQDLQSQVPAAGNSGTHFVTDAASPSGPSPSCLGDSLAETTLSEDTTDSVGSASPHGSSEKSSSFSLSSTEVHMVRPGYSHRVSLPTSPGILATSPYPETDSAFFEPSHLTSAADEGAVQVSRRTISSNSFSPEVFVLPVDVEKENAHFYVADMIISAMEKMKCNILSQQQTESWSKEVSGLLGSDQPDSEMTFDTNIKQESGSSTSSYSGYEGKLCCVTGQPSD

SEQ ID NO: 35105 - protein, 635 aa, Homo sapiens
  ENSP00000368064
MVSQSTVRQDSPVEPWEGISDHSGIIDGSPRLLNTDHPPCQLDIRLMRHKAVWINPQDVQQQPQDLQSQVPAAGNSGTHFVTDAASPSGPSPSCLGDSLAETTLSEDTTDSVGSASPHGSSEKSSSFSLSSTEVHMVRPGYSHRVSLPTSPGILATSPYPETDSAFFEPSHLTSAADEGAVQVSRRTISSNSFSPEVFVLPVDVEKENAHFYVADMIISAMEKMKCNILSQQQTESWSKEVSGLLGSDQPDSEMTFDTNIKQESGSSTSSYSGYEGCAVLQVSPVTETRTYHDVKEICKCDVDEFVILELGDFNDITETCSCSCSSSKSVTYEPDFNSAELLAKELYRVFQKCWILSVVNSQLAGSLSAAGSIVVNEECVRKDFESSMNVVQEIKFKSRIRGTEDWAPPRFQIIFNIHPPLKRDLVVAAQNFFCAGCGTPVEPKFVKRLRYCEYLGKYFCDCCHSYAESCIPARILMMWDFKKYYVSNFSKQLLDSIWHQPIFNLLSIGQSLYAKAKELDRVKEIQEQLFHIKKLLKTCRFANSCVKERALFVNFARIRLSSSHFRQQHVEDVQRAGLAFTNSASSPPSAPGVRGSQRGENFWKVWPLQQHDAPEYCEKDCSTCLMITPICVYYW

SEQ ID NO: 35106 - protein, 505 aa, Homo sapiens
  ENSP00000386578
MVSNHYFLLCVNLPLREIHTPGAVQVSRRTISSNSFSPEVFVLPVDVEKENAHFYVADMIISAMEKMKCNILSQQQTESWSKEVSGLLGSDQPDSEMTFDTNIKQESGSSTSSYSGYEGCAVLQVSPVTETRTYHDVKEICKCDVDEFVILELGDFNDITETCSCSCSSSKSVTYEPDFNSAELLAKELYRVFQKCWILSVVNSQLAGSLSAAGSIVVNEECVRKDFESSMNVVQEIKFKSRIRGTEDWAPPRFQIIFNIHPPLKRDLVVAAQNFFCAGCGTPVEPKFVKRLRYCEYLGKYFCDCCHSYAESCIPARILMMWDFKKYYVSNFSKQLLDSIWHQPIFNLLSIGQSLYAKAKELDRVKEIQEQLFHIKKLLKTCRFANSALKEFEQVPGHLTDELHLFSLEDLVRIKKGLLAPLLKDILKASLAHVAGCELCQGKGFICEFCQNTTVIFPFQTATCRRCSACRACFHKQCFQSSECPRCARITARRKLLESVASAAT

SEQ ID NO: 35107 - protein, 527 aa, Homo sapiens
  ENSP00000485932
MVRPGYSHRVSLPTSPGILATSPYPETDSAFFEPSHLTSAADEGAVQVSRRTISSNSFSPEVFVLPVDVEKENAHFYVADMIISAMEKMKCNILSQQQTESWSKEVSGLLGSDQPDSEMTFDTNIKQESGSSTSSYSGYEGCAVLQVSPVTETRTYHDVKEICKCDVDEFVILELGDFNDITETCSCSCSSSKSVTYEPDFNSAELLAKELYRVFQKCWILSVVNSQLAGSLSAAGSIVVNEECVRKDFESSMNVVQEIKFKSRIRGTEDWAPPRFQIIFNIHPPLKRDLVVAAQNFFCAGCGTPVEPKFVKRLRYCEYLGKYFCDCCHSYAESCIPARILMMWDFKKYYVSNFSKQLLDSIWHQPIFNLLSIGQSLYAKAKELDRVKEIQEQLFHIKKLLKTCRFANSALKEFEQVPGHLTDELHLFSLEDLVRIKKGLLAPLLKDILKASLAHVAGCELCQGKGFICEFCQNTTVIFPFQTATCRRCSACRACFHKQCFQSSECPRCARITARRKLLESVASAAT

SEQ ID NO: 35108 - protein, 129 aa, Homo sapiens
  ENSP00000402357
MVRPGYSHRVSLPTSPGILATSPYPETDSAFFEPSHLTSAADEGAVQVSRRTISSNSFSPEVFVLPVDVEKENAHFYVADMIISAMEKMKCNILSQQQTESWSKEVSGLLGSDQPDSEMTFDTNIKQES

SEQ ID NO: 35109 - protein, 178 aa, Homo sapiens
  ENSP00000414579
MVSQSTVRQDSPVEPWEGISDHSGIIDGSPRLLNTDHPPCQLDIRLMRHKAVWINPQDVQQQPQDLQSQVPAAGNSGTHFVTDAASPSGPSPSCLGDSLAETTLSEDTTDSVGSASPHGSSEKSSSFSLSSTEVHMVRPGYSHRVSLPTSPGILATSPYPETDSAFFEPSHLTSAADE

SEQ ID NO: 35110 - protein, 447 aa, Homo sapiens
  ENSP00000368074
MIISAMEKMKCNILSQQQTESWSKEVSGLLGSDQPDSEMTFDTNIKQESGSSTSSYSGYEGCAVLQVSPVTETRTYHDVKEICKCDVDEFVILELGDFNDITETCSCSCSSSKSVTYEPDFNSAELLAKELYRVFQKCWILSVVNSQLAGSLSAAGSIVVNEECVRKDFESSMNVVQEIKFKSRIRGTEDWAPPRFQIIFNIHPPLKRDLVVAAQNFFCAGCGTPVEPKFVKRLRYCEYLGKYFCDCCHSYAESCIPARILMMWDFKKYYVSNFSKQLLDSIWHQPIFNLLSIGQSLYAKAKELDRVKEIQEQLFHIKKLLKTCRFANSALKEFEQVPGHLTDELHLFSLEDLVRIKKGLLAPLLKDILKASLAHVAGCELCQGKGFICEFCQNTTVIFPFQTATCRRCSACRACFHKQCFQSSECPRCARITARRKLLESVASAAT

SEQ ID NO: 35111 - protein, 505 aa, Homo sapiens; identical to SEQ ID NO: 35106
  ENSP00000368057

SEQ ID NO: 35112 - protein, 662 aa, Homo sapiens; identical to SEQ ID NO: 35102
  ENSP00000396935

SEQ ID NO: 35113 - protein, 604 aa, Homo sapiens
  ENSP00000428543
MISVKRNTWRALSLVIGDCRKKGNFEYCQDRTEKHSTMPDSPVDVKTQSRLTPPTMPPPPTTQGAPRTSSFTPTTLTNGTSHSPTALNGAPSPPNGFSNGPSSSSSSSLANQQLPPACGARQLSKLKRFLTTLQQFGNDISPEIGERVRTLVLGLVNSTLTIEEFHSKLQEATNFPLRPFVIPFLKANLPLLQRELLHCARLAKQNPAQYLAQHEQLLLDASTTSPVDSSELLLDVNENGKRRTPDRTKENGFDREPLHSEHPSKRPCTISPGQRYSPNNGLSYQPNGLPHPTPPPPQHYRLDDMAIAHHYRDSYRHPSHRDLRDRNRPMGLHGTRQEEMIDHRLTDREWAEEWKHLDHLLNCIMDMVEKTRRSLTVLRRCQEADREELNYWIRRYSDAEDLKKGGGSSSSHSRQQSPVNPDPVALDAHREFLHRPASGYVPEEIWKKAEEAVNEVKRQAMTELQKAVSEAERKAHDMITTERAKMERTVAEAKRQAAEDALAVINQQEDSSESCWNCGRKASETCSGCNTARYCGSFCQHKDWEKHHHICGQTLQAQQQGDTPAVSSSVTPNSGAGSPMDTPPAATPRSTTPGTPSTIETTPR

SEQ ID NO: 35114 - protein, 577 aa, Homo sapiens
  ENSP00000379520
MPDRTEKHSTMPDSPVDVKTQSRLTPPTMPPPPTTQGAPRTSSFTPTTLTNGTSHSPTALNGAPSPPNGFSNGPSSSSSSSLANQQLPPACGARQLSKLKRFLTTLQQFGNDISPEIGERVRTLVLGLVNSTLTIEEFHSKLQEATNFPLRPFVIPFLKANLPLLQRELLHCARLAKQNPAQYLAQHEQLLLDASTTSPVDSSELLLDVNENGKRRTPDRTKENGFDREPLHSEHPSKRPCTISPGQRYSPNNGLSYQPNGLPHPTPPPPQHYRLDDMAIAHHYRDSYRHPSHRDLRDRNRPMGLHGTRQEEMIDHRLTDREWAEEWKHLDHLLNCIMDMVEKTRRSLTVLRRCQEADREELNYWIRRYSDAEDLKKGGGSSSSHSRQQSPVNPDPVALDAHREFLHRPASGYVPEEIWKKAEEAVNEVKRQAMTELQKAVSEAERKAHDMITTERAKMERTVAEAKRQAAEDALAVINQQEDSSESCWNCGRKASETCSGCNTARYCGSFCQHKDWEKHHHICGQTLQAQQQGDTPAVSSSVTPNSGAGSPMDTPPAATPRSTTPGTPSTIETTPR

SEQ ID NO: 35115 - protein, 567 aa, Homo sapiens
  ENSP00000353504
MPDSPVDVKTQSRLTPPTMPPPPTTQGAPRTSSFTPTTLTNGTSHSPTALNGAPSPPNGFSNGPSSSSSSSLANQQLPPACGARQLSKLKRFLTTLQQFGNDISPEIGERVRTLVLGLVNSTLTIEEFHSKLQEATNFPLRPFVIPFLKANLPLLQRELLHCARLAKQNPAQYLAQHEQLLLDASTTSPVDSSELLLDVNENGKRRTPDRTKENGFDREPLHSEHPSKRPCTISPGQRYSPNNGLSYQPNGLPHPTPPPPQHYRLDDMAIAHHYRDSYRHPSHRDLRDRNRPMGLHGTRQEEMIDHRLTDREWAEEWKHLDHLLNCIMDMVEKTRRSLTVLRRCQEADREELNYWIRRYSDAEDLKKGGGSSSSHSRQQSPVNPDPVALDAHREFLHRPASGYVPEEIWKKAEEAVNEVKRQAMTELQKAVSEAERKAHDMITTERAKMERTVAEAKRQAAEDALAVINQQEDSSESCWNCGRKASETCSGCNTARYCGSFCQHKDWEKHHHICGQTLQAQQQGDTPAVSSSVTPNSGAGSPMDTPPAATPRSTTPGTPSTIETTPR

SEQ ID NO: 35116 - protein, 567 aa, Homo sapiens; identical to SEQ ID NO: 35115
  ENSP00000390137

SEQ ID NO: 35117 - protein, 615 aa, Homo sapiens
  ENSP00000428742
MCHPDKAFTSDKLQCVFNEYKAAVWVPPRPRPLSRAPLPEDRTEKHSTMPDSPVDVKTQSRLTPPTMPPPPTTQGAPRTSSFTPTTLTNGTSHSPTALNGAPSPPNGFSNGPSSSSSSSLANQQLPPACGARQLSKLKRFLTTLQQFGNDISPEIGERVRTLVLGLVNSTLTIEEFHSKLQEATNFPLRPFVIPFLKANLPLLQRELLHCARLAKQNPAQYLAQHEQLLLDASTTSPVDSSELLLDVNENGKRRTPDRTKENGFDREPLHSEHPSKRPCTISPGQRYSPNNGLSYQPNGLPHPTPPPPQHYRLDDMAIAHHYRDSYRHPSHRDLRDRNRPMGLHGTRQEEMIDHRLTDREWAEEWKHLDHLLNCIMDMVEKTRRSLTVLRRCQEADREELNYWIRRYSDAEDLKKGGGSSSSHSRQQSPVNPDPVALDAHREFLHRPASGYVPEEIWKKAEEAVNEVKRQAMTELQKAVSEAERKAHDMITTERAKMERTVAEAKRQAAEDALAVINQQEDSSESCWNCGRKASETCSGCNTARYCGSFCQHKDWEKHHHICGQTLQAQQQGDTPAVSSSVTPNSGAGSPMDTPPAATPRSTTPGTPSTIETTPR

SEQ ID NO: 35118 - protein, 577 aa, Homo sapiens; identical to SEQ ID NO: 35114
  ENSP00000430728

SEQ ID NO: 35119 - protein, 127 aa, Homo sapiens
  ENSP00000430778
  MOD_RES (1)..(1): Any amino acid
XLDDMAIAHHYRDSYRHPSHRDLRDRNRPMGLHGTRQEEMIDHRLTDREWAEEWKHLDHLLNCIMDMVEKTRRSLTVLRRCQEADREELNYWIRRYSDAEDLKKGGGSSSSHSRQQSPVNPDPVALG

SEQ ID NO: 35120 - protein, 30 aa, Homo sapiens
  ENSP00000429085
  MOD_RES (1)..(1): Any amino acid
XLLRAASRCERKREEANSRQMNKLRSREVK

SEQ ID NO: 35121 - protein, 31 aa, Homo sapiens
  ENSP00000430863
ASRCERKREEANSRQLFSHQLFPSISYLNVL

SEQ ID NO: 35122 - protein, 210 aa, Homo sapiens
  ENSP00000429728
MPDSPVDVKTQSRLTPPTMPPPPTTQGAPRTSSFTPTTLTNGTSHSPTALNGAPSPPNGFSNGPSSSSSSSLANQQLPPACGARQLSKLKRFLTTLQQFGNDISPEIGERVRTLVLGLVNSTLTIEEFHSKLQEATNFPLRPFVIPFLKANLPLLQRELLHCARLAKQNPAQYLAQHEQLLLDASTTSPVDSSELLLDVNENGKRRTPDR

SEQ ID NO: 35123 - protein, 229 aa, Homo sapiens
  ENSP00000431094
MISVKRNTWRALSLVIGDCRKKGNFEYCQDRTEKHSTMPDSPVDVKTQSRLTPPTMPPPPTTQGAPRTSSFTPTTLTNGTSHSPTALNGAPSPPNGFSNGPSSSSSSSLANQQLPPACGARQLSKLKRFLTTLQQFGNDISPEIGERVRTLVLGLVNSTLTIEEFHSKLQEATNFPLRPFVIPFLKANLPLLQRELLHCARLAKQNPAQYLAQHEQLLLDASTTSPVDS

SEQ ID NO: 35124 - protein, 171 aa, Homo sapiens
  ENSP00000427763
MPDSPVDVKTQSRLTPPTMPPPPTTQGAPRTSSFTPTTLTNGTSHSPTALNGAPSPPNGFSNGPSSSSSSSLANQQLPPACGARQLSKLKRFLTTLQQFGNDISPEIGERVRTLVLGLVNSTLTIEEFHSKLQEATNFPLRPFVIPFLKANLPLLQRELLHCARLAKQNPA

SEQ ID NO: 35125 - protein, 169 aa, Homo sapiens
  ENSP00000430204
MISVKRNTWRALSLVIGDCRKKGNFEYCQDRTEKHSTMPDSPVDVKTQSRLTPPTMPPPPTTQGAPRTSSFTPTTLTNGTSHSPTALNGAPSPPNGFSNGPSSSSSSSLANQQLPPACGARQLSKLKRFLTTLQQFGNDISPEIGERVRTLVLGLVNSTLTIEEFHSKL

SEQ ID NO: 35126 - protein, 120 aa, Homo sapiens
  ENSP00000429940
MPDSPVDVKTQSRLTPPTMPPPPTTQGAPRTSSFTPTTLTNGTSHSPTALNGAPSPPNGFSNGPSSSSSSSLANQQLPPACGARQLSKLKRFLTTLQQFGNDISPEIGERVRTLVLGLVN

SEQ ID NO: 35127 - protein, 156 aa, Homo sapiens
  ENSP00000429532
MISVKRNTWRALSLVIGDCRKKGNFEYCQDRTEKHSTMPDSPVDVKTQSRLTPPTMPPPPTTQGAPRTSSFTPTTLTNGTSHSPTALNGAPSPPNGFSNGPSSSSSSSLANQQLPPACGARQLSKLKRFLTTLQQFGNDISPEIGERVRTLVLGLV

SEQ ID NO: 35128 - protein, 135 aa, Homo sapiens
  ENSP00000429506
MISVKRNTWRALSLVIGDCRKKGNFEYCQDRTEKHSTMPDSPVDVKTQSRLTPPTMPPPPTTQGAPRTSSFTPTTLTNGTSHSPTALNGAPSPPNGFSNGPSSSSSSSLANQQLPPACGARQLSKLKRFLTTLQQ

SEQ ID NO: 35129 - protein, 101 aa, Homo sapiens
  ENSP00000430637
MPDRTEKHSTMPDSPVDVKTQSRLTPPTMPPPPTTQGAPRTSSFTPTTLTNGTSHSPTALNGAPSPPNGFSNGPSSSSSSSLANQQLPPACGARQLSKLKR

SEQ ID NO: 35130 - protein, 91 aa, Homo sapiens
  ENSP00000428100
MPDSPVDVKTQSRLTPPTMPPPPTTQGAPRTSSFTPTTLTNGTSHSPTALNGAPSPPNGFSNGPSSSSSSSLANQQLPPACGARQLSKLKR

SEQ ID NO: 35131 - protein, 88 aa, Homo sapiens
  ENSP00000429137
MPDSPVDVKTQSRLTPPTMPPPPTTQGAPRTSSFTPTTLTNGTSHSPTALNGAPSPPNGFSNGPSSSSSSSLANQQLPPACGARQLSK

SEQ ID NO: 35132 - protein, 120 aa, Homo sapiens
  ENSP00000430070
MISVKRNTWRALSLVIGDCRKKGNFEYCQDRTEKHSTMPDSPVDVKTQSRLTPPTMPPPPTTQGAPRTSSFTPTTLTNGTSHSPTALNGAPSPPNGFSNGPSSSSSSSLANQQLPPACGA

SEQ ID NO: 35133 - protein, 119 aa, Homo sapiens
  ENSP00000429118
MISVKRNTWRALSLVIGDCRKKGNFEYCQDRTEKHSTMPDSPVDVKTQSRLTPPTMPPPPTTQGAPRTSSFTPTTLTNGTSHSPTALNGAPSPPNGFSNGPSSSSSSSLANQQLPPACG

SEQ ID NO: 35134 - protein, 36 aa, Homo sapiens
  ENSP00000430084
MISVKRNTWRALSLVIGDCRKKGNFEYCQDKPHLKN

SEQ ID NO: 35135 - protein, 79 aa, Homo sapiens
  ENSP00000428475
MPDRTEKHSTMPDSPVDVKTQSRLTPPTMPPPPTTQGAPRTSSFTPTTLTNGTSHSPTALNGAPSPPNGFSNGPSSSSS

SEQ ID NO: 35136 - protein, 36 aa, Homo sapiens; identical to SEQ ID NO: 35134
  ENSP00000429653

SEQ ID NO: 35137 - protein, 69 aa, Homo sapiens
  ENSP00000429062
MPDRTEKHSTMPDSPVDVKTQSRLTPPTMPPPPTTQGAPRTSSFTPTTLTNGTSHSPTALNGAPSPPNG

SEQ ID NO: 35138 - protein, 93 aa, Homo sapiens
  ENSP00000429666
MISVKRNTWRALSLVIGDCRKKGNFEYCQDRTEKHSTMPDSPVDVKTQSRLTPPTMPPPPTTQGAPRTSSFTPTTLTNGTSHSPTALNGAPSP

SEQ ID NO: 35139 - protein, 36 aa, Homo sapiens; identical to SEQ ID NO: 35134
  ENSP00000429587

SEQ ID NO: 35140 - protein, 68 aa, Homo sapiens
  ENSP00000429034
MISVKRNTWRALSLVIGDCRKKGNFEYCQGARAQHPASGDAAPAPLMALLSAATHSRTGGMSPERACF

SEQ ID NO: 35141 - protein, 85 aa, Homo sapiens
  ENSP00000429375
MISVKRNTWRALSLVIGDCRKKGNFEYCQDRTEKHSTMPDSPVDVKTQSRLTPPTMPPPPTTQGAPRTSSFTPTTLTNGTSHSPT

SEQ ID NO: 35142 - protein, 46 aa, Homo sapiens
  ENSP00000429864
MPDSPVDVKTQSRLTPPTMPPPPTTQGAPRTSSFTPTTLTNGTSHS

SEQ ID NO: 35143 - protein, 54 aa, Homo sapiens
  ENSP00000430080
MISVKRNTWRALSLVIGDCRKKGNFEYCQDRTEKHSTMPDSPVDVKTQSRLTPP

SEQ ID NO: 35144 - protein, 26 aa, Homo sapiens
  ENSP00000430334
MPDRTEKHSTMPDSPVDVKTQSRLTP

SEQ ID NO: 35145 - protein, 48 aa, Homo sapiens
  ENSP00000429857
MISVKRNTWRALSLVIGDCRKKGNFEYCQDRTEKHSTMPDSPVDVKTQ

SEQ ID NO: 35146 - protein, 58 aa, Homo sapiens
  ENSP00000428133
MISVKRNTWRALSLVIGDCRKKGNFEYCQGARAQHPASGDAAPAPLMALLSAATHSRT

SEQ ID NO: 35147 - protein, 577 aa, Homo sapiens; identical to SEQ ID NO: 35114
  ENSP00000478331

SEQ ID NO: 35148 - protein, 604 aa, Homo sapiens; identical to SEQ ID NO: 35113
  ENSP00000481112

SEQ ID NO: 35149 - protein, 604 aa, Homo sapiens; identical to SEQ ID NO: 35113
  ENSP00000481799

SEQ ID NO: 35150 - protein, 584 aa, Homo sapiens
  ENSP00000480500
MVGLSGPVQYRTEKHSTMPDSPVDVKTQSRLTPPTMPPPPTTQGAPRTSSFTPTTLTNGTSHSPTALNGAPSPPNGFSNGPSSSSSSSLANQQLPPACGARQLSKLKRFLTTLQQFGNDISPEIGERVRTLVLGLVNSTLTIEEFHSKLQEATNFPLRPFVIPFLKANLPLLQRELLHCARLAKQNPAQYLAQHEQLLLDASTTSPVDSSELLLDVNENGKRRTPDRTKENGFDREPLHSEHPSKRPCTISPGQRYSPNNGLSYQPNGLPHPTPPPPQHYRLDDMAIAHHYRDSYRHPSHRDLRDRNRPMGLHGTRQEEMIDHRLTDREWAEEWKHLDHLLNCIMDMVEKTRRSLTVLRRCQEADREELNYWIRRYSDAEDLKKGGGSSSSHSRQQSPVNPDPVALDAHREFLHRPASGYVPEEIWKKAEEAVNEVKRQAMTELQKAVSEAERKAHDMITTERAKMERTVAEAKRQAAEDALAVINQQEDSSESCWNCGRKASETCSGCNTARYCGSFCQHKDWEKHHHICGQTLQAQQQGDTPAVSSSVTPNSGAGSPMDTPPAATPRSTTPGTPSTIETTPR

SEQ ID NO: 35151 - protein, 663 aa, Homo sapiens
  ENSP00000402257
MCHPDKAFTSDKLQCVFNEYKAAVWVPPRPRPLSRAPLPEAGGENLHLKISRVRKRNLPFVVWGEEEASTPGLDAISHHLCYPDRTHRDRTEKHSTMPDSPVDVKTQSRLTPPTMPPPPTTQGAPRTSSFTPTTLTNGTSHSPTALNGAPSPPNGFSNGPSSSSSSSLANQQLPPACGARQLSKLKRFLTTLQQFGNDISPEIGERVRTLVLGLVNSTLTIEEFHSKLQEATNFPLRPFVIPFLKANLPLLQRELLHCARLAKQNPAQYLAQHEQLLLDASTTSPVDSSELLLDVNENGKRRTPDRTKENGFDREPLHSEHPSKRPCTISPGQRYSPNNGLSYQPNGLPHPTPPPPQHYRLDDMAIAHHYRDSYRHPSHRDLRDRNRPMGLHGTRQEEMIDHRLTDREWAEEWKHLDHLLNCIMDMVEKTRRSLTVLRRCQEADREELNYWIRRYSDAEDLKKGGGSSSSHSRQQSPVNPDPVALDAHREFLHRPASGYVPEEIWKKAEEAVNEVKRQAMTELQKAVSEAERKAHDMITTERAKMERTVAEAKRQAAEDALAVINQQEDSSESCWNCGRKASETCSGCNTARYCGSFCQHKDWEKHHHICGQTLQAQQQGDTPAVSSSVTPNSGAGSPMDTPPAATPRSTTPGTPSTIETTPR

SEQ ID NO: 35152 - protein, 604 aa, Homo sapiens; identical to SEQ ID NO: 35113
  ENSP00000481315

SEQ ID NO: 35153 - protein, 604 aa, Homo sapiens; identical to SEQ ID NO: 35113
  ENSP00000265814

SEQ ID NO: 35154 - protein, 463 aa, Homo sapiens
  ENSP00000473172
MATVTATTKVPEIRDVTRIERIGAHSHIRGLGLDDALEPRQASQGMVGQLAARRAAGVVLEMIREGKIAGRAVLIAGQPGTGKTAIAMGMAQALGPDTPFTAIAGSEIFSLEMSKTEALTQAFRRSIGVRIKEETEIIEGEVVEIQIDRPATGTGSKVGKLTLKTTEMETIYDLGTKMIESLTKDKVQAGDVITIDKATGKISKLGRSFTRARDYDAMGSQTKFVQCPDGELQKRKEVVHTVSLHEIDVINSRTQGFLALFSGDTGEIKSEVREQINAKVAEWREEGKAEIIPGVLFIDEVHMLDIESFSFLNRALESDMAPVLIMATNRGITRIRGTSYQSPHGIPIDLLDRLLIVSTTPYSEKDTKQILRIRCEEEDVEMSEDAYTVLTRIGLETSLRYAIQLITAASLVCRKRKGTEVQVDDIKRVYSLFLDESRSTQYMKEYQDAFLFNELKGETMDTS

SEQ ID NO: 35155 - protein, 354 aa, Homo sapiens
  ENSP00000471524
MVGQLAARRAAGVVLEMIREGKIAGRAVLIAGQPGTGKTAIAMGMAQALGPDTPFTAIAGSEIFSLEMSKTEALTQAFRRSIGVRIKEETEIIEGEVVEIQIDRPATGTGSKVGKLTLKTTEMETIYDLGTKMIESLTKDKVQAGDVITIDKATGKISKLGRSFTRARDYDAMGSQTKFVQCPDGELQKRKEVVHTVSLHEIDVINSRTQGFLALFSGDTGEIKSEVREQINAKVAEWREEGKAEIIPGVLFIDEVHMLDIESFSFLNRALESDMAPVLIMATNRGITRIRGTSYQSPHGIPIDLLDRLLIVSTTPYSEKDTKQILRIRVQKCRWMTSSGSTHSSWTSPAPRST

SEQ ID NO: 35156 - protein, 109 aa, Homo sapiens
  ENSP00000469189
MVGQLAARRAAGVVLEMIREGKIAGRAVLIAGQPGTGKTAIAMGMAQALGPDTPFTAIAGSEIFSLEMSKTEALTQAFRRSIGVRIKEETEIIEGEVVEIQIDRPATGT

SEQ ID NO: 35157 - protein, 44 aa, Homo sapiens
  ENSP00000469760
MATVELQLSKSSWRNGRFRSPWRQCVMRRVVGPCASSHLGALDC

SEQ ID NO: 35158 - protein, 50 aa, Homo sapiens
  ENSP00000471538
MATVTATTKVPEIRDVTRIERIGAHSHIRGLGLDDALEPRQLPDVVEMPW

SEQ ID NO: 35159 - protein, 259 aa, Homo sapiens
  ENSP00000221413
MATVTATTKVPEIRDVTRIERIGAHSHIRGLGLDDALEPRQASQGMVGQLAARRAAGVVLEMIREGKIAGRAVLIAGQPGTGKTAIAMGMAQALGPDTPFTAIAGSEIFSLEMSKTEALTQAFRRSIGVRIKEETEIIEGEVVEIQIDRPATGTGSKVGKLTLKTTEMETIYDLGTKMIESLTKDKGRDHHRQGDGQDLQAGPLLHTRPRLRRYGLPDQVRAVPRWGAPETQGGGAHRVPARDRRHQLSHPGLPGALLR

SEQ ID NO: 35160 - protein, 39 aa, Homo sapiens
  ENSP00000469488
MATVTATTKVPEIRDVTRIERIEMEFPRVSQDGLDLLTS

SEQ ID NO: 35161 - protein, 354 aa, Homo sapiens; identical to SEQ ID NO: 35155
  ENSP00000486242

SEQ ID NO: 35162 - protein, 50 aa, Homo sapiens
  ENSP00000492610
LHPQTATTKVPEIRDVTRIERIGAHSHIRGLGLDDALEPRQLPDVVEMPW

SEQ ID NO: 35163 - protein, 39 aa, Homo sapiens
  ENSP00000492564
LHPQTATTKVPEIRDVTRIERIEMEFPRVSQDGLDLLTS

SEQ ID NO: 35164 - protein, 676 aa, Homo sapiens
  ENSP00000423306
MTSQYPFEAETPECLVGSVPVQCLCQGLELDCDETNLRAVPSVSSNVTAMSLQWNLIRKLPPDCFKNYHDLQKLYLQNNKITSISIYAFRGLNSLTKLYLSHNRITFLKPGVFEDLHRLEWLIIEDNHLSRISPPTFYGLNSLILLVLMNNVLTRLPDKPLCQHMPRLHWLDLEGNHIHNLRNLTFISCSNLTVLVMRKNKINHLNENTFAPLQKLDELDLGSNKIENLPPLIFKDLKELSQLNLSYNPIQKIQANQFDYLVKLKSLSLEGIEISNIQQRMFRPLMNLSHIYFKKFQYCGYAPHVRSCKPNTDGISSLENLLASIIQRVFVWVVSAVTCFGNIFVICMRPYIRSENKLYAMSIISLCCADCLMGIYLFVIGGFDLKFRGEYNKHAQLWMESTHCQLVGSLAILSTEVSVLLLTFLTLEKYICIVYPFRCVRPGKCRTITVLILIWITGFIVAFIPLSNKEFFKNYYGTNGVCFPLHSEDTESIGAQIYSVAIFLGINLAAFIIIVFSYGSMFYSVHQSAITATEIRNQVKKEMILAKRFFFIVFTDALCWIPIFVVKFLSLLQVEIPGTITSWVVIFILPINSALNPILYTLTTRPFKEMIHRFWYNYRQRKSMDSKGQKTYAPSFIWVEMWPLQEMPPELMKPDLFTYPCEMSLISQSTRLNSYS

SEQ ID NO: 35165 - protein, 757 aa, Homo sapiens
  ENSP00000303248
MTSGSVFFYILIFGKYFSHGGGQDVKCSLGYFPCGNITKCLPQLLHCNGVDDCGNQADEDNCGDNNGWSLQFDKYFASYYKMTSQYPFEAETPECLVGSVPVQCLCQGLELDCDETNLRAVPSVSSNVTAMSLQWNLIRKLPPDCFKNYHDLQKLYLQNNKITSISIYAFRGLNSLTKLYLSHNRITFLKPGVFEDLHRLEWLIIEDNHLSRISPPTFYGLNSLILLVLMNNVLTRLPDKPLCQHMPRLHWLDLEGNHIHNLRNLTFISCSNLTVLVMRKNKINHLNENTFAPLQKLDELDLGSNKIENLPPLIFKDLKELSQLNLSYNPIQKIQANQFDYLVKLKSLSLEGIEISNIQQRMFRPLMNLSHIYFKKFQYCGYAPHVRSCKPNTDGISSLENLLASIIQRVFVWVVSAVTCFGNIFVICMRPYIRSENKLYAMSIISLCCADCLMGIYLFVIGGFDLKFRGEYNKHAQLWMESTHCQLVGSLAILSTEVSVLLLTFLTLEKYICIVYPFRCVRPGKCRTITVLILIWITGFIVAFIPLSNKEFFKNYYGTNGVCFPLHSEDTESIGAQIYSVAIFLGINLAAFIIIVFSYGSMFYSVHQSAITATEIRNQVKKEMILAKRFFFIVFTDALCWIPIFVVKFLSLLQVEIPGTITSWVVIFILPINSALNPILYTLTTRPFKEMIHRFWYNYRQRKSMDSKGQKTYAPSFIWVEMWPLQEMPPELMKPDLFTYPCEMSLISQSTRLNSYS

SEQ ID NO: 35166 - protein, 157 aa, Homo sapiens
  ENSP00000432036
MTSGSVFFYILIFGKYFSHGGGQDVKCSLGYFPCGNITKCLPQLLHCNGVDDCGNQADEDNCGDNNGWSLQFDKYFASYYKMTSQYPFEAETPECLVGSVPVQCLCQGLELDCDETNLRAVPSVSSNVTAMSLQWNLIRKLPPDCFKNYHDLQKLTL

SEQ ID NO: 35167 - protein, 189 aa, Homo sapiens
  ENSP00000434475
MTSGSVFFYILIFGKYFSHGGGQDVKCSLGYFPCGNITKCLPQLLHCNGVDDCGNQADEDNCGDNNGWSLQFDKYFASYYKMTSQYPFEAETPECLVGSVPVQCLCQGLELDCDETNLRAVPSVSSNVTAMSLQWNLIRKLPPDCFKNYHDLQKLYLQNNKITSISIYAFRGLNSLTKLSRAVKDGSEK

SEQ ID NO: 35168 - protein, 709 aa, Homo sapiens
  ENSP00000345889
MTSGSVFFYILIFGKYFSHGGGQDVKCSLGYFPCGNITKCLPQLLHCNGVDDCGNQADEDNCGDNNGWSLQFDKYFASYYKMTSQYPFEAETPECLVGSVPVQCLCQGLELDCDETNLRAVPSVSSNVTAMSLQWNLIRKLPPDCFKNYHDLQKLYLQNNKITSISIYAFRGLNSLTKLYLSHNRITFLKPGVFEDLHRLEWLIIEDNHLSRISPPTFYGLNSLILLVLMNNVLTRLPDKPLCQHMPRLHWLDLEGNHIHNLRNLTFISCSNLTVLVMRKNKINHLNENTFAPLQKLDEFSLEGIEISNIQQRMFRPLMNLSHIYFKKFQYCGYAPHVRSCKPNTDGISSLENLLASIIQRVFVWVVSAVTCFGNIFVICMRPYIRSENKLYAMSIISLCCADCLMGIYLFVIGGFDLKFRGEYNKHAQLWMESTHCQLVGSLAILSTEVSVLLLTFLTLEKYICIVYPFRCVRPGKCRTITVLILIWITGFIVAFIPLSNKEFFKNYYGTNGVCFPLHSEDTESIGAQIYSVAIFLGINLAAFIIIVFSYGSMFYSVHQSAITATEIRNQVKKEMILAKRFFFIVFTDALCWIPIFVVKFLSLLQVEIPGTITSWVVIFILPINSALNPILYTLTTRPFKEMIHRFWYNYRQRKSMDSKGQKTYAPSFIWVEMWPLQEMPPELMKPDLFTYPCEMSLISQSTRLNSYS

SEQ ID NO: 35169 - protein, 724 aa, Homo sapiens
  ENSP00000420712
MTSGSVFFYILIFGKYFSHGGGQDVKCSLGYFPCGNITKCLPQLLHCNGVDDCGNQADEDNCVVGSVPVQCLCQGLELDCDETNLRAVPSVSSNVTAMSLQWNLIRKLPPDCFKNYHDLQKLYLQNNKITSISIYAFRGLNSLTKLYLSHNRITFLKPGVFEDLHRLEWLIIEDNHLSRISPPTFYGLNSLILLVLMNNVLTRLPDKPLCQHMPRLHWLDLEGNHIHNLRNLTFISCSNLTVLVMRKNKINHLNENTFAPLQKLDELDLGSNKIENLPPLIFKDLKELSQLNLSYNPIQKIQANQFDYLVKLKSLSLEGIEISNIQQRMFRPLMNLSHIYFKKFQYCGYAPHVRSCKPNTDGISSLENLLASIIQRVFVWVVSAVTCFGNIFVICMRPYIRSENKLYAMSIISLCCADCLMGIYLFVIGGFDLKFRGEYNKHAQLWMESTHCQLVGSLAILSTEVSVLLLTFLTLEKYICIVYPFRCVRPGKCRTITVLILIWITGFIVAFIPLSNKEFFKNYYGTNGVCFPLHSEDTESIGAQIYSVAIFLGINLAAFIIIVFSYGSMFYSVHQSAITATEIRNQVKKEMILAKRFFFIVFTDALCWIPIFVVKFLSLLQVEIPGTITSWVVIFILPINSALNPILYTLTTRPFKEMIHRFWYNYRQRKSMDSKGQKTYAPSFIWVEMWPLQEMPPELMKPDLFTYPCEMSLISQSTRLNSYS

SEQ ID NO: 35170 - protein, 626 aa, Homo sapiens
  ENSP00000480522
MSLQWNLIRKLPPDCFKNYHDLQKLYLQNNKITSISIYAFRGLNSLTKLYLSHNRITFLKPGVFEDLHRLEWLIIEDNHLSRISPPTFYGLNSLILLVLMNNVLTRLPDKPLCQHMPRLHWLDLEGNHIHNLRNLTFISCSNLTVLVMRKNKINHLNENTFAPLQKLDELDLGSNKIENLPPLIFKDLKELSQLNLSYNPIQKIQANQFDYLVKLKSLLEGIEISNIQQRMFRPLMNLSHIYFKKFQYCGYAPHVRSCKPNTDGISSLENLLASIIQRVFVWVVSAVTCFGNIFVICMRPYIRSENKLYAMSIISLCCADCLMGIYLFVIGGFDLKFRGEYNKHAQLWMESTHCQLVGSLAILSTEVSVLLLTFLTLEKYICIVYPFRCVRPGKCRTITVLILIWITGFIVAFIPLSNKEFFKNYYGTNGVCFPLHSEDTESIGAQIYSVAIFLGINLAAFIIIVFSYGSMFYSVHQSAITATEIRNQVKKEMILAKRFFFIVFTDALCWIPIFVVKFLSLLQVEIPGTITSWVVIFILPINSALNPILYTLTTRPFKEMIHRFWYNYRQRKSMDSKGQKTYAPSFIWVEMWPLQEMPPELMKPDLFTYPCEMSLISQSTRLNSYS

SEQ ID NO: 35171 - protein, 784 aa, Homo sapiens
  ENSP00000405841
MTSGSVFFYILIFGKYFSHGGGQDVKCSLGYFPCGNITKCLPQLLHCNGVDDCGNQADEDNCGDNNGWSLQFDKYFASYYKMTSQYPFEAETPECSFHFFLFITLLFLVPHCHHALPLPLDSVVGSVPVQCLCQGLELDCDETNLRAVPSVSSNVTAMSLQWNLIRKLPPDCFKNYHDLQKLYLQNNKITSISIYAFRGLNSLTKLYLSHNRITFLKPGVFEDLHRLEWLIIEDNHLSRISPPTFYGLNSLILLVLMNNVLTRLPDKPLCQHMPRLHWLDLEGNHIHNLRNLTFISCSNLTVLVMRKNKINHLNENTFAPLQKLDELDLGSNKIENLPPLIFKDLKELSQLNLSYNPIQKIQANQFDYLVKLKSLSLEGIEISNIQQRMFRPLMNLSHIYFKKFQYCGYAPHVRSCKPNTDGISSLENLLASIIQRVFVWVVSAVTCFGNIFVICMRPYIRSENKLYAMSIISLCCADCLMGIYLFVIGGFDLKFRGEYNKHAQLWMESTHCQLVGSLAILSTEVSVLLLTFLTLEKYICIVYPFRCVRPGKCRTITVLILIWITGFIVAFIPLSNKEFFKNYYGTNGVCFPLHSEDTESIGAQIYSVAIFLGINLAAFIIIVFSYGSMFYSVHQSAITATEIRNQVKKEMILAKRFFFIVFTDALCWIPIFVVKFLSLLQVEIPGTITSWVVIFILPINSALNPILYTLTTRPFKEMIHRFWYNYRQRKSMDSKGQKTYAPSFIWVEMWPLQEMPPELMKPDLFTYPCEMSLISQSTRLNSYS

SEQ ID NO: 35172 - protein, 601 aa, Homo sapiens
  ENSP00000414885
MVTCTQNMKAALKSLLYHSRNLGYLQNNKITSISIYAFRGLNSLTKLYLSHNRITFLKPGVFEDLHRLEWLIIEDNHLSRISPPTFYGLNSLILLVLMNNVLTRLPDKPLCQHMPRLHWLVMRKNKINHLNENTFAPLQKLDELDLGSNKIENLPPLIFKDLKELSQLNLSYNPIQKIQANQFDYLVKLKSLSLEGIEISNIQQRMFRPLMNLSHIYFKKFQYCGYAPHVRSCKPNTDGISSLENLLASIIQRVFVWVVSAVTCFGNIFVICMRPYIRSENKLYAMSIISLCCADCLMGIYLFVIGGFDLKFRGEYNKHAQLWMESTHCQLVGSLAILSTEVSVLLLTFLTLEKYICIVYPFRCVRPGKCRTITVLILIWITGFIVAFIPLSNKEFFKNYYGTNGVCFPLHSEDTESIGAQIYSVAIFLGINLAAFIIIVFSYGSMFYSVHQSAITATEIRNQVKKEMILAKRFFFIVFTDALCWIPIFVVKFLSLLQVEIPGTITSWVVIFILPINSALNPILYTLTTRPFKEMIHRFWYNYRQRKSMDSKGQKTYAPSFIWVEMWPLQEMPPELMKPDLFTYPCEMSLISQSTRLNSYS

SEQ ID NO: 35173 - protein, 5033 aa, Homo sapiens
  ENSP00000347667
MGDAEGEDEVQFLRTDDEVVLQCSATVLKEQLKLCLAAEGFGNRLCFLEPTSNAQNVPPDLAICCFVLEQSLSVRALQEMLANTVEAGVESSQGGGHRTLLYGHAILLRHAHSRMYLSCLTTSRSMTDKLAFDVGLQEDATGEACWWTMHPASKQRSEGEKVRVGDDIILVSVSSERYLHLSTASGELQVDASFMQTLWNMNPICSRCEEGFVTGGHVLRLFHGHMDECLTISPADSDDQRRLVYYEGGAVCTHARSLWRLEPLRISWSGSHLRWGQPLRVRHVTTGQYLALTEDQGLVVVDASKAHTKATSFCFRISKEKLDVAPKRDVEGMGPPEIKYGESLCFVQHVASGLWLTYAAPDPKALRLGVLKKKAMLHQEGHMDDALSLTRCQQEESQAARMIHSTNGLYNQFIKSLDSFSGKPRGSGPPAGTALPIEGVILSLQDLIIYFEPPSEDLQHEEKQSKLRSLRNRQSLFQEEGMLSMVLNCIDRLNVYTTAAHFAEFAGEEAAESWKEIVNLLYELLASLIRGNRSNCALFSTNLDWLVSKLDRLEASSGILEVLYCVLIESPEVLNIIQENHIKSIISLLDKHGRNHKVLDVLCSLCVCNGVAVRSNQDLITENLLPGRELLLQTNLINYVTSIRPNIFVGRAEGTTQYSKWYFEVMVDEVTPFLTAQATHLRVGWALTEGYTPYPGAGEGWGGNGVGDDLYSYGFDGLHLWTGHVARPVTSPGQHLLAPEDVISCCLDLSVPSISFRINGCPVQGVFESFNLDGLFFPVVSFSAGVKVRFLLGGRHGEFKFLPPPGYAPCHEAVLPRERLHLEPIKEYRREGPRGPHLVGPSRCLSHTDFVPCPVDTVQIVLPPHLERIREKLAENIHELWALTRIEQGWTYGPVRDDNKRLHPCLVDFHSLPEPERNYNLQMSGETLKTLLALGCHVGMADEKAEDNLKKTKLPKTYMMSNGYKPAPLDLSHVRLTPAQTTLVDRLAENGHNVWARDRVGQGWSYSAVQDIPARRNPRLVPYRLLDEATKRSNRDSLCQAVRTLLGYGYNIEPPDQEPSQVENQSRCDRVRIFRAEKSYTVQSGRWYFEFEAVTTGEMRVGWARPELRPDVELGADELAYVFNGHRGQRWHLGSEPFGRPWQPGDVVGCMIDLTENTIIFTLNGEVLMSDSGSETAFREIEIGDGFLPVCSLGPGQVGHLNLGQDVSSLRFFAICGLQEGFEPFAINMQRPVTTWFSKGLPQFEPVPLEHPHYEVSRVDGTVDTPPCLRLTHRTWGSQNSLVEMLFLRLSLPVQFHQHFRCTAGATPLAPPGLQPPAEDEARAAEPDPDYENLRRSAGGWSEAENGKEGTAKEGAPGGTPQAGGEAQPARAENEKDATTEKNKKRGFLFKAKKVAMMTQPPATPTLPRLPHDVVPADNRDDPEIILNTTTYYYSVRVFAGQEPSCVWAGWVTPDYHQHDMSFDLSKVRVVTVTMGDEQGNVHSSLKCSNCYMVWGGDFVSPGQQGRISHTDLVIGCLVDLATGLMTFTANGKESNTFFQVEPNTKLFPAVFVLPTHQNVIQFELGKQKNIMPLSAAMFQSERKNPAPQCPPRLEMQMLMPVSWSRMPNHFLQVETRRAGERLGWAVQCQEPLTMMALHIPEENRCMDILELSERLDLQRFHSHTLRLYRAVCALGNNRVAHALCSHVDQAQLLHALEDAHLPGPLRAGYYDLLISIHLESACRSRRSMLSEYIVPLTPETRAITLFPPGRSTENGHPRHGLPGVGVTTSLRPPHHFSPPCFVAALPAAGAAEAPARLSPAIPLEALRDKALRMLGEAVRDGGQHARDPVGGSVEFQFVPVLKLVSTLLVMGIFGDEDVKQILKMIEPEVFTEEEEEEDEEEEGEEEDEEEKEEDEEETAQEKEDEEKEEEEAAEGEKEEGLEEGLLQMKLPESVKLQMCHLLEYFCDQELQHRVESLAAFAERYVDKLQANQRSRYGLLIKAFSMTAAETARRTREFRSPPQEQINMLLQFKDGTDEEDCPLPEEIRQDLLDFHQDLLAHCGIQLDGEEEEPEEETTLGSRLMSLLEKVRLVKKKEEKPEEERSAEESKPRSLQELVSHMVVRWAQEDFVQSPELVRAMFSLLHRQYDGLGELLRALPRAYTISPSSVEDTMSLLECLGQIRSLLIVQMGPQEENLMIQSIGNIMNNKVFYQHPNLMRALGMHETVMEVMVNVLGGGESKEIRFPKMVTSCCRFLCYFCRISRQNQRSMFDHLSYLLENSGIGLGMQGSTPLDVAAASVIDNNELALALQEQDLEKVVSYLAGCGLQSCPMLVAKGYPDIGWNPCGGERYLDFLRFAVFVNGESVEENANVVVRLLIRKPECFGPALRGEGGSGLLAAIEEAIRISEDPARDGPGIRRDRRREHFGEEPPEENRVHLGHAIMSFYAALIDLLGRCAPEMHLIQAGKGEALRIRAILRSLVPLEDLVGIISLPLQIPTLGKDGALVQPKMSASFVPDHKASMVLFLDRVYGIENQDFLLHVLDVGFLPDMRAAASLDTATFSTTEMALALNRYLCLAVLPLITKCAPLFAGTEHRAIMVDSMLHTVYRLSRGRSLTKAQRDVIEDCLMSLCRYIRPSMLQHLLRRLVFDVPILNEFAKMPLKLLTNHYERCWKYYCLPTGWANFGVTSEEELHLTRKLFWGIFDSLAHKKYDPELYRMAMPCLCAIAGALPPDYVDASYSSKAEKKATVDAEGNFDPRPVETLNVIIPEKLDSFINKFAEYTHEKWAFDKIQNNWSYGENIDEELKTHPMLRPYKTFSEKDKEIYRWPIKESLKAMIAWEWTIEKAREGEEEKTEKKKTRKISQSAQTYDPREGYNPQPPDLSAVTLSRELQAMAEQLAENYHNTWGRKKKQELEAKGGGTHPLLVPYDTLTAKEKARDREKAQELLKFLQMNGYAVTRGLKDMELDSSSIEKRFAFGFLQQLLRWMDISQEFIAHLEAVVSSGRVEKSPHEQEIKFFAKILLPLINQYFTNHCLYFLSTPAKVLGSGGHASNKEKEMITSLFCKLAALVRHRVSLFGTDAPAVVNCLHILARSLDARTVMKSGPEIVKAGLRSFFESASEDIEKMVENLRLGKVSQARTQVKGVGQNLTYTTVALLPVLTTLFQHIAQHQFGDDVILDDVQVSCYRTLCSIYSLGTTKNTYVEKLRPALGECLARLAAAMPVAFLEPQLNEYNACSVYTTKSPRERAILGLPNSVEEMCPDIPVLERLMADIGGLAESGARYTEMPHVIEITLPMLCSYLPRWWERGPEAPPSALPAGAPPPCTAVTSDHLNSLLGNILRIIVNNLGIDEASWMKRLAVFAQPIVSRARPELLQSHFIPTIGRLRKRAGKVVSEEEQLRLEAKAEAQEGELLVRDEFSVLCRDLYALYPLLIRYVDNNRAQWLTEPNPSAEELFRMVGEIFIYWSKSHNFKREEQNFVVQNEINNMSFLTADNKSKMAKSGGSDQERTKKKRRGDRYSVQTSLIVATLKKMLPIGLNMCAPTDQDLITLAKTRYALKDTDEEVREFLHNNLHLQGKVEGSPSLRWQMALYRGVPGREEDADDPEKIVRRVQEVSAVLYYLDQTEHPYKSKKAVWHKLLSKQRRRAVVACFRMTPLYNLPTHRACNMFLESYKAAWILTEDHSFEDRMIDDLSKAGEQEEEEEEVEEKKPDPLHQLVLHFSRTALTEKSKLDEDYLYMAYADIMAKSCHLEEGGENGEAEEEVEVSFEEKQMEKQRLLYQQARLHTRGAAEMVLQMISACKGETGAMVSSTLKLGISILNGGNAEVQQKMLDYLKDKKEVGFFQSIQALMQTCSVLDLNAFERQNKAEGLGMVNEDGTVINRQNGEKVMADDEFTQDLFRFLQLLCEGHNNDFQNYLRTQTGNTTTINIIICTVDYLLRLQESISDFYWYYSGKDVIEEQGKRNFSKAMSVAKQVFNSLTEYIQGPCTGNQQSLAHSRLWDAVVGFLHVFAHMMMKLAQDSSQIELLKELLDLQKDMVVMLLSLLEGNVVNGMIARQMVDMLVESSSNVEMILKFFDMFLKLKDIVGSEAFQDYVTDPRGLISKKDFQKAMDSQKQFSGPEIQFLLSCSEADENEMINCEEFANRFQEPARDIGFNVAVLLTNLSEHVPHDPRLHNFLELAESILEYFRPYLGRIEIMGASRRIERIYFEISETNRAQWEMPQVKESKRQFIFDVVNEGGEAEKMELFVSFCEDTIFEMQIAAQISEPEGEPETDEDEGAGAAEAGAEGAEEGAAGLEGTAATAAAGATARVVAAAGRALRGLSYRSLRRRVRRLRRLTAREAATAVAALLWAAVTRAGAAGAGAAAGALGLLWGSLFGGGLVEGAKKVTVTELLAGMPDPTSDEVHGEQPAGPGGDADGEGASEGAGDAAEGAGDEEEAVHEAGPGGADGAVAVTDGGPFRPEGAGGLGDMGDTTPAEPPTPEGSPILKRKLGVDGVEEELPPEPEPEPEPELEPEKADAENGEKEEVPEPTPEPPKKQAPPSPPPKKEEAGGEFWGELEVQRVKFLNYLSRNFYTLRFLALFLAFAINFILLFYKVSDSPPGEDDMEGSAAGDVSGAGSGGSSGWGLGAGEEAEGDEDENMVYYFLEESTGYMEPALRCLSLLHTLVAFLCIIGYNCLKVPLVIFKREKELARKLEFDGLYITEQPEDDDVKGQWDRLVLNTPSFPSNYWDKFVKRKVLDKHGDIYGRERIAELLGMDLATLEITAHNERKPNPPPGLLTWLMSIDVKYQIWKFGVIFTDNSFLYLGWYMVMSLLGHYNNFFFAAHLLDIAMGVKTLRTILSSVTHNGKQLVMTVGLLAVVVYLYTVVAFNFFRKFYNKSEDEDEPDMKCDDMMTCYLFHMYVGVRAGGGIGDEIEDPAGDEYELYRVVFDITFFFFVIVILLAIIQGLIIDAFGELRDQQEQVKEDMETKCFICGIGSDYFDTTPHGFETHTLEEHNLANYMFFLMYLINKDETEHTGQESYVWKMYQERCWDFFPAGDCFRKQYEDQLS

SEQ ID NO: 35174 - protein, 5038 aa, Homo sapiens
  ENSP00000352608
MGDAEGEDEVQFLRTDDEVVLQCSATVLKEQLKLCLAAEGFGNRLCFLEPTSNAQNVPPDLAICCFVLEQSLSVRALQEMLANTVEAGVESSQGGGHRTLLYGHAILLRHAHSRMYLSCLTTSRSMTDKLAFDVGLQEDATGEACWWTMHPASKQRSEGEKVRVGDDIILVSVSSERYLHLSTASGELQVDASFMQTLWNMNPICSRCEEGFVTGGHVLRLFHGHMDECLTISPADSDDQRRLVYYEGGAVCTHARSLWRLEPLRISWSGSHLRWGQPLRVRHVTTGQYLALTEDQGLVVVDASKAHTKATSFCFRISKEKLDVAPKRDVEGMGPPEIKYGESLCFVQHVASGLWLTYAAPDPKALRLGVLKKKAMLHQEGHMDDALSLTRCQQEESQAARMIHSTNGLYNQFIKSLDSFSGKPRGSGPPAGTALPIEGVILSLQDLIIYFEPPSEDLQHEEKQSKLRSLRNRQSLFQEEGMLSMVLNCIDRLNVYTTAAHFAEFAGEEAAESWKEIVNLLYELLASLIRGNRSNCALFSTNLDWLVSKLDRLEASSGILEVLYCVLIESPEVLNIIQENHIKSIISLLDKHGRNHKVLDVLCSLCVCNGVAVRSNQDLITENLLPGRELLLQTNLINYVTSIRPNIFVGRAEGTTQYSKWYFEVMVDEVTPFLTAQATHLRVGWALTEGYTPYPGAGEGWGGNGVGDDLYSYGFDGLHLWTGHVARPVTSPGQHLLAPEDVISCCLDLSVPSISFRINGCPVQGVFESFNLDGLFFPVVSFSAGVKVRFLLGGRHGEFKFLPPPGYAPCHEAVLPRERLHLEPIKEYRREGPRGPHLVGPSRCLSHTDFVPCPVDTVQIVLPPHLERIREKLAENIHELWALTRIEQGWTYGPVRDDNKRLHPCLVDFHSLPEPERNYNLQMSGETLKTLLALGCHVGMADEKAEDNLKKTKLPKTYMMSNGYKPAPLDLSHVRLTPAQTTLVDRLAENGHNVWARDRVGQGWSYSAVQDIPARRNPRLVPYRLLDEATKRSNRDSLCQAVRTLLGYGYNIEPPDQEPSQVENQSRCDRVRIFRAEKSYTVQSGRWYFEFEAVTTGEMRVGWARPELRPDVELGADELAYVFNGHRGQRWHLGSEPFGRPWQPGDVVGCMIDLTENTIIFTLNGEVLMSDSGSETAFREIEIGDGFLPVCSLGPGQVGHLNLGQDVSSLRFFAICGLQEGFEPFAINMQRPVTTWFSKGLPQFEPVPLEHPHYEVSRVDGTVDTPPCLRLTHRTWGSQNSLVEMLFLRLSLPVQFHQHFRCTAGATPLAPPGLQPPAEDEARAAEPDPDYENLRRSAGGWSEAENGKEGTAKEGAPGGTPQAGGEAQPARAENEKDATTEKNKKRGFLFKAKKVAMMTQPPATPTLPRLPHDVVPADNRDDPEIILNTTTYYYSVRVFAGQEPSCVWAGWVTPDYHQHDMSFDLSKVRVVTVTMGDEQGNVHSSLKCSNCYMVWGGDFVSPGQQGRISHTDLVIGCLVDLATGLMTFTANGKESNTFFQVEPNTKLFPAVFVLPTHQNVIQFELGKQKNIMPLSAAMFQSERKNPAPQCPPRLEMQMLMPVSWSRMPNHFLQVETRRAGERLGWAVQCQEPLTMMALHIPEENRCMDILELSERLDLQRFHSHTLRLYRAVCALGNNRVAHALCSHVDQAQLLHALEDAHLPGPLRAGYYDLLISIHLESACRSRRSMLSEYIVPLTPETRAITLFPPGRSTENGHPRHGLPGVGVTTSLRPPHHFSPPCFVAALPAAGAAEAPARLSPAIPLEALRDKALRMLGEAVRDGGQHARDPVGGSVEFQFVPVLKLVSTLLVMGIFGDEDVKQILKMIEPEVFTEEEEEEDEEEEGEEEDEEEKEEDEEETAQEKEDEEKEEEEAAEGEKEEGLEEGLLQMKLPESVKLQMCHLLEYFCDQELQHRVESLAAFAERYVDKLQANQRSRYGLLIKAFSMTAAETARRTREFRSPPQEQINMLLQFKDGTDEEDCPLPEEIRQDLLDFHQDLLAHCGIQLDGEEEEPEEETTLGSRLMSLLEKVRLVKKKEEKPEEERSAEESKPRSLQELVSHMVVRWAQEDFVQSPELVRAMFSLLHRQYDGLGELLRALPRAYTISPSSVEDTMSLLECLGQIRSLLIVQMGPQEENLMIQSIGNIMNNKVFYQHPNLMRALGMHETVMEVMVNVLGGGESKEIRFPKMVTSCCRFLCYFCRISRQNQRSMFDHLSYLLENSGIGLGMQGSTPLDVAAASVIDNNELALALQEQDLEKVVSYLAGCGLQSCPMLVAKGYPDIGWNPCGGERYLDFLRFAVFVNGESVEENANVVVRLLIRKPECFGPALRGEGGSGLLAAIEEAIRISEDPARDGPGIRRDRRREHFGEEPPEENRVHLGHAIMSFYAALIDLLGRCAPEMHLIQAGKGEALRIRAILRSLVPLEDLVGIISLPLQIPTLGKDGALVQPKMSASFVPDHKASMVLFLDRVYGIENQDFLLHVLDVGFLPDMRAAASLDTATFSTTEMALALNRYLCLAVLPLITKCAPLFAGTEHRAIMVDSMLHTVYRLSRGRSLTKAQRDVIEDCLMSLCRYIRPSMLQHLLRRLVFDVPILNEFAKMPLKLLTNHYERCWKYYCLPTGWANFGVTSEEELHLTRKLFWGIFDSLAHKKYDPELYRMAMPCLCAIAGALPPDYVDASYSSKAEKKATVDAEGNFDPRPVETLNVIIPEKLDSFINKFAEYTHEKWAFDKIQNNWSYGENIDEELKTHPMLRPYKTFSEKDKEIYRWPIKESLKAMIAWEWTIEKAREGEEEKTEKKKTRKISQSAQTYDPREGYNPQPPDLSAVTLSRELQAMAEQLAENYHNTWGRKKKQELEAKGGGTHPLLVPYDTLTAKEKARDREKAQELLKFLQMNGYAVTRGLKDMELDSSSIEKRFAFGFLQQLLRWMDISQEFIAHLEAVVSSGRVEKSPHEQEIKFFAKILLPLINQYFTNHCLYFLSTPAKVLGSGGHASNKEKEMITSLFCKLAALVRHRVSLFGTDAPAVVNCLHILARSLDARTVMKSGPEIVKAGLRSFFESASEDIEKMVENLRLGKVSQARTQVKGVGQNLTYTTVALLPVLTTLFQHIAQHQFGDDVILDDVQVSCYRTLCSIYSLGTTKNTYVEKLRPALGECLARLAAAMPVAFLEPQLNEYNACSVYTTKSPRERAILGLPNSVEEMCPDIPVLERLMADIGGLAESGARYTEMPHVIEITLPMLCSYLPRWWERGPEAPPSALPAGAPPPCTAVTSDHLNSLLGNILRIIVNNLGIDEASWMKRLAVFAQPIVSRARPELLQSHFIPTIGRLRKRAGKVVSEEEQLRLEAKAEAQEGELLVRDEFSVLCRDLYALYPLLIRYVDNNRAQWLTEPNPSAEELFRMVGEIFIYWSKSHNFKREEQNFVVQNEINNMSFLTADNKSKMAKAGDIQSGGSDQERTKKKRRGDRYSVQTSLIVATLKKMLPIGLNMCAPTDQDLITLAKTRYALKDTDEEVREFLHNNLHLQGKVEGSPSLRWQMALYRGVPGREEDADDPEKIVRRVQEVSAVLYYLDQTEHPYKSKKAVWHKLLSKQRRRAVVACFRMTPLYNLPTHRACNMFLESYKAAWILTEDHSFEDRMIDDLSKAGEQEEEEEEVEEKKPDPLHQLVLHFSRTALTEKSKLDEDYLYMAYADIMAKSCHLEEGGENGEAEEEVEVSFEEKQMEKQRLLYQQARLHTRGAAEMVLQMISACKGETGAMVSSTLKLGISILNGGNAEVQQKMLDYLKDKKEVGFFQSIQALMQTCSVLDLNAFERQNKAEGLGMVNEDGTVINRQNGEKVMADDEFTQDLFRFLQLLCEGHNNDFQNYLRTQTGNTTTINIIICTVDYLLRLQESISDFYWYYSGKDVIEEQGKRNFSKAMSVAKQVFNSLTEYIQGPCTGNQQSLAHSRLWDAVVGFLHVFAHMMMKLAQDSSQIELLKELLDLQKDMVVMLLSLLEGNVVNGMIARQMVDMLVESSSNVEMILKFFDMFLKLKDIVGSEAFQDYVTDPRGLISKKDFQKAMDSQKQFSGPEIQFLLSCSEADENEMINCEEFANRFQEPARDIGFNVAVLLTNLSEHVPHDPRLHNFLELAESILEYFRPYLGRIEIMGASRRIERIYFEISETNRAQWEMPQVKESKRQFIFDVVNEGGEAEKMELFVSFCEDTIFEMQIAAQISEPEGEPETDEDEGAGAAEAGAEGAEEGAAGLEGTAATAAAGATARVVAAAGRALRGLSYRSLRRRVRRLRRLTAREAATAVAALLWAAVTRAGAAGAGAAAGALGLLWGSLFGGGLVEGAKKVTVTELLAGMPDPTSDEVHGEQPAGPGGDADGEGASEGAGDAAEGAGDEEEAVHEAGPGGADGAVAVTDGGPFRPEGAGGLGDMGDTTPAEPPTPEGSPILKRKLGVDGVEEELPPEPEPEPEPELEPEKADAENGEKEEVPEPTPEPPKKQAPPSPPPKKEEAGGEFWGELEVQRVKFLNYLSRNFYTLRFLALFLAFAINFILLFYKVSDSPPGEDDMEGSAAGDVSGAGSGGSSGWGLGAGEEAEGDEDENMVYYFLEESTGYMEPALRCLSLLHTLVAFLCIIGYNCLKVPLVIFKREKELARKLEFDGLYITEQPEDDDVKGQWDRLVLNTPSFPSNYWDKFVKRKVLDKHGDIYGRERIAELLGMDLATLEITAHNERKPNPPPGLLTWLMSIDVKYQIWKFGVIFTDNSFLYLGWYMVMSLLGHYNNFFFAAHLLDIAMGVKTLRTILSSVTHNGKQLVMTVGLLAVVVYLYTVVAFNFFRKFYNKSEDEDEPDMKCDDMMTCYLFHMYVGVRAGGGIGDEIEDPAGDEYELYRVVFDITFFFFVIVILLAIIQGLIIDAFGELRDQQEQVKEDMETKCFICGIGSDYFDTTPHGFETHTLEEHNLANYMFFLMYLINKDETEHTGQESYVWKMYQERCWDFFPAGDCFRKQYEDQLS

SEQ ID NO: 35175 - protein, 886 aa, Homo sapiens
  ENSP00000470927
  MOD_RES (1)..(1): Any amino acid
XNIMNNKVFYQHPNLMRALGMHETVMEVMVNVLGGGESKEIRFPKMVTSCCRFLCYFCRISRQNQRSMFDHLSYLLENSGIGLGMQGSTPLDVAAASVIDNNELALALQEQDLEKVVSYLAGCGLQSCPMLVAKGYPDIGWNPCGGERYLDFLRFAVFVNGESVEENANVVVRLLIRKPECFGPALRGEGGSGLLAAIEEAIRISEDPARDGPGIRRDRRREHFGEEPPEENRVHLGHAIMSFYAALIDLLGRCAPEMHLIQAGKGEALRIRAILRSLVPLEDLVGIISLPLQIPTLGKDGALVQPKMSASFVPDHKASMVLFLDRVYGIENQDFLLHVLDVGFLPDMRAAASLDTATFSTTEMALALNRYLCLAVLPLITKCAPLFAGTEHRAIMVDSMLHTVYRLSRGRSLTKAQRDVIEDCLMSLCRYIRPSMLQHLLRRLVFDVPILNEFAKMPLKLLTNHYERCWKYYCLPTGWANFGVTSEEELHLTRKLFWGIFDSLAHKKYDPELYRMAMPCLCAIAGALPPDYVDASYSSKAEKKATVDAEGNFDPRPVETLNVIIPEKLDSFINKFAEYTHEKWAFDKIQNNWSYGENIDEELKTHPMLRPYKTFSEKDKEIYRWPIKESLKAMIAWEWTIEKAREGEEEKTEKKKTRKISQSAQTYDPREGYNPQPPDLSAVTLSRELQAMAEQLAENYHNTWGRKKKQELEAKGGGTHPLLVPYDTLTAKEKARDREKAQELLKFLQMNGYAVTRGLKDMELDSSSIEKRFAFGFLQQLLRWMDISQEFIAHLEAVVSSGRVEKSPHEQEIKFFAKILLPLINQYFTNHCLYFLSTPAKVLGSGGHASNKEKEMITRDRRPSCGQLSSHPGPLPGCQDSDEVRP

SEQ ID NO: 35176 - protein, 733 aa, Homo sapiens
  ENSP00000471601
  MOD_RES (1)..(1): Any amino acid
XTCCSRPPPSLSLWTVMKSGPEIVKAGLRSFFESASEDIEKMVENLRLGKVSQARTQVKGVGQNLTYTTVALLPVLTTLFQHIAQHQFGDDVILDDVQVSCYRTLCSIYSLGTTKNTYVEKLRPALGECLARLAAAMPVAFLEPQLNEYNACSVYTTKSPRERAILGLPNSVEEMCPDIPVLERLMADIGGLAESGARYTEMPHVIEITLPMLCSYLPRWWERGPEAPPSALPAGAPPPCTAVTSDHLNSLLGNILRIIVNNLGIDEASWMKRLAVFAQPIVSRARPELLQSHFIPTIGRLRKRAGKVVSEEEQLRLEAKAEAQEGELLVRDEFSVLCRDLYALYPLLIRYVDNNRAQWLTEPNPSAEELFRMVGEIFIYWSKSHNFKREEQNFVVQNEINNMSFLTADNKSKMAKAGDIQSGGSDQERTKKKRRGDRYSVQTSLIVATLKKMLPIGLNMCAPTDQDLITLAKTRYALKDTDEEVREFLHNNLHLQGKVEGSPSLRWQMALYRGVPGREEDADDPEKIVRRVQEVSAVLYYLDQTEHPYKSKKAVWHKLLSKQRRRAVVACFRMTPLYNLPTHRACNMFLESYKAAWILTEDHSFEDRMIDDLSKAGEQEEEEEEVEEKKPDPLHQLVLHFSRTALTEKSKLDEDYLYMAYADIMAKSCHLEEGGENGEAEEEVEVSFEEKQMEKQRLLYQQARLHTRGAAEMVLQMISACKGETGAMVSSTL

SEQ ID NO: 35177 - protein, 287 aa, Homo sapiens
  ENSP00000472497
RGPGSVGPGLGWKLRSGGGVRTLTLLVETRFSFCRTEHPYKSKKAVWHKLLSKQRRRAVVACFRMTPLYNLPTHRACNMFLESYKAAWILTEDHSFEDRMIDDLSKAGEQEEEEEEVEEKKPDPLHQLVLHFSRTALTEKSKLDEDYLYMAYADIMAKSCHLEEGGENGEAEEEVEVSFEEKQMEKQRLLYQQARLHTRGAAEMVLQMISACKGETGAMVSSTLKLGISILNGGNAEVQQKMLDYLKDKKEVGFFQSIQALMQTCSVLDLNAFERQNKAEGLGMVNE

SEQ ID NO: 35178 - protein, 171 aa, Homo sapiens
  ENSP00000470848
EKQRLLYQQARLHTRGAAEMVLQMISACKGETGAMVSSTLKLGISILNGGNAEVQQKMLDYLKDKKEVGFFQSIQALMQTCSVLDLNAFERQNKAEGLGMVNEDGTGEKVMADDEFTQDLFRFLQLLCEGHNNGALQWLPKFYTRGGFLYFRSRKDLREKTAWHLKINLLE

SEQ ID NO: 35179 - protein, 79 aa, Homo sapiens
  ENSP00000471404
  MOD_RES (1)..(1): Any amino acid
XRLHTRGAAEMVLQMISACKGETGAMVSSTLKLGISILNGGNAEVQQKMLDYLKDKKEVGFFQSIQALMQTCRREGHGG

SEQ ID NO: 35180 - protein, 144 aa, Homo sapiens
  ENSP00000472126
  MOD_RES (1)..(1): Any amino acid
XELPPEPEPEPEPELEPEKADAENGEKEEVPEPTPEPPKKQAPPSPPPKKEEAGGEFWGELEVQRVKFLVSDSPPGEDDMEGSAAGDVSGAGSGGSSGWGLGAGEEAEGDEDENMVYYFLEESTGYMEPALRCLSLLHTLVAFL

SEQ ID NO: 35181 - protein, 4967 aa, Homo sapiens
  ENSP00000355533
MADGGEGEDEIQFLRTDDEVVLQCTATIHKEQQKLCLAAEGFGNRLCFLESTSNSKNVPPDLSICTFVLEQSLSVRALQEMLANTVEKSEGQVDVEKWKFMMKTAQGGGHRTLLYGHAILLRHSYSGMYLCCLSTSRSSTDKLAFDVGLQEDTTGEACWWTIHPASKQRSEGEKVRVGDDLILVSVSSERYLHLSYGNGSLHVDAAFQQTLWSVAPISSGSEAAQGYLIGGDVLRLLHGHMDECLTVPSGEHGEEQRRTVHYEGGAVSVHARSLWRLETLRVAWSGSHIRWGQPFRLRHVTTGKYLSLMEDKNLLLMDKEKADVKSTAFTFRSSKEKLDVGVRKEVDGMGTSEIKYGDSVCYIQHVDTGLWLTYQSVDVKSVRMGSIQRKAIMHHEGHMDDGISLSRSQHEESRTARVIRSTVFLFNRFIRGLDALSKKAKASTVDLPIESVSLSLQDLIGYFHPPDEHLEHEDKQNRLRALKNRQNLFQEEGMINLVLECIDRLHVYSSAAHFADVAGREAGESWKSILNSLYELLAALIRGNRKNCAQFSGSLDWLISRLERLEASSGILEVLHCVLVESPEALNIIKEGHIKSIISLLDKHGRNHKVLDVLCSLCVCHGVAVRSNQHLICDNLLPGRDLLLQTRLVNHVSSMRPNIFLGVSEGSAQYKKWYYELMVDHTEPFVTAEATHLRVGWASTEGYSPYPGGGEEWGGNGVGDDLFSYGFDGLHLWSGCIARTVSSPNQHLLRTDDVISCCLDLSAPSISFRINGQPVQGMFENFNIDGLFFPVVSFSAGIKVRFLLGGRHGEFKFLPPPGYAPCYEAVLPKEKLKVEHSREYKQERTYTRDLLGPTVSLTQAAFTPIPVDTSQIVLPPHLERIREKLAENIHELWVMNKIELGWQYGPVRDDNKRQHPCLVEFSKLPEQERNYNLQMSLETLKTLLALGCHVGISDEHAEDKVKKMKLPKNYQLTSGYKPAPMDLSFIKLTPSQEAMVDKLAENAHNVWARDRIRQGWTYGIQQDVKNRRNPRLVPYTLLDDRTKKSNKDSLREAVRTLLGYGYNLEAPDQDHAARAEVCSGTGERFRIFRAEKTYAVKAGRWYFEFETVTAGDMRVGWSRPGCQPDQELGSDERAFAFDGFKAQRWHQGNEHYGRSWQAGDVVGCMVDMNEHTMMFTLNGEILLDDSGSELAFKDFDVGDGFIPVCSLGVAQVGRMNFGKDVSTLKYFTICGLQEGYEPFAVNTNRDITMWLSKRLPQFLQVPSNHEHIEVTRIDGTIDSSPCLKVTQKSFGSQNSNTDIMFYRLSMPIECAEVFSKTVAGGLPGAGLFGPKNDLEDYDADSDFEVLMKTAHGHLVPDRVDKDKEATKPEFNNHKDYAQEKPSRLKQRFLLRRTKPDYSTSHSARLTEDVLADDRDDYDFLMQTSTYYYSVRIFPGQEPANVWVGWITSDFHQYDTGFDLDRVRTVTVTLGDEKGKVHESIKRSNCYMVCAGESMSPGQGRNNNGLEIGCVVDAASGLLTFIANGKELSTYYQVEPSTKLFPAVFAQATSPNVFQFELGRIKNVMPLSAGLFKSEHKNPVPQCPPRLHVQFLSHVLWSRMPNQFLKVDVSRISERQGWLVQCLDPLQFMSLHIPEENRSVDILELTEQEELLKFHYHTLRLYSAVCALGNHRVAHALCSHVDEPQLLYAIENKYMPGLLRAGYYDLLIDIHLSSYATARLMMNNEYIVPMTEETKSITLFPDENKKHGLPGIGLSTSLRPRMQFSSPSFVSISNECYQYSPEFPLDILKSKTIQMLTEAVKEGSLHARDPVGGTTEFLFVPLIKLFYTLLIMGIFHNEDLKHILQLIEPSVFKEAATPEEESDTLEKELSVDDAKLQGAGEEEAKGGKRPKEGLLQMKLPEPVKLQMCLLLQYLCDCQVRHRIEAIVAFSDDFVAKLQDNQRFRYNEVMQALNMSAALTARKTKEFRSPPQEQINMLLNFKDDKSECPCPEEIRDQLLDFHEDLMTHCGIELDEDGSLDGNSDLTIRGRLLSLVEKVTYLKKKQAEKPVESDSKKSSTLQQLISETMVRWAQESVIEDPELVRAMFVLLHRQYDGIGGLVRALPKTYTINGVSVEDTINLLASLGQIRSLLSVRMGKEEEKLMIRGLGDIMNNKVFYQHPNLMRALGMHETVMEVMVNVLGGGESKEITFPKMVANCCRFLCYFCRISRQNQKAMFDHLSYLLENSSVGLASPAMRGSTPLDVAAASVMDNNELALALREPDLEKVVRYLAGCGLQSCQMLVSKGYPDIGWNPVEGERYLDFLRFAVFCNGESVEENANVVVRLLIRRPECFGPALRGEGGNGLLAAMEEAIKIAEDPSRDGPSPNSGSSKTLDTEEEEDDTIHMGNAIMTFYSALIDLLGRCAPEMHLIHAGKGEAIRIRSILRSLIPLGDLVGVISIAFQMPTIAKDGNVVEPDMSAGFCPDHKAAMVLFLDRVYGIEVQDFLLHLLEVGFLPDLRAAASLDTAALSATDMALALNRYLCTAVLPLLTRCAPLFAGTEHHASLIDSLLHTVYRLSKGCSLTKAQRDSIEVCLLSICGQLRPSMMQHLLRRLVFDVPLLNEHAKMPLKLLTNHYERCWKYYCLPGGWGNFGAASEEELHLSRKLFWGIFDALSQKKYEQELFKLALPCLSAVAGALPPDYMESNYVSMMEKQSSMDSEGNFNPQPVDTSNITIPEKLEYFINKYAEHSHDKWSMDKLANGWIYGEIYSDSSKVQPLMKPYKLLSEKEKEIYRWPIKESLKTMLAWGWRIERTREGDSMALYNRTRRISQTSQVSVDAAHGYSPRAIDMSNVTLSRDLHAMAEMMAENYHNIWAKKKKMELESKGGGNHPLLVPYDTLTAKEKAKDREKAQDILKFLQINGYAVSRGFKDLELDTPSIEKRFAYSFLQQLIRYVDEAHQYILEFDGGSRGKGEHFPYEQEIKFFAKVVLPLIDQYFKNHRLYFLSAASRPLCSGGHASNKEKEMVTSLFCKLGVLVRHRISLFGNDATSIVNCLHILGQTLDARTVMKTGLESVKSALRAFLDNAAEDLEKTMENLKQGQFTHTRNQPKGVTQIINYTTVALLPMLSSLFEHIGQHQFGEDLILEDVQVSCYRILTSLYALGTSKSIYVERQRSALGECLAAFAGAFPVAFLETHLDKHNIYSIYNTKSSRERAALSLPTNVEDVCPNIPSLEKLMEEIVELAESGIRYTQMPHVMEVILPMLCSYMSRWWEHGPENNPERAEMCCTALNSEHMNTLLGNILKIIYNNLGIDEGAWMKRLAVFSQPIINKVKPQLLKTHFLPLMEKLKKKAATVVSEEDHLKAEARGDMSEAELLILDEFTTLARDLYAFYPLLIRFVDYNRAKWLKEPNPEAEELFRMVAEVFIYWSKSHNFKREEQNFVVQNEINNMSFLITDTKSKMSKAAVSDQERKKMKRKGDRYSMQTSLIVAALKRLLPIGLNICAPGDQELIALAKNRFSLKDTEDEVRDIIRSNIHLQGKLEDPAIRWQMALYKDLPNRTDDTSDPEKTVERVLDIANVLFHLEQKSKRVGRRHYCLVEHPQRSKKAVWHKLLSKQRKRAVVACFRMAPLYNLPRHRAVNLFLQGYEKSWIETEEHYFEDKLIEDLAKPGAEPPEEDEGTKRVDPLHQLILLFSRTALTEKCKLEEDFLYMAYADIMAKSCHDEEDDDGEEEVKSFEEKEMEKQKLLYQQARLHDRGAAEMVLQTISASKGETGPMVAATLKLGIAILNGGNSTVQQKMLDYLKEKKDVGFFQSLAGLMQSCSVLDLNAFERQNKAEGLGMVTEEGSGEKVLQDDEFTCDLFRFLQLLCEGHNSDFQNYLRTQTGNNTTVNIIISTVDYLLRVQESISDFYWYYSGKDVIDEQGQRNFSKAIQVAKQVFNTLTEYIQGPCTGNQQSLAHSRLWDAVVGFLHVFAHMQMKLSQDSSQIELLKELMDLQKDMVVMLLSMLEGNVVNGTIGKQMVDMLVESSNNVEMILKFFDMFLKLKDLTSSDTFKEYDPDGKGVISKRDFHKAMESHKHYTQSETEFLLSCAETDENETLDYEEFVKRFHEPAKDIGFNVAVLLTNLSEHMPNDTRLQTFLELAESVLNYFQPFLGRIEIMGSAKRIERVYFEISESSRTQWEKPQVKESKRQFIFDVVNEGGEKEKMELFVNFCEDTIFEMQLAAQISESDLNERSANKEESEKERPEEQGPRMAFFSILTVRSALFALRYNILTLMRMLSLKSLKKQMKKVKKMTVKDMVTAFFSSYWSIFMTLLHFVASVFRGFFRIICSLLLGGSLVEGAKKIKVAELLANMPDPTQDEVRGDGEEGERKPLEAALPSEDLTDLKELTEESDLLSDIFGLDLKREGGQYKLIPHNPNAGLSDLMSNPVPMPEVQEKFQEQKAKEEEKEEKEETKSEPEKAEGEDGEKEEKAKEDKGKQKLRQLHTHRYGEPEVPESAFWKKIIAYQQKLLNYFARNFYNMRMLALFVAFAINFILLFYKVSTSSVVEGKELPTRSSSENAKVTSLDSSSHRIIAVHYVLEESSGYMEPTLRILAILHTVISFFCIIGYYCLKVPLVIFKREKEVARKLEFDGLYITEQPSEDDIKGQWDRLVINTQSFPNNYWDKFVKRKVMDKYGEFYGRDRISELLGMDKAALDFSDAREKKKPKKDSSLSAVLNSIDVKYQMWKLGVVFTDNSFLYLAWYMTMSVLGHYNNFFFAAHLLDIAMGFKTLRTILSSVTHNGKQLVLTVGLLAVVVYLYTVVAFNFFRKFYNKSEDGDTPDMKCDDMLTCYMFHMYVGVRAGGGIGDEIEDPAGDEYEIYRIIFDITFFFFVIVILLAIIQGLIIDAFGELRDQQEQVKEDMETKCFICGIGNDYFDTVPHGFETHTLQEHNLANYLFFLMYLINKDETEHTGQESYVWKMYQERCWEFFPAGDCFRKQYEDQLN

SEQ ID NO: 35182 - protein, 4950 aa, Homo sapiens
  ENSP00000353174
DDEVVLQCTATIHKEQQKLCLAAEGFGNRLCFLESTSNSKNVPPDLSICTFVLEQSLSVRALQEMLANTVEKSEGQVDVEKWLFSLKTAQGGGHRTLLYGHAILLRHSYSGMYLCCLSTSRSSTDKLAFDVGLQEDTTGEACWWTIHPASKQRSEGEKVRVGDDLILVSVSSERYLHLSYGNGSLHVDAAFQQTLWSVAPISSGSEAAQGYLIGGDVLRLLHGHMDECLTVPSGEHGEEQRRTVHYEGGAVSVHARSLWRLETLRVAWSGSHIRWGQPFRLRHVTTGKYLSLMEDKNLLLMDKEKADVKSTAFTFRSSKEKLDVGVRKEVDGMGTSEIKYGDSVCYIQHVDTGLWLTYQSVDVKSVRMGSIQRKAIMHHEGHMDDGISLSRSQHEESRTARVIRSTVFLFNRFIRGLDALSKKAKASTVDLPIESVSLSLQDLIGYFHPPDEHLEHEDKQNRLRALKNRQNLFQEEGMINLVLECIDRLHVYSSAAHFADVAGREAGESWKSILNSLYELLAALIRGNRKNCAQFSGSLDWLISRLERLEASSGILEVLHCVLVESPEALNIIKEGHIKSIISLLDKHGRNHKVLDVLCSLCVCHGVAVRSNQHLICDNLLPGRDLLLQTRLVNHVSSMRPNIFLGVSEGSAQYKKWYYELMVDHTEPFVTAEATHLRVGWASTEGYSPYPGGGEEWGGNGVGDDLFSYGFDGLHLWSGCIARTVSSPNQHLLRTDDVISCCLDLSAPSISFRINGQPVQGMFENFNIDGLFFPVVSFSAGIKVRFLLGGRHGEFKFLPPPGYAPCYEAVLPKEKLKVEHSREYKQERTYTRDLLGPTVSLTQAAFTPIPVDTSQIVLPPHLERIREKLAENIHELWVMNKIELGWQYGPVRDDNKRQHPCLVEFSKLPEQERNYNLQMSLETLKTLLALGCHVGISDEHAEDKVKKMKLPKNYQLTSGYKPAPMDLSFIKLTPSQEAMVDKLAENAHNVWARDRIRQGWTYGIQQDVKNRRNPRLVPYTLLDDRTKKSNKDSLREAVRTLLGYGYNLEAPDQDHAARAEVCSGTGERFRIFRAEKTYAVKAGRWYFEFETVTAGDMRVGWSRPGCQPDQELGSDERAFAFDGFKAQRWHQGNEHYGRSWQAGDVVGCMVDMNEHTMMFTLNGEILLDDSGSELAFKDFDVGDGFIPVCSLGVAQVGRMNFGKDVSTLKYFTICGLQEGYEPFAVNTNRDITMWLSKRLPQFLQVPSNHEHIEVTRIDGTIDSSPCLKVTQKSFGSQNSNTDIMFYRLSMPIECAEVFSKTVAGGLPGAGLFGPKNDLEDYDADSDFEVLMKTAHGHLVPDRVDKDKEATKPEFNNHKDYAQEKPSRLKQRFLLRRTKPDYSTSHSARLTEDVLADDRDDYDFLMQTSTYYYSVRIFPGQEPANVWVGWITSDFHQYDTGFDLDRVRTVTVTLGDEKGKVHESIKRSNCYMVCAGESMSPGQGRNNNGLEIGCVVDAASGLLTFIANGKELSTYYQVEPSTKLFPAVFAQATSPNVFQFELGRIKNVMPLSAGLFKSEHKNPVPQCPPRLHVQFLSHVLWSRMPNQFLKVDVSRISERQGWLVQCLDPLQFMSLHIPEENRSVDILELTEQEELLKFHYHTLRLYSAVCALGNHRVAHALCSHVDEPQLLYAIENKYMPGLLRAGYYDLLIDIHLSSYATARLMMNNEYIVPMTEETKSITLFPDENKKHGLPGIGLSTSLRPRMQFSSPSFVSISNECYQYSPEFPLDILKSKTIQMLTEAVKEGSLHARDPVGGTTEFLFVPLIKLFYTLLIMGIFHNEDLKHILQLIEPSVFKEAATPEEESDTLEKELSVDDAKLQGAGEEEAKGGKRPKEGLLQMKLPEPVKLQMCLLLQYLCDCQVRHRIEAIVAFSDDFVAKLQDNQRFRYNEVMQALNMSAALTARKTKEFRSPPQEQINMLLNFKDDKSECPCPEEIRDQLLDFHEDLMTHCGIELDEDGSLDGNSDLTIRGRLLSLVEKVTYLKKKQAEKPVESDSKKSSTLQQLISETMVRWAQESVIEDPELVRAMFVLLHRQYDGIGGLVRALPKTYTINGVSVEDTINLLASLGQIRSLLSVRMGKEEEKLMIRGLGDIMNNKVFYQHPNLMRALGMHETVMEVMVNVLGGGESKEITFPKMVANCCRFLCYFCRISRQNQKAMFDHLSYLLENSSVGLASPAMRGSTPLDVAAASVMDNNELALALREPDLEKVVRYLAGCGLQSCQMLVSKGYPDIGWNPVEGERYLDFLRFAVFCNGESVEENANVVVRLLIRRPECFGPALRGEGGNGLLAAMEEAIKIAEDPSRDGPSPNSGSSKTLDTEEEEDDTIHMGNAIMTFYSALIDLLGRCAPEMHLIHAGKGEAIRIRSILRSLIPLGDLVGVISIAFQMPTIAKDGNVVEPDMSAGFCPDHKAAMVLFLDRVYGIEVQDFLLHLLEVGFLPDLRAAASLDTAALSATDMALALNRYLCTAVLPLLTRCAPLFAGTEHHASLIDSLLHTVYRLSKGCSLTKAQRDSIEVCLLSICGQLRPSMMQHLLRRLVFDVPLLNEHAKMPLKLLTNHYERCWKYYCLPGGWGNFGAASEEELHLSRKLFWGIFDALSQKKYEQELFKLALPCLSAVAGALPPDYMESNYVSMMEKQSSMDSEGNFNPQPVDTSNITIPEKLEYFINKYAEHSHDKWSMDKLANGWIYGEIYSDSSKVQPLMKPYKLLSEKEKEIYRWPIKESLKTMLAWGWRIERTREGDSMALYNRTRRISQTSQVSVDAAHGYSPRAIDMSNVTLSRDLHAMAEMMAENYHNIWAKKKKMELESKGGGNHPLLVPYDTLTAKEKAKDREKAQDILKFLQINGYAVSRGFKDLELDTPSIEKRFAYSFLQQLIRYVDEAHQYILEFDGGSRGKGEHFPYEQEIKFFAKVVLPLIDQYFKNHRLYFLSAASRPLCSGGHASNKEKEMVTSLFCKLGVLVRHRISLFGNDATSIVNCLHILGQTLDARTVMKTGLESVKSALRAFLDNAAEDLEKTMENLKQGQFTHTRNQPKGVTQIINYTTVALLPMLSSLFEHIGQHQFGEDLILEDVQVSCYRILTSLYALGTSKSIYVERQRSALGECLAAFAGAFPVAFLETHLDKHNIYSIYNTKSSRERAALSLPTNVEDVCPNIPSLEKLMEEIVELAESGIRYTQMPHVMEVILPMLCSYMSRWWEHGPENNPERAEMCCTALNSEHMNTLLGNILKIIYNNLGIDEGAWMKRLAVFSQPIINKVKPQLLKTHFLPLMEKLKKKAATVVSEEDHLKAEARGDMSEAELLILDEFTTLARDLYAFYPLLIRFVDYNRAKWLKEPNPEAEELFRMVAEVFIYWSKSHNFKREEQNFVVQNEINNMSFLITDTKSKMSKAAVSDQERKKMKRKGDRYSMQTSLIVAALKRLLPIGLNICAPGDQELIALAKNRFSLKDTEDEVRDIIRSNIHLQGKLEDPAIRWQMALYKDLPNRTDDTSDPEKTVERVLDIANVLFHLEQKSKRVGRRHYCLVEHPQRSKKAVWHKLLSKQRKRAVVACFRMAPLYNLPRHRAVNLFLQGYEKSWIETEEHYFEDKLIEDLAKPGAEPPEEDEGTKRVDPLHQLILLFSRTALTEKCKLEEDFLYMAYADIMAKSCHDEEDDDGEEEVKSFEEKEMEKQKLLYQQARLHDRGAAEMVLQTISASKGETGPMVAATLKLGIAILNGGNSTVQQKMLDYLKEKKDVGFFQSLAGLMQSCSVLDLNAFERQNKAEGLGMVTEEGSGEKVLQDDEFTCDLFRFLQLLCEGHNSDFQNYLRTQTGNNTTVNIIISTVDYLLRVQESISDFYWYYSGKDVIDEQGQRNFSKAIQVAKQVFNTLTEYIQGPCTGNQQSLAHSRLWDAVVGFLHVFAHMQMKLSQDSSQIELLKELMDLQKDMVVMLLSMLEGNVVNGTIGKQMVDMLVESSNNVEMILKFFDMFLKLKDLTSSDTFKEYDPDGKGVISKRDFHKAMESHKHYTQSETEFLLSCAETDENETLDYEEFVKRFHEPAKDIGFNVAVLLTNLSEHMPNDTRLQTFLELAESVLNYFQPFLGRIEIMGSAKRIERVYFEISESSRTQWEKPQVKESKRQFIFDVVNEGGEKEKMELFVNFCEDTIFEMQLAAQISESDLNERSANKEESEKERPEEQGPRMAFFSILTVRSALFALRYNILTLMRMLSLKSLKKQMKKVKKMTVKDMVTAFFSSYWSIFMTLLHFVASVFRGFFRIICSLLLGGSLVEGAKKIKVAELLANMPDPTQDEVRGDGEEGERKPLEAALPSEDLTDLKELTEESDLLSDIFGLDLKREGGQYKLIPHNPNAGLSDLMSNPVPMPEVQEKFQVIYLVTAAFSRRAYVLFVCFHRGEDGEKEEKAKEDKGKQKLRQLHTHRYGEPEVPESAFWKKIIAYQQKLLNYFARNFYNMRMLALFVAFAINFILLFYKVSTSSVVEGKELPTRSSSENAKVTSLDSSSHRIIAVHYVLEESSGYMEPTLRILAILHTVISFFCIIGYYCLKVPLVIFKREKEVARKLEFDGLYITEQPSEDDIKGQWDRLVINTQSFPNNYWDKFVKRKVMDKYGEFYGRDRISELLGMDKAALDFSDAREKKKPKKDSSLSAVLNSIDVKYQMWKLGVVFTDNSFLYLAWYMTMSVLGHYNNFFFAAHLLDIAMGFKTLRTILSSVTHNGKQLVLTVGLLAVVVYLYTVVAFNFFRKFYNKSEDGDTPDMKCDDMLTCYMFHMYVGVRAGGGIGDEIEDPAGDEYEIYRIIFDITFFFFVIVILLAIIQGLIIDAFGELRDQQEQVKEDMETKCFICGIGNDYFDTVPHGFETHTLQEHNLANYLFFLMYLINKDETEHTGQESYVWKMYQERCWEFFPAGDCFRKQYEDQLN

SEQ ID NO: 35183 - protein, 4870 aa, Homo sapiens
  ENSP00000489262
MAEGGEGGEDEIQFLRTEDEVVLQCIATIHKEQRKFCLAAEGLGNRLCFLEPTSEAKYIPPDLCVCNFVLEQSLSVRALQEMLANTGENGGEGAAQGGGHRTLLYGHAVLLRHSFSGMYLTCLTTSRSQTDKLAFDVGLREHATGEACWWTIHPASKQRSEGEKVRIGDDLILVSVSSERYLHLSVSNGNIQVDASFMQTLWNVHPTCSGSSIEEGYLLGGHVVRLFHGHDECLTIPSTDQNDSQHRRIFYEAGGAGTRARSLWRVEPLRISWSGSNIRWGQAFRLRHLTTGHYLALTEDQGLILQDRAKSDTKSTAFSFRASKELKEKLDSSHKRDIEGMGVPEIKYGDSVCFVQHIASGLWVTYKAQDAKTSRLGPLKRKVILHQEGHMDDGLTLQRCQREESQAARIIRNTTALFSQFVSGNNRTAAPITLPIEEVLQTLQDLIAYFQPPEEEMRHEDKQNKLRSLKNRQNLFKEEGMLALVLNCIDRLNVYNSVAHFAGIAREESGMAWKEILNLLYKLLAALIRGNRNNCAQFSNNLDWLISKLDRLESSSGILEVLHCILTESPEALNLIAEGHIKSIISLLDKHGRNHKVLDILCSLCLCNGVAVRANQNLICDNLLPRRNLLLQTRLINDVTSIRPNIFLGVAEGSAQYKKWYFELIIDQVDPFLTAEPTHLRVGWASSSGYAPYPGGGEGWGGNGVGDDLYSYGFDGLHLWSGRIPRAVASINQHLLRSDDVVSCCLDLGVPSISFRINGQPVQGMFENFNTDGLFFPVMSFSAGVKVRFLMGGRHGEFKFLPPSGYAPCYEALLPKEKMRLEPVKEYKRDADGIRDLLGTTQFLSQASFIPCPVDTSQVILPPHLEKIRDRLAENIHELWGMNKIELGWTFGKIRDDNKRQHPCLVEFSKLPETEKNYNLQMSTETLKTLLALGCHIAHVNPAAEEDLKKVKLPKNYMMSNGYKPAPLDLSDVKLLPPQEILVDKLAENAHNVWAKDRIKQGWTYGIQQDLKNKRNPRLVPYALLDERTKKSNRDSLREAVRTFVGYGYNIEPSDQELADSAVEKVSIDKIRFFRVERSYAVRSGKWYFEFEVVTGGDMRVGWARPGCRPDVELGADDQAFVFEGNRGQRWHQGSGYFGRTWQPGDVVGCMINLDDASMIFTLNGELLITNKGSELAFADYEIENGFVPICCLGLSQIGRMNLGTDASTFKFYTMCGLQEGFEPFAVNMNRDVAMWFSKRLPTFVNVPKDHPHIEVMRIDGTMDSPPCLKVTHKTFGTQNSNADMIYCRLSMPVECHSSFSHSPCLDSEAFQKRKQMQEILSHTTTQCYYAIRIFAGQDPSCVWVGWVTPDYHLYSEKFDLNKNCTVTVTLGDERGRVHESVKRSNCYMVWGGDIVASSQRSNRSNVDLEIGCLVDLAMGMLSFSANGKELGTCYQVEPNTKVFPAVFLQPTSTSLFQFELGKLKNAMPLSAAIFRSEEKNPVPQCPPRLDVQTIQPVLWSRMPNSFLKVETERVSERHGWVVQCLEPLQMMALHIPEENRCVDILELCEQEDLMRFHYHTLRLYSAVCALGNSRVAYALCSHVDLSQLFYAIDNKYLPGLLRSGFYDLLISIHLASAKERKLMMKNEYIIPITSTTRNIRLFPDESKRHGLPGVGLRTCLKPGFRFSTPCFVVTGEDHQKQSPEIPLESLRTKALSMLTEAVQCSGAHIRDPVGGSVEFQFVPVLKLIGTLLVMGVFDDDDVRQILLLIDPSVFGEHSAGTEEGAEKEEVTQVEEKAVEAGEKAGKEAPVKGLLQTRLPESVKLQMCELLSYLCDCELQHRVEAIVAFGDIYVSKLQANQKFRYNELMQALNMSAALTARKTKEFRSPPQEQINMLLNFQLGENCPCPEEIREELYDFHEDLLLHCGVPLEEEEEEEEDTSWTGKLCALVYKIKGPPKPEKEQPTEEEERCPTTLKELISQTMICWAQEDQIQDSELVRMMFNLLRRQYDSIGELLQALRKTYTISHTSVSDTINLLAALGQIRSLLSVRMGKEEELLMINGLGDIMNNKVFYQHPNLMRVLGMHETVMEVMVNVLGTEKSQIAFPKMVASCCRFLCYFCRISRQNQKAMFEHLSYLLENSSVGLASPSMRGSTPLDVAASSVMDNNELALSLEEPDLEKVVTYLAGCGLQSCPMLLAKGYPDVGWNPIEGERYLSFLRFAVFVNSESVEENASVVVKLLIRRPECFGPALRGEGGNGLLAAMQGAIKISENPALDLPSQGYKREVSTGDDEEEEEIVHMGNAIMSFYSALIDLLGRCAPEMHLIQTGKGEAIRIRSILRSLVPTEDLVGIISIPLKLPSLNKDGSVSEPDMAANFCPDHKAPMVLFLDRVYGIKDQTFLLHLLEVGFLPDLRASASLDTVSLSTTEAALALNRYICSAVLPLLTRCAPLFAGTEHCTSLIDSTLQTIYRLSKGRSLTKAQRDTIEECLLAICNHLRPSMLQQLLRRLVFDVPQLNEYCKMPLKLLTNHYEQCWKYYCLPSGWGSYGLAVEEELHLTEKLFWGIFDSLSHKKYDPDLFRMALPCLSAIAGALPPDYLDTRITATLEKQISVDADGNFDPKPINTMNFSLPEKLEYIVTKYAEHSHDKWACDKSQSGWKYGISLDENVKTHPLIRPFKTLTEKEKEIYRWPARESLKTMLAVGWTVERTKEGEALVQQRENEKLRSVSQANQGNSYSPAPLDLSNVVLSRELQGMVEVVAENYHNIWAKKKKLELESKGGGSHPLLVPYDTLTAKEKFKDREKAQDLFKFLQVNGIIVSRGMKDMELDASSMEKRFAYKFLKKILKYVDSAQEFIAHLEAIVSSGKTEKSPRDQEIKFFAKVLLPLVDQYFTSHCLYFLSSPLKPLSSSGYASHKEKEMVAGLFCKLAALVRHRISLFGSDSTTMVSCLHILAQTLDTRTVMKSGSELVKAGLRAFFENAAEDLEKTSENLKLGKFTHSRTQIKGVSQNINYTTVALLPILTSIFEHVTQHQFGMDLLLGDVQISCYHILCSLYSLGTGKNIYVERQRPALGECLASLAAAIPVAFLEPTLNRYNPLSVFNTKTPRERSILGMPDTVEDMCPDIPQLEGLMKEINDLAESGARYTEMPHVIEVILPMLCNYLSYWWERGPENLPPSTGPCCTKVTSEHLSLILGNILKIINNNLGIDEASWMKRIAVYAQPIISKARPDLLRSHFIPTLEKLKKKAVKTVQEEEQLKADGKGDTQEAELLILDEFAVLCRDLYAFYPMLIRYVDNNRSNWLKSPDADSDQLFRMVAEVFILWCKSHNFKREEQNFVIQNEINNLAFLTGDSKSKMSKAMQVKSGGQDQERKKTKRRGDLYSIQTSLIVAALKKMLPIGLNMCTPGDQELISLAKSRYSHRDTDEEVREHLRNNLHLQEKSDDPAVKWQLNLYKDVLKSEEPFNPEKTVERVQRISAAVFHLEQVEQPLRSKKAVWHKLLSKQRKRAVVACFRMAPLYNLPRHRSINLFLHGYQRFWIETEEYSFEEKLVQDLAKSPKVEEEEEEETEKQPDPLHQIILYFSRNALTERSKLEDDPLYTSYSSMMAKSCQSGEDEEEDEDKEKTFEEKEMEKQKTLYQQARLHERGAAEMVLQMISASKGEMSPMVVETLKLGIAILNGGNAGVQQKMLDYLKEKKDAGFFQSLSGLMQSCSVLDLNAFERQNKAEGLGMVTEEGTLIVRERGEKVLQNDEFTRDLFRFLQLLCEGHNSDFQNFLRTQMGNTTTVNVIISTVDYLLRLQESISDFYWYYSGKDIIDESGQHNFSKALAVTKQIFNSLTEYIQGPCIGNQQSLAHSRLWDAVVGFLHVFANMQMKLSQDSSQIELLKELLDLLQDMVVMLLSLLEGNVVNGTIGKQMVDTLVESSTNVEMILKFFDMFLKLKDLTSSDTFKEYDPDGKGIISKKEFQKAMEGQKQYTQSEIDFLLSCAEADENDMFNYVDFVDRFHEPAKDIGFNVAVLLTNLSEHMPNDSRLKCLLDPAESVLNYFEPYLGRIEIMGGAKKIERVYFEISESSRTQWEKPQVKESKRQFIFDVVNEGGEQEKMELFVNFCEDTIFEMQLASQISESDSADRPEEEEEDEDSSYVLEIAGEEEEDGSLEPASAFAMACASVKRNVTDFLKRATLKNLRKQYRNVKKMTAKELVKVLFSFFWMLFVGLFQLLFTILGGIFQILWSTVFGGGLVEGAKNIRVTKILGDMPDPTQFGIHDDTMEAERAEVMEPGITTELVHFIKGEKGDTDIMSDLFGLHPKKEGSLKHGPEVGLGDLSEIIGKDEPPTLESTVQKKRKAQAAEMKAANEAEGKVESEKADMEDGEKEDKDKEEEQAEYLWTEVTKKKKRRCGQKVEKPEAFTANFFKGLEIYQTKLLHYLARNFYNLRFLALFVAFAINFILLFYKVTEEPLEEETEDVANLWNSFNDEEEEEAMVFFVLQESTGYMAPTLRALAIIHTIISLVCVVGYYCLKVPLVVFKREKEIARKLEFDGLYITEQPSEDDIKGQWDRLVINTPSFPNNYWDKFVKRKVINKYGDLYGAERIAELLGLDKNALDFSPVEETKAEAASLVSWLSSIDMKYHIWKLGVVFTDNSFLYLAWYTTMSVLGHYNNFFFAAHLLDIAMGFKTLRTILSSVTHNGKQLVLTVGLLAVVVYLYTVVAFNFFRKFYNKSEDDDEPDMKCDDMMTCYLFHMYVGVRAGGGIGDEIEDPAGDPYEMYRIVFDITFFFFVIVILLAIIQGLIIDAFGELRDQQEQVREDMETKCFICGIGNDYFDTTPHGFETHTLQEHNLANYLFFLMYLINKDETEHTGQESYVWKMYQERCWDFFPAGDCFRKQYEDQLG

SEQ ID NO: 35184 - protein, 4865 aa, Homo sapiens
  ENSP00000399610
MAEGGEGGEDEIQFLRTEDEVVLQCIATIHKEQRKFCLAAEGLGNRLCFLEPTSEAKYIPPDLCVCNFVLEQSLSVRALQEMLANTGENGGEGAAQGGGHRTLLYGHAVLLRHSFSGMYLTCLTTSRSQTDKLAFDVGLREHATGEACWWTIHPASKQRSEGEKVRIGDDLILVSVSSERYLHLSVSNGNIQVDASFMQTLWNVHPTCSGSSIEEGYLLGGHVVRLFHGHDECLTIPSTDQNDSQHRRIFYEAGGAGTRARSLWRVEPLRISWSGSNIRWGQAFRLRHLTTGHYLALTEDQGLILQDRAKSDTKSTAFSFRASKELKEKLDSSHKRDIEGMGVPEIKYGDSVCFVQHIASGLWVTYKAQDAKTSRLGPLKRKVILHQEGHMDDGLTLQRCQREESQAARIIRNTTALFSQFVSGNNRTAAPITLPIEEVLQTLQDLIAYFQPPEEEMRHEDKQNKLRSLKNRQNLFKEEGMLALVLNCIDRLNVYNSVAHFAGIAREESGMAWKEILNLLYKLLAALIRGNRNNCAQFSNNLDWLISKLDRLESSSGILEVLHCILTESPEALNLIAEGHIKSIISLLDKHGRNHKVLDILCSLCLCNGVAVRANQNLICDNLLPRRNLLLQTRLINDVTSIRPNIFLGVAEGSAQYKKWYFELIIDQVDPFLTAEPTHLRVGWASSSGYAPYPGGGEGWGGNGVGDDLYSYGFDGLHLWSGRIPRAVASINQHLLRSDDVVSCCLDLGVPSISFRINGQPVQGMFENFNTDGLFFPVMSFSAGVKVRFLMGGRHGEFKFLPPSGYAPCYEALLPKEKMRLEPVKEYKRDADGIRDLLGTTQFLSQASFIPCPVDTSQVILPPHLEKIRDRLAENIHELWGMNKIELGWTFGKIRDDNKRQHPCLVEFSKLPETEKNYNLQMSTETLKTLLALGCHIAHVNPAAEEDLKKVKLPKNYMMSNGYKPAPLDLSDVKLLPPQEILVDKLAENAHNVWAKDRIKQGWTYGIQQDLKNKRNPRLVPYALLDERTKKSNRDSLREAVRTFVGYGYNIEPSDQELADSAVEKVSIDKIRFFRVERSYAVRSGKWYFEFEVVTGGDMRVGWARPGCRPDVELGADDQAFVFEGNRGQRWHQGSGYFGRTWQPGDVVGCMINLDDASMIFTLNGELLITNKGSELAFADYEIENGFVPICCLGLSQIGRMNLGTDASTFKFYTMCGLQEGFEPFAVNMNRDVAMWFSKRLPTFVNVPKDHPHIEVMRIDGTMDSPPCLKVTHKTFGTQNSNADMIYCRLSMPVECHSSFSHSPCLDSEAFQKRKQMQEILSHTTTQCYYAIRIFAGQDPSCVWVGWVTPDYHLYSEKFDLNKNCTVTVTLGDERGRVHESVKRSNCYMVWGGDIVASSQRSNRSNVDLEIGCLVDLAMGMLSFSANGKELGTCYQVEPNTKVFPAVFLQPTSTSLFQFELGKLKNAMPLSAAIFRSEEKNPVPQCPPRLDVQTIQPVLWSRMPNSFLKVETERVSERHGWVVQCLEPLQMMALHIPEENRCVDILELCEQEDLMRFHYHTLRLYSAVCALGNSRVAYALCSHVDLSQLFYAIDNKYLPGLLRSGFYDLLISIHLASAKERKLMMKNEYIIPITSTTRNIRLFPDESKRHGLPGVGLRTCLKPGFRFSTPCFVVTGEDHQKQSPEIPLESLRTKALSMLTEAVQCSGAHIRDPVGGSVEFQFVPVLKLIGTLLVMGVFDDDDVRQILLLIDPSVFGEHSAGTEEGAEKEEVTQVEEKAVEAGEKAGKEAPVKGLLQTRLPESVKLQMCELLSYLCDCELQHRVEAIVAFGDIYVSKLQANQKFRYNELMQALNMSAALTARKTKEFRSPPQEQINMLLNFQLGENCPCPEEIREELYDFHEDLLLHCGVPLEEEEEEEEDTSWTGKLCALVYKIKGPPKPEKEQPTEEEERCPTTLKELISQTMICWAQEDQIQDSELVRMMFNLLRRQYDSIGELLQALRKTYTISHTSVSDTINLLAALGQIRSLLSVRMGKEEELLMINGLGDIMNNKVFYQHPNLMRVLGMHETVMEVMVNVLGTEKSQIAFPKMVASCCRFLCYFCRISRQNQKAMFEHLSYLLENSSVGLASPSMRGSTPLDVAASSVMDNNELALSLEEPDLEKVVTYLAGCGLQSCPMLLAKGYPDVGWNPIEGERYLSFLRFAVFVNSESVEENASVVVKLLIRRPECFGPALRGEGGNGLLAAMQGAIKISENPALDLPSQGYKREVSTGDDEEEEEIVHMGNAIMSFYSALIDLLGRCAPEMHLIQTGKGEAIRIRSILRSLVPTEDLVGIISIPLKLPSLNKDGSVSEPDMAANFCPDHKAPMVLFLDRVYGIKDQTFLLHLLEVGFLPDLRASASLDTVSLSTTEAALALNRYICSAVLPLLTRCAPLFAGTEHCTSLIDSTLQTIYRLSKGRSLTKAQRDTIEECLLAICNHLRPSMLQQLLRRLVFDVPQLNEYCKMPLKLLTNHYEQCWKYYCLPSGWGSYGLAVEEELHLTEKLFWGIFDSLSHKKYDPDLFRMALPCLSAIAGALPPDYLDTRITATLEKQISVDADGNFDPKPINTMNFSLPEKLEYIVTKYAEHSHDKWACDKSQSGWKYGISLDENVKTHPLIRPFKTLTEKEKEIYRWPARESLKTMLAVGWTVERTKEGEALVQQRENEKLRSVSQANQGNSYSPAPLDLSNVVLSRELQGMVEVVAENYHNIWAKKKKLELESKGGGSHPLLVPYDTLTAKEKFKDREKAQDLFKFLQVNGIIVSRGMKDMELDASSMEKRFAYKFLKKILKYVDSAQEFIAHLEAIVSSGKTEKSPRDQEIKFFAKVLLPLVDQYFTSHCLYFLSSPLKPLSSSGYASHKEKEMVAGLFCKLAALVRHRISLFGSDSTTMVSCLHILAQTLDTRTVMKSGSELVKAGLRAFFENAAEDLEKTSENLKLGKFTHSRTQIKGVSQNINYTTVALLPILTSIFEHVTQHQFGMDLLLGDVQISCYHILCSLYSLGTGKNIYVERQRPALGECLASLAAAIPVAFLEPTLNRYNPLSVFNTKTPRERSILGMPDTVEDMCPDIPQLEGLMKEINDLAESGARYTEMPHVIEVILPMLCNYLSYWWERGPENLPPSTGPCCTKVTSEHLSLILGNILKIINNNLGIDEASWMKRIAVYAQPIISKARPDLLRSHFIPTLEKLKKKAVKTVQEEEQLKADGKGDTQEAELLILDEFAVLCRDLYAFYPMLIRYVDNNRSNWLKSPDADSDQLFRMVAEVFILWCKSHNFKREEQNFVIQNEINNLAFLTGDSKSKMSKSGGQDQERKKTKRRGDLYSIQTSLIVAALKKMLPIGLNMCTPGDQELISLAKSRYSHRDTDEEVREHLRNNLHLQEKSDDPAVKWQLNLYKDVLKSEEPFNPEKTVERVQRISAAVFHLEQVEQPLRSKKAVWHKLLSKQRKRAVVACFRMAPLYNLPRHRSINLFLHGYQRFWIETEEYSFEEKLVQDLAKSPKVEEEEEEETEKQPDPLHQIILYFSRNALTERSKLEDDPLYTSYSSMMAKSCQSGEDEEEDEDKEKTFEEKEMEKQKTLYQQARLHERGAAEMVLQMISASKGEMSPMVVETLKLGIAILNGGNAGVQQKMLDYLKEKKDAGFFQSLSGLMQSCSVLDLNAFERQNKAEGLGMVTEEGTLIVRERGEKVLQNDEFTRDLFRFLQLLCEGHNSDFQNFLRTQMGNTTTVNVIISTVDYLLRLQESISDFYWYYSGKDIIDESGQHNFSKALAVTKQIFNSLTEYIQGPCIGNQQSLAHSRLWDAVVGFLHVFANMQMKLSQDSSQIELLKELLDLLQDMVVMLLSLLEGNVVNGTIGKQMVDTLVESSTNVEMILKFFDMFLKLKDLTSSDTFKEYDPDGKGIISKKEFQKAMEGQKQYTQSEIDFLLSCAEADENDMFNYVDFVDRFHEPAKDIGFNVAVLLTNLSEHMPNDSRLKCLLDPAESVLNYFEPYLGRIEIMGGAKKIERVYFEISESSRTQWEKPQVKESKRQFIFDVVNEGGEQEKMELFVNFCEDTIFEMQLASQISESDSADRPEEEEEDEDSSYVLEIAGEEEEDGSLEPASAFAMACASVKRNVTDFLKRATLKNLRKQYRNVKKMTAKELVKVLFSFFWMLFVGLFQLLFTILGGIFQILWSTVFGGGLVEGAKNIRVTKILGDMPDPTQFGIHDDTMEAERAEVMEPGITTELVHFIKGEKGDTDIMSDLFGLHPKKEGSLKHGPEVGLGDLSEIIGKDEPPTLESTVQKKRKAQAAEMKAANEAEGKVESEKADMEDGEKEDKDKEEEQAEYLWTEVTKKKKRRCGQKVEKPEAFTANFFKGLEIYQTKLLHYLARNFYNLRFLALFVAFAINFILLFYKVTEEPLEEETEDVANLWNSFNDEEEEEAMVFFVLQESTGYMAPTLRALAIIHTIISLVCVVGYYCLKVPLVVFKREKEIARKLEFDGLYITEQPSEDDIKGQWDRLVINTPSFPNNYWDKFVKRKVINKYGDLYGAERIAELLGLDKNALDFSPVEETKAEAASLVSWLSSIDMKYHIWKLGVVFTDNSFLYLAWYTTMSVLGHYNNFFFAAHLLDIAMGFKTLRTILSSVTHNGKQLVLTVGLLAVVVYLYTVVAFNFFRKFYNKSEDDDEPDMKCDDMMTCYLFHMYVGVRAGGGIGDEIEDPAGDPYEMYRIVFDITFFFFVIVILLAIIQGLIIDAFGELRDQQEQVREDMETKCFICGIGNDYFDTTPHGFETHTLQEHNLANYLFFLMYLINKDETEHTGQESYVWKMYQERCWDFFPAGDCFRKQYEDQLG

SEQ ID NO: 35185 - protein, 4869 aa, Homo sapiens
  ENSP00000373884
MAEGGEGGEDEIQFLRTEDEVVLQCIATIHKEQRKFCLAAEGLGNRLCFLEPTSEAKYIPPDLCVCNFVLEQSLSVRALQEMLANTGENGGEGAAQGGGHRTLLYGHAVLLRHSFSGMYLTCLTTSRSQTDKLAFDVGLREHATGEACWWTIHPASKQRSEGEKVRIGDDLILVSVSSERYLHLSVSNGNIQVDASFMQTLWNVHPTCSGSSIEEGYLLGGHVVRLFHGHDECLTIPSTDQNDSQHRRIFYEAGGAGTRARSLWRVEPLRISWSGSNIRWGQAFRLRHLTTGHYLALTEDQGLILQDRAKSDTKSTAFSFRASKELKEKLDSSHKRDIEGMGVPEIKYGDSVCFVQHIASGLWVTYKAQDAKTSRLGPLKRKVILHQEGHMDDGLTLQRCQREESQAARIIRNTTALFSQFVSGNNRTAAPITLPIEEVLQTLQDLIAYFQPPEEEMRHEDKQNKLRSLKNRQNLFKEEGMLALVLNCIDRLNVYNSVAHFAGIAREESGMAWKEILNLLYKLLAALIRGNRNNCAQFSNNLDWLISKLDRLESSSGILEVLHCILTESPEALNLIAEGHIKSIISLLDKHGRNHKVLDILCSLCLCNGVAVRANQNLICDNLLPRRNLLLQTRLINDVTSIRPNIFLGVAEGSAQYKKWYFELIIDQVDPFLTAEPTHLRVGWASSSGYAPYPGGGEGWGGNGVGDDLYSYGFDGLHLWSGRIPRAVASINQHLLRSDDVVSCCLDLGVPSISFRINGQPVQGMFENFNTDGLFFPVMSFSAGVKVRFLMGGRHGEFKFLPPSGYAPCYEALLPKEKMRLEPVKEYKRDADGIRDLLGTTQFLSQASFIPCPVDTSQVILPPHLEKIRDRLAENIHELWGMNKIELGWTFGKIRDDNKRQHPCLVEFSKLPETEKNYNLQMSTETLKTLLALGCHIAHVNPAAEEDLKKVKLPKNYMMSNGYKPAPLDLSDVKLLPPQEILVDKLAENAHNVWAKDRIKQGWTYGIQQDLKNKRNPRLVPYALLDERTKKSNRDSLREAVRTFVGYGYNIEPSDQELADSAVEKVSIDKIRFFRVERSYAVRSGKWYFEFEVVTGGDMRVGWARPGCRPDVELGADDQAFVFEGNRGQRWHQGSGYFGRTWQPGDVVGCMINLDDASMIFTLNGELLITNKGSELAFADYEIENGFVPICCLGLSQIGRMNLGTDASTFKFYTMCGLQEGFEPFAVNMNRDVAMWFSKRLPTFVNVPKDHPHIEVMRIDGTMDSPPCLKVTHKTFGTQNSNADMIYCRLSMPVECHSSFSHSPCLDSEAFQKRKQMQEILSHTTTQCYYAIRIFAGQDPSCVWVGWVTPDYHLYSEKFDLNKNCTVTVTLGDERGRVHESVKRSNCYMVWGGDIVASSQRSNRSNVDLEIGCLVDLAMGMLSFSANGKELGTCYQVEPNTKVFPAVFLQPTSTSLFQFELGKLKNAMPLSAAIFRSEEKNPVPQCPPRLDVQTIQPVLWSRMPNSFLKVETERVSERHGWVVQCLEPLQMMALHIPEENRCVDILELCEQEDLMRFHYHTLRLYSAVCALGNSRVAYALCSHVDLSQLFYAIDNKYLPGLLRSGFYDLLISIHLASAKERKLMMKNEYIIPITSTTRNIRLFPDESKRHGLPGVGLRTCLKPGFRFSTPCFVVTGEDHQKQSPEIPLESLRTKALSMLTEAVQCSGAHIRDPVGGSVEFQFVPVLKLIGTLLVMGVFDDDDVRQILLLIDPSVFGEHSAGTEEGAEKEEVTQVEEKAVEAGEKAGKEAPVKGLLQTRLPESVKLQMCELLSYLCDCELQHRVEAIVAFGDIYVSKLQANQKFRYNELMQALNMSAALTARKTKEFRSPPQEQINMLLNFQLGENCPCPEEIREELYDFHEDLLLHCGVPLEEEEEEEEDTSWTGKLCALVYKIKGPPKPEKEQPTEEEERCPTTLKELISQTMICWAQEDQIQDSELVRMMFNLLRRQYDSIGELLQALRKTYTISHTSVSDTINLLAALGQIRSLLSVRMGKEEELLMINGLGDIMNNKVFYQHPNLMRVLGMHETVMEVMVNVLGTEKSQIAFPKMVASCCRFLCYFCRISRQNQKAMFEHLSYLLENSSVGLASPSMRGSTPLDVAASSVMDNNELALSLEEPDLEKVVTYLAGCGLQSCPMLLAKGYPDVGWNPIEGERYLSFLRFAVFVNSESVEENASVVVKLLIRRPECFGPALRGEGGNGLLAAMQGAIKISENPALDLPSQGYKREVTGDDEEEEEIVHMGNAIMSFYSALIDLLGRCAPEMHLIQTGKGEAIRIRSILRSLVPTEDLVGIISIPLKLPSLNKDGSVSEPDMAANFCPDHKAPMVLFLDRVYGIKDQTFLLHLLEVGFLPDLRASASLDTVSLSTTEAALALNRYICSAVLPLLTRCAPLFAGTEHCTSLIDSTLQTIYRLSKGRSLTKAQRDTIEECLLAICNHLRPSMLQQLLRRLVFDVPQLNEYCKMPLKLLTNHYEQCWKYYCLPSGWGSYGLAVEEELHLTEKLFWGIFDSLSHKKYDPDLFRMALPCLSAIAGALPPDYLDTRITATLEKQISVDADGNFDPKPINTMNFSLPEKLEYIVTKYAEHSHDKWACDKSQSGWKYGISLDENVKTHPLIRPFKTLTEKEKEIYRWPARESLKTMLAVGWTVERTKEGEALVQQRENEKLRSVSQANQGNSYSPAPLDLSNVVLSRELQGMVEVVAENYHNIWAKKKKLELESKGGGSHPLLVPYDTLTAKEKFKDREKAQDLFKFLQVNGIIVSRGMKDMELDASSMEKRFAYKFLKKILKYVDSAQEFIAHLEAIVSSGKTEKSPRDQEIKFFAKVLLPLVDQYFTSHCLYFLSSPLKPLSSSGYASHKEKEMVAGLFCKLAALVRHRISLFGSDSTTMVSCLHILAQTLDTRTVMKSGSELVKAGLRAFFENAAEDLEKTSENLKLGKFTHSRTQIKGVSQNINYTTVALLPILTSIFEHVTQHQFGMDLLLGDVQISCYHILCSLYSLGTGKNIYVERQRPALGECLASLAAAIPVAFLEPTLNRYNPLSVFNTKTPRERSILGMPDTVEDMCPDIPQLEGLMKEINDLAESGARYTEMPHVIEVILPMLCNYLSYWWERGPENLPPSTGPCCTKVTSEHLSLILGNILKIINNNLGIDEASWMKRIAVYAQPIISKARPDLLRSHFIPTLEKLKKKAVKTVQEEEQLKADGKGDTQEAELLILDEFAVLCRDLYAFYPMLIRYVDNNRSNWLKSPDADSDQLFRMVAEVFILWCKSHNFKREEQNFVIQNEINNLAFLTGDSKSKMSKAMQVKSGGQDQERKKTKRRGDLYSIQTSLIVAALKKMLPIGLNMCTPGDQELISLAKSRYSHRDTDEEVREHLRNNLHLQEKSDDPAVKWQLNLYKDVLKSEEPFNPEKTVERVQRISAAVFHLEQVEQPLRSKKAVWHKLLSKQRKRAVVACFRMAPLYNLPRHRSINLFLHGYQRFWIETEEYSFEEKLVQDLAKSPKVEEEEEEETEKQPDPLHQIILYFSRNALTERSKLEDDPLYTSYSSMMAKSCQSGEDEEEDEDKEKTFEEKEMEKQKTLYQQARLHERGAAEMVLQMISASKGEMSPMVVETLKLGIAILNGGNAGVQQKMLDYLKEKKDAGFFQSLSGLMQSCSVLDLNAFERQNKAEGLGMVTEEGTLIVRERGEKVLQNDEFTRDLFRFLQLLCEGHNSDFQNFLRTQMGNTTTVNVIISTVDYLLRLQESISDFYWYYSGKDIIDESGQHNFSKALAVTKQIFNSLTEYIQGPCIGNQQSLAHSRLWDAVVGFLHVFANMQMKLSQDSSQIELLKELLDLLQDMVVMLLSLLEGNVVNGTIGKQMVDTLVESSTNVEMILKFFDMFLKLKDLTSSDTFKEYDPDGKGIISKKEFQKAMEGQKQYTQSEIDFLLSCAEADENDMFNYVDFVDRFHEPAKDIGFNVAVLLTNLSEHMPNDSRLKCLLDPAESVLNYFEPYLGRIEIMGGAKKIERVYFEISESSRTQWEKPQVKESKRQFIFDVVNEGGEQEKMELFVNFCEDTIFEMQLASQISESDSADRPEEEEEDEDSSYVLEIAGEEEEDGSLEPASAFAMACASVKRNVTDFLKRATLKNLRKQYRNVKKMTAKELVKVLFSFFWMLFVGLFQLLFTILGGIFQILWSTVFGGGLVEGAKNIRVTKILGDMPDPTQFGIHDDTMEAERAEVMEPGITTELVHFIKGEKGDTDIMSDLFGLHPKKEGSLKHGPEVGLGDLSEIIGKDEPPTLESTVQKKRKAQAAEMKAANEAEGKVESEKADMEDGEKEDKDKEEEQAEYLWTEVTKKKKRRCGQKVEKPEAFTANFFKGLEIYQTKLLHYLARNFYNLRFLALFVAFAINFILLFYKVTEEPLEEETEDVANLWNSFNDEEEEEAMVFFVLQESTGYMAPTLRALAIIHTIISLVCVVGYYCLKVPLVVFKREKEIARKLEFDGLYITEQPSEDDIKGQWDRLVINTPSFPNNYWDKFVKRKVINKYGDLYGAERIAELLGLDKNALDFSPVEETKAEAASLVSWLSSIDMKYHIWKLGVVFTDNSFLYLAWYTTMSVLGHYNNFFFAAHLLDIAMGFKTLRTILSSVTHNGKQLVLTVGLLAVVVYLYTVVAFNFFRKFYNKSEDDDEPDMKCDDMMTCYLFHMYVGVRAGGGIGDEIEDPAGDPYEMYRIVFDITFFFFVIVILLAIIQGLIIDAFGELRDQQEQVREDMETKCFICGIGNDYFDTTPHGFETHTLQEHNLANYLFFLMYLINKDETEHTGQESYVWKMYQERCWDFFPAGDCFRKQYEDQLG

SEQ ID NO: 35186 - protein, 4859 aa, Homo sapiens
  ENSP00000489529
MAEGGEGGEDEIQFLRTEDEVVLQCIATIHKEQRKFCLAAEGLGNRLCFLEPTSEAKYIPPDLCVCNFVLEQSLSVRALQEMLANTGENGGEGAAQGGGHRTLLYGHAVLLRHSFSGMYLTCLTTSRSQTDKLAFDVGLREHATGEACWWTIHPASKQRSEGEKVRIGDDLILVSVSSERYLHLSVSNGNIQVDASFMQTLWNVHPTCSGSSIEEGYLLGGHVVRLFHGHDECLTIPSTDQNDSQHRRIFYEAGGAGTRARSLWRVEPLRISWSGSNIRWGQAFRLRHLTTGHYLALTEDQGLILQDRAKSDTKSTAFSFRASKELKEKLDSSHKRDIEGMGVPEIKYGDSVCFVQHIASGLWVTYKAQDAKTSRLGPLKRKVILHQEGHMDDGLTLQRCQREESQAARIIRNTTALFSQFVSGNNRTAAPITLPIEEVLQTLQDLIAYFQPPEEEMRHEDKQNKLRSLKNRQNLFKEEGMLALVLNCIDRLNVYNSVAHFAGIAREESGMAWKEILNLLYKLLAALIRGNRNNCAQFSNNLDWLISKLDRLESSSGILEVLHCILTESPEALNLIAEGHIKSIISLLDKHGRNHKVLDILCSLCLCNGVAVRANQNLICDNLLPRRNLLLQTRLINDVTSIRPNIFLGVAEGSAQYKKWYFELIIDQVDPFLTAEPTHLRVGWASSSGYAPYPGGGEGWGGNGVGDDLYSYGFDGLHLWSGRIPRAVASINQHLLRSDDVVSCCLDLGVPSISFRINGQPVQGMFENFNTDGLFFPVMSFSAGVKVRFLMGGRHGEFKFLPPSGYAPCYEALLPKEKMRLEPVKEYKRDADGIRDLLGTTQFLSQASFIPCPVDTSQVILPPHLEKIRDRLAENIHELWGMNKIELGWTFGKIRDDNKRQHPCLVEFSKLPETEKNYNLQMSTETLKTLLALGCHIAHVNPAAEEDLKKVKLPKNYMMSNGYKPAPLDLSDVKLLPPQEILVDKLAENAHNVWAKDRIKQGWTYGIQQDLKNKRNPRLVPYALLDERTKKSNRDSLREAVRTFVGYGYNIEPSDQELADSAVEKVSIDKIRFFRVERSYAVRSGKWYFEFEVVTGGDMRVGWARPGCRPDVELGADDQAFVFEGNRGQRWHQGSGYFGRTWQPGDVVGCMINLDDASMIFTLNGELLITNKGSELAFADYEIENGFVPICCLGLSQIGRMNLGTDASTFKFYTMCGLQEGFEPFAVNMNRDVAMWFSKRLPTFVNVPKDHPHIEVMRIDGTMDSPPCLKVTHKTFGTQNSNADMIYCRLSMPVECHSSFSHSPCLDSEAFQKRKQMQEILSHTTTQCYYAIRIFAGQDPSCVWVGWVTPDYHLYSEKFDLNKNCTVTVTLGDERGRVHESVKRSNCYMVWGGDIVASSQRSNRSNVDLEIGCLVDLAMGMLSFSANGKELGTCYQVEPNTKVFPAVFLQPTSTSLFQFELGKLKNAMPLSAAIFRSEEKNPVPQCPPRLDVQTIQPVLWSRMPNSFLKVETERVSERHGWVVQCLEPLQMMALHIPEENRCVDILELCEQEDLMRFHYHTLRLYSAVCALGNSRVAYALCSHVDLSQLFYAIDNKYLPGLLRSGFYDLLISIHLASAKERKLMMKNEYIIPITSTTRNIRLFPDESKRHGLPGVGLRTCLKPGFRFSTPCFVVTGEDHQKQSPEIPLESLRTKALSMLTEAVQCSGAHIRDPVGGSVEFQFVPVLKLIGTLLVMGVFDDDDVRQILLLIDPSVFGEHSAGTEEGAEKEEVTQVEEKAVEAGEKAGKEAPVKGLLQTRLPESVKLQMCELLSYLCDCELQHRVEAIVAFGDIYVSKLQANQKFRYNELMQALNMSAALTARKTKEFRSPPQEQINMLLNFQLGENCPCPEEIREELYDFHEDLLLHCGVPLEEEEEEEEDTSWTGKLCALVYKIKGPPKPEKEQPTEEEERCPTTLKELISQTMICWAQEDQIQDSELVRMMFNLLRRQYDSIGELLQALRKTYTISHTSVSDTINLLAALGQIRSLLSVRMGKEEELLMINGLGDIMNNKVFYQHPNLMRVLGMHETVMEVMVNVLGTEKSQIAFPKMVASCCRFLCYFCRISRQNQKAMFEHLSYLLENSSVGLASPSMRGSTPLDVAASSVMDNNELALSLEEPDLEKVVTYLAGCGLQSCPMLLAKGYPDVGWNPIEGERYLSFLRFAVFVNSESVEENASVVVKLLIRRPECFGPALRGEGGNGLLAAMQGAIKISENPALDLPSQGYKREVTGDDEEEEEIVHMGNAIMSFYSALIDLLGRCAPEMHLIQTGKGEAIRIRSILRSLVPTEDLVGIISIPLKLPSLNKDGSVSEPDMAANFCPDHKAPMVLFLDRVYGIKDQTFLLHLLEVGFLPDLRASASLDTVSLSTTEAALALNRYICSAVLPLLTRCAPLFAGTEHCTSLIDSTLQTIYRLSKGRSLTKAQRDTIEECLLAICNHLRPSMLQQLLRRLVFDVPQLNEYCKMPLKLLTNHYEQCWKYYCLPSGWGSYGLAVEEELHLTEKLFWGIFDSLSHKKYDPDLFRMALPCLSAIAGALPPDYLDTRITATLEKQISVDADGNFDPKPINTMNFSLPEKLEYIVTKYAEHSHDKWACDKSQSGWKYGISLDENVKTHPLIRPFKTLTEKEKEIYRWPARESLKTMLAVGWTVERTKEGEALVQQRENEKLRSVSQANQGNSYSPAPLDLSNVVLSRELQGMVEVVAENYHNIWAKKKKLELESKGGGSHPLLVPYDTLTAKEKFKDREKAQDLFKFLQVNGIIVSRGMKDMELDASSMEKRFAYKFLKKILKYVDSAQEFIAHLEAIVSSGKTEKSPRDQEIKFFAKVLLPLVDQYFTSHCLYFLSSPLKPLSSSGYASHKEKEMVAGLFCKLAALVRHRISLFGSDSTTMVSCLHILAQTLDTRTVMKSGSELVKAGLRAFFENAAEDLEKTSENLKLGKFTHSRTQIKGVSQNINYTTVALLPILTSIFEHVTQHQFGMDLLLGDVQISCYHILCSLYSLGTGKNIYVERQRPALGECLASLAAAIPVAFLEPTLNRYNPLSVFNTKTPRERSILGMPDTVEDMCPDIPQLEGLMKEINDLAESGARYTEMPHVIEVILPMLCNYLSYWWERGPENLPPSTGPCCTKVTSEHLSLILGNILKIINNNLGIDEASWMKRIAVYAQPIISKARPDLLRSHFIPTLEKLKKKAVKTVQEEEQLKADGKGDTQEAELLILDEFAVLCRDLYAFYPMLIRYVDNNRSNWLKSPDADSDQLFRMVAEVFILWCKSHNFKREEQNFVIQNEINNLAFLTGDSKSKMSKSGGQDQERKKTKRRGDLYSIQTSLIVAALKKMLPIGLNMCTPGDQELISLAKSRYSHRDTDEEVREHLRNNLHLQEKSDDPAVKWQLNLYKDVLKSEEPFNPEKTVERVQRISAAVFHLEQVEQPLRSKKAVWHKLLSKQRKRAVVACFRMAPLYNLPRHKINNFFLSTFQQVWLEKVNEKTQYDRLIPILMKSPKVEEEEEEETEKQPDPLHQIILYFSRNALTERSKLEDDPLYTSYSSMMAKSCQSGEDEEEDEDKEKTFEEKEMEKQKTLYQQARLHERGAAEMVLQMISASKGEMSPMVVETLKLGIAILNGGNAGVQQKMLDYLKEKKDAGFFQSLSGLMQSCSVLDLNAFERQNKAEGLGMVTEEGTREKVLQNDEFTRDLFRFLQLLCEGHNSDFQNFLRTQMGNTTTVNVIISTVDYLLRLQESISDFYWYYSGKDIIDESGQHNFSKALAVTKQIFNSLTEYIQGPCIGNQQSLAHSRLWDAVVGFLHVFANMQMKLSQDSSQIELLKELLDLLQDMVVMLLSLLEGNVVNGTIGKQMVDTLVESSTNVEMILKFFDMFLKLKDLTSSDTFKEYDPDGKGIISKKEFQKAMEGQKQYTQSEIDFLLSCAEADENDMFNYVDFVDRFHEPAKDIGFNVAVLLTNLSEHMPNDSRLKCLLDPAESVLNYFEPYLGRIEIMGGAKKIERVYFEISESSRTQWEKPQVKESKRQFIFDVVNEGGEQEKMELFVNFCEDTIFEMQLASQISESDSADRPEEEEEDEDSSYVLEIAGEEEEDGSLEPASAFAMACASVKRNVTDFLKRATLKNLRKQYRNVKKMTAKELVKVLFSFFWMLFVGLFQLLFTILGGIFQILWSTVFGGGLVEGAKNIRVTKILGDMPDPTQFGIHDDTMEAERAEVMEPGITTELVHFIKGEKGDTDIMSDLFGLHPKKEGSLKHGPEVGLGDLSEIIGKDEPPTLESTVQKKRKAQAAEMKAANEAEGKVESEKADMEDGEKEDKDKEEEQAEYLWTEVTKKKKRRCGQKVEKPEAFTANFFKGLEIYQTKLLHYLARNFYNLRFLALFVAFAINFILLFYKVTEEPLEEETEDVANLWNSFNDEEEEEAMVFFVLQESTGYMAPTLRALAIIHTIISLVCVVGYYCLKVPLVVFKREKEIARKLEFDGLYITEQPSEDDIKGQWDRLVINTPSFPNNYWDKFVKRKVINKYGDLYGAERIAELLGLDKNALDFSPVEETKAEAASLVSWLSSIDMKYHIWKLGVVFTDNSFLYLAWYTTMSVLGHYNNFFFAAHLLDIAMGFKTLRTILSSVTHNGKQLVLTVGLLAVVVYLYTVVAFNFFRKFYNKSEDDDEPDMKCDDMMTCYLFHMYVGVRAGGGIGDEIEDPAGDPYEMYRIVFDITFFFFVIVILLAIIQGLIIDAFGELRDQQEQVREDMETKCFICGIGNDYFDTTPHGFETHTLQEHNLANYLFFLMYLINKDETEHTGQESYVWKMYQERCWDFFPAGDCFRKQYEDQLG

SEQ ID NO: 35187 - protein, 46 aa, Homo sapiens
  ENSP00000489294
  MOD_RES (1)..(1): Any amino acid
XEDEIQFLRTYIPPDLCVCNFVLEQSLSVRALQEMLANTGENGGEG

SEQ ID NO: 35188 - protein, 1101 aa, Homo sapiens
  ENSP00000489672
  MOD_RES (1)..(1): Any amino acid
XGRCAPEMHLIQTGKGEAIRIRSILRSLVPTEDLVGIISIPLKLPSLNKDGSVSEPDMAANFCPDHKAPMVLFLDRVYGIKDQTFLLHLLEVGFLPDLRASASLDTVSLSTTEAALALNRYICSAVLPLLTRCAPLFAGTEHCTSLIDSTLQTIYRLSKGRSLTKAQRDTIEECLLAICNHLRPSMLQQLLRRLVFDVPQLNEYCKMPLKLLTNHYEQCWKYYCLPSGWGSYGLAVEEELHLTEKLFWGIFDSLSHKKYDPDLFRMALPCLSAIAGALPPDYLDTRITATLEKQISVDADGNFDPKPINTMNFSLPEKLEYIVTKYAEHSHDKWACDKSQSGWKYGISLDENVKTHPLIRPFKTLTEKEKEIYRWPARESLKTMLAVGWTVERTKEGEALVQQRENEKLRSVSQANQGNSYSPAPLDLSNVVLSRELQGMVEVVAENYHNIWAKKKKLELESKGGGSHPLLVPYDTLTAKEKFKDREKAQDLFKFLQVNGIIVSRGMKDMELDASSMEKRFAYKFLKKILKYVDSAQEFIAHLEAIVSSGKTEKSPRDQEIKFFAKVLLPLVDQYFTSHCLYFLSSPLKPLSSSGYASHKEKEMVAGLFCKLAALVRHRISLFGSDSTTMVSCLHILAQTLDTRTVMKSGSELVKAGLRAFFENAAEDLEKTSENLKLGKFTHSRTQIKGVSQNINYTTVALLPILTSIFEHVTQHQFGMDLLLGDVQISCYHILCSLYSLGTGKNIYVERQRPALGECLASLAAAIPVAFLEPTLNRYNPLSVFNTKTPRERSILGMPDTVEDMCPDIPQLEGLMKEINDLAESGARYTEMPHVIEVILPMLCNYLSYWWERGPENLPPSTGPCCTKVTSEHLSLILGNILKIINNNLGIDEASWMKRIAVYAQPIISKARPDLLRSHFIPTLEKLKKKAVKTVQEEEQLKADGKGDTQEAELLILDEFAVLCRDLYAFYPMLIRYVDNNRSNWLKSPDADSDQLFRMVAEVFILWCKSHNFKREEQNFVIQNEINNLAFLTGDSKSKMSKAMQVKVQVKCMTCLFCPSIRGAGLWPPLHCDHHGGGREWIFPPGGPPGLLQGRQLPVKE

SEQ ID NO: 35189 - protein, 33 aa, Homo sapiens
  ENSP00000490438
  MOD_RES (1)..(1): Any amino acid
XQIELLKELLDLLQDMVVMLLSLLEDRFHEPAK

SEQ ID NO: 35190 - protein, 34 aa, Homo sapiens
  ENSP00000489937
  MOD_RES (1)..(1): Any amino acid
XIELLKELLDLLQDMVVMLLSLLEADRPEEEEED

SEQ ID NO: 35191 - protein, 284 aa, Homo sapiens
  ENSP00000489832
  MOD_RES (1)..(1): Any amino acid
XLEIAGEEEEDGSLEPASAFAMACASVKRNVTDFLKRATLKNLRKQYRNVKKMTAKELVKVLFSFFWMLFVGLFQLLFTILGGIFQILWSTVFGGGLVEGAKNIRVTKILGDMPDPTQFGIHDDTMEAERAEVMEPGITTELVHFIKGEKGDTDIMSDLFGLHPKKEGSLKHGPEVGLGDLSEIIGKDEPPTLESTVQKKRKAQAAEMKAANEAEGKVESEKADMEDGEKEDKDKEEEQAEYLWTEVTKKKKRRCGQKVEKPEAFTANFFKGLEIYQTKLLPGH

SEQ ID NO: 35192 - protein, 454 aa, Homo sapiens
  ENSP00000490033
  MOD_RES (1)..(1): Any amino acid
XFVGLFQLLFTILGGIFQILWSTVFGGGLVEGAKNIRVTKILGDMPDPTQFGIHDDTMEAERAEVMEPGITTELVHFIKGEKGDTDIMSDLFGLHPKKEGSLKHGPEVGLGDLSEIIGKDEPPTLESTVQKKRKAQAAEMKAANEAEGKVESEKADMEDGEKEDKDKEEEQAEYLWTEVTKKKKRRCGQKVEKPEAFTANFFKGLEIYQTKLLVTEEPLEEETEDVANLWNSFNDEEEEEAMVFFVLQESTGYMAPTLRALAIIHTIISLVCVVGYYCLKVPLVVFKREKEIARKLEFDGLYITEQPSEDDIKGQWDRLVINTPSFPNNYWDKFVKRKVINKYGDLYGAERIAELLGLDKNALDFSPVEETKAEAASLVSWLSSIDMKYHIWKLGVVFTDNSFLYLAWYTTMSVLGHYNNFFFAAHLLDIAMGFKTLRTILSSVTHNGKQIQTV

SEQ ID NO: 35193 - protein, 615 aa, Homo sapiens
  ENSP00000489346
RVTKILGDMPDPTQFGIHDDTMEAERAEVMEPGITTELVHFIKGEKGDTDIMSDLFGLHPKKEGSLKHGPEVGLGDLSEIIGKDEPPTLESTVQKKRKAQAAEMKAANEAEGKVESEKADMEDGEKEDKDKEEEQAEYLWTEVTKKKKRRCGQKVEKPEAFTANFFKGLEIYQTKLLVTEEPLEEETEDVANLWNSFNDEEEEEAMVFFVLQESTGYMAPTLRALAIIHTIISLVCVVGYYCLKVPLVVFKREKEIARKLEFDGLYITEQPSEDDIKGQWDRLVINTPSFPNNYWDKFVKRKVINKYGDLYGAERIAELLGLDKNALDFSPVEETKAEAASLVSWLSSIDMKYHIWKLGVVFTDNSFLYLAWYTTMSVLGHYNNFFFAAHLLDIAMGFKTLRTILSSVTHNGKQLVLTVGLLAVVVYLYTVVAFNFFRKFYNKSEDDDEPDMKCDDMMTCYLFHMYVGVRAGGGIGDEIEDPAGDPYEMYRIVFDITFFFFVIVILLAIIQGLIIDAFGELRDQQEQVREDMETKCFICGIGNDYFDTTPHGFETHTLQEHNLANYLFFLMYLINKDETEHTGQESYVWKMYQERCWDFFPAGDCFRKQYEDQLG

SEQ ID NO: 35194 - protein, 468 aa, Homo sapiens
  ENSP00000490632
  MOD_RES (1)..(1): Any amino acid
XEKPEAFTANFFKGLEIYQTKLLRVCILSQVTEEPLEEETEDVANLWNSFNDEEEEEAMVFFVLQESTGYMAPTLRALAIIHTIISLVCVVGYYCLKVPLVVFKREKEIARKLEFDGLYITEQPSEDDIKGQWDRLVINTPSFPNNYWDKFVKRKVINKYGDLYGAERIAELLGLDKNALDFSPVEETKAEAASLVSWLSSIDMKYHIWKLGVVFTDNSFLYLAWYTTMSVLGHYNNFFFAAHLLDIAMGFKTLRTILSSVTHNGKQLVLTVGLLAVVVYLYTVVAFNFFRKFYNKSEDDDEPDMKCDDMMTCYLFHMYVGVRAGGGIGDEIEDPAGDPYEMYRIVFDITFFFFVIVILLAIIQGLIIDAFGELRDQQEQVREDMETKCFICGIGNDYFDTTPHGFETHTLQEHNLANYLFFLMYLINKDETEHTGQESYVWKMYQERCWDFFPAGDCFRKQYEDQLG

SEQ ID NO: 35195 - protein, 4873 aa, Homo sapiens
  ENSP00000483166
MAEGGEGGEDEIQFLRTEDEVVLQCIATIHKEQRKFCLAAEGLGNRLCFLEPTSEAKYIPPDLCVCNFVLEQSLSVRALQEMLANTGENGGEGAAQGGGHRTLLYGHAVLLRHSFSGMYLTCLTTSRSQTDKLAFDVGLREHATGEACWWTIHPASKQRSEGEKVRIGDDLILVSVSSERYLHLSVSNGNIQVDASFMQTLWNVHPTCSGSSIEEGYLLGGHVVRLFHGHDECLTIPSTDQNDSQHRRIFYEAGGAGTRARSLWRVEPLRISWSGSNIRWGQAFRLRHLTTGHYLALTEDQGLILQDRAKSDTKSTAFSFRASKELKEKLDSSHKRDIEGMGVPEIKYGDSVCFVQHIASGLWVTYKAQDAKTSRLGPLKRKVILHQEGHMDDGLTLQRCQREESQAARIIRNTTALFSQFVSGNNRTAAPITLPIEEVLQTLQDLIAYFQPPEEEMRHEDKQNKLRSLKNRQNLFKEEGMLALVLNCIDRLNVYNSVAHFAGIAREESGMAWKEILNLLYKLLAALIRGNRNNCAQFSNNLDWLISKLDRLESSSGILEVLHCILTESPEALNLIAEGHIKSIISLLDKHGRNHKVLDILCSLCLCNGVAVRANQNLICDNLLPRRNLLLQTRLINDVTSIRPNIFLGVAEGSAQYKKWYFELIIDQVDPFLTAEPTHLRVGWASSSGYAPYPGGGEGWGGNGVGDDLYSYGFDGLHLWSGRIPRAVASINQHLLRSDDVVSCCLDLGVPSISFRINGQPVQGMFENFNTDGLFFPVMSFSAGVKVRFLMGGRHGEFKFLPPSGYAPCYEALLPKEKMRLEPVKEYKRDADGIRDLLGTTQFLSQASFIPCPVDTSQVILPPHLEKIRDRLAENIHELWGMNKIELGWTFGKIRDDNKRQHPCLVEFSKLPETEKNYNLQMSTETLKTLLALGCHIAHVNPAAEEDLKKVKLPKNYMMSNGYKPAPLDLSDVKLLPPQEILVDKLAENAHNVWAKDRIKQGWTYGIQQDLKNKRNPRLVPYALLDERTKKSNRDSLREAVRTFVGYGYNIEPSDQELADSAVEKVSIDKIRFFRVERSYAVRSGKWYFEFEVVTGGDMRVGWARPGCRPDVELGADDQAFVFEGNRGQRWHQGSGYFGRTWQPGDVVGCMINLDDASMIFTLNGELLITNKGSELAFADYEIENGFVPICCLGLSQIGRMNLGTDASTFKFYTMCGLQEGFEPFAVNMNRDVAMWFSKRLPTFVNVPKDHPHIEVMRIDGTMDSPPCLKVTHKTFGTQNSNADMIYCRLSMPVECHSSFSHSPCLDSEAFQKRKQMQEILSHTTTQCYYAIRIFAGQDPSCVWVGWVTPDYHLYSEKFDLNKNCTVTVTLGDERGRVHESVKRSNCYMVWGGDIVASSQRSNRSNVDLEIGCLVDLAMGMLSFSANGKELGTCYQVEPNTKVFPAVFLQPTSTSLFQFELGKLKNAMPLSAAIFRSEEKNPVPQCPPRLDVQTIQPVLWSRMPNSFLKVETERVSERHGWVVQCLEPLQMMALHIPEENRCVDILELCEQEDLMRFHYHTLRLYSAVCALGNSRVAYALCSHVDLSQLFYAIDNKYLPGLLRSGFYDLLISIHLASAKERKLMMKNEYIIPITSTTRNIRLFPDESKRHGLPGVGLRTCLKPGFRFSTPCFVVTGEDHQKQSPEIPLESLRTKALSMLTEAVQCSGAHIRDPVGGSVEFQFVPVLKLIGTLLVMGVFDDDDVRQILLLIDPSVFGEHSAGTEEGAEKEEVTQVEEKAVEAGEKAGKEAPVKGLLQTRLPESVKLQMCELLSYLCDCELQHRVEAIVAFGDIYVSKLQANQKFRYNELMQALNMSAALTARKTKEFRSPPQEQINMLLNFQLGENCPCPEEIREELYDFHEDLLLHCGVPLEEEEEEEEDTSWTGKLCALVYKIKGPPKPEKEQPTEEEERCPTTLKELISQTMICWAQEDQIQDSELVRMMFNLLRRQYDSIGELLQALRKTYTISHTSVSDTINLLAALGQIRSLLSVRMGKEEELLMINGLGDIMNNKVFYQHPNLMRVLGMHETVMEVMVNVLGTEKSQIAFPKMVASCCRFLCYFCRISRQNQKAMFEHLSYLLENSSVGLASPSMRGSTPLDVAASSVMDNNELALSLEEPDLEKVVTYLAGCGLQSCPMLLAKGYPDVGWNPIEGERYLSFLRFAVFVNSESVEENASVVVKLLIRRPECFGPALRGEGGNGLLAAMQGAIKISENPALDLPSQGYKREVSTGDDEEEEEIVHMGNAIMSFYSALIDLLGRCAPEMHLIQTGKGEAIRIRSILRSLVPTEDLVGIISIPLKLPSLNKDGSVSEPDMAANFCPDHKAPMVLFLDRVYGIKDQTFLLHLLEVGFLPDLRASASLDTVSLSTTEAALALNRYICSAVLPLLTRCAPLFAGTEHCTSLIDSTLQTIYRLSKGRSLTKAQRDTIEECLLAICNHLRPSMLQQLLRRLVFDVPQLNEYCKMPLKLLTNHYEQCWKYYCLPSGWGSYGLAVEEELHLTEKLFWGIFDSLSHKKYDPDLFRMALPCLSAIAGALPPDYLDTRITATLEKQISVDADGNFDPKPINTMNFSLPEKLEYIVTKYAEHSHDKWACDKSQSGWKYGISLDENVKTHPLIRPFKTLTEKEKEIYRWPARESLKTMLAVGWTVERTKEGEALVQQRENEKLRSVSQANQGNSYSPAPLDLSNVVLSRELQGMVEVVAENYHNIWAKKKKLELESKGGGSHPLLVPYDTLTAKEKFKDREKAQDLFKFLQVNGIIVSRGMKDMELDASSMEKRFAYKFLKKILKYVDSAQEFIAHLEAIVSSGKTEKSPRDQEIKFFAKVLLPLVDQYFTSHCLYFLSSPLKPLSSSGYASHKEKEMVAGLFCKLAALVRHRISLFGNDSTTMVSCLHILAQTLDTRTVMKSGSELVKAGLRAFFENAAEDLEKTSENLKLGKFTHSRTQIKGVSQNINYTTVALLPILTSIFEHVTQHQFGMDLLLGDVQISCYHILCSLYSLGTGKNIYVERQRPALGECLASLAAAIPVAFLEPTLNRYNPLSVFNTKTPRERSILGMPDTVEDMCPDIPQLEGLMKEINDLAESGARYTEMPHVIEVILPMLCNYLSYWWERGPENLPPSTGPCCTKVTSEHLSLILGNILKIINNNLGIDEASWMKRIAVYAQPIISKARPDLLRSHFIPTLEKLKKKAVKTVQEEEQLKADGKGDTQEAELLILDEFAVLCRDLYAFYPMLIRYVDNNRSNWLKSPDADSDQLFRMVAEVFILWCKSHNFKREEQNFVIQNEINNLAFLTGDSKSKMSKAMQVKSGGQDQERKKTKRRGDLYSIQTSLIVAALKKMLPIGLNMCTPGDQELISLAKSRYSHRDTDEEVREHLRNNLHLQEKSDDPAVKWQLNLYKDVLKSEEPFNPEKTVERVQRISAAVFHLEQVEQPLRSKKAVWHKLLSKQRKRAVVACFRMAPLYNLPRQHMHRSINLFLHGYQRFWIETEEYSFEEKLVQDLAKSPKVEEEEEEETEKQPDPLHQIILYFSRNALTERSKLEDDPLYTSYSSMMAKSCQSGEDEEEDEDKEKTFEEKEMEKQKTLYQQARLHERGAAEMVLQMISASKGEMSPMVVETLKLGIAILNGGNAGVQQKMLDYLKEKKDAGFFQSLSGLMQSCSVLDLNAFERQNKAEGLGMVTEEGTLIVRERGEKVLQNDEFTRDLFRFLQLLCEGHNSDFQNFLRTQMGNTTTVNVIISTVDYLLRLQESISDFYWYYSGKDIIDESGQHNFSKALAVTKQIFNSLTEYIQGPCIGNQQSLAHSRLWDAVVGFLHVFANMQMKLSQDSSQIELLKELLDLLQDMVVMLLSLLEGNVVNGTIGKQMVDTLVESSTNVEMILKFFDMFLKLKDLTSSDTFKEYDPDGKGIISKKEFQKAMEGQKQYTQSEIDFLLSCAEADENDMFNYVDFVDRFHEPAKDIGFNVAVLLTNLSEHMPNDSRLKCLLDPAESVLNYFEPYLGRIEIMGGAKKIERVYFEISESSRTQWEKPQVKESKRQFIFDVVNEGGEQEKMELFVNFCEDTIFEMQLASQISESDSADRPEEEEEDEDSSYVLEIAGEEEEDGSLEPASAFAMACASVKRNVTDFLKRATLKNLRKQYRNVKKMTAKELVKVLFSFFWMLFVGLFQLLFTILGGIFQILWSTVFGGGLVEGAKNIRVTKILGDMPDPTQFGIHDDTMEAERAEVMEPGITTELVHFIKGEKGDTDIMSDLFGLHPKKEGSLKHGPEVGLGDLSEIIGKDEPPTLESTVQKKRKAQAAEMKAANEAEGKVESEKADMEDGEKEDKDKEEEQAEYLWTEVTKKKKRRCGQKVEKPEAFTANFFKGLEIYQTKLLHYLARNFYNLRFLALFVAFAINFILLFYKVTEEPLEEETEDVANLWNSFNDEEEEEAMVFFVLQESTGYMAPTLRALAIIHTIISLVCVVGYYCLKVPLVVFKREKEIARKLEFDGLYITEQPSEDDIKGQWDRLVINTPSFPNNYWDKFVKRKVINKYGDLYGAERIAELLGLDKNALDFSPVEETKAEAASLVSWLSSIDMKYHIWKLGVVFTDNSFLYLAWYTTMSVLGHYNNFFFAAHLLDIAMGFKTLRTILSSVTHNGKQLVLTVGLLAVVVYLYTVVAFNFFRKFYNKSEDDDEPDMKCDDMMTCYLFHMYVGVRAGGGIGDEIEDPAGDPYEMYRIVFDITFFFFVIVILLAIIQGLIIDAFGELRDQQEQVREDMETKCFICGIGNDYFDTTPHGFETHTLQEHNLANYLFFLMYLINKDETEHTGQESYVWKMYQERCWDFFPAGDCFRKQYEDQLG

SEQ ID NO: 35196 - protein, 101 aa, Homo sapiens
  ENSP00000357704
MACPLEKALDVMVSTFHKYSGKEGDKFKLNKSELKELLTRELPSFLGKRTDEAAFQKLMSNLDSNRDNEVDFQEYCVFLSCIAMMCNEFFEGFPDKQPRKK

SEQ ID NO: 35197 - protein, 101 aa, Homo sapiens; identical to SEQ ID NO: 35196
  ENSP00000346294

SEQ ID NO: 35198 - protein, 101 aa, Homo sapiens; identical to SEQ ID NO: 35196
  ENSP00000357705

SEQ ID NO: 35199 - protein, 101 aa, Homo sapiens; identical to SEQ ID NO: 35196
  ENSP00000357703

SEQ ID NO: 35200 - protein, 92 aa, Homo sapiens
  ENSP00000291700
MSELEKAMVALIDVFHQYSGREGDKHKLKKSELKELINNELSHFLEEIKEQEVVDKVMETLDNDGDGECDFQEFMAFVAMVTTACHEFFEHE

SEQ ID NO: 35201 - protein, 94 aa, Homo sapiens
  ENSP00000356038
MSELEKAMVALIDVFHQYSGREGDKHKLKKSELKELINNELSHFLERWSLPMLPRLVSNFLCSSYPPALASQSAGITGNQRAGGCGQSHGNTGQ

SEQ ID NO: 35202 - protein, 92 aa, Homo sapiens; identical to SEQ ID NO: 35200
  ENSP00000380769

SEQ ID NO: 35203 - protein, 382 aa, Homo sapiens
  ENSP00000305416
MGPTSVPLVKAHRSSVSDYVNYDIIVRHYNYTGKLNISADKENSIKLTSVVFILICCFIILENIFVLLTIWKTKKFHRPMYYFIGNLALSDLLAGVAYTANLLLSGATTYKLTPAQWFLREGSMFVALSASVFSLLAIAIERYITMLKMKLHNGSNNFRLFLLISACWVISLILGGLPIMGWNCISALSSCSTVLPLYHKHYILFCTTVFTLLLLSIVILYCRIYSLVRTRSRRLTFRKNISKASRSSEKSLALLKTVIIVLSVFIACWAPLFILLLLDVGCKVKTCDILFRAEYFLVLAVLNSGTNPIIYTLTNKEMRRAFIRIMSCCKCPSGDSAGKFKRPIIAGMEFSRSKSDNSSHPQKDEGDNPETIMSSGNVNSSS

SEQ ID NO: 35204 - protein, 398 aa, Homo sapiens
  ENSP00000328472
MESGLLRPAPVSEVIVLHYNYTGKLRGARYQPGAGLRADAVVCLAVCAFIVLENLAVLLVLGRHPRFHAPMFLLLGSLTLSDLLAGAAYAANILLSGPLTLKLSPALWFAREGGVFVALTASVLSLLAIALERSLTMARRGPAPVSSRGRTLAMAAAAWGVSLLLGLLPALGWNCLGRLDACSTVLPLYAKAYVLFCVLAFVGILAAICALYARIYCQVRANARRLPARPGTAGTTSTRARRKPRSLALLRTLSVVLLAFVACWGPLFLLLLLDVACPARTCPVLLQADPFLGLAMANSLLNPIIYTLTNRDLRHALLRLVCCGRHSCGRDPSGSQQSASAAEASGGLRRCLPPGLDGSFSGSERSSPQRDGLDTSGSTGSPGAPTAARTLVSEPAAD

SEQ ID NO: 35205 - protein, 398 aa, Homo sapiens; identical to SEQ ID NO: 35204
  ENSP00000416915

SEQ ID NO: 35206 - protein, 75 aa, Homo sapiens
  ENSP00000464884
MCNPVSLYLGSPPPAWPWGARPMESGLLRPAPVSEVIVLHYNYTGKLRGARYQPGAGLRADAVVCLAVCAFIVLE

SEQ ID NO: 35207 - protein, 254 aa, Homo sapiens
  ENSP00000481239
MESGLLRPAPVSEVIVLHYNYTGKLRGARYQPGAGLRADAVVCLAVCAFIVLENLAVLLVLGRHPRFHAPMFLLLGSLTLSDLARPGTAGTTSTRARRKPRSLALLRTLSVVLLAFVACWGPLFLLLLLDVACPARTCPVLLQADPFLGLAMANSLLNPIIYTLTNRDLRHALLRLVCCGRHSCGRDPSGSQQSASAAEASGGLRRCLPPGLDGSFSGSERSSPQRDGLDTSGSTGSPGAPTAARTLVSEPAAD

SEQ ID NO: 35208 - protein, 1324 aa, Homo sapiens
  ENSP00000251020
MSRRKQAKPQHFQSDPEVASLPRRDGDTEKGQPSRPTKSKDAHVCGRCCAEFFELSDLLLHKKNCTKNQLVLIVNENPASPPETFSPSPPPDNPDEQMNDTVNKTDQVDCSDLSEHNGLDREESMEVEAPVANKSGSGTSSGSHSSTAPSSSSSSSSSSGGGGSSSTGTSAITTSLPQLGDLTTLGNFSVINSNVIIENLQSTKVAVAQFSQEARCGGASGGKLAVPALMEQLLALQQQQIHQLQLIEQIRHQILLLASQNADLPTSSSPSQGTLRTSANPLSTLSSHLSQQLAAAAGLAQSLASQSASISGVKQLPPIQLPQSSSGNTIIPSNSGSSPNMNILAAAVTTPSSEKVASSAGASHVSNPAVSSSSSPAFAISSLLSPASNPLLPQQASANSVFPSPLPNIGTTAEDLNSLSALAQQRKSKPPNVTAFEAKSTSDEAFFKHKCRFCAKVFGSDSALQIHLRSHTGERPFKCNICGNRFSTKGNLKVHFQRHKEKYPHIQMNPYPVPEHLDNIPTSTGIPYGMSIPPEKPVTSWLDTKPVLPTLTTSVGLPLPPTLPSLIPFIKTEEPAPIPISHSATSPPGSVKSDSGGPESATRNLGGLPEEAEGSTLPPSGGKSEESGMVTNSVPTASSSVLSSPAADCGPAGSATTFTNPLLPLMSEQFKAKFPFGGLLDSAQASETSKLQQLVENIDKKATDPNECIICHRVLSCQSALKMHYRTHTGERPFKCKICGRAFTTKGNLKTHYSVHRAMPPLRVQHSCPICQKKFTNAVVLQQHIRMHMGGQIPNTPVPDSYSESMESDTGSFDEKNFDDLDNFSDENMEDCPEGSIPDTPKSADASQDSLSSSPLPLEMSSIAALENQMKMINAGLAEQLQASLKSVENGSIEGDVLTNDSSSVGGDMESQSAGSPAISESTSSMQALSPSNSTQEFHKSPSIEEKPQRAVPSEFANGLSPTPVNGGALDLTSSHAEKIIKEDSLGILFPFRDRGKFKNTACDICGKTFACQSALDIHYRSHTKERPFICTVCNRGFSTKGNLKQHMLTHQMRDLPSQLFEPSSNLGPNQNSAVIPANSLSSLIKTEVNGFVHVSPQDSKDTPTSHVPSGPLSSSATSPVLLPALPRRTPKQHYCNTCGKTFSSSSALQIHERTHTGEKPFACTICGRAFTTKGNLKVHMGTHMWNSTPARRGRRLSVDGPMTFLGGNPVKFPEMFQKDLAARSGSGDPSSFWNQYAAALSNGLAMKANEISVIQNGGIPPIPGSLGSGNSSPVSGLTGNLERLQNSEPNAPLAGLEKMASSENGTNFRFTRFVEDSKEIVTS

SEQ ID NO: 35209 - protein, 34 aa, Homo sapiens
  ENSP00000455582
MSRRKQAKPQHFQSDPEVASLPRRDGTHGHSHVE

SEQ ID NO: 35210 - protein, 1154 aa, Homo sapiens
  ENSP00000456777
MNDTVNKTDQVDCSDLSEHNGLDREESMEVEAPVANKSGSGTSSGSHSSTAPSSSSSSSSSSGGGGSSSTGTSAITTSLPQLGDLTTLGNFSVINSNVIIENLQSTKVAVAQFSQEARCGGASGGKLAVPALMEQLLALQQQQIHQLQLIEQIRHQILLLASQNADLPTSSSPSQGTLRTSANPLSTLSSHLSQQLAAAAGLAQSLASQSASISGVKQLPPIQLPQSSSGNTIIPSNSGSSPNMNILAAAVTTPSSEKVASSAGASHVSNPAVSSSSSPAFAISSLLSPASNPLLPQQASANSVFPSPLPNIGTTAEDLNSLSALAQQRKSKPPNVTAFEAKSTSDEAFFKHKCRFCAKVFGSDSALQIHLRSHTGERPFKCNICGNRFSTKGNLKVHFQRHKEKYPHIQMNPYPVPEHLDNIPTSTGIPYGMSIPPEKPVTSWLDTKPVLPTLTTSVGLPLPPTLPSLIPFIKTEEPAPIPISHSATSPPGSVKSDSGGPESATRNLGGLPEEAEGSTLPPSGGKSEESGMVTNSVPTASSSVLSSPAADCGPAGSATTFTNPLLPLMSEQFKAKFPFGGLLDSAQASETSKLQQLVENIDKKATDPNECIICHRVLSCQSALKMHYRTHTGERPFKCKICGRAFTTKGNLKTHYSVHRAMPPLRVQHSCPICQKKFTNAVVLQQHIRMHMGGQIPNTPVPDSYSESMESDTGSFDEKNFDDLDNFSDENMEDCPEGSIPDTPKSADASQDSLSSSPLPLEMSSIAALENQMKMINAGLAEQLQASLKSVENGSIEGDVLTNDSSSVGGDMESQSAGSPAISESTSSMQALSPSNSTQEFHKSPSIEEKPQRAVPSEFANGLSPTPVNGGALDLTSSHAEKIIKEDSLGILFPFRDRGKFKNTACDICGKTFACQSALDIHYRSHTKERPFICTVCNRGFSTKGNLKQHMLTHQMRDLPSQLFEPSSNLGPNQNSAVIPANSLSSLIKTEVNGFVHVSPQDSKDTPTSHVPSGPLSSSATSPVLLPALPRRTPKQHYCNTCGKTFSSSSALQIHERTHTGEKPFACTICGRAFTTKGNLKVHMGTHMWNSTPARRGRRLSVDGPMTFLGGNPVKFPEMFQKDLAARSGSGDPSSFWNQYAAALSNGLAMKANE

SEQ ID NO: 35211 - protein, 1227 aa, Homo sapiens
  ENSP00000407914
MNDTVNKTDQVDCSDLSEHNGLDREESMEVEAPVANKSGSGTSSGSHSSTAPSSSSSSSSSSGGGGSSSTGTSAITTSLPQLGDLTTLGNFSVINSNVIIENLQSTKVAVAQFSQEARCGGASGGKLAVPALMEQLLALQQQQIHQLQLIEQIRHQILLLASQNADLPTSSSPSQGTLRTSANPLSTLSSHLSQQLAAAAGLAQSLASQSASISGVKQLPPIQLPQSSSGNTIIPSNSGSSPNMNILAAAVTTPSSEKVASSAGASHVSNPAVSSSSSPAFAISSLLSPASNPLLPQQASANSVFPSPLPNIGTTAEDLNSLSALAQQRKSKPPNVTAFEAKSTSDEAFFKHKCRFCAKVFGSDSALQIHLRSHTGERPFKCNICGNRFSTKGNLKVHFQRHKEKYPHIQMNPYPVPEHLDNIPTSTGIPYGMSIPPEKPVTSWLDTKPVLPTLTTSVGLPLPPTLPSLIPFIKTEEPAPIPISHSATSPPGSVKSDSGGPESATRNLGGLPEEAEGSTLPPSGGKSEESGMVTNSVPTASSSVLSSPAADCGPAGSATTFTNPLLPLMSEQFKAKFPFGGLLDSAQASETSKLQQLVENIDKKATDPNECIICHRVLSCQSALKMHYRTHTGERPFKCKICGRAFTTKGNLKTHYSVHRAMPPLRVQHSCPICQKKFTNAVVLQQHIRMHMGGQIPNTPVPDSYSESMESDTGSFDEKNFDDLDNFSDENMEDCPEGSIPDTPKSADASQDSLSSSPLPLEMSSIAALENQMKMINAGLAEQLQASLKSVENGSIEGDVLTNDSSSVGGDMESQSAGSPAISESTSSMQALSPSNSTQEFHKSPSIEEKPQRAVPSEFANGLSPTPVNGGALDLTSSHAEKIIKEDSLGILFPFRDRGKFKNTACDICGKTFACQSALDIHYRSHTKERPFICTVCNRGFSTKGNLKQHMLTHQMRDLPSQLFEPSSNLGPNQNSAVIPANSLSSLIKTEVNGFVHVSPQDSKDTPTSHVPSGPLSSSATSPVLLPALPRRTPKQHYCNTCGKTFSSSSALQIHERTHTGEKPFACTICGRAFTTKGNLKVHMGTHMWNSTPARRGRRLSVDGPMTFLGGNPVKFPEMFQKDLAARSGSGDPSSFWNQYAAALSNGLAMKANEISVIQNGGIPPIPGSLGSGNSSPVSGLTGNLERLQNSEPNAPLAGLEKMASSENGTNFRFTRFVEDSKEIVTS

SEQ ID NO: 35212 - protein, 148 aa, Homo sapiens
  ENSP00000402786
  MOD_RES (1)..(1): Any amino acid
XALHCGLNPRGIDHPAHAEGIKLQIEGEGVESQSIKNKNFQKVPDQKGTPKRLQAEAETAKSATVKLSKPVALWTQQDVCKWLKKHCPNQYQIYRRALLRLTDKKLERMGIAQENLRQHILQQVLQLKVREEVRNLQLLTQASSEGSP

SEQ ID NO: 35213 - protein, 153 aa, Homo sapiens
  ENSP00000435927
GLNPRGIDHPAHAEGIKLQIEGEGVESQSIKNKNFQKVPDQKGTPKRLQAEAETAKSATVKLSKPVALWTQQDVCKWLKKHCPNQYQIYSESFKQHDITGRALLRLTDKKLERMGIAQENLRQHILQQVLQLKVREEVRNLQLLTQASSEGSP

SEQ ID NO: 35214 - protein, 68 aa, Homo sapiens
  ENSP00000387605
MAVEALHCGLNPRGIDHPAHAEGIKLQIEGEGVESQSIKNKNFQKVPDQKGTPKRLQAEAETAKGEPC

SEQ ID NO: 35215 - protein, 201 aa, Homo sapiens
  ENSP00000314173
MAVEALHCGLNPRGIDHPAHAEGIKLQIEGEGVESQSIKNKNFQKVPDQKGTPKRLQAEAETAKSATVKLSKPVALWTQQDVCKWLKKHCPNQYQIYSESFKQHDITGRALLRLTDKKLERMGIAQENLRQHILQQVLQLKVREEVRNLQLLTQGTLLLPDGWMDGEIRRKTTLLLGQTGVRENLLLFLHRISIIENSIQI

SEQ ID NO: 35216 - protein, 154 aa, Homo sapiens
  ENSP00000431360
MAVEALHCGLNPRGIDHPAHAEGIKLQIEGEGVESQSIKNKNFQKVPDQKGTPKRLQAEAETAKSATVKLSKPVALWTQQDVCKWLKKHCPNQYQIYSESFKQHDITGRALLRLTDKKLERMGIAQENLRQHILQQVLQLKVREEVRNLQLLTQ

SEQ ID NO: 35217 - protein, 169 aa, Homo sapiens
  ENSP00000434079
  MOD_RES (1)..(1): Any amino acid
XALRAPSREPAASLCVTAAALHCGLNPRGIDHPAHAEGIKLQIEGEGVESQSIKNKNFQKVPDQKGTPKRLQAEAETAKSATVKLSKPVALWTQQDVCKWLKKHCPNQYQIYSESFKQHDITGRALLRLTDKKLERMGIAQENLRQHILQQVLQLKVREEVRNLQLLTQ

SEQ ID NO: 35218 - protein, 161 aa, Homo sapiens
  ENSP00000387133
MAVEALHCGLNPRGIDHPAHAEGIKLQIEGEGVESQSIKNKNFQKVPDQKGTPKRLQAEAETAKSATVKLSKPVALWTQQDVCKWLKKHCPNQYQIYSESFKQHDITGRALLRLTDKKLERMGIAQENLRQHILQQVLQLKVREEVRNLQLLTQASSEGSP

SEQ ID NO: 35219 - protein, 1584 aa, Homo sapiens
  ENSP00000326247
MSKQVSLPEMIKDWTKEHVKKWVNEDLKINEQYGQILLSEEVTGLVLQELTEKDLVEMGLPWGPALLIKRSYNKLNSKSPESDNHDPGQLDNSKPSKTEHQKNPKHTKKEEENSMSSNIDYDPREIRDIKQEESILMKENVLDEVANAKHKKKGKLKPEQLTCMPYPFDQFHDSHRYIEHYTLQPETGALNLIDPIHEFKALTNTETATEVDIKMKFSNEVFRFASACMNSRTNGTIHFGVKDKPHGEIVGVKITSKAAFIDHFNVMIKKYFEESEINEAKKCIREPRFVEVLLQNNTPSDRFVIEVDTIPKHSICNDKYFYIQMQICKDKIWKQNQNLSLFVREGASSRDILANSKQRDVDFKAFLQNLKSLVASRKEAEEEYGMKAMKKESEGLKLVKLLIGNRDSLDNSYYDWYILVTNKCHPNQIKHLDFLKEIKWFAVLEFDPESMINGVVKAYKESRVANLHFPNQYEDKTTNMWEKISTLNLYQQPSWIFCNGRSDLKSETYKPLEPHLWQRERASEVRKLILFLTDENIMTRGKFLVVFLLLSSVESPGDPLIETFWAFYQALKGMENMLCISVNSHIYQRWKDLLQTRMKMEDELTNHSISTLNIELVNSTILKLKSVTRSSRRFLPARGSSSVILEKKKEDVLTALEILCENECTETDIEKDKSKFLEFKKSKEEHFYRGGKVSWWNFYFSSENYSSDFVKRDSYEKLKDLIHCWAESPKPIFAKIINLYHHPGCGGTTLAMHVLWDLKKNFRCAVLKNKTTDFAEIAEQVINLVTYRAKSHQDYIPVLLLVDDFEEQENVYFLQNAIHSVLAEKDLRYEKTLVIILNCMRSRNPDESAKLADSIALNYQLSSKEQRAFGAKLKEIEKQHKNCENFYSFMIMKSNFDETYIENVVRNILKGQDVDSKEAQLISFLALLSSYVTDSTISVSQCEIFLGIIYTSTPWEPESLEDKMGTYSTLLIKTEVAEYGRYTGVRIIHPLIALYCLKELERSYHLDKCQIALNILEENLFYDSGIGRDKFQHDVQTLLLTRQRKVYGDETDTLFSPLMEALQNKDIEKVLSAGSRRFPQNAFICQALARHFYIKEKDFNTALDWARQAKMKAPKNSYISDTLGQVYKSEIKWWLDGNKNCRSITVNDLTHLLEAAEKASRAFKESQRQTDSKNYETENWSPQKSQRRYDMYNTACFLGEIEVGLYTIQILQLTPFFHKENELSKKHMVQFLSGKWTIPPDPRNECYLALSKFTSHLKNLQSDLKRCFDFFIDYMVLLKMRYTQKEIAEIMLSKKVSRCFRKYTELFCHLDPCLLQSKESQLLQEENCRKKLEALRADRFAGLLEYLNPNYKDATTMESIVNEYAFLLQQNSKKPMTNEKQNSILANIILSCLKPNSKLIQPLTTLKKQLREVLQFVGLSHQYPGPYFLACLLFWPENQELDQDSKLIEKYVSSLNRSFRGQYKRMCRSKQASTLFYLGKRKGLNSIVHKAKIEQYFDKAQNTNSLWHSGDVWKKNEVKDLLRRLTGQAEGKLISVEYGTEEKIKIPVISVYSGPLRSGRNIERVSFYLGFSIEGPLAYDIEVI

SEQ ID NO: 35220 - protein, 1584 aa, Homo sapiens; identical to SEQ ID NO: 35219
  ENSP00000405760

SEQ ID NO: 35221 - protein, 1584 aa, Homo sapiens; identical to SEQ ID NO: 35219
  ENSP00000408796

SEQ ID NO: 35222 - protein, 69 aa, Homo sapiens
  ENSP00000391699
MSKQVSLPEMIKDWTKEHVKKWVNEDLKINEQYGQILLSEEVTGLVLQELTEKDLVEMGLPWGPALLIK

SEQ ID NO: 35223 - protein, 69 aa, Homo sapiens; identical to SEQ ID NO: 35222
  ENSP00000391387

SEQ ID NO: 35224 - protein, 69 aa, Homo sapiens; identical to SEQ ID NO: 35222
  ENSP00000396137

SEQ ID NO: 35225 - protein, 69 aa, Homo sapiens; identical to SEQ ID NO: 35222
  ENSP00000410062

SEQ ID NO: 35226 - protein, 406 aa, Homo sapiens
  ENSP00000484397
MSKQVSLPEMIKDWTKEHVKKWVNEDLKINEQYGQILLSEEVTGLVLQELTEKDLVEMGLPWGPALLIKRSYNKLNSKSPESDNHDPGQLDNSKPSKTEHQKNPKHTKKEEENSMSSNIDYDPREIRDIKQEESILMKENVLDEVANAKHKKKLEALRADRFAGLLEYLNPNYKDATTMESIVNEYAFLLQQNSKKPMTNEKQNSILANIILSCLKPNSKLIQPLTTLKKQLREVLQFVGLSHQYPGPYFLACLLFWPENQELDQDSKLIEKYVSSLNRSFRGQYKRMCRSKQASTLFYLGKRKGLNSIVHKAKIEQYFDKAQNTNSLWHSGDVWKKNEVKDLLRRLTGQAEGKLISVEYGTEEKIKIPVISVYSGPLRSGRNIERVSFYLGFSIEGPLAYDIEVI

SEQ ID NO: 35227 - protein, 394 aa, Homo sapiens
  ENSP00000386348
MAGAAMAERGRVPPPAPAPSTEGLPRAFLQSLRTLFDILDDRRRGCVHLREIESRWQGTDARELPRGVLEGLRQVAPASGYLTFERFVAGLRTSLLSADGGPRDPTRAPARPGDQPPPPPQRLVFAPADEPRTVLERKPLPLGVRAPLAGPSAAARSPEQLCAPAEAAPCPAEPERSQSAALEPSSSADAGAVACRALEADSGDARRAPRARGERRRHTIASGVDCGLLKQMKELEQEKEVLLQGLEMMARGRDWYQQQLQRVQERQRRLGQSRASADFGAAGSPRPLGRLLPKVQEVARCLGELLAAACASRALPPSSSGPPCPALTSTSPPVWQQQTILMLKEQNRLLTQEVTEKSERITQLEQEKSALIKQLFEARALSQQDGGPLDSTFI

SEQ ID NO: 35228 - protein, 150 aa, Homo sapiens
  ENSP00000368553
MAKFVIRPATAADCSDILRLIKELAKYEYMEEQVILTEKGNSTVAGRGTSVRCLSPSPRPLPPLLPLLADLLEDGFGEHPFYHCLVAEVPKEHWTPEGNPSPFPEARETKCYVRSSVGCVEPLTTQAEVTENLDRKNSQQVFKLLRKKKN

SEQ ID NO: 35229 - protein, 120 aa, Homo sapiens
  ENSP00000368555
MAKFVIRPATAADCSDILRLIKELAKYEYMEEQVILTEKDLLEDGFGEHPFYHCLVAEVPKEHWTPEGNPSPFPEARETKCYVRSSVGCVEPLTTQAEVTENLDRKNSQQVFKLLRKKKN

SEQ ID NO: 35230 - protein, 143 aa, Homo sapiens
  ENSP00000368556
MAKFVIRPATAADCSDILRLIKELAKYEYMEEQVILTEKGHSIVGFAMYYFTYDPWIGKLLYLEDFFVMSDYRGFGIGSEILKNLSQVAMRCRCSSMHFLVAEWNEPSINFYKRRGASDLSSEEGWRLFKIDKEYLLKMATEE

SEQ ID NO: 35231 - protein, 171 aa, Homo sapiens
  ENSP00000368572
MAKFVIRPATAADCSDILRLIKELAKYEYMEEQVILTEKDLLEDGFGEHPFYHCLVAEVPKEHWTPEGHSIVGFAMYYFTYDPWIGKLLYLEDFFVMSDYRGFGIGSEILKNLSQVAMRCRCSSMHFLVAEWNEPSINFYKRRGASDLSSEEGWRLFKIDKEYLLKMATEE

SEQ ID NO: 35232 - protein, 250 aa, Homo sapiens
  ENSP00000246868
MSIFTPTNQIRLTNVAVVRMKRAGKRFEIACYKNKVVGWRSGVEKDLDEVLQTHSVFVNVSKGQVAKKEDLISAFGTDDQTEICKQILTKGEVQVSDKERHTQLEQMFRDIATIVADKCVNPETKRPYTVILIERAMKDIHYSVKTNKSTKQQALEVIKQLKEKMKIERAHMRLRFILPVNEGKKLKEKLKPLIKVIESEDYGQQLEIVCLIDPGCFREIDELIKKETKGKGSLEVLNLKDVEEGDEKFE

SEQ ID NO: 35233 - protein, 86 aa, Homo sapiens
  ENSP00000394586
MSIFTPTNQIRLTNVAVVRMKRAGKRFEIACYKNKVVGWRSGVEKDLDEVLQTHSVFVNVSKGQVAKKEDLISAFGTDDQTEIYFD

SEQ ID NO: 35234 - protein, 250 aa, Homo sapiens [sequence omitted]

SEQ ID NO: 35235 - protein, 1366 aa, Homo sapiens
  ENSP00000354733
MLAVGPAMDRDYPQHEPPPAGSLLYSPPPLQSAMLHCPYWNTFSLPPYPAFSSDSRPFMSSASFLGSQPCPDTSYAPVATASSLPPKTCDFAQDSSYFEDFSNISIFSSSVDSLSDIVDTPDFLPADSLNQVSTIWDDNPAPSTHDKLFQLSRPFAGFEDFLPSHSTPLLVSYQEQSVQSQPEEEDEAEEEEAEELGHTETYADYVPSKSKIGKQHPDRVVETSTLSSVPPPDITYTLALPSDSGALSALQLEAITYACQQHEVLLPSGQRAGFLIGDGAGVGKGRTVAGVILENHLRGRKKALWFSVSNDLKYDAERDLRDIEATGIAVHALSKIKYGDTTTSEGVLFATYSALIGESQAGGQHRTRLRQILDWCGEAFEGVIVFDECHKAKNAGSTKMGKAVLDLQNKLPLARVVYASATGASEPRNMIYMSRLGIWGEGTPFRNFEEFLHAIEKRGVGAMEIVAMDMKVSGMYIARQLSFSGVTFRIEEIPLAPAFECVYNRAALLWAEALNVFQQAADWIGLESRKSLWGQFWSAHQRFFKYLCIAAKVRRLVELAREELARDKCVVIGLQSTGEARTREVLGENDGHLNCFVSAAEGVFLSLIQKHFPSTKRKRDRGAGSKRKRRPRGRGAKAPRLACETAGVIRISDDSSTESDPGLDSDFNSSPESLVDDDVVIVDAVGLPSDDRGPLCLLQRDPHGPGVLERVERLKQDLLDKVRRLGRELPVNTLDELIDQLGGPQRVAEMTGRKGRVVSRPDGTVAFESRAEQGLSIDHVNLREKQRFMSGEKLVAIISEASSSGVSLQADRRVQNQRRRVHMTLELPWSADRAIQQFGRTHRSNQVSAPEYVFLISELAGERRFASIVAKRLESLGALTHGDRRATESRDLSKYNFENKYGTRALHCVLTTILSQTENKVPVPQGYPGGVPTFFRDMKQGLLSVGIGGRESRNGCLDVEKDCSITKFLNRILGLEVHKQNALFQYFSDTFDHLIEMDKREGKYDMGILDLAPGIEEIYEESQQVFLAPGHPQDGQVVFYKISVDRGLKWEDAFAKSLALTGPYDGFYLSYKVRGNKPSCLLAEQNRGQFFTVYKPNIGRQSQLEALDSLRRKFHRVTAEEAKEPWESGYALSLTHCSHSAWNRHCRLAQEGKDCLQGLRLRHHYMLCGALLRVWGRIAAVMADVSSSSYLQIVRLKTKDRKKQVGIKIPEGCVRRVLQELRLMDADVKRRQAPALGCPAPPAPRPLALPCGPGEVLDLTYSPPAEAFPPPPHFSFPAPLSLDAGPGVVPLGTPDAQADPAALAHQGCDINFKEVLEDMLRSLHAGPPSEGALGEGAGAGGAAGGGPERQSVIQFSPPFPGAQAPL

SEQ ID NO: 35236 - protein, 1309 aa, Homo sapiens
  ENSP00000400762
MREPLPGSASWGTPGPPSAGTMSQLQLWLQFEALNKDSSYFEDFSNISIFSSSVDSLSDIVDTPDFLPADSLNQVSTIWDDNPAPSTHDKLFQLSRPFAGFEDFLPSHSTPLLVSYQEQSVQSQPEEEDEAEEEEAEELGHTETYADYVPSKSKIGKQHPDRVVETSTLSSVPPPDITYTLALPSDSGALSALQLEAITYACQQHEVLLPSGQRAGFLIGDGAGVGKGRTVAGVILENHLRGRKKALWFSVSNDLKYDAERDLRDIEATGIAVHALSKIKYGDTTTSEGVLFATYSALIGESQAGGQHRTRLRQILDWCGEAFEGVIVFDECHKAKNAGSTKMGKAVLDLQNKLPLARVVYASATGASEPRNMIYMSRLGIWGEGTPFRNFEEFLHAIEKRGVGAMEIVAMDMKVSGMYIARQLSFSGVTFRIEEIPLAPAFECVYNRAALLWAEALNVFQQAADWIGLESRKSLWGQFWSAHQRFFKYLCIAAKVRRLVELAREELARDKCVVIGLQSTGEARTREVLGENDGHLNCFVSAAEGVFLSLIQKHFPSTKRKRDRGAGSKRKRRPRGRGAKAPRLACETAGVIRISDDSSTESDPGLDSDFNSSPESLVDDDVVIVDAVGLPSDDRGPLCLLQRDPHGPGVLERVERLKQDLLDKVRRLGRELPVNTLDELIDQLGGPQRVAEMTGRKGRVVSRPDGTVAFESRAEQGLSIDHVNLREKQRFMSGEKLVAIISEASSSGVSLQADRRVQNQRRRVHMTLELPWSADRAIQQFGRTHRSNQVSAPEYVFLISELAGERRFASIVAKRLESLGALTHGDRRATESRDLSKYNFENKYGTRALHCVLTTILSQTENKVPVPQGYPGGVPTFFRDMKQGLLSVGIGGRESRNGCLDVEKDCSITKFLNRILGLEVHKQNALFQYFSDTFDHLIEMDKREGKYDMGILDLAPGIEEIYEESQQVFLAPGHPQDGQVVFYKISVDRGLKWEDAFAKSLALTGPYDGFYLSYKVRGNKPSCLLAEQNRGQFFTVYKPNIGRQSQLEALDSLRRKFHRVTAEEAKEPWESGYALSLTHCSHSAWNRHCRLAQEGKDCLQGLRLRHHYMLCGALLRVWGRIAAVMADVSSSSYLQIVRLKTKDRKKQVGIKIPEGCVRRVLQELRLMDADVKRRQAPALGCPAPPAPRPLALPCGPGEVLDLTYSPPAEAFPPPPHFSFPAPLSLDAGPGVVPLGTPDAQADPAALAHQGCDINFKEVLEDMLRSLHAGPPSEGALGEGAGAGGAAGGGPERQSVIQFSPPFPGAQAPL

SEQ ID NO: 35237 - protein, 1356 aa, Homo sapiens
  ENSP00000468520
MLAVGPAMDRDYPQHEPPPAGSLLYSPPPLQSAMLHCPYWNTFSLPPYPAFSSDSRPFMSSASFLGSQPCPDTSYAPVATASSLPPKTCDFAQDSSYFEDFSNISIFSSSVDSLSDIVDTPDFLPADSLNQVSTIWDDNPAPSTHDKLFQLSRPFAGFEDFLPSHSTPLLVSYQEQSVQSQPEEEDEAEEEEAEELGHTETYADYVPSKSKIGKQHPDRVVETSTLSSVPPPDITYTLALPSDSGALSALQLEAITYACQQHEVLLPSGQRAGFLIGDGAGVGKGRTVAGVILENHLRGRKKALWFSVSNDLKYDAERDLRDIEATGIAVHALSKIKYGDTTTSEGVLFATYSALIGESQAGGQHRTRLRQILDWCGEAFEGVIVFDECHKAKNAGSTKMGKAVLDLQNKLPLARVVYASATGASEPRNMIYMSRLGIWGEGTPFRNFEEFLHAIEKRGVGAMEIVAMDMKVSGMYIARQLSFSGVTFRIEEIPLAPAFECVYNRAALLAADWIGLESRKSLWGQFWSAHQRFFKYLCIAAKVRRLVELAREELARDKCVVIGLQSTGEARTREVLGENDGHLNCFVSAAEGVFLSLIQKHFPSTKRKRDRGAGSKRKRRPRGRGAKAPRLACETAGVIRISDDSSTESDPGLDSDFNSSPESLVDDDVVIVDAVGLPSDDRGPLCLLQRDPHGPGVLERVERLKQDLLDKVRRLGRELPVNTLDELIDQLGGPQRVAEMTGRKGRVVSRPDGTVAFESRAEQGLSIDHVNLREKQRFMSGEKLVAIISEASSSGVSLQADRRVQNQRRRVHMTLELPWSADRAIQQFGRTHRSNQVSAPEYVFLISELAGERRFASIVAKRLESLGALTHGDRRATESRDLSKYNFENKYGTRALHCVLTTILSQTENKVPVPQGYPGGVPTFFRDMKQGLLSVGIGGRESRNGCLDVEKDCSITKFLNRILGLEVHKQNALFQYFSDTFDHLIEMDKREGKYDMGILDLAPGIEEIYEESQQVFLAPGHPQDGQVVFYKISVDRGLKWEDAFAKSLALTGPYDGFYLSYKVRGNKPSCLLAEQNRGQFFTVYKPNIGRQSQLEALDSLRRKFHRVTAEEAKEPWESGYALSLTHCSHSAWNRHCRLAQEGKDCLQGLRLRHHYMLCGALLRVWGRIAAVMADVSSSSYLQIVRLKTKDRKKQVGIKIPEGCVRRVLQELRLMDADVKRRQAPALGCPAPPAPRPLALPCGPGEVLDLTYSPPAEAFPPPPHFSFPAPLSLDAGPGVVPLGTPDAQADPAALAHQGCDINFKEVLEDMLRSLHAGPPSEGALGEGAGAGGAAGGGPERQSVIQFSPPFPGAQAPL

SEQ ID NO: 35238 - protein, 128 aa, Homo sapiens
  ENSP00000468534
MLAVGPAMDRDYPQHEPPPAGSLLYSPPPLQSAMLHCPYWNTFSLPPYPAFSSDSRPFMSSASFLGSQPCPDTSYAPVATASSLPPKTCDFAQDSSYFEDFSNISIFSSSVDSLSDIVDTPDFLPADS

SEQ ID NO: 35239 - protein, 128 aa, Homo sapiens; identical to SEQ ID NO: 35238
  ENSP00000466861

SEQ ID NO: 35240 - protein, 111 aa, Homo sapiens
  ENSP00000468302
MLAVGPAMDRDYPQHEPPPAGSLLYSPPPLQSAMLHCPYWNTFSLPPYPAFSSDSRPFMSSASFLGSQPCPDTSYAPVATASSLPPKTCDFAQDSSYFEDFSNISIFSSSV

SEQ ID NO: 35241 - protein, 1366 aa, Homo sapiens; identical to SEQ ID NO: 35235
  ENSP00000488808

SEQ ID NO: 35242 - protein, 1309 aa, Homo sapiens; identical to SEQ ID NO: 35236
  ENSP00000482802

SEQ ID NO: 35243 - protein, 1356 aa, Homo sapiens; identical to SEQ ID NO: 35237
  ENSP00000488286

SEQ ID NO: 35244 - protein, 128 aa, Homo sapiens; identical to SEQ ID NO: 35238
  ENSP00000488832

SEQ ID NO: 35245 - protein, 128 aa, Homo sapiens; identical to SEQ ID NO: 35238
  ENSP00000488079

SEQ ID NO: 35246 - protein, 111 aa, Homo sapiens; identical to SEQ ID NO: 35240
  ENSP00000488056

SEQ ID NO: 35247 - protein, 1366 aa, Homo sapiens; identical to SEQ ID NO: 35235
  ENSP00000477651

SEQ ID NO: 35248 - protein, 45 aa, Homo sapiens
  ENSP00000457520
MAEKVNNFPPLPKFIPLKPCFYQDFEADIPPQHVSMTKRLYYLWM

SEQ ID NO: 35249 - protein, 235 aa, Homo sapiens
  ENSP00000406547
MAEKVNNFPPLPKFIPLKPCFYQDFEADIPPQHVSMTKRLYYLWMLNSVTLAVNLVGCLAWLIGGGGATNFGLAFLWLILFTPCSYVCWFRPIYKAFKTDSSFSFMAFFFTFMAQLVISIIQAVGIPGWGVCGWIATISFFGTNIGSAVVMLIPTVMFTVMAVFSFIALSMVHKFYRGSGGSFSKAQEEWTTGAWKNPHVQQAAQNAAMGAAQGAMNQPQTQYSATPNYTYSNEM

SEQ ID NO: 35250 - protein, 116 aa, Homo sapiens
  ENSP00000456505
MAEKVNNFPPLPKFIPLKPCFYQDFEADIPPQHVSMTKRLYYLWMLNSVTLAVNLVGCLAWLIGGGGATNFGLAFLWLILFTPCSYVCWFRPIYKAFKTDSSFSFMAFFFTFMAQL

SEQ ID NO: 35251 - protein, 97 aa, Homo sapiens
  ENSP00000456991
MAEKVNNFPPLPKFIPLKPCFYQDFEADIPPQHVSMTKRLYYLWMLNSVTLAVNLVGCLAWLIGGGGATNFGLAFLWLILFTPCSYVCWFRPIYKAF

SEQ ID NO: 35252 - protein, 243 aa, Homo sapiens
  ENSP00000455313
MAEKVNNFPPLPKFIPLKPCFYQDFEADIPPQHVSMTKRLYYLWMLNSVTLAVNLVGCLAWLIGGGGATNFGLAFLWLILFTPCSYVCWFRPIYKAFKTDSSFSFMAFFFTFMAQLVISIIQAVGIPGWGVCPTLASSCSGWIATISFFGTNIGSAVVMLIPTVMFTVMAVFSFIALSMVHKFYRGSGGSFSKAQEEWTTGAWKNPHVQQAAQNAAMGAAQGAMNQPQTQYSATPNYTYSNEM

SEQ ID NO: 35253 - protein, 123 aa, Homo sapiens
  ENSP00000454860
MAEKVNNFPPLPKFIPLKPCFYQDFEADIPPQHVSMTKRLYYLWMLNSVTLAVNLVGCLAWLIGGGGATNFGLAFLWLILFTPCSYVCWFRPIYKAFKTDSSFSFMAFFFTFMAQLVISIIQA

SEQ ID NO: 35254 - protein, 45 aa, Homo sapiens; identical to SEQ ID NO: 35248
  ENSP00000455598

SEQ ID NO: 35255 - protein, 95 aa, Homo sapiens
  ENSP00000454766
MAEKVNNFPPLPKFIPLKPCFYQDFEADIPPQHVSMTKRLYYLWMLNSVTLAVNLVGCLAWLIGGGGATNFGLAFLWLILFTPCSYVCWFRPIYK

SEQ ID NO: 35256 - protein, 45 aa, Homo sapiens; identical to SEQ ID NO: 35248
  ENSP00000458072

SEQ ID NO: 35257 - protein, 235 aa, Homo sapiens; identical to SEQ ID NO: 35249
  ENSP00000355387

SEQ ID NO: 35258 - protein, 46 aa, Homo sapiens
  ENSP00000457444
MAEKVNNFPPLPKFIPLKPCFYQDFEADIPPQHVSMTKRLYYLWMC

SEQ ID NO: 35259 - protein, 69 aa, Homo sapiens
  ENSP00000457121
MAEKVNNFPPLPKFIPLKPCFYQDFEADIPPQHVSMTKRLYYLWMLNSVTLAVNLVGCLAWLIGGGGAT

SEQ ID NO: 35260 - protein, 148 aa, Homo sapiens
  ENSP00000455039
MAEKVNNFPPLPKFIPLKPCFYQDFEADIPPQHVSMTKRLYYLWMLNSVTLAVNLVGCLAWLIGGGGATNFGLAFLWLILFTPCSYVCWFRPIYKAFKTDSSFSFMAFFFTFMAQLVISIIQAVGIPGWGVCGWIATISFFGTNIGSA

SEQ ID NO: 35261 - protein, 45 aa, Homo sapiens; identical to SEQ ID NO: 35248
  ENSP00000455203

SEQ ID NO: 35262 - protein, 168 aa, Homo sapiens
  ENSP00000454602
MHLNLEGLGGLEGREALALCPGDGSHLLCRRTDSSFSFMAFFFTFMAQLVISIIQAVGIPGWGVCGWIATISFFGTNIGSAVVMLIPTVMFTVMAVFSFIALSMVHKFYRGSGGSFSKAQEEWTTGAWKNPHVQQAAQNAAMGAAQGAMNQPQTQYSATPNYTYSNEM

SEQ ID NO: 35263 - protein, 466 aa, Homo sapiens
  ENSP00000337985
MKVRSAGGDGDALCVTEEDLAGDDEDMPTFPCTQKGRPGPRCSRCQKNLSLHTSVRILYLFLALLLVAVAVLASLVFRKVDSLSEDISLTQSIYDKKLVLMQKNLQGLDPKALNNCSFCHEAGQLGPEIRKLQEELEGIQKLLLAQEVQLDQTLQAQEVLSTTSRQISQEMGSCSFSIHQVNQSLGLFLAQVRGWQATTAGLDLSLKDLTQECYDVKAAVHQINFTVGQTSEWIHGIQRKTDEETLTLQKIVTDWQNYTRLFSGLRTTSTKTGEAVKNIQATLGASSQRISQNSESMHDLVLQVMGLQLQLDNISSFLDDHEENMHDLQYHTHYAQNRTVERFESLEGRMASHEIEIGTIFTNINATDNHVHSMLKYLDDVRLSCTLGFHTHAEELYYLNKSVSIMLGTTDLLRERFSLLSARLDLNVRNLSMIVEEMKAVDTQHGEILRNVTILRGHTLFSHNRI

SEQ ID NO: 35264 - protein, 606 aa, Homo sapiens
  ENSP00000301904
MKVRSAGGDGDALCVTEEDLAGDDEDMPTFPCTQKGRPGPRCSRCQKNLSLHTSVRILYLFLALLLVAVAVLASLVFRKVDSLSEDISLTQSIYDKKLVLMQKNLQGLDPKALNNCSFCHEAGQLGPEIRKLQEELEGIQKLLLAQEVQLDQTLQAQEVLSTTSRQISQEMGSCSFSIHQVNQSLGLFLAQVRGWQATTAGLDLSLKDLTQECYDVKAAVHQINFTVGQTSEWIHGIQRKTDEETLTLQKIVTDWQNYTRLFSGLRTTSTKTGEAVKNIQATLGASSQRISQNSESMHDLVLQVMGLQLQLDNISSFLDDHEENMHDLQYHTHYAQNRTVERFESLEGRMASHEIEIGTIFTNINATDNHVHSMLKYLDDVRLSCTLGFHTHAEELYYLNKSVSIMLGTTDLLRERFSLLSARLDLNVRNLSMIVEEMKAVDTQHGEILRNVTILRGAPGPPGPRGFKGDMGVKGPVGGRGPKGDPGSLGPLGPQGPQGQPGEAGPVGERGPVGPRGFPGLKGSKGSFGTGGPRGQPGPKGDIGPPGPEGPPGSPGPSGPQGKPGIAGKTGSPGQRGAMGPKGEPGIQGPPGLPGPPGPPGSQSFY

SEQ ID NO: 35265 - protein, 283 aa, Homo sapiens
  ENSP00000432840
MSNVTLRKMSPTGNEMKSTTQGTTRKQQDFHEVNKRRTFLQDNSWIKKRPEEEKDENYGRVVLNRHNSHDALDRKVNERDVPKATISRYSSDDTLDRSMSMFRSLEVTKLQPGGSLNANTSNTIASTSATTPVKKKRQSWFPPPPPGYNASSSTGTRRREPGVHPPIPPKPSSPVSSPNQLRQDNRQIHPPKPGVYTETNRSAERNISEELDNLIKMNKSLNRNQGLDSLFRANPKVEEREKRAKSLESLIYMSTRTDKDGKGIQSLGSPIKVNQRTDKNEKG

SEQ ID NO: 35266 - protein, 668 aa, Homo sapiens
  ENSP00000366454
MSNVTLRKMSPTGNEMKSTTQGTTRKQQDFHEVNKRRTFLQDNSWIKKRPEEEKDENYGRVVLNRHNSHDALDRKVNERDVPKATISRYSSDDTLDRISDRNDAAKTYKANTLDNQLTNRSMSMFRSLEVTKLQPGGSLNANTSNTIASTSATTPVKKKRQSWFPPPPPGYNASSSTGTRRREPGVHPPIPPKPSSPVSSPNQLRQDNRQIHPPKPGVYTETNRSAERNISEELDNLIKMNKSLNRNQGLDSLFRANPKVEEREKRAKSLESLIYMSTRTDKDGKGIQSLGSPIKVNQRTDKNEKGRQNLESVAKVNARMNKTSRRSEDLDNATEVNPKGHENTTGKKDLDGLIKVDPETNKNITRGQSLDNLIKVTPEVKRSNQGSKDLNNFIKVYPGTEKSTEGGQSLDSLIKVTPERNRTNQGNQDLENLIKVIPSANKSSEQGLDEHINVSPKAVKNTDGKQDLDKLIKVNPEIFTNNQRNQDLANLIKVNPAVIRNNQSQDLDNLIKVKPSALRNTNRDQNLENLIEVNSHVSENKNGSSNTGAKQAGPQDTVVYTRTYVENSKSPKDGYQENISGKYIQTVYSTSDRSVIERDMCTYCRKPLGVETKMILDELQICCHSTCFKCEICKQPLENLQAGDSIWIYRQTIHCEPCYSKIMAKWIP

SEQ ID NO: 35267 - protein, 688 aa, Homo sapiens
  ENSP00000302579
MSNVTLRKMSPTGNEMKSTTQGTTRKQQDFHEVNKRRTFLQDNSWIKKRPEEEKDENYGRVVLNRHNSHDALDRKVNERDVPKATISRYSSDDTLDRISDRNDAAKTYKANTLDNQLTNRSMSMFRSLEVTKLQPGGSLNANTSNTIASTSATTPVKKKRQSWFPPPPPGYNASSSTGTRRREPGVHPPIPPKPSSPVSSPNQLRQDNRQIHPPKPGVYTETNRSAERNIRSQDLDNIVKVATSLQRSDKGEELDNLIKMNKSLNRNQGLDSLFRANPKVEEREKRAKSLESLIYMSTRTDKDGKGIQSLGSPIKVNQRTDKNEKGRQNLESVAKVNARMNKTSRRSEDLDNATEVNPKGHENTTGKKDLDGLIKVDPETNKNITRGQSLDNLIKVTPEVKRSNQGSKDLNNFIKVYPGTEKSTEGGQSLDSLIKVTPERNRTNQGNQDLENLIKVIPSANKSSEQGLDEHINVSPKAVKNTDGKQDLDKLIKVNPEIFTNNQRNQDLANLIKVNPAVIRNNQSQDLDNLIKVKPSALRNTNRDQNLENLIEVNSHVSENKNGSSNTGAKQAGPQDTVVYTRTYVENSKSPKDGYQENISGKYIQTVYSTSDRSVIERDMCTYCRKPLGVETKMILDELQICCHSTCFKCEICKQPLENLQAGDSIWIYRQTIHCEPCYSKIMAKWIP

SEQ ID NO: 35268 - protein, 646 aa, Homo sapiens
  ENSP00000437895
MSNVTLRKMSPTGNEMKSTTQGTTRKQQDFHEVNKRRTFLQDNSWIKKRPEEEKDENYGRVVLNRHNSHDALDRKVNERDVPKATISRYSSDDTLDRISDRNDAAKTYKANTLDNQLTNRSMSMFRSLEVTKLQPGGSLNANTSNTIASTSATTPVKKKREPGVHPPIPPKPSSPVSSPNQLRQDNRQIHPPKPGVYTETNRSAERNIRSQDLDNIVKVATSLQRSDKGEELDNLIKMNKSLNRNQGLDSLFRANPKVEEREKRAKSLESLIYMSTRTDKDGKGIQSLGSPIKVNQRTDKNEKGRQNLESVAKVNARMNKTSRRSEDLDNATEVNPKGHENTTGGQSLDNLIKVTPEVKRSNQGSKDLNNFIKVYPGTEKSTEGGQSLDSLIKVTPERNRTNQGNQDLENLIKVIPSANKSSEQGLDEHINVSPKAVKNTDGKQDLDKLIKVNPEIFTNNQRNQDLANLIKVNPAVIRNNQSQDLDNLIKVKPSALRNTNRDQNLENLIEVNSHVSENKNGSSNTGAKQAGPQDTVVYTRTYVENSKSPKDGYQENISGKYIQTVYSTSDRSVIERDMCTYCRKPLGVETKMILDELQICCHSTCFKCEICKQPLENLQAGDSIWIYRQTIHCEPCYSKIMAKWIP

SEQ ID NO: 35269 - protein, 468 aa, Homo sapiens
  ENSP00000220478
MGFLGTGTWILVLVLPIQAFPKPGGSQDKSLHNRELSAERPLNEQIAEAEEDKIKKTYPPENKPGQSNYSFVDNLNLLKAITEKEKIEKERQSIRSSPLDNKLNVEDVDSTKNRKLIDDYDSTKSGLDHKFQDDPDGLHQLDGTPLTAEDIVHKIAARIYEENDRAVFDKIVSKLLNLGLITESQAHTLEDEVAEVLQKLISKEANNYEEDPNKPTSWTENQAGKIPEKVTPMAAIQDGLAKGENDETVSNTLTLTNGLERRTKTYSEDNFEELQYFPNFYALLKSIDSEKEAKEKETLITIMKTLIDFVKMMVKYGTISPEEGVSYLENLDEMIALQTKNKLEKNATDNISKLFPAPSEKSHEETDSTKEEAAKMEKEYGSLKDSTKDDNSNPGGKTDEPKGKTEAYLEAIRKNIEWLKKHDKKGNKEDYDLSKMRDFINKQADAYVEKGILDKEEAEAIKRIYSSL

SEQ ID NO: 35270 - protein, 236 aa, Homo sapiens
  ENSP00000445205
MAAIQDGLAKGENDETVSNTLTLTNGLERRTKTYSEDNFEELQYFPNFYALLKSIDSEKEAKEKETLITIMKTLIDFVKMMVKYGTISPEEGVSYLENLDEMIALQTKNKLEKNATDNISKLFPAPSEKSHEETDSTKEEAAKMEKEYGSLKDSTKDDNSNPGGKTDEPKGKTEAYLEAIRKNIEWLKKHDKKGNKEDYDLSKMRDFINKQADAYVEKGILDKEEAEAIKRIYSSL

SEQ ID NO: 35271 - protein, 57 aa, Homo sapiens
  ENSP00000452745
MAAIQDGLAKGENDETVSNTLTLTNGLERRTKTYSEDNFEELQYFPNFYALLKSIDS

SEQ ID NO: 35272 - protein, 276 aa, Homo sapiens
  ENSP00000367197
MDSSREPTLGRLDAAGFWQVWQRFDADEKGYIEEKELDAFFLHMLMKLGTDDTVMKANLHKVKQQFMTTQDASKDGRIRMKELAGMFLSEDENFLLLFRRENPLDSSVEFMQIWRKYDADSSGFISAAELRNFLRDLFLHHKKAISEAKLEEYTGTMMKIFDRNKDGRLDLNDLARILALQENFLLQFKMDACSTEERKRDFEKIFAYYDVSKTGALEGPEVDGFVKDMMELVQPSISGVDLDKFREILLRHCDVNKDGKIQKSELALCLGLKINP

SEQ ID NO: 35273 - protein, 49 aa, Homo sapiens
  ENSP00000484392
MDSSREPTLGRLDAAGFWQVWQRFDADGHGHESKFAQGETAVYDYPRCL

SEQ ID NO: 35274 - protein, 49 aa, Homo sapiens; identical to SEQ ID NO: 35273
  ENSP00000333933

SEQ ID NO: 35275 - protein, 149 aa, Homo sapiens
  ENSP00000493054
MEQTVLVPPGPDSFNFFTRESLAAIERRIAEEKAKNPKPDKKDDDENGPKPNSDLEAGKNLPFIYGDIPPEMVSEPLEDLDPYYINKKTFIVLNKGKAIFRFSATSALYILTPFNPLRKIAIKILVHSYIIQHANYVHYFDKLCVYDNE

SEQ ID NO: 35276 - protein, 1997 aa, Homo sapiens
  ENSP00000492917
MEQTVLVPPGPDSFNFFTRESLAAIERRIAEEKAKNPKPDKKDDDENGPKPNSDLEAGKNLPFIYGDIPPEMVSEPLEDLDPYYINKKTFIVLNKGKAIFRFSATSALYILTPFNPLRKIAIKILVHSLFSMLIMCTILTNCVFMTMSNPPDWTKNVEYTFTGIYTFESLIKIIARGFCLEDFTFLRDPWNWLDFTVITFAYVTEFVDLGNVSALRTFRVLRALKTISVIPGLKTIVGALIQSVKKLSDVMILTVFCLSVFALIGLQLFMGNLRNKCIQWPPTNASLEEHSIEKNITVNYNGTLINETVFEFDWKSYIQDSRYHYFLEGFLDALLCGNSSDAGQCPEGYMCVKAGRNPNYGYTSFDTFSWAFLSLFRLMTQDFWENLYQLTLRAAGKTYMIFFVLVIFLGSFYLINLILAVVAMAYEEQNQATLEEAEQKEAEFQQMIEQLKKQQEAAQAATATASEHSREPSAAGRLSDSSSEASKLSSKSAKERRNRRKKRKQKEQSGGEEKDEDEFQKSESEDSIRRKGFRFSIEGNRLTYEKRYSSPHQSLLSIRGSLFSPRRNSRTSLFSFRGRAKDVGSENDFADDEHSTFEDNESRRDSLFVPRRHGERRNSNLSQTSRSSRMLAVFPANGKMHSTVDCNGVVSLVGGPSVPTSPVGQLLPEGTTTETEMRKRRSSSFHVSMDFLEDPSQRQRAMSIASILTNTVEELEESRQKCPPCWYKFSNIFLIWDCSPYWLKVKHVVNLVVMDPFVDLAITICIVLNTLFMAMEHYPMTDHFNNVLTVGNLVFTGIFTAEMFLKIIAMDPYYYFQEGWNIFDGFIVTLSLVELGLANVEGLSVLRSFRLLRVFKLAKSWPTLNMLIKIIGNSVGALGNLTLVLAIIVFIFAVVGMQLFGKSYKDCVCKIASDCQLPRWHMNDFFHSFLIVFRVLCGEWIETMWDCMEVAGQAMCLTVFMMVMVIGNLVVLNLFLALLLSSFSADNLAATDDDNEMNNLQIAVDRMHKGVAYVKRKIYEFIQQSFIRKQKILDEIKPLDDLNNKKDSCMSNHTAEIGKDLDYLKDVNGTTSGIGTGSSVEKYIIDESDYMSFINNPSLTVTVPIAVGESDFENLNTEDFSSESDLEESKEKLNESSSSSEGSTVDIGAPVEEQPVVEPEETLEPEACFTEGCVQRFKCCQINVEEGRGKQWWNLRRTCFRIVEHNWFETFIVFMILLSSGALAFEDIYIDQRKTIKTMLEYADKVFTYIFILEMLLKWVAYGYQTYFTNAWCWLDFLIVDVSLVSLTANALGYSELGAIKSLRTLRALRPLRALSRFEGMRVVVNALLGAIPSIMNVLLVCLIFWLIFSIMGVNLFAGKFYHCINTTTGDRFDIEDVNNHTDCLKLIERNETARWKNVKVNFDNVGFGYLSLLQVATFKGWMDIMYAAVDSRNVELQPKYEESLYMYLYFVIFIIFGSFFTLNLFIGVIIDNFNQQKKKFGGQDIFMTEEQKKYYNAMKKLGSKKPQKPIPRPGNKFQGMVFDFVTRQVFDISIMILICLNMVTMMVETDDQSEYVTTILSRINLVFIVLFTGECVLKLISLRHYYFTIGWNIFDFVVVILSIVGMFLAELIEKYFVSPTLFRVIRLARIGRILRLIKGAKGIRTLLFALMMSLPALFNIGLLLFLVMFIYAIFGMSNFAYVKREVGIDDMFNFETFGNSMICLFQITTSAGWDGLLAPILNSKPPDCDPNKVNPGSSVKGDCGNPSVGIFFFVSYIIISFLVVVNMYIAVILENFSVATEESAEPLSEDDFEMFYEVWEKFDPDATQFMEFEKLSQFAAALEPPLNLPQPNKLQLIAMDLPMVSGDRIHCLDILFAFTKRVLGESGEMDALRIQMEERFMASNPSKVSYQPITTTLKRKQEEVSAVIIQRAYRRHLLKRTVKQASFTYNKNKIKGGANLLIKEDMIIDRINENSITEKTDLTMSTAACPPSYDRVTKPIVEKHEQEGKDEKAKGK

SEQ ID NO: 35277 - protein, 1915 aa, Homo sapiens
  ENSP00000492945
MEQTVLVPPGPDSFNFFTRESLAAIERRIAEEKAKNPKPDKKDDDENGPKPNSDLEAGKNLPFIYGDIPPEMVSEPLEDLDPYYINKKTFIVLNKGKAIFRFSATSALYILTPFNPLRKIAIKILVHSLFSMLIMCTILTNCVFMTMSNPPDWTKNVEYTFTGIYTFESLIKIIARGFCLEDFTFLRDPWNWLDFTVITFAYVTEFVDLGNVSALRTFRVLRALKTISVIPGLKTIVGALIQSVKKLSDVMILTVFCLSVFALIGLQLFMGNLRNKCIQWPPTNASLEEHSIEKNITVNYNGTLINETVFEFDWKSYIQDSRYHYFLEGFLDALLCGNSSDAGQCPEGYMCVKAGRNPNYGYTSFDTFSWAFLSLFRLMTQDFWENLYQLTLRAAGKTYMIFFVLVIFLGSFYLINLILAVVAMAYEEQNQATLEEAEQKEAEFQQMIEQLKKQQEAAQQAATATASEHSREPSAAGRLSDSSSEASKLSSKSAKERRNRRKKRKQKEQSGGEEKDEDEFQKSESEDSIRRKGFRFSIEGNRLTYEKRYSSPHQSLLSIRGSLFSPRRNSRTSLFSFRGRAKDVGSENDFADDEHSTFEDNESRRDSLFVPRRHGERRNSNLSQTSRSSRMLAVFPANGKMHSTVDCNGVVSLVGGPSVPTSPVGQLLPEVIIDKPATDDNGTTTETEMRKRRSSSFHVSMDFLEDPSQRQRAMSIASILTNTVEELEESRQKCPPCWYKFSNIFLIWDCSPYWLKVKHVVNLVVMDPFVDLAITICIVLNTLFMAMEHYPMTDHFNNVLTVGNLVFTGIFTAEMFLKIIAMDPYYYFQEGWNIFDGFIVTLSLVELGLANVEGLSVLRSFRLLRVFKLAKSWPTLNMLIKIIGNSVGALGNLTLVLAIIVFIFAVVGMQLFGKSYKDCVCKIASDCQLPRWHMNDFFHSFLIVFRVLCGEWIETMWDCMEVAGQAMCLTVFMMVMVIGNLVVLNLFLALLLSSFSADNLAATDDDNEMNNLQIAVDRMHKGVAYVKRKIYEFIQQSFIRKQKILDEIKPLDDLNNKKDSCMSNHTAEIGKDLDYLKDVNGTTSGIGTGSSVEKYIIDESDYMSFINNPSLTVTVPIAVGESDFENLNTEDFSSESDLEESKEKLNESSSSSEGSTVDIGAPVEEQPVVEPEETLEPEACFTEGCVQRFKCCQINVEEGRGKQWWNLRRTCFRIVEHNWFETFIVFMILLSSGALAFEDIYIDQRKTIKTMLEYADKVFTYIFILEMLLKWVAYGYQTYFTNAWCWLDFLIVDVSLVSLTANALGYSELGAIKSLRTLRALRPLRALSRFEGMRATFKGWMDIMYAAVDSRNVELQPKYEESLYMYLYFVIFIIFGSFFTLNLFIGVIIDNFNQQKKKFGGQDIFMTEEQKKYYNAMKKLGSKKPQKPIPRPGNKFQGMVFDFVTRQVFDISIMILICLNMVTMMVETDDQSEYVTTILSRINLVFIVLFTGECVLKLISLRHYYFTIGWNIFDFVVVILSIVGMFLAELIEKYFVSPTLFRVIRLARIGRILRLIKGAKGIRTLLFALMMSLPALFNIGLLLFLVMFIYAIFGMSNFAYVKREVGIDDMFNFETFGNSMICLFQITTSAGWDGLLAPILNSKPPDCDPNKVNPGSSVKGDCGNPSVGIFFFVSYIIISFLVVVNMYIAVILENFSVATEESAEPLSEDDFEMFYEVWEKFDPDATQFMEFEKLSQFAAALEPPLNLPQPNKLQLIAMDLPMVSGDRIHCLDILFAFTKRVLGESGEMDALRIQMEERFMASNPSKVSYQPITTTLKRKQEEVSAVIIQRAYRRHLLKRTVKQASFTYNKNKIKGGANLLIKEDMIIDRINENSITEKTDLTMSTAACPPSYDRVTKPIVEKHEQEGKDEKAKGK

SEQ ID NO: 35278 - protein, 1998 aa, Homo sapiens
  ENSP00000491573
MEQTVLVPPGPDSFNFFTRESLAAIERRIAEEKAKNPKPDKKDDDENGPKPNSDLEAGKNLPFIYGDIPPEMVSEPLEDLDPYYINKKTFIVLNKGKAIFRFSATSALYILTPFNPLRKIAIKILVHSLFSMLIMCTILTNCVFMTMSNPPDWTKNVEYTFTGIYTFESLIKIIARGFCLEDFTFLRDPWNWLDFTVITFAFVTEFVNLGNFSALRTFRVLRALKTISVIPGLKTIVGALIQSVKKLSDVMILTVFCLSVFALIGLQLFMGNLRNKCIQWPPTNASLEEHSIEKNITVNYNGTLINETVFEFDWKSYIQDSRYHYFLEGFLDALLCGNSSDAGQCPEGYMCVKAGRNPNYGYTSFDTFSWAFLSLFRLMTQDFWENLYQLTLRAAGKTYMIFFVLVIFLGSFYLINLILAVVAMAYEEQNQATLEEAEQKEAEFQQMIEQLKKQQEAAQQAATATASEHSREPSAAGRLSDSSSEASKLSSKSAKERRNRRKKRKQKEQSGGEEKDEDEFQKSESEDSIRRKGFRFSIEGNRLTYEKRYSSPHQSLLSIRGSLFSPRRNSRTSLFSFRGRAKDVGSENDFADDEHSTFEDNESRRDSLFVPRRHGERRNSNLSQTSRSSRMLAVFPANGKMHSTVDCNGVVSLVGGPSVPTSPVGQLLPEGTTTETEMRKRRSSSFHVSMDFLEDPSQRQRAMSIASILTNTVEELEESRQKCPPCWYKFSNIFLIWDCSPYWLKVKHVVNLVVMDPFVDLAITICIVLNTLFMAMEHYPMTDHFNNVLTVGNLVFTGIFTAEMFLKIIAMDPYYYFQEGWNIFDGFIVTLSLVELGLANVEGLSVLRSFRLLRVFKLAKSWPTLNMLIKIIGNSVGALGNLTLVLAIIVFIFAVVGMQLFGKSYKDCVCKIASDCQLPRWHMNDFFHSFLIVFRVLCGEWIETMWDCMEVAGQAMCLTVFMMVMVIGNLVVLNLFLALLLSSFSADNLAATDDDNEMNNLQIAVDRMHKGVAYVKRKIYEFIQQSFIRKQKILDEIKPLDDLNNKKDSCMSNHTAEIGKDLDYLKDVNGTTSGIGTGSSVEKYIIDESDYMSFINNPSLTVTVPIAVGESDFENLNTEDFSSESDLEESKEKLNESSSSSEGSTVDIGAPVEEQPVVEPEETLEPEACFTEGCVQRFKCCQINVEEGRGKQWWNLRRTCFRIVEHNWFETFIVFMILLSSGALAFEDIYIDQRKTIKTMLEYADKVFTYIFILEMLLKWVAYGYQTYFTNAWCWLDFLIVDVSLVSLTANALGYSELGAIKSLRTLRALRPLRALSRFEGMRVVVNALLGAIPSIMNVLLVCLIFWLIFSIMGVNLFAGKFYHCINTTTGDRFDIEDVNNHTDCLKLIERNETARWKNVKVNFDNVGFGYLSLLQVATFKGWMDIMYAAVDSRNVELQPKYEESLYMYLYFVIFIIFGSFFTLNLFIGVIIDNFNQQKKKFGGQDIFMTEEQKKYYNAMKKLGSKKPQKPIPRPGNKFQGMVFDFVTRQVFDISIMILICLNMVTMMVETDDQSEYVTTILSRINLVFIVLFTGECVLKLISLRHYYFTIGWNIFDFVVVILSIVGMFLAELIEKYFVSPTLFRVIRLARIGRILRLIKGAKGIRTLLFALMMSLPALFNIGLLLFLVMFIYAIFGMSNFAYVKREVGIDDMFNFETFGNSMICLFQITTSAGWDGLLAPILNSKPPDCDPNKVNPGSSVKGDCGNPSVGIFFFVSYIIISFLVVVNMYIAVILENFSVATEESAEPLSEDDFEMFYEVWEKFDPDATQFMEFEKLSQFAAALEPPLNLPQPNKLQLIAMDLPMVSGDRIHCLDILFAFTKRVLGESGEMDALRIQMEERFMASNPSKVSYQPITTTLKRKQEEVSAVIIQRAYRRHLLKRTVKQASFTYNKNKIKGGANLLIKEDMIIDRINENSITEKTDLTMSTAACPPSYDRVTKPIVEKHEQEGKDEKAKGK

SEQ ID NO: 35279 - protein, 1998 aa, Homo sapiens
  ENSP00000490780
MEQTVLVPPGPDSFNFFTRESLAAIERRIAEEKAKNPKPDKKDDDENGPKPNSDLEAGKNLPFIYGDIPPEMVSEPLEDLDPYYINKKTFIVLNKGKAIFRFSATSALYILTPFNPLRKIAIKILVHSLFSMLIMCTILTNCVFMTMSNPPDWTKNVEYTFTGIYTFESLIKIIARGFCLEDFTFLRDPWNWLDFTVITFAYVTEFVDLGNVSALRTFRVLRALKTISVIPGLKTIVGALIQSVKKLSDVMILTVFCLSVFALIGLQLFMGNLRNKCIQWPPTNASLEEHSIEKNITVNYNGTLINETVFEFDWKSYIQDSRYHYFLEGFLDALLCGNSSDAGQCPEGYMCVKAGRNPNYGYTSFDTFSWAFLSLFRLMTQDFWENLYQLTLRAAGKTYMIFFVLVIFLGSFYLINLILAVVAMAYEEQNQATLEEAEQKEAEFQQMIEQLKKQQEAAQQAATATASEHSREPSAAGRLSDSSSEASKLSSKSAKERRNRRKKRKQKEQSGGEEKDEDEFQKSESEDSIRRKGFRFSIEGNRLTYEKRYSSPHQSLLSIRGSLFSPRRNSRTSLFSFRGRAKDVGSENDFADDEHSTFEDNESRRDSLFVPRRHGERRNSNLSQTSRSSRMLAVFPANGKMHSTVDCNGVVSLVGGPSVPTSPVGQLLPEGTTTETEMRKRRSSSFHVSMDFLEDPSQRQRAMSIASILTNTVEELEESRQKCPPCWYKFSNIFLIWDCSPYWLKVKHVVNLVVMDPFVDLAITICIVLNTLFMAMEHYPMTDHFNNVLTVGNLVFTGIFTAEMFLKIIAMDPYYYFQEGWNIFDGFIVTLSLVELGLANVEGLSVLRSFRLLRVFKLAKSWPTLNMLIKIIGNSVGALGNLTLVLAIIVFIFAVVGMQLFGKSYKDCVCKIASDCQLPRWHMNDFFHSFLIVFRVLCGEWIETMWDCMEVAGQAMCLTVFMMVMVIGNLVVLNLFLALLLSSFSADNLAATDDDNEMNNLQIAVDRMHKGVAYVKRKIYEFIQQSFIRKQKILDEIKPLDDLNNKKDSCMSNHTAEIGKDLDYLKDVNGTTSGIGTGSSVEKYIIDESDYMSFINNPSLTVTVPIAVGESDFENLNTEDFSSESDLEESKEKLNESSSSSEGSTVDIGAPVEEQPVVEPEETLEPEACFTEGCVQRFKCCQINVEEGRGKQWWNLRRTCFRIVEHNWFETFIVFMILLSSGALAFEDIYIDQRKTIKTMLEYADKVFTYIFILEMLLKWVAYGYQTYFTNAWCWLDFLIVDVSLVSLTANALGYSELGAIKSLRTLRALRPLRALSRFEGMRVVVNALLGAIPSIMNVLLVCLIFWLIFSIMGVNLFAGKFYHCINTTTGDRFDIEDVNNHTDCLKLIERNETARWKNVKVNFDNVGFGYLSLLQVATFKGWMDIMYAAVDSRNVELQPKYEESLYMYLYFVIFIIFGSFFTLNLFIGVIIDNFNQQKKKFGGQDIFMTEEQKKYYNAMKKLGSKKPQKPIPRPGNKFQGMVFDFVTRQVFDISIMILICLNMVTMMVETDDQSEYVTTILSRINLVFIVLFTGECVLKLISLRHYYFTIGWNIFDFVVVILSIVGMFLAELIEKYFVSPTLFRVIRLARIGRILRLIKGAKGIRTLLFALMMSLPALFNIGLLLFLVMFIYAIFGMSNFAYVKREVGIDDMFNFETFGNSMICLFQITTSAGWDGLLAPILNSKPPDCDPNKVNPGSSVKGDCGNPSVGIFFFVSYIIISFLVVVNMYIAVILENFSVATEESAEPLSEDDFEMFYEVWEKFDPDATQFMEFEKLSQFAAALEPPLNLPQPNKLQLIAMDLPMVSGDRIHCLDILFAFTKRVLGESGEMDALRIQMEERFMASNPSKVSYQPITTTLKRKQEEVSAVIIQRAYRRHLLKRTVKQASFTYNKNKIKGGANLLIKEDMIIDRINENSITEKTDLTMSTAACPPSYDRVTKPIVEKHEQEGKDEKAKGK

SEQ ID NO: 35280 - protein, 1618 aa, Homo sapiens
  ENSP00000490692
MEQTVLVPPGPDSFNFFTRESLAAIERRIAEEKAKNPKPDKKDDDENGPKPNSDLEAGKNLPFIYGDIPPEMVSEPLEDLDPYYINKKTFIVLNKGKAIFRFSATSALYILTPFNPLRKIAIKILVHSLFSMLIMCTILTNCVFMTMSNPPDWTKNVEYTFTGIYTFESLIKIIARGFCLEDFTFLRDPWNWLDFTVITFAYVTEFVDLGNVSALRTFRVLRALKTISVIPGLKTIVGALIQSVKKLSDVMILTVFCLSVFALIGLQLFMGNLRNKCIQWPPTNASLEEHSIEKNITVNYNGTLINETVFEFDWKSYIQDSRYHYFLEGFLDALLCGNSSDAGQCPEGYMCVKAGRNPNYGYTSFDTFSWAFLSLFRLMTQDFWENLYQLTLRAAGKTYMIFFVLVIFLGSFYLINLILAVVAMAYEEQNQATLEEAEQKEAEFQQMIEQLKKQQEAAQQAATATASEHSREPSAAGRLSDSSSEASKLSSKSAKERRNRRKKRKQKEQSGGEEKDEDEFQKSESEDSIRRKGFRFSIEGNRLTYEKRYSSPHQSLLSIRGSLFSPRRNSRTSLFSFRGRAKDVGSENDFADDEHSTFEDNESRRDSLFVPRRHGERRNSNLSQTSRSSRMLAVFPANGKMHSTVDCNGVVSLVGGPSVPTSPVGQLLPEGTTTETEMRKRRSSSFHVSMDFLEDPSQRQRAMSIASILTNTVEELEESRQKCPPCWYKFSNIFLIWDCSPYWLKVKHVVNLVVMDPFVDLAITICIVLNTLFMAMEHYPMTDHFNNVLTVGNLVFTGIFTAEMFLKIIAMDPYYYFQEGWNIFDGFIVTLSLVELGLANVEGLSVLRSFRLLRVFKLAKSWPTLNMLIKIIGNSVGALGNLTLVLAIIVFIFAVVGMQLFGKSYKDCVCKIASDCQLPRWHMNDFFHSFLIVFRVLCGEWIETMWDCMEVAGQAMCLTVFMMVMVIGNLVVLNLFLALLLSSFSADNLAATDDDNEMNNLQIAVDRMHKGVAYVKRKIYEFIQQSFIRKQKILDEIKPLDDLNNKKDSCMSNHTAEIGKDLDYLKDVNGTTSGIGTGSSVEKYIIDESDYMSFINNPSLTVTVPIAVGESDFENLNTEDFSSESDLEESKEKLNESSSSSEGSTVDIGAPVEEQPVVEPEETLEPEACFTEGCVQRFKCCQINVEEGRGKQWWNLRRTCFRIVEHNWFETFIVFMILLSSGALAFEDIYIDQRKTIKTMLEYADKVFTYIFILEMLLKWVAYGYQTYFTNAWCWLDFLIVDVSLVSLTANALGYSELGAIKSLRTLRALRPLRALSRFEGMRVVVNALLGAIPSIMNVLLVCLIFWLIFSIMGVNLFAGKFYHCINTTTGDRFDIEDVNNHTDCLKLIERNETARWKNVKVNFDNVGFGYLSLLQVATFKGWMDIMYAAVDSRNVELQPKYEESLYMYLYFVIFIIFGSFFTLNLFIGVIIDNFNQQKKKFGGQDIFMTEEQKKYYNAMKKLGSKKPQKPIPRPGNKFQGMVFDFVTRQVFDISIMILICLNMVTMMVETDDQSEYVTTILSRINLVFIVLFTGECVLKLISLRHYYFTIGWNIFDFVVVILSIVGKKYLKFLNSVK

SEQ ID NO: 35281 - protein, 829 aa, Homo sapiens
  ENSP00000490288
MEQTVLVPPGPDSFNFFTRESLAAIERRIAEEKAKNPKPDKKDDDENGPKPNSDLEAGKNLPFIYGDIPPEMVSEPLEDLDPYYINKKTFIVLNKGKAIFRFSATSALYILTPFNPLRKIAIKILVHSLFSMLIMCTILTNCVFMTMSNPPDWTKNVEYTFTGIYTFESLIKIIARGFCLEDFTFLRDPWNWLDFTVITFAYVTEFVDLGNVSALRTFRVLRALKTISVIPGLKTIVGALIQSVKKLSDVMILTVFCLSVFALIGLQLFMGNLRNKCIQWPPTNASLEEHSIEKNITVNYNGTLINETVFEFDWKSYIQDSRYHYFLEGFLDALLCGNSSDAGQCPEGYMCVKAGRNPNYGYTSFDTFSWAFLSLFRLMTQDFWENLYQLTLRAAGKTYMIFFVLVIFLGSFYLINLILAVVAMAYEEQNQATLEEAEQKEAEFQQMIEQLKKQQEAAQQAATATASEHSREPSAAGRLSDSSSEASKLSSKSAKERRNRRKKRKQKEQSGGEEKDEDEFQKSESEDSIRRKGFRFSIEGNRLTYEKRYSSPHQSLLSIRGSLFSPRRNSRTSLFSFRGRAKDVGSENDFADDEHSTFEDNESRRDSLFVPRRHGERRNSNLSQTSRSSRMLAVFPANGKMHSTVDCNGVVSLVGGPSVPTSPVGQLLPEGTTTETEMRKRRSSSFHVSMDFLEDPSQRQRAMSIASILTNTVEELEESRQKCPPCWYKFSNIFLIWDCSPYWLKVKHVVNLVVMDPFVDLAITICIVLNTLFMAMEHYPMTDHFNNVLTVGNLVSILEGFHWDLYSRNVSENYCHGSLLLFPRRLEYL

SEQ ID NO: 35282 - protein, 2009 aa, Homo sapiens
  ENSP00000303540
MEQTVLVPPGPDSFNFFTRESLAAIERRIAEEKAKNPKPDKKDDDENGPKPNSDLEAGKNLPFIYGDIPPEMVSEPLEDLDPYYINKKTFIVLNKGKAIFRFSATSALYILTPFNPLRKIAIKILVHSLFSMLIMCTILTNCVFMTMSNPPDWTKNVEYTFTGIYTFESLIKIIARGFCLEDFTFLRDPWNWLDFTVITFAYVTEFVDLGNVSALRTFRVLRALKTISVIPGLKTIVGALIQSVKKLSDVMILTVFCLSVFALIGLQLFMGNLRNKCIQWPPTNASLEEHSIEKNITVNYNGTLINETVFEFDWKSYIQDSRYHYFLEGFLDALLCGNSSDAGQCPEGYMCVKAGRNPNYGYTSFDTFSWAFLSLFRLMTQDFWENLYQLTLRAAGKTYMIFFVLVIFLGSFYLINLILAVVAMAYEEQNQATLEEAEQKEAEFQQMIEQLKKQQEAAQQAATATASEHSREPSAAGRLSDSSSEASKLSSKSAKERRNRRKKRKQKEQSGGEEKDEDEFQKSESEDSIRRKGFRFSIEGNRLTYEKRYSSPHQSLLSIRGSLFSPRRNSRTSLFSFRGRAKDVGSENDFADDEHSTFEDNESRRDSLFVPRRHGERRNSNLSQTSRSSRMLAVFPANGKMHSTVDCNGVVSLVGGPSVPTSPVGQLLPEVIIDKPATDDNGTTTETEMRKRRSSSFHVSMDFLEDPSQRQRAMSIASILTNTVEELEESRQKCPPCWYKFSNIFLIWDCSPYWLKVKHVVNLVVMDPFVDLAITICIVLNTLFMAMEHYPMTDHFNNVLTVGNLVFTGIFTAEMFLKIIAMDPYYYFQEGWNIFDGFIVTLSLVELGLANVEGLSVLRSFRLLRVFKLAKSWPTLNMLIKIIGNSVGALGNLTLVLAIIVFIFAVVGMQLFGKSYKDCVCKIASDCQLPRWHMNDFFHSFLIVFRVLCGEWIETMWDCMEVAGQAMCLTVFMMVMVIGNLVVLNLFLALLLSSFSADNLAATDDDNEMNNLQIAVDRMHKGVAYVKRKIYEFIQQSFIRKQKILDEIKPLDDLNNKKDSCMSNHTAEIGKDLDYLKDVNGTTSGIGTGSSVEKYIIDESDYMSFINNPSLTVTVPIAVGESDFENLNTEDFSSESDLEESKEKLNESSSSSEGSTVDIGAPVEEQPVVEPEETLEPEACFTEGCVQRFKCCQINVEEGRGKQWWNLRRTCFRIVEHNWFETFIVFMILLSSGALAFEDIYIDQRKTIKTMLEYADKVFTYIFILEMLLKWVAYGYQTYFTNAWCWLDFLIVDVSLVSLTANALGYSELGAIKSLRTLRALRPLRALSRFEGMRVVVNALLGAIPSIMNVLLVCLIFWLIFSIMGVNLFAGKFYHCINTTTGDRFDIEDVNNHTDCLKLIERNETARWKNVKVNFDNVGFGYLSLLQVATFKGWMDIMYAAVDSRNVELQPKYEESLYMYLYFVIFIIFGSFFTLNLFIGVIIDNFNQQKKKFGGQDIFMTEEQKKYYNAMKKLGSKKPQKPIPRPGNKFQGMVFDFVTRQVFDISIMILICLNMVTMMVETDDQSEYVTTILSRINLVFIVLFTGECVLKLISLRHYYFTIGWNIFDFVVVILSIVGMFLAELIEKYFVSPTLFRVIRLARIGRILRLIKGAKGIRTLLFALMMSLPALFNIGLLLFLVMFIYAIFGMSNFAYVKREVGIDDMFNFETFGNSMICLFQITTSAGWDGLLAPILNSKPPDCDPNKVNPGSSVKGDCGNPSVGIFFFVSYIIISFLVVVNMYIAVILENFSVATEESAEPLSEDDFEMFYEVWEKFDPDATQFMEFEKLSQFAAALEPPLNLPQPNKLQLIAMDLPMVSGDRIHCLDILFAFTKRVLGESGEMDALRIQMEERFMASNPSKVSYQPITTTLKRKQEEVSAVIIQRAYRRHLLKRTVKQASFTYNKNKIKGGANLLIKEDMIIDRINENSITEKTDLTMSTAACPPSYDRVTKPIVEKHEQEGKDEKAKGK

SEQ ID NO: 35283 - protein, 1998 aa, Homo sapiens; identical to SEQ ID NO: 35279
  ENSP00000490799

SEQ ID NO: 35284 - protein, 1998 aa, Homo sapiens; identical to SEQ ID NO: 35279
  ENSP00000364554

SEQ ID NO: 35285 - protein, 331 aa, Homo sapiens
  ENSP00000490184
  MOD_RES (1)..(1): Any amino acid
XIGKDLDYLKDVNGTTSGIGTGSSVEKYIIDESDYMSFINNPSLTVTVPIAVGESDFENLNTEDFSSESDLEESKEKLNESSSSSEGSTVDIGAPVEEQPVVEPEETLEPEACFTEGCVQRFKCCQINVEEGRGKQWWNLRRTCFRIVEHNWFETFIVFMILLSSGALAFEDIYIDQRKTIKTMLEYADKVFTYIFILEMLLKWVAYGYQTYFTNAWCWLDFLIVDVSLVSLTANALGYSELGAIKSLRTLRALRPLRALSRFEGMRDNLAPTWMGWSAGSSPEPFIMGGCECPFRSNSIHHECASGLSYILANFQHHGRKFVCWQILPLY

SEQ ID NO: 35286 - protein, 1981 aa, Homo sapiens
  ENSP00000386312
MEQTVLVPPGPDSFNFFTRESLAAIERRIAEEKAKNPKPDKKDDDENGPKPNSDLEAGKNLPFIYGDIPPEMVSEPLEDLDPYYINKKTFIVLNKGKAIFRFSATSALYILTPFNPLRKIAIKILVHSLFSMLIMCTILTNCVFMTMSNPPDWTKNVEYTFTGIYTFESLIKIIARGFCLEDFTFLRDPWNWLDFTVITFAYVTEFVDLGNVSALRTFRVLRALKTISVIPGLKTIVGALIQSVKKLSDVMILTVFCLSVFALIGLQLFMGNLRNKCIQWPPTNASLEEHSIEKNITVNYNGTLINETVFEFDWKSYIQDSRYHYFLEGFLDALLCGNSSDAGQCPEGYMCVKAGRNPNYGYTSFDTFSWAFLSLFRLMTQDFWENLYQLTLRAAGKTYMIFFVLVIFLGSFYLINLILAVVAMAYEEQNQATLEEAEQKEAEFQQMIEQLKKQQEAAQQAATATASEHSREPSAAGRLSDSSSEASKLSSKSAKERRNRRKKRKQKEQSGGEEKDEDEFQKSESEDSIRRKGFRFSIEGNRLTYEKRYSSPHQSLLSIRGSLFSPRRNSRTSLFSFRGRAKDVGSENDFADDEHSTFEDNESRRDSLFVPRRHGERRNSNLSQTSRSSRMLAVFPANGKMHSTVDCNGVVSLGTTTETEMRKRRSSSFHVSMDFLEDPSQRQRAMSIASILTNTVEELEESRQKCPPCWYKFSNIFLIWDCSPYWLKVKHVVNLVVMDPFVDLAITICIVLNTLFMAMEHYPMTDHFNNVLTVGNLVFTGIFTAEMFLKIIAMDPYYYFQEGWNIFDGFIVTLSLVELGLANVEGLSVLRSFRLLRVFKLAKSWPTLNMLIKIIGNSVGALGNLTLVLAIIVFIFAVVGMQLFGKSYKDCVCKIASDCQLPRWHMNDFFHSFLIVFRVLCGEWIETMWDCMEVAGQAMCLTVFMMVMVIGNLVVLNLFLALLLSSFSADNLAATDDDNEMNNLQIAVDRMHKGVAYVKRKIYEFIQQSFIRKQKILDEIKPLDDLNNKKDSCMSNHTAEIGKDLDYLKDVNGTTSGIGTGSSVEKYIIDESDYMSFINNPSLTVTVPIAVGESDFENLNTEDFSSESDLEESKEKLNESSSSSEGSTVDIGAPVEEQPVVEPEETLEPEACFTEGCVQRFKCCQINVEEGRGKQWWNLRRTCFRIVEHNWFETFIVFMILLSSGALAFEDIYIDQRKTIKTMLEYADKVFTYIFILEMLLKWVAYGYQTYFTNAWCWLDFLIVDVSLVSLTANALGYSELGAIKSLRTLRALRPLRALSRFEGMRVVVNALLGAIPSIMNVLLVCLIFWLIFSIMGVNLFAGKFYHCINTTTGDRFDIEDVNNHTDCLKLIERNETARWKNVKVNFDNVGFGYLSLLQVATFKGWMDIMYAAVDSRNVELQPKYEESLYMYLYFVIFIIFGSFFTLNLFIGVIIDNFNQQKKKFGGQDIFMTEEQKKYYNAMKKLGSKKPQKPIPRPGNKFQGMVFDFVTRQVFDISIMILICLNMVTMMVETDDQSEYVTTILSRINLVFIVLFTGECVLKLISLRHYYFTIGWNIFDFVVVILSIVGMFLAELIEKYFVSPTLFRVIRLARIGRILRLIKGAKGIRTLLFALMMSLPALFNIGLLLFLVMFIYAIFGMSNFAYVKREVGIDDMFNFETFGNSMICLFQITTSAGWDGLLAPILNSKPPDCDPNKVNPGSSVKGDCGNPSVGIFFFVSYIIISFLVVVNMYIAVILENFSVATEESAEPLSEDDFEMFYEVWEKFDPDATQFMEFEKLSQFAAALEPPLNLPQPNKLQLIAMDLPMVSGDRIHCLDILFAFTKRVLGESGEMDALRIQMEERFMASNPSKVSYQPITTTLKRKQEEVSAVIIQRAYRRHLLKRTVKQASFTYNKNKIKGGANLLIKEDMIIDRINENSITEKTDLTMSTAACPPSYDRVTKPIVEKHEQEGKDEKAKGK

SEQ ID NO: 35287 - protein, 30 aa, Homo sapiens
  ENSP00000489986
SLLQVATFKGWMDIMYAAVDSRNPLSGSKT

SEQ ID NO: 35288 - protein, 145 aa, Homo sapiens
  ENSP00000490895
MEQTVLVPPGPDSFNFFTRESLAAIERRIAEEKAKNPKPDKKDDDENGPKPNSDLEAGKNLPFIYGDIPPEMVSEPLEDLDPYYINKKMEFCSHHPGWSAVARSWLTATSASWVQAILLFSCLSLPSNWDYRDPPPGPANFFVCF

SEQ ID NO: 35289 - protein, 3 aa, Homo sapiens
  ENSP00000490612
MEQ

SEQ ID NO: 35290 - protein, 2009 aa, Homo sapiens; identical to SEQ ID NO: 35282
  ENSP00000407030

SEQ ID NO: 35291 - protein, 731 aa, Homo sapiens
  ENSP00000490765
MAQSVLVPPGPDSFRFFTRESLAAIEQRIAEEKAKRPKQERKDEDDENGPKPNSDLEAGKSLPFIYGDIPPEMVSVPLEDLDPYYINKKTFIVLNKGKAISRFSATPALYILTPFNPIRKLAIKILVHSLFNMLIMCTILTNCVFMTMSNPPDWTKNVEYTFTGIYTFESLIKILARGFCLEDFTFLRDPWNWLDFTVITFAYVTEFVDLGNVSALRTFRVLRALKTISVIPGLKTIVGALIQSVKKLSDVMILTVFCLSVFALIGLQLFMGNLRNKCLQWPPDNSSFEINITSFFNNSLDGNGTTFNRTVSIFNWDEYIEDKSHFYFLEGQNDALLCGNSSDAGQCPEGYICVKAGRNPNYGYTSFDTFSWAFLSLFRLMTQDFWENLYQLTLRAAGKTYMIFFVLVIFLGSFYLINLILAVVAMAYEEQNQATLEEAEQKEAEFQQMLEQLKKQQEEAQAAAAAASAESRDFSGAGGIGVFSESSSVASKLSSKSEKELKNRRKKKKQKEQSGEEEKNDRVRKSESEDSIRRKGFRFSLEGSRLTYEKRFSSPHQSLLSIRGSLFSPRRNSRASLFSFRGRAKDIGSENDFADDEHSTFEDNDSRRDSLFVPHRHGERRHSNVSQASRASRVLPILPMNGKMHSAVDCNGVVSLVGGPSTLTSAGQLLPEGTTTETEIRKRRSSSYHVSMDLLEDPTSRQRAMSIASILTNTMEDFFFLYLASRKLLQM

SEQ ID NO: 35292 - protein, 505 aa, Homo sapiens
  ENSP00000406454
MAQSVLVPPGPDSFRFFTRESLAAIEQRIAEEKAKRPKQERKDEDDENGPKPNSDLEAGKSLPFIYGDIPPEMVSVPLEDLDPYYINKKTFIVLNKGKAISRFSATPALYILTPFNPIRKLAIKILVHSLFNMLIMCTILTNCVFMTMSNPPDWTKNVEYTFTGIYTFESLIKILARGFCLEDFTFLRDPWNWLDFTVITFAYVTEFVDLGNVSALRTFRVLRALKTISVIPGLKTIVGALIQSVKKLSDVMILTVFCLSVFALIGLQLFMGNLRNKCLQWPPDNSSFEINITSFFNNSLDGNGTTFNRTVSIFNWDEYIEDKSHFYFLEGQNDALLCGNSSDAGQCPEGYICVKAGRNPNYGYTSFDTFSWAFLSLFRLMTQDFWENLYQLTLRAAGKTYMIFFVLVIFLGSFYLINLILAVVAMAYEEQNQATLEEAEQKEAEFQQMLEQLKKQQEEAQAAAAAASAESRDFSGAGGIGVFSESSSVASKLSSKSEKELKNRR

SEQ ID NO: 35293 - protein, 2005 aa, Homo sapiens
  ENSP00000490107
MAQSVLVPPGPDSFRFFTRESLAAIEQRIAEEKAKRPKQERKDEDDENGPKPNSDLEAGKSLPFIYGDIPPEMVSVPLEDLDPYYINKKTFIVLNKGKAISRFSATPALYILTPFNPIRKLAIKILVHSLFNMLIMCTILTNCVFMTMSNPPDWTKNVEYTFTGIYTFESLIKILARGFCLEDFTFLRDPWNWLDFTVITFAYVTEFVNLGNVSALRTFRVLRALKTISVIPGLKTIVGALIQSVKKLSDVMILTVFCLSVFALIGLQLFMGNLRNKCLQWPPDNSSFEINITSFFNNSLDGNGTTFNRTVSIFNWDEYIEDKSHFYFLEGQNDALLCGNSSDAGQCPEGYICVKAGRNPNYGYTSFDTFSWAFLSLFRLMTQDFWENLYQLTLRAAGKTYMIFFVLVIFLGSFYLINLILAVVAMAYEEQNQATLEEAEQKEAEFQQMLEQLKKQQEEAQAAAAAASAESRDFSGAGGIGVFSESSSVASKLSSKSEKELKNRRKKKKQKEQSGEEEKNDRVRKSESEDSIRRKGFRFSLEGSRLTYEKRFSSPHQSLLSIRGSLFSPRRNSRASLFSFRGRAKDIGSENDFADDEHSTFEDNDSRRDSLFVPHRHGERRHSNVSQASRASRVLPILPMNGKMHSAVDCNGVVSLVGGPSTLTSAGQLLPEGTTTETEIRKRRSSSYHVSMDLLEDPTSRQRAMSIASILTNTMEELEESRQKCPPCWYKFANMCLIWDCCKPWLKVKHLVNLVVMDPFVDLAITICIVLNTLFMAMEHYPMTEQFSSVLSVGNLVFTGIFTAEMFLKIIAMDPYYYFQEGWNIFDGFIVSLSLMELGLANVEGLSVLRSFRLLRVFKLAKSWPTLNMLIKIIGNSVGALGNLTLVLAIIVFIFAVVGMQLFGKSYKECVCKISNDCELPRWHMHDFFHSFLIVFRVLCGEWIETMWDCMEVAGQTMCLTVFMMVMVIGNLVVLNLFLALLLSSFSSDNLAATDDDNEMNNLQIAVGRMQKGIDFVKRKIREFIQKAFVRKQKALDEIKPLEDLNNKKDSCISNHTTIEIGKDLNYLKDGNGTTSGIGSSVEKYVVDESDYMSFINNPSLTVTVPIAVGESDFENLNTEEFSSESDMEESKEKLNATSSSEGSTVDIGAPAEGEQPEVEPEESLEPEACFTEDCVRKFKCCQISIEEGKGKLWWNLRKTCYKIVEHNWFETFIVFMILLSSGALAFEDIYIEQRKTIKTMLEYADKVFTYIFILEMLLKWVAYGFQVYFTNAWCWLDFLIVDVSLVSLTANALGYSELGAIKSLRTLRALRPLRALSRFEGMRVVVNALLGAIPSIMNVLLVCLIFWLIFSIMGVNLFAGKFYHCINYTTGEMFDVSVVNNYSECKALIESNQTARWKNVKVNFDNVGLGYLSLLQVATFKGWMDIMYAAVDSRNVELQPKYEDNLYMYLYFVIFIIFGSFFTLNLFIGVIIDNFNQQKKKFGGQDIFMTEEQKKYYNAMKKLGSKKPQKPIPRPANKFQGMVFDFVTKQVFDISIMILICLNMVTMMVETDDQSQEMTNILYWINLVFIVLFTGECVLKLISLRYYYFTIGWNIFDFVVVILSIVGMFLAELIEKYFVSPTLFRVIRLARIGRILRLIKGAKGIRTLLFALMMSLPALFNIGLLLFLVMFIYAIFGMSNFAYVKREVGIDDMFNFETFGNSMICLFQITTSAGWDGLLAPILNSGPPDCDPDKDHPGSSVKGDCGNPSVGIFFFVSYIIISFLVVVNMYIAVILENFSVATEESAEPLSEDDFEMFYEVWEKFDPDATQFIEFAKLSDFADALDPPLLIAKPNKVQLIAMDLPMVSGDRIHCLDILFAFTKRVLGESGEMDALRIQMEERFMASNPSKVSYEPITTTLKRKQEEVSAIIIQRAYRRYLLKQKVKKVSSIYKKDKGKECDGTPIKEDTLIDKLNENSTPEKTDMTPSTTSPPSYDSVTKPEKEKFEKDKSEKEDKGKDIRESKK

SEQ ID NO: 35294 - protein, 92 aa, Homo sapiens
  ENSP00000490592
MAQSVLVPPGPDSFRFFTRESLAAIEQRIAEEKAKRPKQERKDEDDENGPKPNSDLEAGKSLPFIYGDIPPEMVSVPLEDLDPYYINKKVSS

SEQ ID NO: 35295 - protein, 1873 aa, Homo sapiens
  ENSP00000490849
MLIMCTILTNCVFMTMSNPPDWTKNVEYTFTGIYTFESLIKILARGFCLEDFTFLRDPWNWLDFTVITFAYVTEFVDLGNVSALRTFRVLRALKTISVIPGLKTIVGALIQSVKKLSDVMILTVFCLSVFALIGLQLFMGNLRNKCLQWPPDNSSFEINITSFFNNSLDGNGTTFNRTVSIFNWDEYIEDKSHFYFLEGQNDALLCGNSSDAGQCPEGYICVKAGRNPNYGYTSFDTFSWAFLSLFRLMTQDFWENLYQLTLRAAGKTYMIFFVLVIFLGSFYLINLILAVVAMAYEEQNQATLEEAEQKEAEFQQMLEQLKKQQEEAQAAAAAASAESRDFSGAGGIGVFSESSSVASKLSSKSEKELKNRRKKKKQKEQSGEEEKNDRVRKSESEDSIRRKGFRFSLEGSRLTYEKRFSSPHQSLLSIRGSLFSPRRNSRASLFSFRGRAKDIGSENDFADDEHSTFEDNDSRRDSLFVPHRHGERRHSNVSQASRASRVLPILPMNGKMHSAVDCNGVVSLVGGPSTLTSAGQLLPEGTTTETEIRKRRSSSYHVSMDLLEDPTSRQRAMSIASILTNTMEELEESRQKCPPCWYKFANMCLIWDCCKPWLKVKHLVNLVVMDPFVDLAITICIVLNTLFMAMEHYPMTEQFSSVLSVGNLVFTGIFTAEMFLKIIAMDPYYYFQEGWNIFDGFIVSLSLMELGLANVEGLSVLRSFRLLRVFKLAKSWPTLNMLIKIIGNSVGALGNLTLVLAIIVFIFAVVGMQLFGKSYKECVCKISNDCELPRWHMHDFFHSFLIVFRVLCGEWIETMWDCMEVAGQTMCLTVFMMVMVIGNLVVLNLFLALLLSSFSSDNLAATDDDNEMNNLQIAVGRMQKGIDFVKRKIREFIQKAFVRKQKALDEIKPLEDLNNKKDSCISNHTTIEIGKDLNYLKDGNGTTSGIGSSVEKYVVDESDYMSFINNPSLTVTVPIAVGESDFENLNTEEFSSESDMEESKEKLNATSSSEGSTVDIGAPAEGEQPEVEPEESLEPEACFTEDCVRKFKCCQISIEEGKGKLWWNLRKTCYKIVEHNWFETFIVFMILLSSGALAFEDIYIEQRKTIKTMLEYADKVFTYIFILEMLLKWVAYGFQVYFTNAWCWLDFLIVDVSLVSLTANALGYSELGAIKSLRTLRALRPLRALSRFEGMRVVVNALLGAIPSIMNVLLVCLIFWLIFSIMGVNLFAGKFYHCINYTTGEMFDVSVVNNYSECKALIESNQTARWKNVKVNFDNVGLGYLSLLQVATFKGWMDIMYAAVDSRNVELQPKYEDNLYMYLYFVIFIIFGSFFTLNLFIGVIIDNFNQQKKKFGGQDIFMTEEQKKYYNAMKKLGSKKPQKPIPRPANKFQGMVFDFVTKQVFDISIMILICLNMVTMMVETDDQSQEMTNILYWINLVFIVLFTGECVLKLISLRYYYFTIGWNIFDFVVVILSIVGMFLAELIEKYFVSPTLFRVIRLARIGRILRLIKGAKGIRTLLFALMMSLPALFNIGLLLFLVMFIYAIFGMSNFAYVKREVGIDDMFNFETFGNSMICLFQITTSAGWDGLLAPILNSGPPDCDPDKDHPGSSVKGDCGNPSVGIFFFVSYIIISFLVVVNMYIAVILENFSVATEESAEPLSEDDFEMFYEVWEKFDPDATQFIEFAKLSDFADALDPPLLIAKPNKVQLIAMDLPMVSGDRIHCLDILFAFTKRVLGESGEMDALRIQMEERFMASNPSKVSYEPITTTLKRKQEEVSAIIIQRAYRRYLLKQKVKKVSSIYKKDKGKECDGTPIKEDTLIDKLNENSTPEKTDMTPSTTSPPSYDSVTKPEKEKFEKDKSEKEDKGKDIRESKK

SEQ ID NO: 35296 - protein, 2005 aa, Homo sapiens; identical to SEQ ID NO: 35293
  ENSP00000486885

SEQ ID NO: 35297 - protein, 558 aa, Homo sapiens
  ENSP00000489821
MAQSVLVPPGPDSFRFFTRESLAAIEQRIAEEKAKRPKQERKDEDDENGPKPNSDLEAGKSLPFIYGDIPPEMVSVPLEDLDPYYINKKTFIVLNKGKAISRFSATPALYILTPFNPIRKLAIKILVHSLFNMLIMCTILTNCVFMTMSNPPDWTKNVEYVTEFVDLGNVSALRTFRVLRALKTISVIPGLKTIVGALIQSVKKLSDVMILTVFCLSVFALIGLQLFMGNLRNKCLQWPPDNSSFEINITSFFNNSLDGNGTTFNRTVSIFNWDEYIEDKSHFYFLEGQNDALLCGNSSDAGQCPEGYICVKAGRNPNYGYTSFDTFSWAFLSLFRLMTQDFWENLYQLTLRAAGKTYMIFFVLVIFLGSFYLINLILAVVAMAYEEQNQATLEEAEQKEAEFQQMLEQLKKQQEEAQAAAAAASAESRDFSGAGGIGVFSESSSVASKLSSKSEKELKNRRKKKKQKEQSGEEEKNDRVRKSESEDSIRRKGFRFSLEGSRLTYEKRFSSPHQVTLMQEVGSLGLQQLHPCHFAGYSFPPDYFHGLALNVCGFSSPY

SEQ ID NO: 35298 - protein, 2005 aa, Homo sapiens
  ENSP00000490866
MAQSVLVPPGPDSFRFFTRESLAAIEQRIAEEKAKRPKQERKDEDDENGPKPNSDLEAGKSLPFIYGDIPPEMVSVPLEDLDPYYINKKTFIVLNKGKAISRFSATPALYILTPFNPIRKLAIKILVHSLFNMLIMCTILTNCVFMTMSNPPDWTKNVEYTFTGIYTFESLIKILARGFCLEDFTFLRDPWNWLDFTVITFAYVTEFVDLGNVSALRTFRVLRALKTISVIPGLKTIVGALIQSVKKLSDVMILTVFCLSVFALIGLQLFMGNLRNKCLQWPPDNSSFEINITSFFNNSLDGNGTTFNRTVSIFNWDEYIEDKSHFYFLEGQNDALLCGNSSDAGQCPEGYICVKAGRNPNYGYTSFDTFSWAFLSLFRLMTQDFWENLYQLTLRAAGKTYMIFFVLVIFLGSFYLINLILAVVAMAYEEQNQATLEEAEQKEAEFQQMLEQLKKQQEEAQAAAAAASAESRDFSGAGGIGVFSESSSVASKLSSKSEKELKNRRKKKKQKEQSGEEEKNDRVRKSESEDSIRRKGFRFSLEGSRLTYEKRFSSPHQSLLSIRGSLFSPRRNSRASLFSFRGRAKDIGSENDFADDEHSTFEDNDSRRDSLFVPHRHGERRHSNVSQASRASRVLPILPMNGKMHSAVDCNGVVSLVGGPSTLTSAGQLLPEGTTTETEIRKRRSSSYHVSMDLLEDPTSRQRAMSIASILTNTMEELEESRQKCPPCWYKFANMCLIWDCCKPWLKVKHLVNLVVMDPFVDLAITICIVLNTLFMAMEHYPMTEQFSSVLSVGNLVFTGIFTAEMFLKIIAMDPYYYFQEGWNIFDGFIVSLSLMELGLANVEGLSVLRSFRLLRVFKLAKSWPTLNMLIKIIGNSVGALGNLTLVLAIIVFIFAVVGMQLFGKSYKECVCKISNDCELPRWHMHDFFHSFLIVFRVLCGEWIETMWDCMEVAGQTMCLTVFMMVMVIGNLVVLNLFLALLLSSFSSDNLAATDDDNEMNNLQIAVGRMQKGIDFVKRKIREFIQKAFVRKQKALDEIKPLEDLNNKKDSCISNHTTIEIGKDLNYLKDGNGTTSGIGSSVEKYVVDESDYMSFINNPSLTVTVPIAVGESDFENLNTEEFSSESDMEESKEKLNATSSSEGSTVDIGAPAEGEQPEVEPEESLEPEACFTEDCVRKFKCCQISIEEGKGKLWWNLRKTCYKIVEHNWFETFIVFMILLSSGALAFEDIYIEQRKTIKTMLEYADKVFTYIFILEMLLKWVAYGFQVYFTNAWCWLDFLIVDVSLVSLTANALGYSELGAIKSLRTLRALRPLRALSRFEGMRVVVNALLGAIPSIMNVLLVCLIFWLIFSIMGVNLFAGKFYHCINYTTGEMFDVSVVNNYSECKALIESNQTARWKNVKVNFDNVGLGYLSLLQVATFKGWMDIMYAAVDSRNVELQPKYEDNLYMYLYFVIFIIFGSFFTLNLFIGVIIDNFNQQKKKFGGQDIFMTEEQKKYYNAMKKLGSKKPQKPIPRPANKFQGMVFDFVTKQVFDISIMILICLNMVTMMVETDDQSQEMTNILYWINLVFIVLFTGECVLKLISLRYYYFTIGWNIFDFVVVILSIVGMFLAELIEKYFVSPTLFRVIRLARIGRILRLIKGAKGIRTLLFALMMSLPALFNIGLLLFLVMFIYAIFGMSNFAYVKREVGIDDMFNFETFGNSMICLFQITTSAGWDGLLAPILNSGPPDCDPDKDHPGSSVKGDCGNPSVGIFFFVSYIIISFLVVVNMYIAVILENFSVATEESAEPLSEDDFEMFYEVWEKFDPDATQFIEFAKLSDFADALDPPLLIAKPNKVQLIAMDLPMVSGDRIHCLDILFAFTKRVLGESGEMDALRIQMEERFMASNPSKVSYEPITTTLKRKQEEVSAIIIQRAYRRYLLKQKVKKVSSIYKKDKGKECDGTPIKEDTLIDKLNENSTPEKTDMTPSTTSPPSYDSVTKPEKEKFEKDKSEKEDKGKDIRESKK

SEQ ID NO: 35299 - protein, 2005 aa, Homo sapiens; identical to SEQ ID NO: 35298
  ENSP00000283256

SEQ ID NO: 35300 - protein, 92 aa, Homo sapiens; identical to SEQ ID NO: 35294
  ENSP00000489873

SEQ ID NO: 35301 - protein, 730 aa, Homo sapiens
  ENSP00000490800
MAQSVLVPPGPDSFRFFTRESLAAIEQRIAEEKAKRPKQERKDEDDENGPKPNSDLEAGKSLPFIYGDIPPEMVSVPLEDLDPYYINKKTFIVLNKGKAISRFSATPALYILTPFNPIRKLAIKILVHSLFNMLIMCTILTNCVFMTMSNPPDWTKNVEYTFTGIYTFESLIKILARGFCLEDFTFLRDPWNWLDFTVITFAYVTEFVDLGNVSALRTFRVLRALKTISVIPGLKTIVGALIQSVKKLSDVMILTVFCLSVFALIGLQLFMGNLRNKCLQWPPDNSSFEINITSFFNNSLDGNGTTFNRTVSIFNWDEYIEDKSHFYFLEGQNDALLCGNSSDAGQCPEGYICVKAGRNPNYGYTSFDTFSWAFLSLFRLMTQDFWENLYQLTLRAAGKTYMIFFVLVIFLGSFYLINLILAVVAMAYEEQNQATLEEAEQKEAEFQQMLEQLKKQQEEAQAAAAAASAESRDFSGAGGIGVFSESSSVASKLSSKSEKELKNRRKKKKQKEQSGEEEKNDRVRKSESEDSIRRKGFRFSLEGSRLTYEKRFSSPHQSLLSIRGSLFSPRRNSRASLFSFRGRAKDIGSENDFADDEHSTFEDNDSRRDSLFVPHRHGERRHSNVSQASRASRVLPILPMNGKMHSAVDCNGVVSLVGGPSTLTSAGQLLPEGTTTETEIRKRRSSSYHVSMDLLEDPTSRQRAMSIASILTNTMEGKSFEDCLAFRSLP

SEQ ID NO: 35302 - protein, 178 aa, Homo sapiens
  ENSP00000487466
WTKNVEYTFTGIYTFESLIKILARGFCLEDFTFLRDPWNWLDFTVITFAYVTEFVDLGNVSALRTFRVLRALKTISVIPGLKTIVGALIQSVKKLSDVMILTVFCLSVFALIGLQLFMGNLRNKCLQWPPDNSSFEINITSFFNNSLDGNGTTFNRTVSIFNWDEYIEDKSKIYSINH

SEQ ID NO: 35303 - protein, 2005 aa, Homo sapiens; identical to SEQ ID NO: 35298
  ENSP00000364586

SEQ ID NO: 35304 - protein, 2005 aa, Homo sapiens; identical to SEQ ID NO: 35293
  ENSP00000364576

SEQ ID NO: 35305 - protein, 215 aa, Homo sapiens
  ENSP00000278947
MHRDAWLPRPAFSLTGLSLFFSLVPPGRSMEVTVPATLNVLNGSDARLPCTFNSCYTVNHKQFSLNWTYQECNNCSEEMFLQFRMKIINLKLERFQDRVEFSGNPSKYDVSVMLRNVQPEDEGIYNCYIMNPPDRHRGHGKIHLQVLMEEPPERDSTVAVIVGASVGGFLAVVILVLMVVKCVRRKKEQKLSTDDLKTEEEGKTDGEGNPDDGAK

SEQ ID NO: 35306 - protein, 228 aa, Homo sapiens
  ENSP00000322460
MPGAGDGGKAPARWLGTGLLGLFLLPVTLSLEVSVGKATDIYAVNGTEILLPCTFSSCFGFEDLHFRWTYNSSDAFKILIEGTVKNEKSDPKVTLKDDDRITLVGSTKEKMNNISIVLRDLEFSDTGKYTCHVKNPKENNLQHHATIFLQVVDRLEEVDNTVTLIILAVVGGVIGLLILILLIKKLIIFILKKTREKKKECLVSSSGNDNTENGLPGSKAEEKPPSKV

SEQ ID NO: 35307 - protein, 94 aa, Homo sapiens
  ENSP00000436343
MPGAGDGGKAPARWLGTGLLVEEVDNTVTLIILAVVGGVIGLLILILLIKKLIIFILKKTREKKKECLVSSSGNDNTENGLPGSKAEEKPPSKV

SEQ ID NO: 35308 - protein, 1977 aa, Homo sapiens
  ENSP00000386306
MAMLPPPGPQSFVHFTKQSLALIEQRIAERKSKEPKEEKKDDDEEAPKPSSDLEAGKQLPFIYGDIPPGMVSEPLEDLDPYYADKKTFIVLNKGKTIFRFNATPALYMLSPFSPLRRISIKILVHSLFSMLIMCTILTNCIFMTMNNPPDWTKNVEYTFTGIYTFESLVKILARGFCVGEFTFLRDPWNWLDFVVIVFAYLTEFVNLGNVSALRTFRVLRALKTISVIPGLKTIVGALIQSVKKLSDVMILTVFCLSVFALIGLQLFMGNLKHKCFRNSLENNETLESIMNTLESEEDFRKYFYYLEGSKDALLCGFSTDSGQCPEGYTCVKIGRNPDYGYTSFDTFSWAFLALFRLMTQDYWENLYQQTLRAAGKTYMIFFVVVIFLGSFYLINLILAVVAMAYEEQNQANIEEAKQKELEFQQMLDRLKKEQEEAEAIAAAAAEYTSIRRSRIMGLSESSSETSKLSSKSAKERRNRRKKKNQKKLSSGEEKGDAEKLSKSESEDSIRRKSFHLGVEGHRRAHEKRLSTPNQSPLSIRGSLFSARRSSRTSLFSFKGRGRDIGSETEFADDEHSIFGDNESRRGSLFVPHRPQERRSSNISQASRSPPMLPVNGKMHSAVDCNGVVSLVDGRSALMLPNGQLLPEGTTNQIHKKRRCSSYLLSEDMLNDPNLRQRAMSRASILTNTVEELEESRQKCPPWWYRFAHKFLIWNCSPYWIKFKKCIYFIVMDPFVDLAITICIVLNTLFMAMEHHPMTEEFKNVLAIGNLVFTGIFAAEMVLKLIAMDPYEYFQVGWNIFDSLIVTLSLVELFLADVEGLSVLRSFRLLRVFKLAKSWPTLNMLIKIIGNSVGALGNLTLVLAIIVFIFAVVGMQLFGKSYKECVCKINDDCTLPRWHMNDFFHSFLIVFRVLCGEWIETMWDCMEVAGQAMCLIVYMMVMVIGNLVVLNLFLALLLSSFSSDNLTAIEEDPDANNLQIAVTRIKKGINYVKQTLREFILKAFSKKPKISREIRQAEDLNTKKENYISNHTLAEMSKGHNFLKEKDKISGFGSSVDKHLMEDSDGQSFIHNPSLTVTVPIAPGESDLENMNAEELSSDSDSEYSKVRLNRSSSSECSTVDNPLPGEGEEAEAEPMNSDEPEACFTDGCVWRFSCCQVNIESGKGKIWWNIRKTCYKIVEHSWFESFIVLMILLSSGALAFEDIYIERKKTIKIILEYADKIFTYIFILEMLLKWIAYGYKTYFTNAWCWLDFLIVDVSLVTLVANTLGYSDLGPIKSLRTLRALRPLRALSRFEGMRVVVNALIGAIPSIMNVLLVCLIFWLIFSIMGVNLFAGKFYECINTTDGSRFPASQVPNRSECFALMNVSQNVRWKNLKVNFDNVGLGYLSLLQVATFKGWTIIMYAAVDSVNVDKQPKYEYSLYMYIYFVVFIIFGSFFTLNLFIGVIIDNFNQQKKKLGGQDIFMTEEQKKYYNAMKKLGSKKPQKPIPRPGNKIQGCIFDLVTNQAFDISIMVLICLNMVTMMVEKEGQSQHMTEVLYWINVVFIILFTGECVLKLISLRHYYFTVGWNIFDFVVVIISIVGMFLADLIETYFVSPTLFRVIRLARIGRILRLVKGAKGIRTLLFALMMSLPALFNIGLLLFLVMFIYAIFGMSNFAYVKKEDGINDMFNFETFGNSMICLFQITTSAGWDGLLAPILNSKPPDCDPKKVHPGSSVEGDCGNPSVGIFYFVSYIIISFLVVVNMYIAVILENFSVATEESTEPLSEDDFEMFYEVWEKFDPDATQFIEFSKLSDFAAALDPPLLIAKPNKVQLIAMDLPMVSGDRIHCLDILFAFTKRVLGESGEMDSLRSQMEERFMSANPSKVSYEPITTTLKRKQEDVSATVIQRAYRRYRLRQNVKNISSIYIKDGDRDDDLLNKKDMAFDNVNENSSPEKTDATSSTTSPPSYDSVTKPDKEKYEQDRTEKEDKGKDSKESKK

SEQ ID NO: 35309 - protein, 1988 aa, Homo sapiens
  ENSP00000386330
MAMLPPPGPQSFVHFTKQSLALIEQRIAERKSKEPKEEKKDDDEEAPKPSSDLEAGKQLPFIYGDIPPGMVSEPLEDLDPYYADKKTFIVLNKGKTIFRFNATPALYMLSPFSPLRRISIKILVHSLFSMLIMCTILTNCIFMTMNNPPDWTKNVEYTFTGIYTFESLVKILARGFCVGEFTFLRDPWNWLDFVVIVFAYLTEFVNLGNVSALRTFRVLRALKTISVIPGLKTIVGALIQSVKKLSDVMILTVFCLSVFALIGLQLFMGNLKHKCFRNSLENNETLESIMNTLESEEDFRKYFYYLEGSKDALLCGFSTDSGQCPEGYTCVKIGRNPDYGYTSFDTFSWAFLALFRLMTQDYWENLYQQTLRAAGKTYMIFFVVVIFLGSFYLINLILAVVAMAYEEQNQANIEEAKQKELEFQQMLDRLKKEQEEAEAIAAAAAEYTSIRRSRIMGLSESSSETSKLSSKSAKERRNRRKKKNQKKLSSGEEKGDAEKLSKSESEDSIRRKSFHLGVEGHRRAHEKRLSTPNQSPLSIRGSLFSARRSSRTSLFSFKGRGRDIGSETEFADDEHSIFGDNESRRGSLFVPHRPQERRSSNISQASRSPPMLPVNGKMHSAVDCNGVVSLVDGRSALMLPNGQLLPEVIIDKATSDDSGTTNQIHKKRRCSSYLLSEDMLNDPNLRQRAMSRASILTNTVEELEESRQKCPPWWYRFAHKFLIWNCSPYWIKFKKCIYFIVMDPFVDLAITICIVLNTLFMAMEHHPMTEEFKNVLAIGNLVFTGIFAAEMVLKLIAMDPYEYFQVGWNIFDSLIVTLSLVELFLADVEGLSVLRSFRLLRVFKLAKSWPTLNMLIKIIGNSVGALGNLTLVLAIIVFIFAVVGMQLFGKSYKECVCKINDDCTLPRWHMNDFFHSFLIVFRVLCGEWIETMWDCMEVAGQAMCLIVYMMVMVIGNLVVLNLFLALLLSSFSSDNLTAIEEDPDANNLQIAVTRIKKGINYVKQTLREFILKAFSKKPKISREIRQAEDLNTKKENYISNHTLAEMSKGHNFLKEKDKISGFGSSVDKHLMEDSDGQSFIHNPSLTVTVPIAPGESDLENMNAEELSSDSDSEYSKVRLNRSSSSECSTVDNPLPGEGEEAEAEPMNSDEPEACFTDGCVWRFSCCQVNIESGKGKIWWNIRKTCYKIVEHSWFESFIVLMILLSSGALAFEDIYIERKKTIKIILEYADKIFTYIFILEMLLKWIAYGYKTYFTNAWCWLDFLIVDVSLVTLVANTLGYSDLGPIKSLRTLRALRPLRALSRFEGMRVVVNALIGAIPSIMNVLLVCLIFWLIFSIMGVNLFAGKFYECINTTDGSRFPASQVPNRSECFALMNVSQNVRWKNLKVNFDNVGLGYLSLLQVATFKGWTIIMYAAVDSVNVDKQPKYEYSLYMYIYFVVFIIFGSFFTLNLFIGVIIDNFNQQKKKLGGQDIFMTEEQKKYYNAMKKLGSKKPQKPIPRPGNKIQGCIFDLVTNQAFDISIMVLICLNMVTMMVEKEGQSQHMTEVLYWINVVFIILFTGECVLKLISLRHYYFTVGWNIFDFVVVIISIVGMFLADLIETYFVSPTLFRVIRLARIGRILRLVKGAKGIRTLLFALMMSLPALFNIGLLLFLVMFIYAIFGMSNFAYVKKEDGINDMFNFETFGNSMICLFQITTSAGWDGLLAPILNSKPPDCDPKKVHPGSSVEGDCGNPSVGIFYFVSYIIISFLVVVNMYIAVILENFSVATEESTEPLSEDDFEMFYEVWEKFDPDATQFIEFSKLSDFAAALDPPLLIAKPNKVQLIAMDLPMVSGDRIHCLDILFAFTKRVLGESGEMDSLRSQMEERFMSANPSKVSYEPITTTLKRKQEDVSATVIQRAYRRYRLRQNVKNISSIYIKDGDRDDDLLNKKDMAFDNVNENSSPEKTDATSSTTSPPSYDSVTKPDKEKYEQDRTEKEDKGKDSKESKK

SEQ ID NO: 35310 - protein, 528 aa, Homo sapiens
  ENSP00000413212
ILTNCIFMTMNNPPDWTKNVEYTFTGIYTFESLVKILARGFCVGEFTFLRDPWNWLDFVVIVFAYVTEFVDLGNVSALRTFRVLRALKTISVIPGLKTIVGALIQSVKKLSDVMILTVFCLSVFALIGLQLFMGNLKHKCFRNSLENNETLESIMNTLESEEDFRKYFYYLEGSKDALLCGFSTDSGQCPEGYTCVKIGRNPDYGYTSFDTFSWAFLALFRLMTQDYWENLYQQTLRAAGKTYMIFFVVVIFLGSFYLINLILAVVAMAYEEQNQANIEEAKQKELEFQQMLDRLKKEQEEAEAIAAAAAEYTSIRRSRIMGLSESSSETSKLSSKSAKERRNRRKKKNQKKLSSGEEKGDAEKLSKSESEDSIRRKSFHLGVEGHRRAHEKRLSTPNQSPLSIRGSLFSARRSSRTSLFSFKGRGRDIGSETEFADDEHSIFGDNESRRGSLFVPHRPQERRSSNISQASRSPPMLPVNGKMHSAVDCNGVVSLVDGRSALMLPNGQLLPEGTTNQIHKKRRCSSYL

SEQ ID NO: 35311 - protein, 539 aa, Homo sapiens
  ENSP00000393141
ILTNCIFMTMNNPPDWTKNVEYTFTGIYTFESLVKILARGFCVGEFTFLRDPWNWLDFVVIVFAYVTEFVDLGNVSALRTFRVLRALKTISVIPGLKTIVGALIQSVKKLSDVMILTVFCLSVFALIGLQLFMGNLKHKCFRNSLENNETLESIMNTLESEEDFRKYFYYLEGSKDALLCGFSTDSGQCPEGYTCVKIGRNPDYGYTSFDTFSWAFLALFRLMTQDYWENLYQQTLRAAGKTYMIFFVVVIFLGSFYLINLILAVVAMAYEEQNQANIEEAKQKELEFQQMLDRLKKEQEEAEAIAAAAAEYTSIRRSRIMGLSESSSETSKLSSKSAKERRNRRKKKNQKKLSSGEEKGDAEKLSKSESEDSIRRKSFHLGVEGHRRAHEKRLSTPNQSPLSIRGSLFSARRSSRTSLFSFKGRGRDIGSETEFADDEHSIFGDNESRRGSLFVPHRPQERRSSNISQASRSPPMLPVNGKMHSAVDCNGVVSLVDGRSALMLPNGQLLPEVIIDKATSDDSGTTNQIHKKRRCSSYL

SEQ ID NO: 35312 - protein, 1988 aa, Homo sapiens; identical to SEQ ID NO: 35309
  ENSP00000304748

SEQ ID NO: 35313 - protein, 649 aa, Homo sapiens
  ENSP00000300061
MAPGEKIKAKIKKNLPVTGPQAPTIKELMRWYCLNTNTHGCRRIVVSRGRLRRLLWIGFTLTAVALILWQCALLVFSFYTVSVSIKVHFRKLDFPAVTICNINPYKYSTVRHLLADLEQETREALKSLYGFPESRKRREAESWNSVSEGKQPRFSHRIPLLIFDQDEKGKARDFFTGRKRKVGGSIIHKASNVMHIESKQVVGFQLCSNDTSDCATYTFSSGINAIQEWYKLHYMNIMAQVPLEKKINMSYSAEELLVTCFFDGVSCDARNFTLFHHPMHGNCYTFNNRENETILSTSMGGSEYGLQVILYINEEEYNPFLVSSTGAKVIIHRQDEYPFVEDVGTEIETAMVTSIGMHLTESFKLSEPYSQCTEDGSDVPIRNIYNAAYSLQICLHSCFQTKMVEKCGCAQYSQPLPPAANYCNYQQHPNWMYCYYQLHRAFVQEELGCQSVCKEACSFKEWTLTTSLAQWPSVVSEKWLLPVLTWDQGRQVNKKLNKTDLAKLLIFYKDLNQRSIMESPANSIEMLLSNFGGQLGLWMSCSVVCVIEIIEVFFIDFFSIIARRQWQKAKEWWAWKQAPPCPEAPRSPQGQDNPALDIDDDLPTFNSALHLPPALGTQVPGTPPPKYNTLRLERAFSNQLTDTQMLDEL

SEQ ID NO: 35314 - protein, 348 aa, Homo sapiens
  ENSP00000455711
MPRSFLVKKVKLDAFSSADLESAYGRARSDLGAPLHDKGYLSDYVGPSSVYDGDAEAALLKGPSPEPMYAAAVRGELGPAAAGSAPPPTPRPELATAAGGYINGDAAVSEGYAADAFFITDGRSRRKASNAGAAAAPSTASAAAPDGDAGGGGGAGGRSLGSGPGGRGGTRAGAGTEARAGPGAAGAGGRHACGECGKTYATSSNLSRHKQTHRSLDSQLARRCPTCGKVYVSMPAMAMHLLTHDLRHKCGVCGKAFSRPWLLQGHMRSHTGEKPFGCAHCGKAFADRSNLRAHMQTHSAFKHFQCKRCKKSFALKSYLNKHYESACFKGGAGGPAAPAPPQLSPVQA

SEQ ID NO: 35315 - protein, 988 aa, Homo sapiens
  ENSP00000354080
MGAAAVRWHLCVLLALGTRGRLAGGSGLPGSVDVDECSEGTDDCHIDAICQNTPKSYKCLCKPGYKGEGKQCEDIDECENDYYNGGCVHECINIPGNYRCTCFDGFMLAHDGHNCLDVDECQDNNGGCQQICVNAMGSYECQCHSGFFLSDNQHTCIHRSNEGMNCMNKDHGCAHICRETPKGGVACDCRPGFDLAQNQKDCTLTCNYGNGGCQHSCEDTDTGPTCGCHQKYALHSDGRTCIETCAVNNGGCDRTCKDTATGVRCSCPVGFTLQPDGKTCKDINECLVNNGGCDHFCRNTVGSFECGCRKGYKLLTDERTCQDIDECSFERTCDHICINSPGSFQCLCHRGYILYGTTHCGDVDECSMSNGSCDQGCVNTKGSYECVCPPGRRLHWNGKDCVETGKCLSRAKTSPRAQLSCSKAGGVESCFLSCPAHTLFVPDSENSYVLSCGVPGPQGKALQKRNGTSSGLGPSCSDAPTTPIKQKARFKIRDAKCHLRPHSQARAKETARQPLLDHCHVTFVTLKCDSSKKRRRGRKSPSKEVSHITAEFEIETKMEEASDTCEADCLRKRAEQSLQAAIKTLRKSIGRQQFYVQVSGTEYEVAQRPAKALEGQGACGAGQVLQDSKCVACGPGTHFGGELGQCVSCMPGTYQDMEGQLSCTPCPSSDGLGLPGARNVSECGGQCSPGFFSADGFKPCQACPVGTYQPEPGRTGCFPCGGGLLTKHEGTTSFQDCEAKVHCSPGHHYNTTTHRCIRCPVGTYQPEFGQNHCITCPGNTSTDFDGSTNVTHCKNQHCGGELGDYTGYIESPNYPGDYPANAECVWHIAPPPKRRILIVVPEIFLPIEDECGDVLVMRKSASPTSITTYETCQTYERPIAFTSRSRKLWIQFKSNEGNSGKGFQVPYVTYDEDYQQLIEDIVRDGRLYASENHQEILKDKKLIKALFDVLAHPQNYFKYTAQESKEMFPRSFIKLLRSKVSRFLRPYK

SEQ ID NO: 35316 - protein, 175 aa, Homo sapiens
  ENSP00000395327
  MOD_RES (1)..(1): Any amino acid
XRETPKGGVACDCRPGFDLAQNQKDCTLTCNYGNGGCQHSCEDTDTGPTCGCHQKYALHSDGRTCIEKDEAAIERSQFNATSVADVDKRVKRRLLMETCAVNNGGCDRTCKDTATGVRCSCPVGFTLQPDGKTCKDINECLVNNGGCDHFCRNTVGSFECGCRKGYKLLTDERTC

SEQ ID NO: 35317 - protein, 347 aa, Homo sapiens
  ENSP00000290460
MGAAAVRWHLCVLLALGTRGRLAGGSGLPGSVDVDECSEGTDDCHIDAICQNTPKSYKCLCKPGYKGEGKQCEDIDECENDYYNGGCVHECINIPGNYRCTCFDGFMLAHDGHNCLDVDECQDNNGGCQQICVNAMGSYECQCHSGFFLSDNQHTCIHRSNEGMNCMNKDHGCAHICRETPKGGVACDCRPGFDLAQNQKDCTLTCNYGNGGCQHSCEDTDTGPTCGCHQKYALHSDGRTCIEKDEAAIERSQFNATSVADVDKRVKRRLLMETCAVNNGGCDRTCKDTATGVRCSCPVGFTLQPDGKTCKGQHVELCGCPCLYWPGQEPPCACIAGPRAGLNGGHV

SEQ ID NO: 35318 - protein, 363 aa, Homo sapiens [sequence omitted]

SEQ ID NO: 35319 - protein, 310 aa, Homo sapiens
  ENSP00000254351
MRRAALWLWLCALALSLQPALPQIVATNLPPEDQDGSGDDSDNFSGSGAGALQDITLSQQTPSTWKDTQLLTAIPTSPEPTGLEATAASTSTLPAGEGPKEGEAVVLPEVEPGLTAREQEATPRPRETTQLPTTHLASTTTATTAQEPATSHPHRDMQPGHHETSTPAGPSQADLHTPHTEDGGPSATERAAEDGASSQLPAAEGSGEQDFTFETSGENTAVVAVEPDRRNQSPVDQGATGASQGLLDRKEVLGGVIAGGLVGLIFAVCLVGFMLYRMKKKDEGSYSLEEPKQANGGAYQKPTKQEEFYA

SEQ ID NO: 35320 - protein, 169 aa, Homo sapiens
  ENSP00000384613
MRRAALWLWLCALALSLQPALPQIVATNLPPEDQDGSGDDSDNFSGSGAGALQDITLSQQTPSTWKDTQLLTAIPTSPEPTGLEATAASTSTLPAGEGPKEGEAVVLPEVEPGLTAREQEATPRPRETTQLPTTHLASTTTATTAQEPATSHPHRDMQPVHFVSWGGLI

SEQ ID NO: 35321 - protein, 215 aa, Homo sapiens
  ENSP00000400773
PRWPGEPGQGCVGGAGERLQGPRACRGRLEQIVATNLPPEDQDGSGDDSDNFSGSGAGALQDITLSQQTPSTWKDTQLLTAIPTSPEPTGLEATAASTSTLPAGEGPKEGEAVVLPEVEPGLTAREQEATPRPRETTQLPTTHLASTTTATTAQEPATSHPHRDMQPGHHETSTPAGPSQADLHTPHTEDGGPSATERAAEDGASSQLPAAEGSG

SEQ ID NO: 35322 - protein, 28 aa, Homo sapiens
  ENSP00000390201
MRRAALWLWLCALALSLQPALPSLSHGR

SEQ ID NO: 35323 - protein, 310 aa, Homo sapiens; identical to SEQ ID NO: 35319
  ENSP00000370542

SEQ ID NO: 35324 - protein, 384 aa, Homo sapiens
  ENSP00000338346
MAIAYLGSSCPSQPPSSLALSLSPTPSDFEQESGIETAMRFSPDVALAVSTTPAVLPTTNIQPVGTPFEELPSERPTLEPATSPLVVTEVPEEPSQRATTVSTTMATTAATSTGDPTVATVPATVATATPSTPAAPPFTATTAVIRTTGVRRLLPLPLTTVATARATTPEAPSPPTTAAVLDTEAPTPRLVSTATSRPRALPRPATTQEPDIPERSTLPLGTTAPGPTEVAQTPTPETFLTTIRDEPEVPVSGGPSGDFELPEEETTQPDTANEVVAVGGAAAKASSPPGTLPKGARPGPGLLDNAIDSGSSAAQLPQKSILERKEVLVAVIVGGVVGALFAAFLVTLLIYRMKKKDEGSYTLEEPKQASVTYQKPDKQEEFYA

SEQ ID NO: 35325 - protein, 442 aa, Homo sapiens
  ENSP00000344468
MKPGPPHRAGAAHGAGAGAGAAAGPGARGLLLPPLLLLLLAGRAAGAQRWRSENFERPVDLEGSGDDDSFPDDELDDLYSGSGSGYFEQESGIETAMRFSPDVALAVSTTPAVLPTTNIQPVGTPFEELPSERPTLEPATSPLVVTEVPEEPSQRATTVSTTMATTAATSTGDPTVATVPATVATATPSTPAAPPFTATTAVIRTTGVRRLLPLPLTTVATARATTPEAPSPPTTAAVLDTEAPTPRLVSTATSRPRALPRPATTQEPDIPERSTLPLGTTAPGPTEVAQTPTPETFLTTIRDEPEVPVSGGPSGDFELPEEETTQPDTANEVVAVGGAAAKASSPPGTLPKGARPGPGLLDNAIDSGSSAAQLPQKSILERKEVLVAVIVGGVVGALFAAFLVTLLIYRMKKKDEGSYTLEEPKQASVTYQKPDKQEEFYA

SEQ ID NO: 35326 - protein, 198 aa, Homo sapiens
  ENSP00000361818
MAPARLFALLLFFVGGVAESIRETEVIDPQDLLEGRYFSGALPDDEDVVGPGQESDDFELSGSGDLDDLEDSMIGPEVVHPLVPLDNHIPERAGSGSQVPTEPKKLEENEVIPKRISPVEESEDVSNKVSMSSTVQGSNIFERTEVLAALIVGGIVGILFAVFLILLLMYRMKKKDEGSYDLGKKPIYKKAPTNEFYA

SEQ ID NO: 35327 - protein, 2213 aa, Homo sapiens
  ENSP00000385899
MARGARPSAAGGGGGGAEPPERAGPGRPRGSPPGRARPSLAPRPGPEPSRPRAAPETSGGDTAGAGRCGGRRAAKLGPGRRGWWALLALQLHLLRALAQDDVAPYFKTEPGLPQIHLEGNRLVLTCLAEGSWPLEFKWMRDDSELTTYSSEYKYIIPSLQKLDAGFYRCVVRNRMGALLQRKSEVQVAYMGSFMDTDQRKTVSQGRAAILNLLPITSYPRPQVTWFREGHKIIPSNRIAITLENQLVILATTTSDAGAYYVQAVNEKNGENKTSPFIHLSIARDVGTPETMAPTIVVPPGNRSVVAGSSETTLECIASARPVEDLSVTWKRNGVRITSGLHSFGRRLTISNPTSADTGPYVCEAALPGSAFEPARATAFLFIIEPPYFTAEPESRISAEVEETVDIGCQAMGVPLPTLQWYKDAISISRLQNPRYKVLASGGLRIQKLRPEDSGIFQCFASNEGGEIQTHTYLDVTNIAPVFTQRPVDTTVTDGMTAILRCEVSGAPKPAITWKRENHILASGSVRIPRFMLLESGGLQIAPVFIQDAGNYTCYAANTEGSLNASATLTVWNRTSIVHPPEDHVVIKGTTATLHCGATHDPRVSLRYVWKKDNVALTPSSTSRIVVEKDGSLLISQTWSGDIGDYSCEIVSEGGNDSRMARLEVIELPHSPQNLLVSPNSSHSHAVVLSWVRPFDGNSPILYYIVELSENNSPWKVHLSNVGPEMTGVTVSGLTPARTYQFRVCAVNEVGRGQYSAETSRLMLPEEPPSAPPKNIVASGRTNQSIMVQWQPPPETEHNGVLRGYILRYRLAGLPGEYQQRNITSPEVNYCLVTDLIIWTQYEIQVAAYNGAGLGVFSRAVTEYTLQGVPTAPPQNVQTEAVNSTTIQFLWNPPPQQFINGINQGYKLLAWPADAPEAVTVVTIAPDFHGVHHGHITNLKKFTAYFTSVLCFTTPGDGPPSTPQLVWTQEDKPGAVGHLSFTEILDTSLKVSWQEPLEKNGIITGYQISWEVYGRNDSRLTHTLNSTTHEYKIQGLSSLTTYTIDVAAVTAVGTGLVTSSTISSGVPPDLPGAPSNLVISNISPRSATLQFRPGYDGKTSISRWIVEGQVGAIGDEEEWVTLYEEENEPDAQMLEIPNLTPYTHYRFRMKQVNIVGPSPYSPSSRVIQTLQAPPDVAPTSVTVRTASETSLRLRWVPLPDSQYNGNPESVGYRIKYWRSDLQSSAVAQVVSDRLEREFTIEELEEWMEYELQMQAFNAVGAGPWSEVVRGRTRESVPSAAPENVSAEAVSSTQILLTWTSVPEQDQNGLILGYKILFRAKDLDPEPRSHIVRGNHTQSALLAGLRKFVLYELQVLAFTRIGNGVPSTPLILERTKDDAPGPPVRLVFPEVRLTSVRIVWQPPEEPNGIILGYQIAYRLASSSPHTFTTVEVGATVRQFTATDLAPESAYIFRLSAKTRQGWGEPLEATVITTEKRERPAPPRELLVPQAEVTARSLRLQWVPGSDGASPIRYFTMQVRELPRGEWQTYSSSISHEATACVVDRLRPFTSYKLRLKATNDIGDSDFSSETEAVTTLQDVPGEPPGSVSATPHTTSSVLIQWQPPRDESLNGLLQGYRIYYRELEYEAGSGTEAKTLKNPIALHAELTAQSSFKTVNSSSTSTMCELTHLKKYRRYEVIMTAYNIIGESPASAPVEVFVGEAAPAMAPQNVQVTPLTASQLEVTWDPPPPESQNGNIQGYKIYYWEADSQNETEKMKVLFLPEPVVRLKNLTSHTKYLVSISAFNAAGDGPKSDPQQGRTHQAAPGAPSFLAFSEITSTTLNVSWGEPAAANGILQGYRVVYEPLAPVQGVSKVVTVEVRGNWQRWLKVRDLTKGVTYFFRVQARTITYGPELQANITAGPAEGSPGSPRDVLVTKSASELTLQWTEGHSGDTPTTGYVIEARPSDEGLWDMFVKDIPRSATSYTLSLDKLRQGVTYEFRVVAVNEAGYGEPSNPSTAVSAQVEAPFYEEWWFLLVMALSSLIVILLVVFALVLHGQNKKYKNCSTGKGISTMEESVTLDNGGFAALELSSRHLNVKSTFSKKNGTRSPPRPSPGGLHYSDEDICNKYNGAVLTESVSLKEKSADASESEATDSDYEDALPKHSFVNHYMSDPTYYNSWKRRAQGRAPAPHRYEAVAGSEAGAQLHPVITTQSAGGVYTPAGPGARTPLTGFSSFV

SEQ ID NO: 35328 - protein, 2193 aa, Homo sapiens
  ENSP00000374182
MARGARPSAAGGGGGGAEPPERAGPGRPRGSPPGRARPSLAPRPGPEPSRPRAAPETSGGDTAGAGRCGGRRAAKLGPGRRGWWALLALQLHLLRALAQDDVAPYFKTEPGLPQIHLEGNRLVLTCLAEGSWPLEFKWMRDDSELTTYSSEYKYIIPSLQKLDAGFYRCVVRNRMGALLQRKSEVQVAYMGSFMDTDQRKTVSQGRAAILNLLPITSYPRPQVTWFREGHKIIPSNRIAITLENQLVILATTTSDAGAYYVQAVNEKNGENKTSPFIHLSIARDVGTPETMAPTIVVPPGNRSVVAGSSETTLECIASARPVEDLSVTWKRNGVRITSGLHSFGRRLTISNPTSADTGPYVCEAALPGSAFEPARATAFLFIIEPPYFTAEPESRISAEVEETVDIGCQAMGVPLPTLQWYKDAISISRLQNPRYKVLASGGLRIQKLRPEDSGIFQCFASNEGGEIQTHTYLDVTNIAPVFTQRPVDTTVTDGMTAILRCEVSGAPKPAITWKRENHILASGSVRIPRFMLLESGGLQIAPVFIQDAGNYTCYAANTEGSLNASATLTVWNRTSIVHPPEDHVVIKGTTATLHCGATHDPRVSLRYVWKKDNVALTPSSTSRIVVEKDGSLLISQTWSGDIGDYSCEIVSEGGNDSRMARLEVIELPHSPQNLLVSPNSSHSHAVVLSWVRPFDGNSPILYYIVELSENNSPWKVHLSNVGPEMTGVTVSGLTPARTYQFRVCAVNEVGRGQYSAETSRLMLPEEPPSAPPKNIVASGRTNQSIMVQWQPPPETEHNGVLRGYILRYRLAGLPGEYQQRNITSPEVNYCLVTDLIIWTQYEIQVAAYNGAGLGVFSRAVTEYTLQGVPTAPPQNVQTEAVNSTTIQFLWNPPPQQFINGINQGYKLLAWPADAPEAVTVVTIAPDFHGVHHGHITNLKKFTAYFTSVLCFTTPGDGPPSTPQLVWTQEDKPGAVGHLSFTEILDTSLKVSWQEPLEKNGIITGYQISWEVYGRNDSRLTHTLNSTTHEYKIQGLSSLTTYTIDVAAVTAVGTGLVTSSTISSGVPPDLPGAPSNLVISNISPRSATLQFRPGYDGKTSISRWIVEGQVGAIGDEEEWVTLYEEENEPDAQMLEIPNLTPYTHYRFRMKQVNIVGPSPYSPSSRVIQTLQAPPDVAPTSVTVRTASETSLRLRWVPLPDSQYNGNPESVGYRIKYWRSDLQSSAVAQVVSDRLEREFTIEELEEWMEYELQMQAFNAVGAGPWSEVVRGRTRESVPSAAPENVSAEAVSSTQILLTWTSVPEQDQNGLILGYKILFRAKDLDPEPRSHIVRGNHTQSALLAGLRKFVLYELQVLAFTRIGNGVPSTPLILERTKDDAPGPPVRLVFPEVRLTSVRIVWQPPEEPNGIILGYQIAYRLASSSPHTFTTVEVGATVRQFTATDLAPESAYIFRLSAKTRQGWGEPLEATVITTEKRERPAPPRELLVPQAEVTARSLRLQWVPGSDGASPIRYFTMQVRELPRGEWQTYSSSISHEATACVVDRLRPFTSYKLRLKATNDIGDSDFSSETEAVTTLQDVPGEPPGSVSATPHTTSSVLIQWQPPRDESLNGLLQGYRIYYRELEYEAGSGTEAKTLKNPIALHAELTDLKKYRRYEVIMTAYNIIGESPASAPVEVFVGEAAPAMAPQNVQVTPLTASQLEVTWDPPPPESQNGNIQGYKIYYWEADSQNETEKMKVLFLPEPVVRLKNLTSHTKYLVSISAFNAAGDGPKSDPQQGRTHQAAPGAPSFLAFSEITSTTLNVSWGEPAAANGILQGYRVVYEPLAPVQGVSKVVTVEVRGNWQRWLKVRDLTKGVTYFFRVQARTITYGPELQANITAGPAEGSPGSPRDVLVTKSASELTLQWTEGHSGDTPTTGYVIEARPSDEGLWDMFVKDIPRSATSYTLSLDKLRQGVTYEFRVVAVNEAGYGEPSNPSTAVSAQVEAPFYEEWWFLLVMALSSLIVILLVVFALVLHGQNKKYKNCSTGKGISTMEESVTLDNGGFAALELSSRHLNVKSTFSKKNGTRSPPRPSPGGLHYSDEDICNKYNGAVLTESVSLKEKSADASESEATDSDYEDALPKHSFVNHYMSDPTYYNSWKRRAQGRAPAPHRYEAVAGSEAGAQLHPVITTQSAGGVYTPAGPGARTPLTGFSSFV

SEQ ID NO: 35329 - protein, 107 aa, Homo sapiens
  ENSP00000404118
  MOD_RES (1)..(1): Any amino acid
XGDVGTPETMAPTIVVPPGNRSVVAGSSETTLECIASARPVEDLSVTWKRNGVRITSGLHSFGRRLTISNPTSADTGPYVCEAALPGSAFEPARATAFLFIIGPTLF

SEQ ID NO: 35330 - protein, 2213 aa, Homo sapiens
  ENSP00000478062
MARGARPSAAGGGGGGAEPPERAGPGRPRGSPPGRARPSLAPRPGPEPSRPRAAPETSGGDTAGAGRCGGRRAAKLGPGRRGWWALLALQLHLLRALAQGRCAPYFKTEPGLPQIHLEGNRLVLTCLAEGSWPLEFKWMRDDSELTTYSSEYKYIIPSLQKLDAGFYRCVVRNRMGALLQRKSEVQVAYMGSFMDTDQRKTVSQGRAAILNLLPITSYPRPQVTWFREGHKIIPSNRIAITLENQLVILATTTSDAGAYYVQAVNEKNGENKTSPFIHLSIARDVGTPETMAPTIVVPPGNRSVVAGSSETTLECIASARPVEDLSVTWKRNGVRITSGLHSFGRRLTISNPTSADTGPYVCEAALPGSAFEPARATAFLFIIEPPYFTAEPESRISAEVEETVDIGCQAMGVPLPTLQWYKDAISISRLQNPRYKVLASGGLRIQKLRPEDSGIFQCFASNEGGEIQTHTYLDVTNIAPVFTQRPVDTTVTDGMTAILRCEVSGAPKPAITWKRENHILASGSVRIPRFMLLESGGLQIAPVFIQDAGNYTCYAANTEGSLNASATLTVWNRTSIVHPPEDHVVIKGTTATLHCGATHDPRVSLRYVWKKDNVALTPSSTSRIVVEKDGSLLISQTWSGDIGDYSCEIVSEGGNDSRMARLEVIELPHSPQNLLVSPNSSHSHAVVLSWVRPFDGNSPILYYIVELSENNSPWKVHLSNVGPEMTGVTVSGLTPARTYQFRVCAVNEVGRGQYSAETSRLMLPEEPPSAPPKNIVASGRTNQSIMVQWQPPPETEHNGVLRGYILRYRLAGLPGEYQQRNITSPEVNYCLVTDLIIWTQYEIQVAAYNGAGLGVFSRAVTEYTLQGVPTAPPQNVQTEAVNSTTIQFLWNPPPQQFINGINQGYKLLAWPADAPEAVTVVTIAPDFHGVHHGHITNLKKFTAYFTSVLCFTTPGDGPPSTPQLVWTQEDKPGAVGHLSFTEILDTSLKVSWQEPLEKNGIITGYQISWEVYGRNDSRLTHTLNSTTHEYKIQGLSSLTTYTIDVAAVTAVGTGLVTSSTISSGVPPDLPGAPSNLVISNISPRSATLQFRPGYDGKTSISRWIVEGQVGAIGDEEEWVTLYEEENEPDAQMLEIPNLTPYTHYRFRMKQVNIVGPSPYSPSSRVIQTLQAPPDVAPTSVTVRTASETSLRLRWVPLPDSQYNGNPESVGYRIKYWRSDLQSSAVAQVVSDRLEREFTIEELEEWMEYELQMQAFNAVGAGPWSEVVRGRTRESVPSAAPENVSAEAVSSTQILLTWTSVPEQDQNGLILGYKILFRAKDLDPEPRSHIVRGNHTQSALLAGLRKFVLYELQVLAFTRIGNGVPSTPLILERTKDDAPGPPVRLVFPEVRLTSVRIVWQPPEEPNGIILGYQIAYRLASSSPHTFTTVEVGATVRQFTATDLAPESAYIFRLSAKTRQGWGEPLEATVITTEKRERPAPPRELLVPQAEVTARSLRLQWVPGSDGASPIRYFTMQVRELPRGEWQTYSSSISHEATACVVDRLRPFTSYKLRLKATNDIGDSDFSSETEAVTTLQDVPGEPPGSVSATPHTTSSVLIQWQPPRDESLNGLLQGYRIYYRELEYEAGSGTEAKTLKNPIALHAELTAQSSFKTVNSSSTSTMCELTHLKKYRRYEVIMTAYNIIGESPASAPVEVFVGEAAPAMAPQNVQVTPLTASQLEVTWDPPPPESQNGNIQGYKIYYWEADSQNETEKMKVLFLPEPVVRLKNLTSHTKYLVSISAFNAAGDGPKSDPQQGRTHQAAPGAPSFLAFSEITSTTLNVSWGEPAAANGILQGYRVVYEPLAPVQGVSKVVTVEVRGNWQRWLKVRDLTKGVTYFFRVQARTITYGPELQANITAGPAEGSPGSPRDVLVTKSASELTLQWTEGHSGDTPTTGYVIEARPSDEGLWDMFVKDIPRSATSYTLSLDKLRQGVTYEFRVVAVNEAGYGEPSNPSTAVSAQVEAPFYEEWWFLLVMALSSLIVILLVVFALVLHGQNKKYKNCSTGKGISTMEESVTLDNGGFAALELSSRHLNVKSTFSKKNGTRSPPRPSPGGLHYSDEDICNKYNGAVLTESVSLKEKSADASESEATDSDYEDALPKHSFVNHYMSDPTYYNSWKRRAQGRAPAPHRYEAVAGSEAGAQLHPVITTQSAGGVYTPAGPGARTPLTGFSSFV

SEQ ID NO: 35331 - protein, 696 aa, Homo sapiens
  ENSP00000251170
MVQRYQSPVRVYKYPFELVMAAYEKRFPTCPQIPVFLGSEVLRESRSPDGAVHVVERSCRLRVDAPRLLRKIAGVEHVVFVQTNILNWKERTLLIEAHNETFANRVVVNEHCSYTVHPENEDWTCFEQSASLDIRSFFGFENALEKIAMKQYTANVKRGKEVIEHYLNELISQGTSHIPRWTPAPVREEDARNQAGPRDPSSLEAHGPRSTLGPALEAVSMDGDKLDADYIERCLGHLTPMQESCLIQLRHWLQETHKGKIPKDEHILRFLRAHDFHLDKAREMLRQSLSWRKQHQVDLLLQTWQPPALLEEFYAGGWHYQDIDGRPLYILRLGQMDTKGLMKAVGEEALLRHVLSVNEEGQKRCEGSTRQLGRPISSWTCLLDLEGLNMRHLWRPGVKALLRMIEVVEDNYPETLGRLLIVRAPRVFPVLWTLISPFINENTRRKFLIYSGSNYQGPGGLVDYLDREVIPDFLGGESVCNVPEGGLVPKSLYMTEEEQEHTDQLWQWSETYHSASVLRGAPHEVAVEILEGESVITWDFDILRGDVVFSLYHTKQAPRLGAREPGTRASGQLIDKGWVLGRDYSRVEAPLVCREGESIQGSHVTRWPGVYLLQWQMHSPPSSVACSLPGVDDVLTALHSPGPKCKLLYYCEVLASEDFRGSMSSLESCTSGFSQLSAATSSSSSGQSHSSSLVSR

SEQ ID NO: 35332 - protein, 169 aa, Homo sapiens
  ENSP00000468423
MVQRYQSPVRVYKYPFELVMAAYEKRFPTCPQIPVFLGSEVLRESRSPDGAVHVVERSCRLRVDAPRLLRKIAGVEHVVFVQTNILNWKERTLLIEAHNETFANRVVVNEHCSYTVHPENEDWTCFEQSASLDIRSFFGFENALEKIAMKQYTANVKRGKEVIEHYLNE

SEQ ID NO: 35333 - protein, 1032 aa, Homo sapiens
  ENSP00000280551
MSQQGYVATPPYSQPQPGIGLSPPHYGHYGDPSHTASPTGMMKPAGPLGATATRGMLPPGPPPPGPHQFGQNGAHATGHPPQRFPGPPPVNNVASSHAPYQPSAQSSYPGPISTSSVTQLGSQLSAMQINSYGSGMAPPSQGPPGPLSATSLQTPPRPPQPSILQPGSQVLPPPPTTLNGPGASPLPLPMYRPDGLSGPPPPNAQYQPPPLPGQTLGAGYPPQQANSGPQMAGAQLSYPGGFPGGPAQMAGPPQPQKKLDPDSIPSPIQVIENDRASRGGQVYATNTRGQIPPLVTTDCMIQDQGNASPRFIRCTTYCFPCTSDMAKQAQIPLAAVIKPFATIPSNESPLYLVNHGESGPVRCNRCKAYMCPFMQFIEGGRRYQCGFCNCVNDVPPFYFQHLDHIGRRLDHYEKPELSLGSYEYVATLDYCRKSKPPNPPAFIFMIDVSYSNIKNGLVKLICEELKTMLEKIPKEEQEETSAIRVGFITYNKVLHFFNVKSNLAQPQMMVVTDVGEVFVPLLDGFLVNYQESQSVIHNLLDQIPDMFADSNENETVFAPVIQAGMEALKAADCPGKLFIFHSSLPTAEAPGKLKNRDDKKLVNTDKEKILFQPQTNVYDSLAKDCVAHGCSVTLFLFPSQYVDVASLGLVPQLTGGTLYKYNNFQMHLDRQQFLNDLRNDIEKKIGFDAIMRVRTSTGFRATDFFGGILMNNTTDVEMAAIDCDKAVTVEFKHDDKLSEDSGALIQCAVLYTTISGQRRLRIHNLGLNCSSQLADLYKSCETDALINFFAKSAFKAVLHQPLKVIREILVNQTAHMLACYRKNCASPSAASQLILPDSMKVLPVYMNCLLKNCVLLSRPEISTDERAYQRQLVMTMGVADSQLFFYPQLLPIHTLDVKSTMLPAAVRCSESRLSEEGIFLLANGLHMFLWLGVSSPPELIQGIFNVPSFAHINTDMTLLPEVGNPYSQQLRMIMGIIQQKRPYSMKLTIVKQREQPEMVFRQFLVEDKGLYGGSSYVDFLCCVHKEICQLLN

SEQ ID NO: 35334 - protein, 663 aa, Homo sapiens
  ENSP00000425491
MCPFMQFIEGGRRYQCGFCNCVNDVPPFYFQHLDHIGRRLDHYEKPELSLGSYEYVATLDYCRKSKPPNPPAFIFMIDVSYSNIKNGLVKLICEELKTMLEKIPKEEQEETSAIRVGFITYNKVLHFFNVKSNLAQPQMMVVTDVGEVFVPLLDGFLVNYQESQSVIHNLLDQIPDMFADSNENETVFAPVIQAGMEALKAADCPGKLFIFHSSLPTAEAPGKLKNRDDKKLVNTDKEKILFQPQTNVYDSLAKDCVAHGCSVTLFLFPSQYVDVASLGLVPQLTGGTLYKYNNFQMHLDRQQFLNDLRNDIEKKIGFDAIMRVRTSTGFRATDFFGGILMNNTTDVEMAAIDCDKAVTVEFKHDDKLSEDSGALIQCAVLYTTISGQRRLRIHNLGLNCSSQLADLYKSCETDALINFFAKSAFKAVLHQPLKVIREILVNQTAHMLACYRKNCASPSAASQLILPDSMKVLPVYMNCLLKNCVLLSRPEISTDERAYQRQLVMTMGVADSQLFFYPQLLPIHTLDVKSTMLPAAVRCSESRLSEEGIFLLANGLHMFLWLGVSSPPELIQGIFNVPSFAHINTDMTLLPEVGNPYSQQLRMIMGIIQQKRPYSMKLTIVKQREQPEMVFRQFLVEDKGLYGGSSYVDFLCCVHKEICQLLN

SEQ ID NO: 35335 - protein, 67 aa, Homo sapiens
  ENSP00000422717
MSQQGYVATPPYSQPQPGIGLSPPHYGHYGDPSHTASPTGRKLRSLKISFLPRFIQLISNQWGLELL

SEQ ID NO: 35336 - protein, 211 aa, Homo sapiens
  ENSP00000424085
MSQQGYVATPPYSQPQPGIGLSPPHYGHYGDPSHTASPTGMMKPAGPLGATATRGMLPPGPPPPGPHQFGQNGAHATGHPPQRFRHGSSKPGTPWPSVSHIIADSSTTSTAFHFAAWISSSSTTTHHTQWSWCLTFASTNVQTRWALWASSSKCPVPAPTSSRPDLGCWISSAAGQLWSPDGRRTTVLPRRLPWRSCTDGWSATAPEEAGS

SEQ ID NO: 35337 - protein, 305 aa, Homo sapiens
  ENSP00000427249
MSQQGYVATPPYSQPQPGIGLSPPHYGHYGDPSHTASPTGMMKPAGPLGATATRGMLPPGPPPPGPHQFGQNGAHATGHPPQRFPGPPPVNNVASSHAPYQPSAQSSYPGPISTSSVTQLGSQLSAMQINSYDHGKSGSSDVVRQKREDRRGKSHSTEIYINRNAVYPVQAWLLQARDPLALCQPHHCRLLHDLHSLPFCSLDLKFFHHHPPHSMVLVPHLCLYQCTDQMGSLGLLLQMPSTSPHLFQARPWVLDILRSRPTLVPRWQAHNCLTQEASLEVLHRWLVRHSPRRSWILTLSLAQSR

SEQ ID NO: 35338 - protein, 165 aa, Homo sapiens
  ENSP00000426309
MSQQGYVATPPYSQPQPGIGLSPPHYGHYGDPSHTASPTGMMKPAGPLGATATRGMLPPGPPPPGPHQFGQNGAHATGHPPQRFPGPPPVNNVASSHAPYQPSAQSSYPGPISTSSVTQLGSQLSAMQINSYGSGMAPPSQGPPGPLSATSLQTPPRPPQPSILQ

SEQ ID NO: 35339 - protein, 393 aa, Homo sapiens
  ENSP00000388324
MIDVSYSNIKNGLVKLICEELKTMLEKIPKEEQEETSAIRVGFITYNKVLHFFNVKSNLAQPQMMVVTDVGEVFVPLLDGFLVNYQESQSVIHNLLDQIPDMFADSNENETVFAPVIQAGMEALKAADCPGKLFIFHSSLPTAEAPGKLKNRDDKKLVNTDKEKILFQPQTNVYDSLAKDCVAHGCSVTLFLFPSQYVDVASLGLVPQLTGGTLYKYNNFQMHLDRQQFLNDLRNDIEKKIGFDAIMRVRTSTGFRATDFFGGILMNNTTDVEMAAIDCDKAVTVEFKHDDKLSEDSGALIQCAVLYTTISGQRRLRIHNLGLNCSSQLADLYKSCETDALINFFAKSAFKAVLHQPLKVIREILVNQTAHMLACYRKNCASPSAASQFTCEK

SEQ ID NO: 35340 - protein, 1132 aa, Homo sapiens
  ENSP00000382767
MQRRGAGLGWPRQQQQQPPPLAVGPRAAAMVPSGGVPQGLGGRSACALLLLCYLNVVPSLGRQTSLTTSVIPKAEQSVAYKDFIYFTVFEGNVRNVSEVSVEYLCSQPCVVNLEAVVSSEFRSSIPVYKKRWKNEKHLHTSRTQIVHVKFPSIMVYRDDYFIRHSISVSAVIVRAWITHKYSGRDWNVKWEENLLHAVAKNYTLLQTIPPFERPFKDHQVCLEWNMGYIWNLRANRIPQCPLENDVVALLGFPYASSGENTGIVKKFPRFRNRELEATRRQRMDYPVFTVSLWLYLLHYCKANLCGILYFVDSNEMYGTPSVFLTEEGYLHIQMHLVKGEDLAVKTKFIIPLKEWFRLDISFNGGQIVVTTSIGQDLKSYHNQTISFREDFHYNDTAGYFIIGGSRYVAGIEGFFGPLKYYRLRSLHPAQIFNPLLEKQLAEQIKLYYERCAEVQEIVSVYASAAKHGGERQEACHLHNSYLDLQRRYGRPSMCRAFPWEKELKDKHPSLFQALLEMDLLTVPRNQNESVSEIGGKIFEKAVKRLSSIDGLHQISSIVPFLTDSSCCGYHKASYYLAVFYETGLNVPRDQLQGMLYSLVGGQGSERLSSMNLGYKHYQGIDNYPLDWELSYAYYSNIATKTPLDQHTLQGDQAYVETIRLKDDEILKVQTKEDGDVFMWLKHEATRGNAAAQQRLAQMLFWGQQGVAKNPEAAIEWYAKGALETEDPALIYDYAIVLFKGQGVKKNRRLALELMKKAASKGLHQAVNGLGWYYHKFKKNYAKAAKYWLKAEEMGNPDASYNLGVLHLDGIFPGVPGRNQTLAGEYFHKAAQGGHMEGTLWCSLYYITGNLETFPRDPEKAVVWAKHVAEKNGYLGHVIRKGLNAYLEGSWHEALLYYVLAAETGIEVSQTNLAHICEERPDLARRYLGVNCVWRYYNFSVFQIDAPSFAYLKMGDLYYYGHQNQSQDLELSVQMYAQAALDGDSQGFFNLALLIEEGTIIPHHILDFLEIDSTLHSNNISILQELYERCWSHSNEESFSPCSLAWLYLHLRLLWGAILHSALIYFLGTFLLSILIAWTVQYFQSVSASDPPPRPSQASPDTATSTASPAVTPAADASDQDQPTVTNNPEPRG

SEQ ID NO: 35341 - protein, 1097 aa, Homo sapiens
  ENSP00000264868
MAPRPKKQPDKNPLHGRELNVVPSLGRQTSLTTSVIPKAEQSVAYKDFIYFTVFEGNVRNVSEVSVEYLCSQPCVVNLEAVVSSEFRSSIPVYKKRWKNEKHLHTSRTQIVHVKFPSIMVYRDDYFIRHSISVSAVIVRAWITHKYSGRDWNVKWEENLLHAVAKNYTLLQTIPPFERPFKDHQVCLEWNMGYIWNLRANRIPQCPLENDVVALLGFPYASSGENTGIVKKFPRFRNRELEATRRQRMDYPVFTVSLWLYLLHYCKANLCGILYFVDSNEMYGTPSVFLTEEGYLHIQMHLVKGEDLAVKTKFIIPLKEWFRLDISFNGGQIVVTTSIGQDLKSYHNQTISFREDFHYNDTAGYFIIGGSRYVAGIEGFFGPLKYYRLRSLHPAQIFNPLLEKQLAEQIKLYYERCAEVQEIVSVYASAAKHGGERQEACHLHNSYLDLQRRYGRPSMCRAFPWEKELKDKHPSLFQALLEMDLLTVPRNQNESVSEIGGKIFEKAVKRLSSIDGLHQISSIVPFLTDSSCCGYHKASYYLAVFYETGLNVPRDQLQGMLYSLVGGQGSERLSSMNLGYKHYQGIDNYPLDWELSYAYYSNIATKTPLDQHTLQGDQAYVETIRLKDDEILKVQTKEDGDVFMWLKHEATRGNAAAQQRLAQMLFWGQQGVAKNPEAAIEWYAKGALETEDPALIYDYAIVLFKGQGVKKNRRLALELMKKAASKGLHQAVNGLGWYYHKFKKNYAKAAKYWLKAEEMGNPDASYNLGVLHLDGIFPGVPGRNQTLAGEYFHKAAQGGHMEGTLWCSLYYITGNLETFPRDPEKAVVWAKHVAEKNGYLGHVIRKGLNAYLEGSWHEALLYYVLAAETGIEVSQTNLAHICEERPDLARRYLGVNCVWRYYNFSVFQIDAPSFAYLKMGDLYYYGHQNQSQDLELSVQMYAQAALDGDSQGFFNLALLIEEGTIIPHHILDFLEIDSTLHSNNISILQELYERCWSHSNEESFSPCSLAWLYLHLRLLWGAILHSALIYFLGTFLLSILIAWTVQYFQSVSASDPPPRPSQASPDTATSTASPAVTPAADASDQDQPTVTNNPEPRG

SEQ ID NO: 35342 - protein, 979 aa, Homo sapiens
  ENSP00000425438
MVYRDDYFIRHSISVSAVIVRAWITHKYSGRDWNVKWEENLLHAVAKNYTLLQTIPPFERPFKDHQVCLEWNMGYIWNLRANRIPQCPLENDVVALLGFPYASSGENTGIVKKFPRFRNRELEATRRQRMDYPVFTVSLWLYLLHYCKANLCGILYFVDSNEMYGTPSVFLTEEGYLHIQMHLVKGEDLAVKTKFIIPLKEWFRLDISFNGGQIVVTTSIGQDLKSYHNQTISFREDFHYNDTAGYFIIGGSRYVAGIEGFFGPLKYYRLRSLHPAQIFNPLLEKQLAEQIKLYYERCAEVQEIVSVYASAAKHGGERQEACHLHNSYLDLQRRYGRPSMCRAFPWEKELKDKHPSLFQALLEMDLLTVPRNQNESVSEIGGKIFEKAVKRLSSIDGLHQISSIVPFLTDSSCCGYHKASYYLAVFYETGLNVPRDQLQGMLYSLVGGQGSERLSSMNLGYKHYQGIDNYPLDWELSYAYYSNIATKTPLDQHTLQGDQAYVETIRLKDDEILKVQTKEDGDVFMWLKHEATRGNAAAQQRLAQMLFWGQQGVAKNPEAAIEWYAKGALETEDPALIYDYAIVLFKGQGVKKNRRLALELMKKAASKGLHQAVNGLGWYYHKFKKNYAKAAKYWLKAEEMGNPDASYNLGVLHLDGIFPGVPGRNQTLAGEYFHKAAQGGHMEGTLWCSLYYITGNLETFPRDPEKAVVWAKHVAEKNGYLGHVIRKGLNAYLEGSWHEALLYYVLAAETGIEVSQTNLAHICEERPDLARRYLGVNCVWRYYNFSVFQIDAPSFAYLKMGDLYYYGHQNQSQDLELSVQMYAQAALDGDSQGFFNLALLIEEGTIIPHHILDFLEIDSTLHSNNISILQELYERCWSHSNEESFSPCSLAWLYLHLRLLWGAILHSALIYFLGTFLLSILIAWTVQYFQSVSASDPPPRPSQASPDTATSTASPAVTPAADASDQDQPTVTNNPEPRG

SEQ ID NO: 35343 - protein, 130 aa, Homo sapiens
  ENSP00000421701
  MOD_RES (1)..(1): Any amino acid
XYAQAALDGDSQGFFNLALLIEEGTIIPHHILDFLEIDSTLHSNNISILQELYERCWSHSNEESFSPCSLAWLYLHLRLLWGAILHSALIYFLGTFLLSILIAWTVQYFQSVSEFCLCVPENTAPKLLAA

SEQ ID NO: 35344 - protein, 130 aa, Homo sapiens
  ENSP00000426050
TNLAHICEERPDLARRYLGVNCVWRYYNFSVFQIDAPSFAYLKMGDLYYYGHQNQSQDLELSVQMYAQAALDGDSQGFFNLALLIEEGTIIPHHILDFLEIDSTLHSNNISILQELYERSTFWEPFCYPY

SEQ ID NO: 35345 - protein, 77 aa, Homo sapiens
  ENSP00000424564
TLAGEYFHKAAQGGHMEGTLWCSLYYITGNLETFPRDPEKAVVKSLSTSVLGHPHTDTLALQKIVLHNTFGFKFNLT

SEQ ID NO: 35346 - protein, 75 aa, Homo sapiens
  ENSP00000423743
MVYRDDYFIRHSISVSAVIVRAWITHKYSGRDWNVKWEENLLHAVAKNYTLLQTIPPFERPFKDHQVCLEWNMGY

SEQ ID NO: 35347 - protein, 62 aa, Homo sapiens
  ENSP00000421567
MVYRDDYFIRHSISVSAVIVRAWITHKYSGRDWNVKWEENLLHAVAKNYTLLQTIPPFERPF

SEQ ID NO: 35348 - protein, 35 aa, Homo sapiens
  ENSP00000420951
MVYRDDYFIRHSISVSAVIVRAWITHKYSGRDWNV

SEQ ID NO: 35349 - protein, 94 aa, Homo sapiens
  ENSP00000418813
  MOD_RES (92)..(92): Selenocysteine
MVYISNGQVLDSRSQSPWRLSLITDFFWGIAEFVVLFFKTLLQQDVKKRRSYGNSSDSRYDDGRGPPGNPPRRMGRINHLRGPSPPPMAGGXGR

SEQ ID NO: 35350 - protein, 72 aa, Homo sapiens
  ENSP00000417272
MVYISNGQVLDSRSQSPWRLSLITDFFWGIAEFVVLFFKTLLQQDVKKRRSYGNSSDSRYDDGRGKPSPKNG

SEQ ID NO: 35351 - protein, 93 aa, Homo sapiens
  ENSP00000443164
MVYISNGQVLDSRSQSPWRLSLITDFFWGIAEFVVLFFKTLLQQDVKKRRSYGNSSDSRYDDGRGPPGNPPRRMGRINHLRGPSPPPMAGGGR

SEQ ID NO: 35352 - protein, 145 aa, Homo sapiens
  ENSP00000384564
  MOD_RES (48)..(48): Selenocysteine
MSLLLPPLALLLLLAALVAPATAATAYRPDWNRLSGLTRARVETCGGXQLNRLKEVKAFVTQDIPFYHNLVMKHLPGADPELVLLGRRYEELERIPLSEMTREEINALVQELGFYRKAAPDAQVPPEYVWAPAKPPEETSDHADL

SEQ ID NO: 35353 - protein, 145 aa, Homo sapiens; identical to SEQ ID NO: 35352
  ENSP00000383155
  MOD_RES (48)..(48): Selenocysteine

SEQ ID NO: 35354 - protein, 144 aa, Homo sapiens
  ENSP00000480176
MSLLLPPLALLLLLAALVAPATAATAYRPDWNRLSGLTRARVETCGGQLNRLKEVKAFVTQDIPFYHNLVMKHLPGADPELVLLGRRYEELERIPLSEMTREEINALVQELGFYRKAAPDAQVPPEYVWAPAKPPEETSDHADL

SEQ ID NO: 35355 - protein, 412 aa, Homo sapiens
  ENSP00000447752
MPLQLLLLLILLGPGNSLQLWDTWADEAEKALGPLLARDRRQATEYEYLDYDFLPETEPPEMLRNSTDTTPLTGPGTPESTTVEPAARRSTGLDAGGAVTELTTELANMGNLSTDSAAMEIQTTQPAATEAQTTQPVPTEAQTTPLAATEAQTTRLTATEAQTTPLAATEAQTTPPAATEAQTTQPTGLEAQTTAPAAMEAQTTAPAAMEAQTTPPAAMEAQTTQTTAMEAQTTAPEATEAQTTQPTATEAQTTPLAAMEALSTEPSATEALSMEPTTKRGLFIPFSVSSVTHKGIPMAASNLSVNYPVGAPDHISVKQCLLAILILALVATIFFVCTVVLAVRLSRKGHMYPVRNYSPTEMVCISSLLPDGGEGPSATANGGLSKAKSPGLTPEPREDREGDDLTLHSFLP

SEQ ID NO: 35356 - protein, 428 aa, Homo sapiens
  ENSP00000228463
MAVGASGLEGDKMAGAMPLQLLLLLILLGPGNSLQLWDTWADEAEKALGPLLARDRRQATEYEYLDYDFLPETEPPEMLRNSTDTTPLTGPGTPESTTVEPAARRSTGLDAGGAVTELTTELANMGNLSTDSAAMEIQTTQPAATEAQTTQPVPTEAQTTPLAATEAQTTRLTATEAQTTPLAATEAQTTPPAATEAQTTQPTGLEAQTTAPAAMEAQTTAPAAMEAQTTPPAAMEAQTTQTTAMEAQTTAPEATEAQTTQPTATEAQTTPLAAMEALSTEPSATEALSMEPTTKRGLFIPFSVSSVTHKGIPMAASNLSVNYPVGAPDHISVKQCLLAILILALVATIFFVCTVVLAVRLSRKGHMYPVRNYSPTEMVCISSLLPDGGEGPSATANGGLSKAKSPGLTPEPREDREGDDLTLHSFLP

SEQ ID NO: 35357 - protein, 402 aa, Homo sapiens
  ENSP00000373614
MPLQLLLLLILLGPGNSLQLWDTWADEAEKALGPLLARDRRQATEYEYLDYDFLPETEPPEMLRNSTDTTPLTGPGTPESTTVEPAARRSTGLDAGGAVTELTTELANMGNLSTDSAAMEIQTTQPAATEAQTTPLAATEAQTTRLTATEAQTTPLAATEAQTTPPAATEAQTTQPTGLEAQTTAPAAMEAQTTAPAAMEAQTTPPAAMEAQTTQTTAMEAQTTAPEATEAQTTQPTATEAQTTPLAAMEALSTEPSATEALSMEPTTKRGLFIPFSVSSVTHKGIPMAASNLSVNYPVGAPDHISVKQCLLAILILALVATIFFVCTVVLAVRLSRKGHMYPVRNYSPTEMVCISSLLPDGGEGPSATANGGLSKAKSPGLTPEPREDREGDDLTLHSFLP

SEQ ID NO: 35358 - protein, 214 aa, Homo sapiens
  ENSP00000482586
MGRAGAAAVIPGLALLWAVGLGSAAPSPPRLRLSFQELQAWHGLQTFSLERTCCYQALLVDEERGRLFVGAENHVASLNLDNISKRAKKLAWPAPVEWREECNWAGKDIGTECMNFVKLLHAYNRTHLLACGTGAFHPTCAFVEVGHRAEEPVLRLDPGRIEDGKGKSPYDPRHRAASVLVGEELYSGVAADLMGRDFTIFRSLGQRPSLRTEP

SEQ ID NO: 35359 - protein, 749 aa, Homo sapiens
  ENSP00000484146
MGRAGAAAVIPGLALLWAVGLGSAAPSPPRLRLSFQELQAWHGLQTFSLERTCCYQALLVDEERGRLFVGAENHVASLNLDNISKRAKKLAWPAPVEWREECNWAGKDIGTECMNFVKLLHAYNRTHLLACGTGAFHPTCAFVEVGHRAEEPVLRLDPGRIEDGKGKSPYDPRHRAASVLVGEELYSGVAADLMGRDFTIFRSLGQRPSLRTEPHDSRWLNEPKFVKVFWIPESENPDDDKIYFFFRETAVEAAPALGRLSVSRVGQICRNDVGGQRSLVNKWTTFLKARLVCSVPGVEGDTHFDQLQDVFLLSSRDHRTPLLYAVFSTSSSIFQGSAVCVYSMNDVRRAFLGPFAHKEGPMHQWVSYQGRVPYPRPGMCPSKTFGTFSSTKDFPDDVIQFARNHPLMYNSVLPTGGRPLFLQVGANYTFTQIAADRVAAADGHYDVLFIGTDVGTVLKVISVPKGSRPSAEGLLLEELHVFEDSAAVTSMQISSKRHQLYVASRSAVAQIALHRCAAHGRVCTECCLARDPYCAWDGVACTRFQPSAKRRFRRQDVRNGDPSTLCSGDSSRPALLEHKVFGVEGSSAFLECEPRSLQARVEWTFQRAGVTAHTQVLAEERTERTARGLLLRRLRRRDSGVYLCAAVEQGFTQPLRRLSLHVLSATQAERLARAEEAAPAAPPGPKLWYRDFLQLVEPGGGGSANSLRMCRPQPALQSLPLESRRKGRNRRTHAPEPRAERGPRSATHW

SEQ ID NO: 35360 - protein, 748 aa, Homo sapiens
  ENSP00000485281
MGRAGAAAVIPGLALLWAVGLGSAAPSPPRLRLSFQELQAWHGLQTFSLERTCCYQALLVDEERGRLFVGAENHVASLNLDNISKRAKKLAWPAPVEWREECNWAGKDIGTECMNFVKLLHAYNRTHLLACGTGAFHPTCAFVEVGHRAEEPVLRLDPGRIEDGKGKSPYDPRHRAASVLVGEELYSGVAADLMGRDFTIFRSLGQRPSLRTEPHDSRWLNEPKFVKVFWIPESENPDDDKIYFFFRETAVEAAPALGRLSVSRVGQICRNDVGGQRSLVNKWTTFLKARLVCSVPGVEGDTHFDQLQDVFLLSSRDHRTPLLYAVFSTSSIFQGSAVCVYSMNDVRRAFLGPFAHKEGPMHQWVSYQGRVPYPRPGMCPSKTFGTFSSTKDFPDDVIQFARNHPLMYNSVLPTGGRPLFLQVGANYTFTQIAADRVAAADGHYDVLFIGTDVGTVLKVISVPKGSRPSAEGLLLEELHVFEDSAAVTSMQISSKRHQLYVASRSAVAQIALHRCAAHGRVCTECCLARDPYCAWDGVACTRFQPSAKRRFRRQDVRNGDPSTLCSGDSSRPALLEHKVFGVEGSSAFLECEPRSLQARVEWTFQRAGVTAHTQVLAEERTERTARGLLLRRLRRRDSGVYLCAAVEQGFTQPLRRLSLHVLSATQAERLARAEEAAPAAPPGPKLWYRDFLQLVEPGGGGSANSLRMCRPQPALQSLPLESRRKGRNRRTHAPEPRAERGPRSATHW

SEQ ID NO: 35361 - protein, 754 aa, Homo sapiens
  ENSP00000480680
MGRAGAAAVIPGLALLWAVGLGSAAPSPPRLRLSFQELQAWHGLQTFSLERTCCYQALLVDEERGRLFVGAENHVASLNLDNISKRAKKLAWPAPVEWREECNWAGKDIGTECMNFVKLLHAYNRTHLLACGTGAFHPTCAFVEVGHRAEEPVLRLDPGRIEDGKGKSPYDPRHRAASVLVGEELYSGVAADLMGRDFTIFRSLGQRPSLRTEPHDSRWLNEPKFVKVFWIPESENPDDDKIYFFFRETAVEAAPALGRLSVSRVGQICRNDVGGQRSLVNKWTTFLKARLVCSVPGVEGDTHFDQLRPFPAEDVFLLSSRDHRTPLLYAVFSTSSSIFQGSAVCVYSMNDVRRAFLGPFAHKEGPMHQWVSYQGRVPYPRPGMCPSKTFGTFSSTKDFPDDVIQFARNHPLMYNSVLPTGGRPLFLQVGANYTFTQIAADRVAAADGHYDVLFIGTDVGTVLKVISVPKGSRPSAEGLLLEELHVFEDSAAVTSMQISSKRHQLYVASRSAVAQIALHRCAAHGRVCTECCLARDPYCAWDGVACTRFQPSAKRRFRRQDVRNGDPSTLCSGDSSRPALLEHKVFGVEGSSAFLECEPRSLQARVEWTFQRAGVTAHTQVLAEERTERTARGLLLRRLRRRDSGVYLCAAVEQGFTQPLRRLSLHVLSATQAERLARAEEAAPAAPPGPKLWYRDFLQLVEPGGGGSANSLRMCRPQPALQSLPLESRRKGRNRRTHAPEPRAERGPRSATHW

SEQ ID NO: 35362 - protein, 406 aa, Homo sapiens
  ENSP00000485646
MNDVRRAFLGPFAHKEGPMHQWVSYQGRVPYPRPGMCPSKTFGTFSSTKDFPDDVIQFARNHPLMYNSVLPTGGRPLFLQVGANYTFTQIAADRVAAADGHYDVLFIGTDVGTVLKVISVPKGSRPSAEGLLLEELHVFEDSAAVTSMQISSKRHQLYVASRSAVAQIALHRCAAHGRVCTECCLARDPYCAWDGVACTRFQPSAKRRFRRQDVRNGDPSTLCSGDSSRPALLEHKVFGVEGSSAFLECEPRSLQARVEWTFQRAGVTAHTQVLAEERTERTARGLLLRRLRRRDSGVYLCAAVEQGFTQPLRRLSLHVLSATQAERLARAEEAAPAAPPGPKLWYRDFLQLVEPGGGGSANSLRMCRPQPALQSLPLESRRKGRNRRTHAPEPRAERGPRSATHW

SEQ ID NO: 35363 - protein, 406 aa, Homo sapiens; identical to SEQ ID NO: 35362
  ENSP00000485173

SEQ ID NO: 35364 - protein, 749 aa, Homo sapiens; identical to SEQ ID NO: 35359
  ENSP00000481957

SEQ ID NO: 35365 - protein, 751 aa, Homo sapiens
  ENSP00000265361
MAFRTICVLVGVFICSICVKGSSQPQARVYLTFDELRETKTSEYFSLSHHPLDYRILLMDEDQDRIYVGSKDHILSLNINNISQEALSVFWPASTIKVEECKMAGKDPTHGCGNFVRVIQTFNRTHLYVCGSGAFSPVCTYLNRGRRSEDQVFMIDSKCESGKGRCSFNPNVNTVSVMINEELFSGMYIDFMGTDAAIFRSLTKRNAVRTDQHNSKWLSEPMFVDAHVIPDGTDPNDAKVYFFFKEKLTDNNRSTKQIHSMIARICPNDTGGLRSLVNKWTTFLKARLVCSVTDEDGPETHFDELEDVFLLETDNPRTTLVYGIFTTSSSVFKGSAVCVYHLSDIQTVFNGPFAHKEGPNHQLISYQGRIPYPRPGTCPGGAFTPNMRTTKEFPDDVVTFIRNHPLMYNSIYPIHKRPLIVRIGTDYKYTKIAVDRVNAADGRYHVLFLGTDRGTVQKVVVLPTNNSVSGELILEELEVFKNHAPITTMKISSKKQQLYVSSNEGVSQVSLHRCHIYGTACADCCLARDPYCAWDGHSCSRFYPTGKRRSRRQDVRHGNPLTQCRGFNLKAYRNAAEIVQYGVKNNTTFLECAPKSPQASIKWLLQKDKDRRKEVKLNERIIATSQGLLIRSVQGSDQGLYHCIATENSFKQTIAKINFKVLDSEMVAVVTDKWSPWTWASSVRALPFHPKDIMGAFSHSEMQMINQYCKDTRQQHQQGDESQKMRGDYGKLKALINSRKSRNRRNQLPES

SEQ ID NO: 35366 - protein, 751 aa, Homo sapiens; identical to SEQ ID NO: 35365
  ENSP00000411193

SEQ ID NO: 35367 - protein, 40 aa, Homo sapiens
  ENSP00000393825
MAFRTICVLVGVFICSICVKGSSQPQARVYLTFDGPSFHD

SEQ ID NO: 35368 - protein, 63 aa, Homo sapiens
  ENSP00000395398
MAFRTICVLVGVFICSICVKGSSQPQARVYLTFDEPTLYNAVCYICGYKKKCGVNLVLSNHLL

SEQ ID NO: 35369 - protein, 63 aa, Homo sapiens; identical to SEQ ID NO: 35368
  ENSP00000399891

SEQ ID NO: 35370 - protein, 777 aa, Homo sapiens
  ENSP00000284136
MNANKDERLKARSQDFHLFPALMMLSMTMLFLPVTGTLKQNIPRLKLTYKDLLLSNSCIPFLGSSEGLDFQTLLLDEERGRLLLGAKDHIFLLSLVDLNKNFKKIYWPAAKERVELCKLAGKDANTECANFIRVLQPYNKTHIYVCGTGAFHPICGYIDLGVYKEDIIFKLDTHNLESGRLKCPFDPQQPFASVMTDEYLYSGTASDFLGKDTAFTRSLGPTHDHHYIRTDISEHYWLNGAKFIGTFFIPDTYNPDDDKIYFFFRESSQEGSTSDKTILSRVGRVCKNDVGGQRSLINKWTTFLKARLICSIPGSDGADTYFDELQDIYLLPTRDERNPVVYGVFTTTSSIFKGSAVCVYSMADIRAVFNGPYAHKESADHRWVQYDGRIPYPRPGTCPSKTYDPLIKSTRDFPDDVISFIKRHSVMYKSVYPVAGGPTFKRINVDYRLTQIVVDHVIAEDGQYDVMFLGTDIGTVLKVVSISKEKWNMEEVVLEELQIFKHSSIILNMELSLKQQQLYIGSRDGLVQLSLHRCDTYGKACADCCLARDPYCAWDGNACSRYAPTSKRRARRQDVKYGDPITQCWDIEDSISHETADEKVIFGIEFNSTFLECIPKSQQATIKWYIQRSGDEHREELKPDERIIKTEYGLLIRSLQKKDSGMYYCKAQEHTFIHTIVKLTLNVIENEQMENTQRAEHEEGKVKDLLAESRLRYKDYIQILSSPNFSLDQYCEQMWHREKRRQRNKGGPKWKHMQEMKKKRNRRHHRDLDELPRAVAT

SEQ ID NO: 35371 - protein, 294 aa, Homo sapiens
  ENSP00000401366
MNANKDERLKARSQDFHLFPALMMLSMTMLFLPVTGTLKQNIPRLKLTYKDLLLSNSCIPFLGSSEGLDFQTLLLDEERGRLLLGAKDHIFLLSLVDLNKNFKKIYWPAAKERVELCKLAGKDANTECANFIRVLQPYNKTHIYVCGTGAFHPICGYIDLGVYKEDIIFKLDTHNLESGRLKCPFDPQQPFASVMTDEYLYSGTASDFLGKDTAFTRSLGPTHDHHYIRTDISEHYWLNGAKFIGTFFIPDTYNPDDDKIYFFFRESSQEGSTSDKTILSRVGRVCKENLCFED

SEQ ID NO: 35372 - protein, 775 aa, Homo sapiens
  ENSP00000303212
MASAGHIITLLLWGYLLELWTGGHTADTTHPRLRLSHKELLNLNRTSIFHSPFGFLDLHTMLLDEYQERLFVGGRDLVYSLSLERISDGYKEIHWPSTALKMEECIMKGKDAGECANYVRVLHHYNRTHLLTCGTGAFDPVCAFIRVGYHLEDPLFHLESPRSERGRGRCPFDPSSSFISTLIGSELFAGLYSDYWSRDAAIFRSMGRLAHIRTEHDDERLLKEPKFVGSYMIPDNEDRDDNKVYFFFTEKALEAENNAHAIYTRVGRLCVNDVGGQRILVNKWSTFLKARLVCSVPGMNGIDTYFDELEDVFLLPTRDHKNPVIFGLFNTTSNIFRGHAICVYHMSSIRAAFNGPYAHKEGPEYHWSVYEGKVPYPRPGSCASKVNGGRYGTTKDYPDDAIRFARSHPLMYQAIKPAHKKPILVKTDGKYNLKQIAVDRVEAEDGQYDVLFIGTDNGIVLKVITIYNQEMESMEEVILEELQIFKDPVPIISMEISSKRQQLYIGSASAVAQVRFHHCDMYGSACADCCLARDPYCAWDGISCSRYYPTGTHAKRRFRRQDVRHGNAAQQCFGQQFVGDALDKTEEHLAYGIENNSTLLECTPRSLQAKVIWFVQKGRETRKEEVKTDDRVVKMDLGLLFLRLHKSDAGTYFCQTVEHSFVHTVRKITLEVVEEEKVEDMFNKDDEEDRHHRMPCPAQSSISQGAKPWYKEFLQLIGYSNFQRVEEYCEKVWCTDRKRKKLKMSPSKWKYANPQEKKLRSKPEHYRLPRHTLDS

SEQ ID NO: 35373 - protein, 715 aa, Homo sapiens
  ENSP00000405052
MLLDEYQERLFVGGRDLVYSLSLERISDGYKEIHWPSTALKMEECIMKGKDAGECANYVRVLHHYNRTHLLTCGTGAFDPVCAFIRVGYHLEDPLFHLESPRSERGRGRCPFDPSSSFISTLIGSELFAGLYSDYWSRDAAIFRSMGRLAHIRTEHDDERLLKEPKFVGSYMIPDNEDRDDNKVYFFFTEKALEAENNAHAIYTRVGRLCVNDVGGQRILVNKWSTFLKARLVCSVPGMNGIDTYFDELEDVFLLPTRDHKNPVIFGLFNTTSNIFRGHAICVYHMSSIRAAFNGPYAHKEGPEYHWSVYEGKVPYPRPGSCASKVNGGRYGTTKDYPDDAIRFARSHPLMYQAIKPAHKKPILVKTDGKYNLKQIAVDRVEAEDGQYDVLFIGTDNGIVLKVITIYNQEMESMEEVILEELQIFKDPVPIISMEISSKRQQLYIGSASAVAQVRFHHCDMYGSACADCCLARDPYCAWDGISCSRYYPTGTHAKRRFRRQDVRHGNAAQQCFGQQFVGDALDKTEEHLAYGIENNSTLLECTPRSLQAKVIWFVQKGRETRKEEVKTDDRVVKMDLGLLFLRLHKSDAGTYFCQTVEHSFVHTVRKITLEVVEEEKVEDMFNKDDEEDRHHRMPCPAQSSISQGAKPWYKEFLQLIGYSNFQRVEEYCEKVWCTDRKRKKLKMSPSKWKYANPQEKKLRSKPEHYRLPRHTLDS

SEQ ID NO: 35374 - protein, 163 aa, Homo sapiens
  ENSP00000412867
MLLDEYQERLFVGGRDLVYSLSLERISDGYKEIHWPSTALKMEECIMKGKDAGECANYVRVLHHYNRTHLLTCGTGAFDPVCAFIRVGYHLEDPLFHLESPRSERGRGRCPFDPSSSFISTLIGSELFAGLYSDYWSRDAAIFRSMGRLAHIRTEHDDERLLK

SEQ ID NO: 35375 - protein, 39 aa, Homo sapiens
  ENSP00000415184
MASAGHIITLLLWGYLLELWTGGHTADTTHPRLRLSHKE

SEQ ID NO: 35376 - protein, 782 aa, Homo sapiens
  ENSP00000231721
MAPSAWAICWLLGGLLLHGGSSGPSPGPSVPRLRLSYRDLLSANRSAIFLGPQGSLNLQAMYLDEYRDRLFLGGLDALYSLRLDQAWPDPREVLWPPQPGQREECVRKGRDPLTECANFVRVLQPHNRTHLLACGTGAFQPTCALITVGHRGEHVLHLEPGSVESGRGRCPHEPSRPFASTFIDGELYTGLTADFLGREAMIFRSGGPRPALRSDSDQSLLHDPRFVMAARIPENSDQDNDKVYFFFSETVPSPDGGSNHVTVSRVGRVCVNDAGGQRVLVNKWSTFLKARLVCSVPGPGGAETHFDQLEDVFLLWPKAGKSLEVYALFSTVSAVFQGFAVCVYHMADIWEVFNGPFAHRDGPQHQWGPYGGKVPFPRPGVCPSKMTAQPGRPFGSTKDYPDEVLQFARAHPLMFWPVRPRHGRPVLVKTHLAQQLHQIVVDRVEAEDGTYDVIFLGTDSGSVLKVIALQAGGSAEPEEVVLEELQVFKVPTPITEMEISVKRQMLYVGSRLGVAQLRLHQCETYGTACAECCLARDPYCAWDGASCTHYRPSLGKRRFRRQDIRHGNPALQCLGQSQEEEAVGLVAATMVYGTEHNSTFLECLPKSPQAAVRWLLQRPGDEGPDQVKTDERVLHTERGLLFRRLSRFDAGTYTCTTLEHGFSQTVVRLALVVIVASQLDNLFPPEPKPEEPPARGGLASTPPKAWYKDILQLIGFANLPRVDEYCERVWCRGTTECSGCFRSRSRGKQARGKSWAGLELGKKMKSRVHAEHNRTPREVEAT

SEQ ID NO: 35377 - protein, 99 aa, Homo sapiens
  ENSP00000420291
  MOD_RES (1)..(1): Any amino acid
XSSGPSPGPSVPRLRLSYRDRVRQLRAGATASQPDPPASLWHWGLPAHLCPHHSWPPWGACAPPGAWQCGKWPGAVPSRAQPSLCQHLHRRGAVHGSHC

SEQ ID NO: 35378 - protein, 186 aa, Homo sapiens
  ENSP00000419181
MAPSAWAICWLLGGLLLHGGSSGPSPGPSVPRLRLSYRGAMVRKPSSTMWMETFSRYLLSANRSAIFLGPQGSLNLQAMYLDEYRDRLFLGGLDALYSLRLDQAWPDPREVLWPPQPGQREECVRKGRDPLTECANFVRVLQPHNRTHLLACGTGAFQPTCALITVGHRGEHVLHLEPGSVESGRG

SEQ ID NO: 35379 - protein, 548 aa, Homo sapiens
  ENSP00000446394
MRMCTPIRGLLMALAVMFGTAMAFAPIPRITWEHREVHLVQFHEPDIYNYSALLLSEDKDTLYIGAREAVFAVNALNISEKQHEVYWKVSEDKKAKCAEKGKSKQTECLNYIRVLQPLSATSLYVCGTNAFQPACDHLNLTSFKFLGKNEDGKGRCPFDPAHSYTSVMVDGELYSGTSYNFLGSEPIISRNSSHSPLRTEYAIPWLNEPSFVFADVIRKSPDSPDGEDDRVYFFFTEVSVEYEFVFRVLIPRIARVCKGDQGGLRTLQKKWTSFLKARLICSRPDSGLVFNVLRDVFVLRSPGLKVPVFYALFTPQLNNVGLSAVCAYNLSTAEEVFSHGKYMQSTTVEQSHTKWVRYNGPVPKPRPGACIDSEARAANYTSSLNLPDKTLQFVKDHPLMDDSVTPIDNRPRLIKKDVNYTQIVVDRTQALDGTVYDVMFVSTDRGALHKAISLEHAVHIIEETQLFQDFEPVQTLLLSSKKVLQTFALSGRRMGELWRPVSLCRPMHCPMAGPMHSAGCRTPSGKALSIAALSSPQQGTRLRRCRLL

SEQ ID NO: 35380 - protein, 862 aa, Homo sapiens
  ENSP00000416523
MRMCTPIRGLLMALAVMFGTAMAFAPIPRITWEHREVHLVQFHEPDIYNYSALLLSEDKDTLYIGAREAVFAVNALNISEKQHEVYWKVSEDKKAKCAEKGKSKQTECLNYIRVLQPLSATSLYVCGTNAFQPACDHLNLTSFKFLGKNEDGKGRCPFDPAHSYTSVMVDGELYSGTSYNFLGSEPIISRNSSHSPLRTEYAIPWLNEPSFVFADVIRKSPDSPDGEDDRVYFFFTEVSVEYEFVFRVLIPRIARVCKGDQGGLRTLQKKWTSFLKARLICSRPDSGLVFNVLRDVFVLRSPGLKVPVFYALFTPQLNNVGLSAVCAYNLSTAEEVFSHGKYMQSTTVEQSHTKWVRYNGPVPKPRPGACIDSEARAANYTSSLNLPDKTLQFVKDHPLMDDSVTPIDNRPRLIKKDVNYTQIVVDRTQALDGTVYDVMFVSTDRGALHKAISLEHAVHIIEETQLFQDFEPVQTLLLSSKKGNRFVYAGSNSGVVQAPLAFCGKHGTCEDCVLARDPYCAWSPPTATCVALHQTESPSRGLIQEMSGDASVCPDKSKGSYRQHFFKHGGTAELKCSQKSNLARVFWKFQNGVLKAESPKYGLMGRKNLLIFNLSEGDSGVYQCLSEERVKNKTVFQVVAKHVLEVKVVPKPVVAPTLSVVQTEGSRIATKVLVASTQGSSPPTPAVQATSSGAITLPPKPAPTGTSCEPKIVINTVPQLHSEKTMYLKSSDNRLLMSLFLFFFVLFLCLFFYNCYKGYLPRQCLKFRSALLIGKKKPKSDFCDREQSLKETLVEPGSFSQQNGEHPKPALDTGYETEQDTITSKVPTDREDSQRIDDLSARDKPFDVKCELKFADSDADGD

SEQ ID NO: 35381 - protein, 862 aa, Homo sapiens; identical to SEQ ID NO: 35380
  ENSP00000405102

SEQ ID NO: 35382 - protein, 862 aa, Homo sapiens; identical to SEQ ID NO: 35380
  ENSP00000388768

SEQ ID NO: 35383 - protein, 146 aa, Homo sapiens
  ENSP00000390754
MRMCTPIRGLLMALAVMFGTAMAFAPIPRITWEHREVHLVQFHEPDIYNYSALLLSEDKDTLYIGAREAVFAVNALNISEKQHEVYWKVSEDKKAKCAEKGKSKQTECLNYIRVLQPLSATSLYVCGTNAFQPACDHLNLTSFKFL

SEQ ID NO: 35384 - protein, 75 aa, Homo sapiens
  ENSP00000413352
MRMCTPIRGLLMALAVMFGTAMAFAPIPRITWEHREVHLVQFHEPDIYNYSALLLSEDKDTLYIGAREAVFAVNA

SEQ ID NO: 35385 - protein, 66 aa, Homo sapiens
  ENSP00000438389
MRMCTPIRGLLMALAVMFGTAMAFAPIPRITWEHREVHLVQFHEPDIYNYSALLLSEDKDTLYIGA

SEQ ID NO: 35386 - protein, 59 aa, Homo sapiens
  ENSP00000416747
MRMCTPIRGLLMALAVMFGTAMAFAPIPRITWEHREVHLVQFHEPDIYNYSALLLSEDK

SEQ ID NO: 35387 - protein, 1 aa, Homo sapiens
  ENSP00000405652
M

SEQ ID NO: 35388 - protein, 862 aa, Homo sapiens; identical to SEQ ID NO: 35380
  ENSP00000348822

SEQ ID NO: 35389 - protein, 738 aa, Homo sapiens
  ENSP00000391733
MRMCTPIRGLLMALAVMFGTAMAFAPIPRITWEHREVHLVQFHEPDIYNYSALLLSEDKDTLYIGAREAVFAVNALNISEKQHEVYWKVSEDKKAKCAEKGKSKQTECLNYIRVLQPLSATSLYVCGTNAFQPACDHLNLTSFKFLGKNEDGKGRCPFDPAHSYTSVMVDGELYSGTSYNFLGSEPIISRNSSHSPLRTEYAIPWLNEPSFVFADVIRKSPDSPDGEDDRVYFFFTEVSVEYEFVFRVLIPRIARVCKGDQGGLRTLQKKWTSFLKARLICSRPDSGLVFNVLRDVFVLRSPGLKVPVFYALFTPQLNNVGLSAVCAYNLSTAEEVFSHGKYMQSTTVEQSHTKWVRYNGPVPKPRPGACIDSEARAANYTSSLNLPDKTLQFVKDHPLMDDSVTPIDNRPRLIKKDVNYTQIVVDRTQALDGTVYDVMFVSTDRGALHKAISLEHAVHIIEETQLFQDFEPVQTLLLSSKKGNRFVYAGSNSGVVQAPLAFCGKHGTCEDCVLARDPYCAWSPPTATCVALHQTESPSRGLIQEMSGDASVCPASSPKPLPPPGSSSLSCLGHVGDRRLSSPWTPWPASGAGPDSSSRVSLLPPFLSDQAQHVHALGNFYLFCQATGPADIRFVWEKNGRALETCVPVQTHALPDGRAHALSWLQDAIRESAEYRCSVLSSAGNKTSKVQVAVMRPEVTHQERWTRELSAWRAVAGEHDRMMQSWRKAWESCSKDTL

SEQ ID NO: 35390 - protein, 738 aa, Homo sapiens; identical to SEQ ID NO: 35389
  ENSP00000344923

SEQ ID NO: 35391 - protein, 123 aa, Homo sapiens
  ENSP00000399948
MWTQRWKRSVSPGPADIRFVWEKNGRALETCVPVQTHALPDGRAHALSWLQDAIRESAEYRCSVLSSAGNKTSKVQVAVMRPEVTHQERWTRELSAWRAVAGEHDRMMQSWRKAWESCSKDTL

SEQ ID NO: 35392 - protein, 738 aa, Homo sapiens; identical to SEQ ID NO: 35389
  ENSP00000411981

SEQ ID NO: 35393 - protein, 548 aa, Homo sapiens; identical to SEQ ID NO: 35379
  ENSP00000395222

SEQ ID NO: 35394 - protein, 522 aa, Homo sapiens
  ENSP00000428896
MWGRLWPLLLSILTATAVPGPSLRRPSRELDATPRMTIPYEELSGTRHFKGQAQNYSTLLLEEASARLLVGARGALFSLSANDIGDGAHKEIHWEASPEMQSKCHQKGKNNQTECFNHVRFLQRLNSTHLYACGTHAFQPLCAAIDAEAFTLPTSFEEGKEKCPYDPARGFTGLIIDGGLYTATRYEFRSIPDIRRSRHPHSLRTEETPMHWLNDAEFVFSVLVRESKASAVGDDDKVYYFFTERATEEGSGSFTQSRSSHRVARVARVCKGDLGGKKILQKKWTSFLKARLICHIPLYETLRGVCSLDAETSSRTHFYAAFTLSTQWKTLEASAICRYDLAEIQAVFAGPYMEYQDGSRRWGRYEGGVPEPRPGSCITDSLRSQGYNSSQDLPSLVLDFVKLHPLMARPVVPTRGRPLLLKRNIRYTHLTGTPVTTPAGPTYDLLFLGTADGWIHKAVVLGSGMHIIEETQVFRESQSVENLVISLLQHSLYVGAPSGVIQLPLSSCSRYRSCYDCILARD

SEQ ID NO: 35395 - protein, 838 aa, Homo sapiens
  ENSP00000430881
MWGRLWPLLLSILTATAVPGPSLRRPSRELDATPRMTIPYEELSGTRHFKGQAQNYSTLLLEEASARLLVGARGALFSLSANDIGDGAHKEIHWEASPEMQSKCHQKGKNNQTECFNHVRFLQRLNSTHLYACGTHAFQPLCAAIDAEAFTLPTSFEEGKEKCPYDPARGFTGLIIDGGLYTATRYEFRSIPDIRRSRHPHSLRTEETPMHWLNDAEFVFSVLVRESKASAVGDDDKVYYFFTERATEEGSGSFTQSRSSHRVARVARVCKGDLGGKKILQKKWTSFLKARLICHIPLYETLRGVCSLDAETSSRTHFYAAFTLSTQWKTLEASAICRYDLAEIQAVFAGPYMEYQDGSRRWGRYEGGVPEPRPGSCITDSLRSQGYNSSQDLPSLVLDFVKLHPLMARPVVPTRGRPLLLKRNIRYTHLTGTPVTTPAGPTYDLLFLGTADGWIHKAVVLGSGMHIIEETQVFRESQSVENLVISLLQHSLYVGAPSGVIQLPLSSCSRYRSCYDCILARDPYCGWDPGTHACAAATTIANRTALIQDIERGNRGCESSRDTGPPPPLKTRSVLRGDDVLLPCDQPSNLARALWLLNGSMGLSDGQGGYRVGVDGLLVTDAQPEHSGNYGCYAEENGLRTLLASYSLTVRPATPAPAPKAPATPGAQLAPDVRLLYVLAIAALGGLCLILASSLLYVACLREGRRGRRRKYSLGRASRAGGSAVQLQTVSGQCPGEEDEGDDEGAGGLEGSCLQIIPGEGAPAPPPPPPPPPPAELTNGLVALPSRLRRMNGNSYVLLRQSNNGVPAGPCSFAEELSRILEKRKHTQLVEQLDESSV

SEQ ID NO: 35396 - protein, 170 aa, Homo sapiens
  ENSP00000430103
MWGRLWPLLLSILTATAVPGPSLRRPSRELDATPRMTIPYEELSGTRHFKGQAQNYSTLLLEEASARLLVGARGALFSLSANDIGDGAHKEIHWEASPEMQSKCHQKGKNNQTECFNHVRFLQRLNSTHLYACGTHAFQPLCAAIDAEAFTLPTSFEEGKEKCPYDPARG

SEQ ID NO: 35397 - protein, 838 aa, Homo sapiens; identical to SEQ ID NO: 35395
  ENSP00000359270

SEQ ID NO: 35398 - protein, 702 aa, Homo sapiens
  ENSP00000430175
MWGRLWPLLLSILTATAVPGPSLRRPSRELDATPRMTIPYEELSGTRHFKGQAQNYSTLLLEEASARLLVGARGALFSLSANDIGDGAHKEIHWEASPEMQSKCHQKGKNNQTECFNHVRFLQRLNSTHLYACGTHAFQPLCAAIDAEAFTLPTSFEEGKEKCPYDPARGFTGLIIDGGLYTATRYEFRSIPDIRRSRHPHSLRTEETPMHWLNDAEFVFSVLVRESKASAVGDDDKVYYFFTERATEEGSGSFTQSRSSHRVARVARVCKGDLGGKKILQKKWTSFLKARLICHIPLYETLRGVCSLDAETSSRTHFYAAFTLSTQWKTLEASAICRYDLAEIQAVFAGPYMEYQDGSRRWGRYEGGVPEPRPGSCITDSLRSQGYNSSQDLPSLVLDFVKLHPLMARPVVPTRGRPLLLKRNIRYTHLTGTPVTTPAGPTYDLLFLGTADGWIHKAVVLGSGMHIIEETQVFRESQSVENLVISLLQHSLYVGAPSGVIQLPLSSCSRYRSCYDCILARDPYCGWDPGTHACAAATTIANRSQGSRTALIQDIERGNRGCESSRDTGRALQVHMGSMSPPSAWPCVLDGPETRQDLCQPPKPCVHSHAHMEECLSAGLQCPHPHLLLVHSCFIPASGLGVPSQLPHPIWSSSPAPCGDLFVKSLGTGQPGEVRLHHSPPLPSCVALVNQPPHSPWSFSRV

SEQ ID NO: 35399 - protein, 843 aa, Homo sapiens
  ENSP00000210633
MWGRLWPLLLSILTATAVPGPSLRRPSRELDATPRMTIPYEELSGTRHFKGQAQNYSTLLLEEASARLLVGARGALFSLSANDIGDGAHKEIHWEASPEMQSKCHQKGKNNQTECFNHVRFLQRLNSTHLYACGTHAFQPLCAAIDAEAFTLPTSFEEGKEKCPYDPARGFTGLIIDGGLYTATRYEFRSIPDIRRSRHPHSLRTEETPMHWLNDAEFVFSVLVRESKASAVGDDDKVYYFFTERATEEGSGSFTQSRSSHRVARVARVCKGDLGGKKILQKKWTSFLKARLICHIPLYETLRGVCSLDAETSSRTHFYAAFTLSTQWKTLEASAICRYDLAEIQAVFAGPYMEYQDGSRRWGRYEGGVPEPRPGSCITDSLRSQGYNSSQDLPSLVLDFVKLHPLMARPVVPTRGRPLLLKRNIRYTHLTGTPVTTPAGPTYDLLFLGTADGWIHKAVVLGSGMHIIEETQVFRESQSVENLVISLLQHSLYVGAPSGVIQLPLSSCSRYRSCYDCILARDPYCGWDPGTHACAAATTIANRSQGSRTALIQDIERGNRGCESSRDTGPPPPLKTRSVLRGDDVLLPCDQPSNLARALWLLNGSMGLSDGQGGYRVGVDGLLVTDAQPEHSGNYGCYAEENGLRTLLASYSLTVRPATPAPAPKAPATPGAQLAPDVRLLYVLAIAALGGLCLILASSLLYVACLREGRRGRRRKYSLGRASRAGGSAVQLQTVSGQCPGEEDEGDDEGAGGLEGSCLQIIPGEGAPAPPPPPPPPPPAELTNGLVALPSRLRRMNGNSYVLLRQSNNGVPAGPCSFAEELSRILEKRKHTQLVEQLDESSV

SEQ ID NO: 35400 - protein, 131 aa, Homo sapiens
  ENSP00000429888
  MOD_RES (1)..(1): Any amino acid
XREGRRGRRRKYSLGRASRAGGSAVQLQTVSGRALQVHMGSMSPPSAWPCVLDGPETRQDLCQPPKPCVHSHAHMEECLSAGLQCPHPHLLLVHSCFIPASGLGVPSQLPHPIWSSSPAPCGDLFVKSLGT

SEQ ID NO: 35401 - protein, 127 aa, Homo sapiens
  ENSP00000479499
MGSMSPPSAWPCVLDGPETRQDLCQPPKPCVHSHAHMEECLSAGLQCPHPHLLLVHSCFIPASGLGVPSQLPHPIWSSSPAPCGDLFVKSLGTGQPGEVRLHHSPPLPSCVALVNQPPHSPWSFSRV

SEQ ID NO: 35402 - protein, 1074 aa, Homo sapiens
  ENSP00000371936
MKGTCVIAWLFSSLGLWRLAHPEAQGTTQCQRTEHPVISYKEIGPWLREFRAKNAVDFSQLTFDPGQKELVVGARNYLFRLQLEDLSLIQAVEWECDEATKKACYSKGKSKEECQNYIRVLLVGGDRLFTCGTNAFTPVCTNRSLSNLTEIHDQISGMARCPYSPQHNSTALLTAGGELYAATAMDFPGRDPAIYRSLGILPPLRTAQYNSKWLNEPNFVSSYDIGNFTYFFFRENAVEHDCGKTVFSRAARVCKNDIGGRFLLEDTWTTFMKARLNCSRPGEVPFYYNELQSTFFLPELDLIYGIFTTNVNSIAASAVCVFNLSAIAQAFSGPFKYQENSRSAWLPYPNPNPHFQCGTVDQGLYVNLTERNLQDAQKFILMHEVVQPVTTVPSFMEDNSRFSHVAVDVVQGREALVHIIYLATDYGTIKKVRVPLNQTSSSCLLEEIELFPERRREPIRSLQILHSQSVLFVGLREHVVKIPLKRCQFYRTRSTCIGAQDPYCGWDVVMKKCTSLEESLSMTQWEQSISACPTRNLTVDGHFGVWSPWTPCTHTDGSAVGSCLCRTRSCDSPAPQCGGWQCEGPGMEIANCSRNGGWTPWTSWSPCSTTCGIGFQVRQRSCSNPTPRHGGRVCVGQNREERYCNEHLLCPPHMFWTGWGPWERCTAQCGGGIQARRRICENGPDCAGCNVEYQSCNTNPCPELKKTTPWTPWTPVNISDNGGHYEQRFRYTCKARLADPNLLEVGRQRIEMRYCSSDGTSGCSTDGLSGDFLRAGRYSAHTVNGAWSAWTSWSQCSRDCSRGIRNRKRVCNNPEPKYGGMPCLGPSLEYQECNILPCPVDGVWSCWSPWTKCSATCGGGHYMRTRSCSNPAPAYGGDICLGLHTEEALCNTQPCPESWSEWSDWSECEASGVQVRARQCILLFPMGSQCSGNTTESRPCVFDSNFIPEVSVARSSSVEEKRCGEFNMFHMIAVGLSSSILGCLLTLLVYTYCQRYQQQSHDATVIHPVSPAPLNTSITNHINKLDKYDSVEAIKAFNKNNLILEERNKYFNPHLTGKTYSNAYFTDLNNYDEY

SEQ ID NO: 35403 - protein, 254 aa, Homo sapiens
  ENSP00000421961
MKGTCVIAWLFSSLGLWRLAHPEAQGTTQCQRTEHPVISYKEIGPWLREFRAKNAVDFSQLTFDPGQKELVVGARNYLFRLQLEDLSLIQAVEWECDEATKKACYSKGKSKEECQNYIRVLLVGGDRLFTCGTNAFTPVCTNRSLSNLTEIHDQISGMARCPYSPQHNSTALLTAGGELYAATAMDFPGRDPAIYRSLGILPPLRTAQYNSKWLNEPNFVSSYDIGNFTYFFFRENAVEHDCGKTVFSRAARVC

SEQ ID NO: 35404 - protein, 197 aa, Homo sapiens
  ENSP00000400828
  MOD_RES (1)..(1): Any amino acid
XRSCTSPAPSPEGWSPWSEWSKCTDDGAQSRSRHCEELLPGSSACAGNSSQSRPCPYSEIPVILPASSMEEATDCAGFNLIHLVATGISCFLGSGLLTLAVYLSCQHCQRQSQESTLVHPATPNHLHYKGGGTPKNEKYTPMEFKTLNKNNLIPDDRANFYPLQQTNVYTTTYYPSPLNKHSFRPEASPGQRCFPNS

SEQ ID NO: 35405 - protein, 1151 aa, Homo sapiens
  ENSP00000350215
MPCGFSPSPVAHHLVPGPPDTPAQQLRCGWTVGGWLLSLVRGLLPCLPPGARTAEGPIMVLAGPLAVSLLLPSLTLLVSHLSSSQDVSSEPSSEQQLCALSKHPTVAFEDLQPWVSNFTYPGARDFSQLALDPSGNQLIVGARNYLFRLSLANVSLLQATEWASSEDTRRSCQSKGKTEEECQNYVRVLIVAGRKVFMCGTNAFSPMCTSRQVGNLSRTIEKINGVARCPYDPRHNSTAVISSQGELYAATVIDFSGRDPAIYRSLGSGPPLRTAQYNSKWLNEPNFVAAYDIGLFAYFFLRENAVEHDCGRTVYSRVARVCKNDVGGRFLLEDTWTTFMKARLNCSRPGEVPFYYNELQSAFHLPEQDLIYGVFTTNVNSIAASAVCAFNLSAISQAFNGPFRYQENPRAAWLPIANPIPNFQCGTLPETGPNENLTERSLQDAQRLFLMSEAVQPVTPEPCVTQDSVRFSHLVVDLVQAKDTLYHVLYIGTESGTILKALSTASRSLHGCYLEELHVLPPGRREPLRSLRILHSARALFVGLRDGVLRVPLERCAAYRSQGACLGARDPYCGWDGKQQRCSTLEDSSNMSLWTQNITACPVRNVTRDGGFGPWSPWQPCEHLDGDNSGSCLCRARSCDSPRPRCGGLDCLGPAIHIANCSRNGAWTPWSSWALCSTSCGIGFQVRQRSCSNPAPRHGGRICVGKSREERFCNENTPCPVPIFWASWGSWSKCSSNCGGGMQSRRRACENGNSCLGCGVEFKTCNPEGCPEVRRNTPWTPWLPVNVTQGGARQEQRFRFTCRAPLADPHGLQFGRRRTETRTCPADGSGSCDTDALVEVLLRSGSTSPHTVSGGWAAWGPWSSCSRDCELGFRVRKRTCTNPEPRNGGLPCVGDAAEYQDCNPQACPVRGAWSCWTSWSPCSASCGGGHYQRTRSCTSPAPSPGEDICLGLHTEEALCATQACPEGWSPWSEWSKCTDDGAQSRSRHCEELLPGSSACAGNSSQSRPCPYSEIPVILPASSMEEATDCAGFNLIHLVATGISCFLGSGLLTLAVYLSCQHCQRQSQESTLVHPATPNHLHYKGGGTPKNEKYTPMEFKTLNKNNLIPDDRANFYPLQQTNVYTTTYYPSPLNKHSFRPEASPGQRCFPNS

SEQ ID NO: 35406 - protein, 1094 aa, Homo sapiens
  ENSP00000417570
MPCGFSPSPVAHHLVPGPPDTPAQQLRCGWTVGGWLLSLVRGLLPCLPPGARTAEGPIMVLAGPLAVSLLLPSLTLLVSHLSSSQDVSSEPSSEQQLCALSKHPTVAFEDLQPWVSNFTYPGARDFSQLALDPSGNQLIVGARNYLFRLSLANVSLLQATEWASSEDTRRSCQSKGKTEEECQNYVRVLIVAGRKVFMCGTNAFSPMCTSRQVGNLSRTIEKINGVARCPYDPRHNSTAVISSQGELYAATVIDFSGRDPAIYRSLGSGPPLRTAQYNSKWLNEPNFVAAYDIGLFAYFFLRENAVEHDCGRTVYSRVARVCKNDVGGRFLLEDTWTTFMKARLNCSRPGEVPFYYNELQSAFHLPEQDLIYGVFTTNVNSIAASAVCAFNLSAISQAFNGPFRYQENPRAAWLPIANPIPNFQCGTLPETGPNENLTERSLQDAQRLFLMSEAVQPVTPEPCVTQDSVRFSHLVVDLVQAKDTLYHVLYIGTESGTILKALSTASRSLHGCYLEELHVLPPGRREPLRSLRILHSARALFVGLRDGVLRVPLERCAAYRSQGACLGARDPYCGWDGKQQRCSTLEDSSNMSLWTQNITACPVRNVTRDGGFGPWSPWQPCEHLDGDNSGSCLCRARSCDSPRPRCGGLDCLGPAIHIANCSRNGAWTPWSSWALCSTSCGIGFQVRQRSCSNPAPRHGGRICVGKSREERFCNENTPCPVPIFWASWGSWSKCSSNCGGGMQSRRRACENGNSCLGCGVEFKTCNPEGCPEVRRNTPWTPWLPVNVTQGGARQEQRFRFTCRAPLADPHGLQFGRRRTETRTCPADGSGSCDTDALVEVLLRSGSTSPHTVSGGWAAWGPWSSCSRDCELGFRVRKRTCTNPEPRNGGLPCVGDAAEYQDCNPQACPVRGAWSCWTSWSPCSASCGGGHYQRTRSCTSPAPSPGEDICLGLHTEEALCATQACPEGWSPWSEWSKCTDDGAQSRSRHCEELLPGSSACAGNSSQSRPCPYSEIPVILPASSMEEATDCAGKRNRTYLMLRSSQPSGTPLQSLDSFHILLQTAKLCWGPHCFEMGSISSTWWPRASPASWALGS

SEQ ID NO: 35407 - protein, 1088 aa, Homo sapiens
  ENSP00000377208
MPCGFSPSPVAHHLVPGPPDTPAQQLRCGWTVGGWLLSLVRGLLPCLPPGARTAEGPIMVLAGPLAVSLLLPSLTLLVSHLSSSQDVSSEPSSEQQLCALSKHPTVAFEDLQPWVSNFTYPGARDFSQLALDPSGNQLIVGARNYLFRLSLANVSLLQATEWASSEDTRRSCQSKGKTEEECQNYVRVLIVAGRKVFMCGTNAFSPMCTSRQVGNLSRTIEKINGVARCPYDPRHNSTAVISSQGELYAATVIDFSGRDPAIYRSLGSGPPLRTAQYNSKWLNEPNFVAAYDIGLFAYFFLRENAVEHDCGRTVYSRVARVCKNDVGGRFLLEDTWTTFMKARLNCSRPGEVPFYYNELQSAFHLPEQDLIYGVFTTNVNSIAASAVCAFNLSAISQAFNGPFRYQENPRAAWLPIANPIPNFQCGTLPETGPNENLTERSLQDAQRLFLMSEAVQPVTPEPCVTQDSVRFSHLVVDLVQAKDTLYHVLYIGTESGTILKALSTASRSLHGCYLEELHVLPPGRREPLRSLRILHSARALFVGLRDGVLRVPLERCAAYRSQGACLGARDPYCGWDGKQQRCSTLEDSSNMSLWTQNITACPVRNVTRDGGFGPWSPWQPCEHLDGDNSGSCLCRARSCDSPRPRCGGLDCLGPAIHIANCSRNGAWTPWSSWALCSTSCGIGFQVRQRSCSNPAPRHGGRICVGKSREERFCNENTPCPVPIFWASWGSWSKCSSNCGGGMQSRRRACENGNSCLGCGVEFKTCNPEGCPEVRRNTPWTPWLPVNVTQGGARQEQRFRFTCRAPLADPHGLQFGRRRTETRTCPADGSGSCDTDALVEVLLRSGSTSPHTVSGGWAAWGPWSSCSRDCELGFRVRKRTCTNPEPRNGGLPCVGDAAEYQDCNPQACPVRGAWSCWTSWSPCSASCGGGHYQRTRSCTSPAPSPGEDICLGLHTEEALCATQACPEGWSPWSEWSKCTDDGAQSRSRHCEELLPGSSACAGNSSQSRPCPYSEIPVILPASSMEEATDCAGFNLIHLVATGISCFLGSGLLTLAVYLSCQHCQRQSQESTLVHPATPNHLHYKGGGTP

SEQ ID NO: 35408 - protein, 142 aa, Homo sapiens
  ENSP00000401056
MPCGFSPSPVAHHLVPGPPDTPAQQLRCGWTVGGWLLSLVRGLLPCLPPGARTAEGPIMVLAGPLAVSLLLPSLTLLVSHLSSSQDVSSEPSSEQQLCALSKHPTVAFEDLQPWVSNFTYPGARDFSQLALDPSGNQLIVGA

SEQ ID NO: 35409 - protein, 84 aa, Homo sapiens
  ENSP00000401038
MPCGFSPSPVAHHLVPGPPDTPAQQLRCGWTVGGWLLSLVRGLLPCLPPGARTAEGPIMVLAGPLAVSLLLPSLTLLVSHLSSS

SEQ ID NO: 35410 - protein, 1205 aa, Homo sapiens
  ENSP00000389588
MLHLSAEEAIGCVRVRRSFIDELAFGRGHSTGTGKQKRRDRVSGSSWCLACVSWMPCGFSPSPVAHHLVPGPPDTPAQQLRCGWTVGGWLLSLVRGLLPCLPPGARTAEGPIMVLAGPLAVSLLLPSLTLLVSHLSSSQDVSSEPSSEQQLCALSKHPTVAFEDLQPWVSNFTYPGARDFSQLALDPSGNQLIVGARNYLFRLSLANVSLLQATEWASSEDTRRSCQSKGKTEEECQNYVRVLIVAGRKVFMCGTNAFSPMCTSRQVGNLSRTIEKINGVARCPYDPRHNSTAVISSQGELYAATVIDFSGRDPAIYRSLGSGPPLRTAQYNSKWLNEPNFVAAYDIGLFAYFFLRENAVEHDCGRTVYSRVARVCKNDVGGRFLLEDTWTTFMKARLNCSRPGEVPFYYNELQSAFHLPEQDLIYGVFTTNVNSIAASAVCAFNLSAISQAFNGPFRYQENPRAAWLPIANPIPNFQCGTLPETGPNENLTERSLQDAQRLFLMSEAVQPVTPEPCVTQDSVRFSHLVVDLVQAKDTLYHVLYIGTESGTILKALSTASRSLHGCYLEELHVLPPGRREPLRSLRILHSARALFVGLRDGVLRVPLERCAAYRSQGACLGARDPYCGWDGKQQRCSTLEDSSNMSLWTQNITACPVRNVTRDGGFGPWSPWQPCEHLDGDNSGSCLCRARSCDSPRPRCGGLDCLGPAIHIANCSRNGAWTPWSSWALCSTSCGIGFQVRQRSCSNPAPRHGGRICVGKSREERFCNENTPCPVPIFWASWGSWSKCSSNCGGGMQSRRRACENGNSCLGCGVEFKTCNPEGCPEVRRNTPWTPWLPVNVTQGGARQEQRFRFTCRAPLADPHGLQFGRRRTETRTCPADGSGSCDTDALVEVLLRSGSTSPHTVSGGWAAWGPWSSCSRDCELGFRVRKRTCTNPEPRNGGLPCVGDAAEYQDCNPQACPVRGAWSCWTSWSPCSASCGGGHYQRTRSCTSPAPSPGEDICLGLHTEEALCATQACPEGWSPWSEWSKCTDDGAQSRSRHCEELLPGSSACAGNSSQSRPCPYSEIPVILPASSMEEATDCAGFNLIHLVATGISCFLGSGLLTLAVYLSCQHCQRQSQESTLVHPATPNHLHYKGGGTPKNEKYTPMEFKTLNKNNLIPDDRANFYPLQQTNVYTTTYYPSPLNKHSFRPEASPGQRCFPNS

SEQ ID NO: 35411 - protein, 1151 aa, Homo sapiens; identical to SEQ ID NO: 35405
  ENSP00000479602

SEQ ID NO: 35412 - protein, 1057 aa, Homo sapiens
  ENSP00000195173
MVLAGPLAVSLLLPSLTLLVSHLSSSQDVSSEPSSEQQLCALSKHPTVAFEDLQPWVSNFTYPGARDFSQLALDPSGNQLIVGARNYLFRLSLANVSLLQATEWASSEDTRRSCQSKGKTEEECQNYVRVLIVAGRKVFMCGTNAFSPMCTSRQVGNLSRTIEKINGVARCPYDPRHNSTAVISSQGELYAATVIDFSGRDPAIYRSLGSGPPLRTAQYNSKWLNEPNFVAAYDIGLFAYFFLRENAVEHDCGRTVYSRVARVCKNDVGGRFLLEDTWTTFMKARLNCSRPGEVPFYYNELQSAFHLPEQDLIYGVFTTNVNSIAASAVCAFNLSAISQAFNGPFRYQENPRAAWLPIANPIPNFQCGTLPETGPNENLTERSLQDAQRLFLMSEAVQPVTPEPCVTQDSVRFSHLVVDLVQAKDTLYHVLYIGTESGTILKALSTASRSLHGCYLEELHVLPPGRREPLRSLRILHSARALFVGLRDGVLRVPLERCAAYRSQGACLGARDPYCGWDGKQQRCSTLEDSSNMSLWTQNITACPVRNVTRDGGFGPWSPWQPCEHLDGDNSGSCLCRARSCDSPRPRCGGLDCLGPAIHIANCSRNGAWTPWSSWALCSTSCGIGFQVRQRSCSNPAPRHGGRICVGKSREERFCNENTPCPVPIFWASWGSWSKCSSNCGGGMQSRRRACENGNSCLGCGVEFKTCNPEGCPEVRRNTPWTPWLPVNVTQGGARQEQRFRFTCRAPLADPHGLQFGRRRTETRTCPADGSGSCDTDALVEVLLRSGSTSPHTVSGGWAAWGPWSSCSRDCELGFRVRKRTCTNPEPRNGGLPCVGDAAEYQDCNPQACPGEDICLGLHTEEALCATQACPEGWSPWSEWSKCTDDGAQSRSRHCEELLPGSSACAGNSSQSRPCPYSEIPVILPASSMEEATDCAGFNLIHLVATGISCFLGSGLLTLAVYLSCQHCQRQSQESTLVHPATPNHLHYKGGGTPKNEKYTPMEFKTLNKNNLIPDDRANFYPLQQTNVYTTTYYPSPLNKHSFRPEASPGQRCFPNS

SEQ ID NO: 35413 - protein, 1030 aa, Homo sapiens
  ENSP00000345512
MRSEALLLYFTLLHFAGAGFPEDSEPISISHGNYTKQYPVFVGHKPGRNTTQRHRLDIQMIMIMNGTLYIAARDHIYTVDIDTSHTEEIYCSKKLTWKSRQADVDTCRMKGKHKDECHNFIKVLLKKNDDALFVCGTNAFNPSCRNYKMDTLEPFGDEFSGMARCPYDAKHANVALFADGKLYSATVTDFLAIDAVIYRSLGESPTLRTVKHDSKWLKEPYFVQAVDYGDYIYFFFREIAVEYNTMGKVVFPRVAQVCKNDMGGSQRVLEKQWTSFLKARLNCSVPGDSHFYFNILQAVTDVIRINGRDVVLATFSTPYNSIPGSAVCAYDMLDIASVFTGRFKEQKSPDSTWTPVPDERVPKPRPGCCAGSSSLERYATSNEFPDDTLNFIKTHPLMDEAVPSIFNRPWFLRTMVRYRLTKIAVDTAAGPYQNHTVVFLGSEKGIILKFLARIGNSGFLNDSLFLEEMSVYNSEKCSYDGVEDKRIMGMQLDRASSSLYVAFSTCVIKVPLGRCERHGKCKKTCIASRDPYCGWIKEGGACSHLSPNSRLTFEQDIERGNTDGLGDCHNSFVALNGHSSSLLPSTTTSDSTAQEGYESRGGMLDWKHLLDSPDSTDPLGAVSSHNHQDKKGVIRESYLKGHDQLVPVTLLAIAVILAFVMGAVFSGITVYCVCDHRRKDVAVVQRKEKELTHSRRGSMSSVTKLSGLFGDTQSKDPKPEAILTPLMHNGKLATPGNTAKMLIKADQHHLDLTALPTPESTPTLQQKRKPSRGSREWERNQNLINACTKDMPPMGSPVIPTDLPLRASPSHIPSVVVLPITQQGYQHEYVDQPKMSEVAQMALEDQAATLEYKTIKEHLSSKSPNHGVNLVENLDSLPPKVPQREASLGPPGASLSQTGLSKRLEMHHSSSYGVDYKRSYPTNSLTRSHQATTLKRNNTNSSNSSHLSRNQSFGRGDNPPPAPQRVDSIQVHSSQPSGQAVTVSRQPSLNAYNSLTRSGLKRTPSLKPDVPPKPSFAPLSTSMKPNDACT

SEQ ID NO: 35414 - protein, 1047 aa, Homo sapiens
  ENSP00000257414
MRSEALLLYFTLLHFAGAGFPEDSEPISISHGNYTKQYPVFVGHKPGRNTTQRHRLDIQMIMIMNGTLYIAARDHIYTVDIDTSHTEEIYCSKKLTWKSRQADVDTCRMKGKHKDECHNFIKVLLKKNDDALFVCGTNAFNPSCRNYKMDTLEPFGDEFSGMARCPYDAKHANVALFADGKLYSATVTDFLAIDAVIYRSLGESPTLRTVKHDSKWLKEPYFVQAVDYGDYIYFFFREIAVEYNTMGKVVFPRVAQVCKNDMGGSQRVLEKQWTSFLKARLNCSVPGDSHFYFNILQAVTDVIRINGRDVVLATFSTPYNSIPGSAVCAYDMLDIASVFTGRFKEQKSPDSTWTPVPDERVPKPRPGCCAGSSSLERYATSNEFPDDTLNFIKTHPLMDEAVPSIFNRPWFLRTMVRYRLTKIAVDTAAGPYQNHTVVFLGSEKGIILKFLARIGNSGFLNDSLFLEEMSVYNSEKCSYDGVEDKRIMGMQLDRASSSLYVAFSTCVIKVPLGRCERHGKCKKTCIASRDPYCGWIKEGGACSHLSPNSRLTFEQDIERGNTDGLGDCHNSFVALNDISTPLPDNEMSYNTVYGHSSSLLPSTTTSDSTAQEGYESRGGMLDWKHLLDSPDSTDPLGAVSSHNHQDKKGVIRESYLKGHDQLVPVTLLAIAVILAFVMGAVFSGITVYCVCDHRRKDVAVVQRKEKELTHSRRGSMSSVTKLSGLFGDTQSKDPKPEAILTPLMHNGKLATPGNTAKMLIKADQHHLDLTALPTPESTPTLQQKRKPSRGSREWERNQNLINACTKDMPPMGSPVIPTDLPLRASPSHIPSVVVLPITQQGYQHEYVDQPKMSEVAQMALEDQAATLEYKTIKEHLSSKSPNHGVNLVENLDSLPPKVPQREASLGPPGASLSQTGLSKRLEMHHSSSYGVDYKRSYPTNSLTRSHQATTLKRNNTNSSNSSHLSRNQSFGRGDNPPPAPQRVDSIQVHSSQPSGQAVTVSRQPSLNAYNSLTRSGLKRTPSLKPDVPPKPSFAPLSTSMKPNDACT

SEQ ID NO: 35415 - protein, 457 aa, Homo sapiens
  ENSP00000422997
MKTGHSSSLLPSTTTSDSTAQEGYESRGGMLDWKHLLDSPDSTDPLGAVSSHNHQDKKGVIRESYLKGHDQLVPVTLLAIAVILAFVMGAVFSGITVYCVCDHRRKDVAVVQRKEKELTHSRRGSMSSVTKLSGLFGDTQSKDPKPEAILTPLMHNGKLATPGNTAKMLIKADQHHLDLTALPTPESTPTLQQKRKPSRGSREWERNQNLINACTKDMPPMGSPVIPTDLPLRASPSHIPSVVVLPITQQGYQHEYVDQPKMSEVAQMALEDQAATLEYKTIKEHLSSKSPNHGVNLVENLDSLPPKVPQREASLGPPGASLSQTGLSKRLEMHHSSSYGVDYKRSYPTNSLTRSHQATTLKRNNTNSSNSSHLSRNQSFGRGDNPPPAPQRVDSIQVHSSQPSGQAVTVSRQPSLNAYNSLTRSGLKRTPSLKPDVPPKPSFAPLSTSMKPNDACT

SEQ ID NO: 35416 - protein, 545 aa, Homo sapiens
  ENSP00000422275
  MOD_RES (1)..(1): Any amino acid
XYQNHTVVFLGSEKGIILKFLARIGNSGFLNDSLFLEEMSVYNSEKCSYDGVEDKRIMGMQLDRASSSLYVAFSTCVIKVPLGRCERHGKCKKTCIASRDPYCGWIKEGGACSHLSPNSRLTFEQDIERGNTDGLGDCHNSFVALNGVIRESYLKGHDQLVPVTLLAIAVILAFVMGAVFSGITVYCVCDHRRKDVAVVQRKEKELTHSRRGSMSSVTKLSGLFGDTQSKDPKPEAILTPLMHNGKLATPGNTAKMLIKADQHHLDLTALPTPESTPTLQQKRKPSRGSREWERNQNLINACTKDMPPMGSPVIPTDLPLRASPSHIPSVVVLPITQQGYQHEYVDQPKMSEVAQMALEDQAATLEYKTIKEHLSSKSPNHGVNLVENLDSLPPKVPQREASLGPPGASLSQTGLSKRLEMHHSSSYGVDYKRSYPTNSLTRSHQATTLKRNNTNSSNSSHLSRNQSFGRGDNPPPAPQRVDSIQVHSSQPSGQAVTVSRQPSLNAYNSLTRSGLKRTPSLKPDVPPKPSFAPLSTSMKPNDACT

SEQ ID NO: 35417 - protein, 409 aa, Homo sapiens
  ENSP00000425364
MKNASPETREGVIRESYLKGHDQLVPVTLLAIAVILAFVMGAVFSGITVYCVCDHRRKDVAVVQRKEKELTHSRRGSMSSVTKLSGLFGDTQSKDPKPEAILTPLMHNGKLATPGNTAKMLIKADQHHLDLTALPTPESTPTLQQKRKPSRGSREWERNQNLINACTKDMPPMGSPVIPTDLPLRASPSHIPSVVVLPITQQGYQHEYVDQPKMSEVAQMALEDQAATLEYKTIKEHLSSKSPNHGVNLVENLDSLPPKVPQREASLGPPGASLSQTGLSKRLEMHHSSSYGVDYKRSYPTNSLTRSHQATTLKRNNTNSSNSSHLSRNQSFGRGDNPPPAPQRVDSIQVHSSQPSGQAVTVSRQPSLNAYNSLTRSGLKRTPSLKPDVPPKPSFAPLSTSMKPNDACT

SEQ ID NO: 35418 - protein, 1030 aa, Homo sapiens; identical to SEQ ID NO: 35413
  ENSP00000424388

SEQ ID NO: 35419 - protein, 159 aa, Homo sapiens
  ENSP00000421935
MRSEALLLYFTLLHFAGAGFPEDSEPISISHGNYTKQYPVFVGHKPGRNTTQRHRLDIQMIMIMNGTLYIAARDHIYTVDIDTSHTEEIYCSKKLTWKSRQADVDTCRMKGKHKDECHNFIKVLLKKNDDALFVCGTNAFNPSCRNYKMDTLEPFGDEF

SEQ ID NO: 35420 - protein, 114 aa, Homo sapiens
  ENSP00000425553
MRSEALLLYFTLLHFAGAGFPEDSEPISISHGNYTKQYPVFVGHKPGRNTTQRHRLDIQMIMIMNGTLYIAARDHIYTVDIDTSHTEEIYCSKKLTWKSRQADVDTCRMKGKHK

SEQ ID NO: 35421 - protein, 1011 aa, Homo sapiens
  ENSP00000452815
MRVFLLCAYILLLMVSQLRAVSFPEDDEPLNTVDYHYSRQYPVFRGRPSGNESQHRLDFQLMLKIRDTLYIAGRDQVYTVNLNEMPKTEVIPNKKLTWRSRQQDRENCAMKGKHKDECHNFIKVFVPRNDEMVFVCGTNAFNPMCRYYRLSTLEYDGEEISGLARCPFDARQTNVALFADGKLYSATVADFLASDAVIYRSMGDGSALRTIKYDSKWIKEPHFLHAIEYGNYVYFFFREIAVEHNNLGKAVYSRVARICKNDMGGSQRVLEKHWTSFLKARLNCSVPGDSFFYFDVLQSITDIIQINGIPTVVGVFTTQLNSIPGSAVCAFSMDDIEKVFKGRFKEQKTPDSVWTAVPEDKVPKPRPGCCAKHGLAEAYKTSIDFPDETLSFIKSHPLMDSAVPPIADEPWFTKTRVRYRLTAISVDHSAGPYQNYTVIFVGSEAGMVLKVLAKTSPFSLNDSVLLEEIEAYNHAKCSAENEEDKKVISLQLDKDHHALYVAFSSCIIRIPLSRCERYGSCKKSCIASRDPYCGWLSQGSCGRVTPGMLLLTEDFFAFHNHSAEGYEQDTEFGNTAHLGDCHGVRWEVQSGESNQMVHMNVLITCVFAAFVLGAFIAGVAVYCYRDMFVRKNRKIHKDAESAQSCTDSSGSFAKLNGLFDSPVKEYQQNIDSPKLYSNLLTSRKELPPNGDTKSMVMDHRGQPPELAALPTPESTPVLHQKTLQAMKSHSEKAHGHGASRKETPQFFPSSPPPHSPLSHGHIPSAIVLPNATHDYNTSFSNSNAHKAEKKLQNIDHPLTKSSSKRDHRRSVDSRNTLNDLLKHLNDPNSNPKAIMGDIQMAHQNLMLDPMGSMSEVPPKVPNREASLYSPPSTLPRNSPTKRVDVPTTPGVPMTSLERQRGYHKNSSQRHSISAMPKNLNSPNGVLLSRQPSMNRGGYMPTPTGAKVDYIQGTPVSVHLQPSLSRQSSYTSNGTLPRTGLKRTPSLKPDVPPKPSFVPQTPSVRPLNKYTY

SEQ ID NO: 35422 - protein, 22 aa, Homo sapiens
  ENSP00000453097
MRVFLLCAYILLLMVSQLRAVS

SEQ ID NO: 35423 - protein, 1 aa, Homo sapiens
  ENSP00000453420
M

SEQ ID NO: 35424 - protein, 148 aa, Homo sapiens
  ENSP00000453530
MRVFLLCAYILLLMVSQLRAVSFPEDDEPLNTVDYHYSRQYPVFRGRPSGNESQHRLDFQLMLKIRDTLYIAGRDQVYTVNLNEMPKTEVIPNKKLTWRSRQQDRENCAMKGKHKDECHNFIKVFVPRNDEMVFVCGTNAFNPMCRYY

SEQ ID NO: 35425 - protein, 1073 aa, Homo sapiens
  ENSP00000446152
MRVFLLCAYILLLMVSQLRAVSFPEDDEPLNTVDYHYSRQYPVFRGRPSGNESQHRLDFQLMLKIRDTLYIAGRDQVYTVNLNEMPKTEVIPNKKLTWRSRQQDRENCAMKGKHKDECHNFIKVFVPRNDEMVFVCGTNAFNPMCRYYRLSTLEYDGEEISGLARCPFDARQTNVALFADGKLYSATVADFLASDAVIYRSMGDGSALRTIKYDSKWIKEPHFLHAIEYGNYVYFFFREIAVEHNNLGKAVYSRVARICKNDMGGSQRVLEKHWTSFLKARLNCSVPGDSFFYFDVLQSITDIIQINGIPTVVGVFTTQLNSIPGSAVCAFSMDDIEKVFKGRFKEQKTPDSVWTAVPEDKVPKPRPGCCAKHGLAEAYKTSIDFPDETLSFIKSHPLMDSAVPPIADEPWFTKTRVRYRLTAISVDHSAGPYQNYTVIFVGSEAGMVLKVLAKTSPFSLNDSVLLEEIEAYNHAKCSAENEEDKKVISLQLDKDHHALYVAFSSCIIRIPLSRCERYGSCKKSCIASRDPYCGWLSQGSCGRVTPGMLAEGYEQDTEFGNTAHLGDCHEILPTSTTPDYKIFGGPTSDMEVSSSSVTTMASIPEITPKVIDTWRPKLTSSRKFVVQDDPNTSDFTDPLSGIPKGVRWEVQSGESNQMVHMNVLITCVFAAFVLGAFIAGVAVYCYRDMFVRKNRKIHKDAESAQSCTDSSGSFAKLNGLFDSPVKEYQQNIDSPKLYSNLLTSRKELPPNGDTKSMVMDHRGQPPELAALPTPESTPVLHQKTLQAMKSHSEKAHGHGASRKETPQFFPSSPPPHSPLSHGHIPSAIVLPNATHDYNTSFSNSNAHKAEKKLQNIDHPLTKSSSKRDHRRSVDSRNTLNDLLKHLNDPNSNPKAIMGDIQMAHQNLMLDPMGSMSEVPPKVPNREASLYSPPSTLPRNSPTKRVDVPTTPGVPMTSLERQRGYHKNSSQRHSISAMPKNLNSPNGVLLSRQPSMNRGGYMPTPTGAKVDYIQGTPVSVHLQPSLSRQSSYTSNGTLPRTGLKRTPSLKPDVPPKPSFVPQTPSVRPLNKYTY

SEQ ID NO: 35426 - protein, 597 aa, Homo sapiens
  ENSP00000453661
MRVFLLCAYILLLMVSQLRAVSFPEDDEPLNTVDYHYSRQYPVFRGRPSGNESQHRLDFQLMLKIRDTLYIAGRDQVYTVNLNEMPKTEVIPNKKLTWRSRQQDRENCAMKGKHKDECHNFIKVFVPRNDEMVFVCGTNAFNPMCRYYRLSTLEYDGEEISGLARCPFDARQTNVALFADGKLYSATVADFLASDAVIYRSMGDGSALRTIKYDSKWIKEPHFLHAIEYGNYVYFFFREIAVEHNNLGKAVYSRVARICKNDMGGSQRVLEKHWTSFLKARLNCSVPGDSFFYFDVLQSITDIIQINGIPTVVGVFTTQLNSIPGSAVCAFSMDDIEKVFKGRFKEQKTPDSVWTAVPEDKVPKPRPGCCAKHGLAEAYKTSIDFPDETLSFIKSHPLMDSAVPPIADEPWFTKTRVRYRLTAISVDHSAGPYQNYTVIFVGSEAGMVLKVLAKTSPFSLNDSVLLEEIEAYNHAKCSAENEEDKKVISLQLDKDHHALYVAFSSCIIRIPLSRCERYGSCKKSCIASRDPYCGWLSQGSCGRVTPGMLAEGYEQDTEFGNTAHLGDCHDMEVSSSSVTTMVYDGKSSLESPTRWST

SEQ ID NO: 35427 - protein, 476 aa, Homo sapiens
  ENSP00000374076
MRVFLLCAYILLLMVSQLRAVSFPEDDEPLNTVDYHYSRQYPVFRGRPSGNESQHRLDFQLMLKIRDTLYIAGRDQVYTVNLNEMPKTEVIPNKKLTWRSRQQDRENCAMKGKHKDECHNFIKVFVPRNDEMVFVCGTNAFNPMCRYYRLSTLEYDGEEISGLARCPFDARQTNVALFADGKLYSATVADFLASDAVIYRSMGDGSALRTIKYDSKWIKEPHFLHAIEYGNYVYFFFREIAVEHNNLGKAVYSRVARICKNDMGGSQRVLEKHWTSFLKARLNCSVPGDSFFYFDVLQSITDIIQINGIPTVVGVFTTQLNSIPGSAVCAFSMDDIEKVFKGRFKEQKTPDSVWTAVPEDKVPKPRPGCCAKHGLAEAYKTSIDFPDETLSFIKSHPLMDSAVPPIADEPWFTKTRVRYRLTAISVDHSAGPYQNYTVIFVGSEAGMVLKVLAKTSPFSLNDSVLLEEIEAYNHAK

SEQ ID NO: 35428 - protein, 1073 aa, Homo sapiens; identical to SEQ ID NO: 35425
  ENSP00000324857

SEQ ID NO: 35429 - protein, 1017 aa, Homo sapiens
  ENSP00000346786
MRVFLLCAYILLLMVSQLRAVSFPEDDEPLNTVDYHYSRQYPVFRGRPSGNESQHRLDFQLMLKIRDTLYIAGRDQVYTVNLNEMPKTEVIPNKKLTWRSRQQDRENCAMKGKHKDECHNFIKVFVPRNDEMVFVCGTNAFNPMCRYYRLSTLEYDGEEISGLARCPFDARQTNVALFADGKLYSATVADFLASDAVIYRSMGDGSALRTIKYDSKWIKEPHFLHAIEYGNYVYFFFREIAVEHNNLGKAVYSRVARICKNDMGGSQRVLEKHWTSFLKARLNCSVPGDSFFYFDVLQSITDIIQINGIPTVVGVFTTQLNSIPGSAVCAFSMDDIEKVFKGRFKEQKTPDSVWTAVPEDKVPKPRPGCCAKHGLAEAYKTSIDFPDETLSFIKSHPLMDSAVPPIADEPWFTKTRVRYRLTAISVDHSAGPYQNYTVIFVGSEAGMVLKVLAKTSPFSLNDSVLLEEIEAYNHAKCSAENEEDKKVISLQLDKDHHALYVAFSSCIIRIPLSRCERYGSCKKSCIASRDPYCGWLSQGSCGRVTPGMLAEGYEQDTEFGNTAHLGDCHEILPTSTTPDYKIFGGPTSGVRWEVQSGESNQMVHMNVLITCVFAAFVLGAFIAGVAVYCYRDMFVRKNRKIHKDAESAQSCTDSSGSFAKLNGLFDSPVKEYQQNIDSPKLYSNLLTSRKELPPNGDTKSMVMDHRGQPPELAALPTPESTPVLHQKTLQAMKSHSEKAHGHGASRKETPQFFPSSPPPHSPLSHGHIPSAIVLPNATHDYNTSFSNSNAHKAEKKLQNIDHPLTKSSSKRDHRRSVDSRNTLNDLLKHLNDPNSNPKAIMGDIQMAHQNLMLDPMGSMSEVPPKVPNREASLYSPPSTLPRNSPTKRVDVPTTPGVPMTSLERQRGYHKNSSQRHSISAMPKNLNSPNGVLLSRQPSMNRGGYMPTPTGAKVDYIQGTPVSVHLQPSLSRQSSYTSNGTLPRTGLKRTPSLKPDVPPKPSFVPQTPSVRPLNKYTY

SEQ ID NO: 35430 - protein, 1011 aa, Homo sapiens; identical to SEQ ID NO: 35421
  ENSP00000350770

SEQ ID NO: 35431 - protein, 998 aa, Homo sapiens
  ENSP00000374079
MRVFLLCAYILLLMVSQLRAVSFPEDDEPLNTVDYHYSRQYPVFRGRPSGNESQHRLDFQLMLKIRDTLYIAGRDQVYTVNLNEMPKTEVIPNKKLTWRSRQQDRENCAMKGKHKDECHNFIKVFVPRNDEMVFVCGTNAFNPMCRYYRLSTLEYDGEEISGLARCPFDARQTNVALFADGKLYSATVADFLASDAVIYRSMGDGSALRTIKYDSKWIKEPHFLHAIEYGNYVYFFFREIAVEHNNLGKAVYSRVARICKNDMGGSQRVLEKHWTSFLKARLNCSVPGDSFFYFDVLQSITDIIQINGIPTVVGVFTTQLNSIPGSAVCAFSMDDIEKVFKGRFKEQKTPDSVWTAVPEDKVPKPRPGCCAKHGLAEAYKTSIDFPDETLSFIKSHPLMDSAVPPIADEPWFTKTRVRYRLTAISVDHSAGPYQNYTVIFVGSEAGMVLKVLAKTSPFSLNDSVLLEEIEAYNHAKCSAENEEDKKVISLQLDKDHHALYVAFSSCIIRIPLSRCERYGSCKKSCIASRDPYCGWLSQGSCGRVTPGMLAEGYEQDTEFGNTAHLGDCHGVRWEVQSGESNQMVHMNVLITCVFAAFVLGAFIAGVAVYCYRDMFVRKNRKIHKDAESAQSCTDSSGSFAKLNGLFDSPVKEYQQNIDSPKLYSNLLTSRKELPPNGDTKSMVMDHRGQPPELAALPTPESTPVLHQKTLQAMKSHSEKAHGHGASRKETPQFFPSSPPPHSPLSHGHIPSAIVLPNATHDYNTSFSNSNAHKAEKKLQNIDHPLTKSSSKRDHRRSVDSRNTLNDLLKHLNDPNSNPKAIMGDIQMAHQNLMLDPMGSMSEVPPKVPNREASLYSPPSTLPRNSPTKRVDVPTTPGVPMTSLERQRGYHKNSSQRHSISAMPKNLNSPNGVLLSRQPSMNRGGYMPTPTGAKVDYIQGTPVSVHLQPSLSRQSSYTSNGTLPRTGLKRTPSLKPDVPPKPSFVPQTPSVRPLNKYTY

SEQ ID NO: 35432 - protein, 219 aa, Homo sapiens
  ENSP00000453755
MRVFLLCAYILLLMVSQLRAVSFPEDDEPLNTVDYHYSRQYPVFRGRPSGNESQHRLDFQLMLKIRDTLYIAGRDQVYTVNLNEMPKTEVIPNKKLTWRSRQQDRENCAMKGKHKDECHNFIKVFVPRNDEMVFVCGTNAFNPMCRYYRLSTLEYDGEEISGLARCPFDARQTNVALFADGKLYSATVADFLASDAVIYRSMGDGSALRTIKYDSKWIK

SEQ ID NO: 35433 - protein, 54 aa, Homo sapiens
  ENSP00000453518
  MOD_RES (1)..(1): Any amino acid
XLLTEDFFAFHNHSAEGYEQDTEFGNTAHLGDCHEILPTSTTPDYKIFGGPTSG

SEQ ID NO: 35434 - protein, 198 aa, Homo sapiens
  ENSP00000453689
  MOD_RES (1)..(1): Any amino acid
XLTEDFFAFHNHSAEGYEQDTEFGNTAHLGDCHEILPTSTTPDYKIFGGPTSDMEVSSSSVTTMASIPEITPKVIDTWRPKLTSSRKFVVQDDPNTSDFTDPLSGIPKGVRWEVQSGESNQMVHMNVLITCVFAAFVLGAFIAGVAVYCYRDMFVRKNRKIHKDAESAQSCTDSSGSFAKLNGLFDSPVKEYQQNIDS

SEQ ID NO: 35435 - protein, 597 aa, Homo sapiens; identical to SEQ ID NO: 35426
  ENSP00000348276

SEQ ID NO: 35436 - protein, 501 aa, Homo sapiens
  ENSP00000371535
MNRESFAAGERLVSPAYVRQGCEARRSHEHLIRLLLEKGKCPENGWDESTLELFLHELAIMDSNNFLGNCGVGEREGRVASALVARRHYRFIHGIGRSGDISAVQPKAAGSSLLNKITNSLVLDIIKLAGVHTVANCFVVPMATGMSLTLCFLTLRHKRPKAKYIIWPRIDQKSCFKSMITAGFEPVVIENVLEGDELRTDLKAVEAKVQELGPDCILCIHSTTSCFAPRVPDRLEELAVICANYDIPHIVNNAYGVQSSKCMHLIQQGARVGRIDAFVQSLDKNFMVPVGGAIIAGFNDSFIQEISKMYPGRASASPSLDVLITLLSLGSNGYKKLLKERKEMFSYLSNQIKKLSEAYNERLLHTPHNPISLAMTLKTLDEHRDKAVTQLGSMLFTRQVSGARVVPLGSMQTVSGYTFRGFMSHTNNYPCAYLNAASAIGMKMQDVDLFIKRLDRCLKAVRKERSKESDDNYDKTEDVDIEEMALKLDNVLLDTYQDASS

SEQ ID NO: 35437 - protein, 112 aa, Homo sapiens
  ENSP00000351857
MNRESFAAGERLVSPAYVRQGCEARRSHEHLIRLLLEKSLALSPRLECSVTISAHCSLRLPGSRHSPASASRVAGTTGARHHTRASVQRMAGMKVHLNSFYMNLQSWTATIS

SEQ ID NO: 35438 - protein, 47 aa, Homo sapiens
  ENSP00000421880
MNRESFAAGERLVSPAYVRQGCEARRSHEHLIRLLLEKVHSWHWTIR

SEQ ID NO: 35439 - protein, 95 aa, Homo sapiens
  ENSP00000423850
  MOD_RES (1)..(1): Any amino acid
XKYIIWPRIDQKSCFKSMITAGFEPVVIENVLEGDELRTDLKAVEAKVQELGPDCILCIHSTTSCFAPRVPDRKSFSFTFFRCPYYFIVTWIKWL

SEQ ID NO: 35440 - protein, 177 aa, Homo sapiens [sequence omitted]

SEQ ID NO: 35441 - protein, 331 aa, Homo sapiens
  ENSP00000463768
MVAGESGLGKSTLVNSLFLTDLYRDRKLLGAEERIMQTVEITKHAVDIEEKGVRLRLTIVDTPGFGDAVNNTECWKPVAEYIDQQFEQYFRDESGLNRKNIQDNRVHCCLYFISPFGHGLRPLDVEFMKALHQRVNIVPILAKADTLTPPEVDHKKRKIREEIEHFGIKIYQFPDCDSDEDEDFKLQDQALKESIPFAVIGSNTVVEARGRRVRGRLYPWGIVEVENPGHCDFVKLRTMLVRTHMQDLKDVTRETHYENYRAQCIQSMTRLVVKERNRNKLTRESGTDFPIPAVPPGTDPETEKLIREKDEELRRMQEMLHKIQKQMKENY

SEQ ID NO: 35442 - protein, 274 aa, Homo sapiens
  ENSP00000402348
MIKRFLEDTTDDGELSKFVKDFSGNASCHPPEAKTWASRPQVPEPRPQAPDLYDDDLEFRPPSRPQSSDNQQYFCAPAPLSPSARPRSPWGKLDPYDSSEDDKEYVGFATLPNQVHRKSVKKGFDFTLMVAGESGLGKSTLVNSLFLTDLYRDRKLLGAEERIMQTVEITKHAVDIEEKGVRLRLTIVDTPGFGDAVNNTECWKPVAEYIDQQFEQYFRDESGLNRKNIQDNRVHCCLYFISPFGHGYGPSLRLLAPPGAVKGTGQEHQGQGCH

SEQ ID NO: 35443 - protein, 332 aa, Homo sapiens
  ENSP00000464373
MDRSLGWQGNSVPEDRTEAGDDKEYVGFATLPNQVHRKSVKKGFDFTLMVAGESGLGKSTLVNSLFLTDLYRDRKLLGAEERIMQTVEITKHAVDIEEKGVRLRLTIVDTPGFGDAVNNTECWKPVAEYIDQQFEQYFRDESGLNRKNIQDNRVHCCLYFISPFGHGLRPLDVEFMKALHQRVNIVPILAKADTLTPPEVDHKKRKIREEIEHFGIKIYQFPDCDSDEDEDFKLQDQALKESIPFAVIGSNTVVEARGRRVRGRLYPWGIVEVENPGHCDFVKLRTMLVRTHMQDLKDVTRETHYENYRAQCIQSMTRLVVKERNRKDRSRN

SEQ ID NO: 35444 - protein, 478 aa, Homo sapiens
  ENSP00000321674
MDRSLGWQGNSVPEDRTEAGIKRFLEDTTDDGELSKFVKDFSGNASCHPPEAKTWASRPQVPEPRPQAPDLYDDDLEFRPPSRPQSSDNQQYFCAPAPLSPSARPRSPWGKLDPYDSSEDDKEYVGFATLPNQVHRKSVKKGFDFTLMVAGESGLGKSTLVNSLFLTDLYRDRKLLGAEERIMQTVEITKHAVDIEEKGVRLRLTIVDTPGFGDAVNNTECWKPVAEYIDQQFEQYFRDESGLNRKNIQDNRVHCCLYFISPFGHGLRPLDVEFMKALHQRVNIVPILAKADTLTPPEVDHKKRKIREEIEHFGIKIYQFPDCDSDEDEDFKLQDQALKESIPFAVIGSNTVVEARGRRVRGRLYPWGIVEVENPGHCDFVKLRTMLVRTHMQDLKDVTRETHYENYRAQCIQSMTRLVVKERNRNKLTRESGTDFPIPAVPPGTDPETEKLIREKDEELRRMQEMLHKIQKQMKENY

SEQ ID NO: 35445 - protein, 493 aa, Homo sapiens
  ENSP00000402000
MRSSPALFSSRAAPQKPRKEGSQAAGLLVFSDSLEIKRFLEDTTDDGELSKFVKDFSGNASCHPPEAKTWASRPQVPEPRPQAPDLYDDDLEFRPPSRPQSSDNQQYFCAPAPLSPSARPRSPWGKLDPYDSSEDDKEYVGFATLPNQVHRKSVKKGFDFTLMVAGESGLGKSTLVNSLFLTDLYRDRKLLGAEERIMQTVEITKHAVDIEEKGVRLRLTIVDTPGFGDAVNNTECWKPVAEYIDQQFEQYFRDESGLNRKNIQDNRVHCCLYFISPFGHGLRPLDVEFMKALHQRVNIVPILAKADTLTPPEVDHKKRKIREEIEHFGIKIYQFPDCDSDEDEDFKLQDQALKESIPFAVIGSNTVVEARGRRVRGRLYPWGIVEVENPGHCDFVKLRTMLVRTHMQDLKDVTRETHYENYRAQCIQSMTRLVVKERNRNKLTRESGTDFPIPAVPPGTDPETEKLIREKDEELRRMQEMLHKIQKQMKENY

SEQ ID NO: 35446 - protein, 379 aa, Homo sapiens
  ENSP00000462727
MDRSLGWQGNSVPEDRTEAGDDKEYVGFATLPNQVHRKSVKKGFDFTLMVAGESGLGKSTLVNSLFLTDLYRDRKLLGAEERIMQTVEITKHAVDIEEKGVRLRLTIVDTPGFGDAVNNTECWKPVAEYIDQQFEQYFRDESGLNRKNIQDNRVHCCLYFISPFGHGLRPLDVEFMKALHQRVNIVPILAKADTLTPPEVDHKKRKIREEIEHFGIKIYQFPDCDSDEDEDFKLQDQALKESIPFAVIGSNTVVEARGRRVRGRLYPWGIVEVENPGHCDFVKLRTMLVRTHMQDLKDVTRETHYENYRAQCIQSMTRLVVKERNRNKLTRESGTDFPIPAVPPGTDPETEKLIREKDEELRRMQEMLHKIQKQMKENY

SEQ ID NO: 35447 - protein, 459 aa, Homo sapiens
  ENSP00000321071
MIKRFLEDTTDDGELSKFVKDFSGNASCHPPEAKTWASRPQVPEPRPQAPDLYDDDLEFRPPSRPQSSDNQQYFCAPAPLSPSARPRSPWGKLDPYDSSEDDKEYVGFATLPNQVHRKSVKKGFDFTLMVAGESGLGKSTLVNSLFLTDLYRDRKLLGAEERIMQTVEITKHAVDIEEKGVRLRLTIVDTPGFGDAVNNTECWKPVAEYIDQQFEQYFRDESGLNRKNIQDNRVHCCLYFISPFGHGLRPLDVEFMKALHQRVNIVPILAKADTLTPPEVDHKKRKIREEIEHFGIKIYQFPDCDSDEDEDFKLQDQALKESIPFAVIGSNTVVEARGRRVRGRLYPWGIVEVENPGHCDFVKLRTMLVRTHMQDLKDVTRETHYENYRAQCIQSMTRLVVKERNRNKLTRESGTDFPIPAVPPGTDPETEKLIREKDEELRRMQEMLHKIQKQMKENY

SEQ ID NO: 35448 - protein, 470 aa, Homo sapiens
  ENSP00000414779
MPGFYSVMTDEEIKRFLEDTTDDGELSKFVKDFSGNASCHPPEAKTWASRPQVPEPRPQAPDLYDDDLEFRPPSRPQSSDNQQYFCAPAPLSPSARPRSPWGKLDPYDSSEDDKEYVGFATLPNQVHRKSVKKGFDFTLMVAGESGLGKSTLVNSLFLTDLYRDRKLLGAEERIMQTVEITKHAVDIEEKGVRLRLTIVDTPGFGDAVNNTECWKPVAEYIDQQFEQYFRDESGLNRKNIQDNRVHCCLYFISPFGHGLRPLDVEFMKALHQRVNIVPILAKADTLTPPEVDHKKRKIREEIEHFGIKIYQFPDCDSDEDEDFKLQDQALKESIPFAVIGSNTVVEARGRRVRGRLYPWGIVEVENPGHCDFVKLRTMLVRTHMQDLKDVTRETHYENYRAQCIQSMTRLVVKERNRNKLTRESGTDFPIPAVPPGTDPETEKLIREKDEELRRMQEMLHKIQKQMKENY

SEQ ID NO: 35449 - protein, 175 aa, Homo sapiens
  ENSP00000464382
MDDKEYVGFATLPNQVHRKSVKKGFDFTLMVAGESGLGKSTLVNSLFLTDLYRDRKLLGAEERIMQTVEITKHAVDIEEKGVRLRLTIVDTPGFGDAVNNTECWKPVAEYIDQQFEQYFRDESGLNRKNIQDNRVHCCLYFISPFGHGYGPSLRLLAPPGAVKGTGQEHQGQGCH

SEQ ID NO: 35450 - protein, 207 aa, Homo sapiens
  ENSP00000463671
MGPVPTSFGKRRGGPQTLPASPGGMDDKEYVGFATLPNQVHRKSVKKGFDFTLMVAGESGLGKSTLVNSLFLTDLYRDRKLLGAEERIMQTVEITKHAVDIEEKGVRLRLTIVDTPGFGDAVNNTECWKPVAEYIDQQFEQYFRDESGLNRKNIQDNRVHCCLYFISPFGHGLRPLDVEFMKALHQRVNIVPILAKADTLTPPEVDH

SEQ ID NO: 35451 - protein, 55 aa, Homo sapiens
  ENSP00000462278
MDRSLGWQGNSVPEDRTEAGIKRFLEDTTDDGELSKMTRSMWALQPSPTKSTESP

SEQ ID NO: 35452 - protein, 36 aa, Homo sapiens
  ENSP00000462362
MIKRFLEDTTDDGELSKMTRSMWALQPSPTKSTESP

SEQ ID NO: 35453 - protein, 225 aa, Homo sapiens
  ENSP00000463461
MGPVPTSFGKRRGGPQTLPASPGGMIKRFLEDTTDDGELSKFVKDFSGNASCHPPEAKTWASRPQVPEPRPQAPDLYDDDLEFRPPSRPQSSDNQQYFCAPAPLSPSARPRSPWGKLDPYDSSEDDKEYVGFATLPNQVHRKSVKKGFDFTLMVAGESGLGKSTLVNSLFLTDLYRDRKLLGAEERIMQTVEITKHAVDIEEKGVRLRLTIVDTPGFGDAVNNTE

SEQ ID NO: 35454 - protein, 72 aa, Homo sapiens
  ENSP00000464360
MIKRFLEDTTDDGELSKFVKDFSGNASCHPPEAKTWASRPQVPEPRPQAPDLYDDDLEFRPPSRPQSSDNQQ

SEQ ID NO: 35455 - protein, 459 aa, Homo sapiens; identical to SEQ ID NO: 35447
  ENSP00000376801

SEQ ID NO: 35456 - protein, 77 aa, Homo sapiens
  ENSP00000489466
MSVSARSAAAEERSVNSSTMVAQQKNLEGYVGFANLPNQVYRKSVKRGFEFTLMVVGESGLGKSTLINSLFLTDLYS

SEQ ID NO: 35457 - protein, 76 aa, Homo sapiens
  ENSP00000489044
MSVSARSAAAEERSVNSSTMAQQKNLEGYVGFANLPNQVYRKSVKRGFEFTLMVVGESGLGKSTLINSLFLTDLYS

SEQ ID NO: 35458 - protein, 384 aa, Homo sapiens
  ENSP00000381992
MVVGESGLGKSTLINSLFLTDLYSPEYPGPSHRIKKTVQVEQSKVLIKEGGVQLLLTIVDTPGFGDAVDNSNCWQPVIDYIDSKFEDYLNAESRVNRRQMPDNRVQCCLYFIAPSGHGLKPLDIEFMKRLHEKVNIIPLIAKADTLTPEECQQFKKQIMKEIQEHKIKIYEFPETDDEEENKLVKKIKDRLPLAVVGSNTIIEVNGKRVRGRQYPWGVAEVENGEHCDFTILRNMLIRTHMQDLKDVTNNVHYENYRSRKLAAVTYNGVDNNKNKGQLTKSPLAQMEEERREHVAKMKKMEMEMEQVFEMKVKEKVQKLKDSEAELQRRHEQMKKNLEAQHKELEEKRRQFEDEKANWEAQQRILEQQNSSRTLEKNKKKGKIF

SEQ ID NO: 35459 - protein, 401 aa, Homo sapiens
  ENSP00000413507
MSVSARSAAAEERSVNSSTMGESGLGKSTLINSLFLTDLYSPEYPGPSHRIKKTVQVEQSKVLIKEGGVQLLLTIVDTPGFGDAVDNSNCWQPVIDYIDSKFEDYLNAESRVNRRQMPDNRVQCCLYFIAPSGHGLKPLDIEFMKRLHEKVNIIPLIAKADTLTPEECQQFKKQIMKEIQEHKIKIYEFPETDDEEENKLVKKIKDRLPLAVVGSNTIIEVNGKRVRGRQYPWGVAEVENGEHCDFTILRNMLIRTHMQDLKDVTNNVHYENYRSRKLAAVTYNGVDNNKNKGQLTKSPLAQMEEERREHVAKMKKMEMEMEQVFEMKVKEKVQKLKDSEAELQRRHEQMKKNLEAQHKELEEKRRQFEDEKANWEAQQRILEQQNSSRTLEKNKKKGKIF

SEQ ID NO: 35460 - protein, 147 aa, Homo sapiens
  ENSP00000489538
MVVGESGLGKSTLINSLFLTDLYSPEYPGPSHRIKKTVQVEQSKVLIKEGGVQLLLTIVDTPGFGDAVDNSNCWQPVIDYIDSKFEDYLNAESRVNRRQMPDNRVQCCLYFIAPSGHGLKPLDIEFMKRLHEKVNIIPLIAKADTLT

SEQ ID NO: 35461 - protein, 157 aa, Homo sapiens
  ENSP00000489480
MVVGESGLGKSTLINSLFLTDLYSPEYPGPSHRIKKTVQVEQSKVLIKEGGVQLLLTIVDTPGFGDAVDNSNCWQPVIDYIDSKFEDYLNAESRVNRRQMPDNRVQCCLYFIAPSGHGLKPLDIEFMKRLHEKVNIIPLIAKADTLTPEECQQFKKQ

SEQ ID NO: 35462 - protein, 46 aa, Homo sapiens
  ENSP00000489192
SARSAAAEERSVNSSTMVPLWISSVGIWNTGMMEMCSLQSSSTEEP

SEQ ID NO: 35463 - protein, 111 aa, Homo sapiens
  ENSP00000489596
VTYNGVDNNKNKGQLTKHLMITLNIRDRSPLAQMEEERREHVAKMKKMEMEMEQVFEMKVKEKVQKLKDSEAELQRRHEQMKKNLEAQHKELEEKRRQFEDEKANWEAQQR

SEQ ID NO: 35464 - protein, 437 aa, Homo sapiens
  ENSP00000344868
MSVSARSAAAEERSVNSSTMGQQQKNLEGYVGFANLPNQVYRKSVKRGFEFTLMVVGESGLGKSTLINSLFLTDLYSPEYPGPSHRIKKTVQVEQSKVLIKEGGVQLLLTIVDTPGFGDAVDNSNCWQPVIDYIDSKFEDYLNAESRVNRRQMPDNRVQCCLYFIAPSGHGLKPLDIEFMKRLHEKVNIIPLIAKADTLTPEECQQFKKQIMKEIQEHKIKIYEFPETDDEEENKLVKKIKDRLPLAVVGSNTIIEVNGKRVRGRQYPWGVAEVENGEHCDFTILRNMLIRTHMQDLKDVTNNVHYENYRSRKLAAVTYNGVDNNKNKGQLTKSPLAQMEEERREHVAKMKKMEMEMEQVFEMKVKEKVQKLKDSEAELQRRHEQMKKNLEAQHKELEEKRRQFEDEKANWEAQQRILEQQNSSRTLEKNKKKGKIF

SEQ ID NO: 35465 - protein, 88 aa, Homo sapiens
  ENSP00000444240
MKKMEMEMEQVFEMKVKEKVQKLKDSEAELQRRHEQMKKNLEAQHKELEEKRRQFEDEKANWEAQQRILEQQNSSRTLEKNKKKGKIF

SEQ ID NO: 35466 - protein, 417 aa, Homo sapiens
  ENSP00000381993
MKQQKNLEGYVGFANLPNQVYRKSVKRGFEFTLMVVGESGLGKSTLINSLFLTDLYSPEYPGPSHRIKKTVQVEQSKVLIKEGGVQLLLTIVDTPGFGDAVDNSNCWQPVIDYIDSKFEDYLNAESRVNRRQMPDNRVQCCLYFIAPSGHGLKPLDIEFMKRLHEKVNIIPLIAKADTLTPEECQQFKKQIMKEIQEHKIKIYEFPETDDEEENKLVKKIKDRLPLAVVGSNTIIEVNGKRVRGRQYPWGVAEVENGEHCDFTILRNMLIRTHMQDLKDVTNNVHYENYRSRKLAAVTYNGVDNNKNKGQLTKSPLAQMEEERREHVAKMKKMEMEMEQVFEMKVKEKVQKLKDSEAELQRRHEQMKKNLEAQHKELEEKRRQFEDEKANWEAQQRILEQQNSSRTLEKNKKKGKIF

SEQ ID NO: 35467 - protein, 464 aa, Homo sapiens
  ENSP00000362814
MDGRMMRSMRLREEESPGPSHTASCLCGSAPCILCSCCPASRNSTVSRLIFTFFLFLGVLVSIIMLSPGVESQLYKLPWVCEEGAGIPTVLQGHIDCGSLLGYRAVYRMCFATAAFFFFFTLLMLCVSSSRDPRAAIQNGFWFFKFLILVGLTVGAFYIPDGSFTNIWFYFGVVGSFLFILIQLVLLIDFAHSWNQRWLGKAEECDSRAWYAGLFFFTLLFYLLSIAAVALMFMYYTEPSGCHEGKVFISLNLTFCVCVSIAAVLPKVQDAQPNSGLLQASVITLYTMFVTWSALSSIPEQKCNPHLPTQLGNETVVAGPEGYETQWWDAPSIVGLIIFLLCTLFISLRSSDHRQVNSLMQTEECPPMLDATQQQQQVAACEGRAFDNEQDGVTYSYSFFHFCLVLASLHVMMTLTNWYKPGETRKMISTWTAVWVKICASWAGLLLYLWTLVAPLLLRNRDFS

SEQ ID NO: 35468 - protein, 455 aa, Homo sapiens
  ENSP00000362813
MGACLGACSLLSCASCLCGSAPCILCSCCPASRNSTVSRLIFTFFLFLGVLVSIIMLSPGVESQLYKLPWVCEEGAGIPTVLQGHIDCGSLLGYRAVYRMCFATAAFFFFFTLLMLCVSSSRDPRAAIQNGFWFFKFLILVGLTVGAFYIPDGSFTNIWFYFGVVGSFLFILIQLVLLIDFAHSWNQRWLGKAEECDSRAWYAGLFFFTLLFYLLSIAAVALMFMYYTEPSGCHEGKVFISLNLTFCVCVSIAAVLPKVQDAQPNSGLLQASVITLYTMFVTWSALSSIPEQKCNPHLPTQLGNETVVAGPEGYETQWWDAPSIVGLIIFLLCTLFISLRSSDHRQVNSLMQTEECPPMLDATQQQQQVAACEGRAFDNEQDGVTYSYSFFHFCLVLASLHVMMTLTNWYKPGETRKMISTWTAVWVKICASWAGLLLYLWTLVAPLLLRNRDFS

SEQ ID NO: 35469 - protein, 459 aa, Homo sapiens
  ENSP00000439048
MGAEGAPDFLSCPRVRRASCLCGSAPCILCSCCPASRNSTVSRLIFTFFLFLGVLVSIIMLSPGVESQLYKLPWVCEEGAGIPTVLQGHIDCGSLLGYRAVYRMCFATAAFFFFFTLLMLCVSSSRDPRAAIQNGFWFFKFLILVGLTVGAFYIPDGSFTNIWFYFGVVGSFLFILIQLVLLIDFAHSWNQRWLGKAEECDSRAWYAGLFFFTLLFYLLSIAAVALMFMYYTEPSGCHEGKVFISLNLTFCVCVSIAAVLPKVQDAQPNSGLLQASVITLYTMFVTWSALSSIPEQKCNPHLPTQLGNETVVAGPEGYETQWWDAPSIVGLIIFLLCTLFISLRSSDHRQVNSLMQTEECPPMLDATQQQQQVAACEGRAFDNEQDGVTYSYSFFHFCLVLASLHVMMTLTNWYKPGETRKMISTWTAVWVKICASWAGLLLYLWTLVAPLLLRNRDFS

SEQ ID NO: 35470 - protein, 459 aa, Homo sapiens
  ENSP00000444307
MRSMRLREEESPGPSHTASCLCGSAPCILCSCCPASRNSTVSRLIFTFFLFLGVLVSIIMLSPGVESQLYKLPWVCEEGAGIPTVLQGHIDCGSLLGYRAVYRMCFATAAFFFFFTLLMLCVSSSRDPRAAIQNGFWFFKFLILVGLTVGAFYIPDGSFTNIWFYFGVVGSFLFILIQLVLLIDFAHSWNQRWLGKAEECDSRAWYAGLFFFTLLFYLLSIAAVALMFMYYTEPSGCHEGKVFISLNLTFCVCVSIAAVLPKVQDAQPNSGLLQASVITLYTMFVTWSALSSIPEQKCNPHLPTQLGNETVVAGPEGYETQWWDAPSIVGLIIFLLCTLFISLRSSDHRQVNSLMQTEECPPMLDATQQQQQVAACEGRAFDNEQDGVTYSYSFFHFCLVLASLHVMMTLTNWYKPGETRKMISTWTAVWVKICASWAGLLLYLWTLVAPLLLRNRDFS

SEQ ID NO: 35471 - protein, 66 aa, Homo sapiens
  ENSP00000420076
MVAKQRIRMANEKHSKNITQRGNVAKTSRNAPEEKASVGPWLLALFIFVVCGSAIFQIIQSIRMGM

SEQ ID NO: 35472 - protein, 55 aa, Homo sapiens
  ENSP00000420002
MVAKQRIRMANEKHSKNITQRGNVAKTSQFSRLFKVSGWACEVTDLKMFPFSCEF

SEQ ID NO: 35473 - protein, 78 aa, Homo sapiens
  ENSP00000419472
MVAKQRIRMANEKHSKNITQRGNVAKTSRNAPEEKASVGPWLLALFIFVVCGSGKWLGGSHQVESWVERIWDDVVTGQ

SEQ ID NO: 35474 - protein, 66 aa, Homo sapiens; identical to SEQ ID NO: 35471
  ENSP00000239944

SEQ ID NO: 35475 - protein, 379 aa, Homo sapiens
  ENSP00000370115
MEQLSSANTRFALDLFLALSENNPAGNIFISPFSISSAMAMVFLGTRGNTAAQLSKTFHFNTVEEVHSRFQSLNADINKRGASYILKLANRLYGEKTYNFLPEFLVSTQKTYGADLASVDFQHASEDARKTINQWVKGQTEGKIPELLASGMVDNMTKLVLVNAIYFKGNWKDKFMKEATTNAPFRLNKKDRKTVKMMYQKKKFAYGYIEDLKCRVLELPYQGEELSMVILLPDDIEDESTGLKKIEEQLTLEKLHEWTKPENLDFIEVNVSLPRFKLEESYTLNSDLARLGVQDLFNSSKADLSGMSGARDIFISKIVHKSFVEVNEEGTEAAAATAGIATFCMLMPEENFTADHPFLFFIRHNSSGSILFLGRFSSP

SEQ ID NO: 35476 - protein, 397 aa, Homo sapiens
  ENSP00000386412
MNWHLPLFLLASVTLPSICSHFNPLSLEELGSNTGIQVFNQIVKSRPHDNIVISPHGIASVLGMLQLGADGRTKKQLAMVMRYGVNGVGKILKKINKAIVSKKNKDIVTVANAVFVKNASEIEVPFVTRNKDVFQCEVRNVNFEDPASACDSINAWVKNETRDMIDNLLSPDLIDGVLTRLVLVNAVYFKGLWKSRFQPENTKKRTFVAADGKSYQVPMLAQLSVFRCGSTSAPNDLWYNFIELPYHGESISMLIALPTESSTPLSAIIPHISTKTIDSWMSIMVPKRVQVILPKFTAVAQTDLKEPLKVLGITDMFDSSKANFAKITRSENLHVSHILQKAKIEVSEDGTKASAATTAILIARSSPPWFIVDRPFLFFIRHNPTGAVLFMGQINKP

SEQ ID NO: 35477 - protein, 398 aa, Homo sapiens
  ENSP00000258405
MNWHLPLFLLASVTLPSICSHFNPLSLEELGSNTGIQVFNQIVKSRPHDNIVISPHGIASVLGMLQLGADGRTKKQLAMVMRYGVNGVGKILKKINKAIVSKKNKDIVTVANAVFVKNASEIEVPFVTRNKDVFQCEVRNVNFEDPASACDSINAWVKNETRDMIDNLLSPDLIDGVLTRLVLVNAVYFKGLWKSRFQPENTKKRTFVAADGKSYQVPMLAQLSVFRCGSTSAPNDLWYNFIELPYHGESISMLIALPTESSTPLSAIIPHISTKTIDSWMSIMVPKRVQVILPKFTAVAQTDLKEPLKVLGITDMFDSSKANFAKITTGSENLHVSHILQKAKIEVSEDGTKASAATTAILIARSSPPWFIVDRPFLFFIRHNPTGAVLFMGQINKP

SEQ ID NO: 35478 - protein, 397 aa, Homo sapiens; identical to SEQ ID NO: 35476
  ENSP00000386969

SEQ ID NO: 35479 - protein, 409 aa, Homo sapiens
  ENSP00000415786
MSDCRSSLVEGTMNWHLPLFLLASVTLPSICSHFNPLSLEELGSNTGIQVFNQIVKSRPHDNIVISPHGIASVLGMLQLGADGRTKKQLAMVMRYGVNGVGKILKKINKAIVSKKNKDIVTVANAVFVKNASEIEVPFVTRNKDVFQCEVRNVNFEDPASACDSINAWVKNETRDMIDNLLSPDLIDGVLTRLVLVNAVYFKGLWKSRFQPENTKKRTFVAADGKSYQVPMLAQLSVFRCGSTSAPNDLWYNFIELPYHGESISMLIALPTESSTPLSAIIPHISTKTIDSWMSIMVPKRVQVILPKFTAVAQTDLKEPLKVLGITDMFDSSKANFAKITRSENLHVSHILQKAKIEVSEDGTKASAATTAILIARSSPPWFIVDRPFLFFIRHNPTGAVLFMGQINKP

SEQ ID NO: 35480 - protein, 275 aa, Homo sapiens
  ENSP00000408452
MNWHLPLFLLASVTLPSICSHFNPLSLEELGSNTGIQVFNQIVKSRPHDNIVISPHGIASVLGMLQLGADGRTKKQLAMVMRYGVNGVGKILKKINKAIVSKKNKDIVTVANAVFVKNASEIEVPFVTRNKDVFQCEVRNVNFEDPASACDSINAWVKNETRDMIDNLLSPDLIDGVLTRLVLVNAVYFKGLWKSRFQPENTKKRTFVAADGKSYQVPMLAQLSVFRCGSTSAPNDLWYNFIELPYHGESISMLIALPTESSTPLSAIIPHISTK

SEQ ID NO: 35481 - protein, 86 aa, Homo sapiens
  ENSP00000399655
MNWHLPLFLLASVTLPSICSHFNPLSLEELGSNTGIQVFNQIVKSRPHDNIVISPHGIASVLGMLQLGADGRTKKQLAMVMRYGVN

SEQ ID NO: 35482 - protein, 42 aa, Homo sapiens
  ENSP00000394518
MNWHLPLFLLASVTLPSICSHFNPLSLEELGSNTGIQVFNQI

SEQ ID NO: 35483 - protein, 418 aa, Homo sapiens
  ENSP00000434657
MRSLLLLSAFCLLEAALAAEVKKPAAAAAPGTAEKLSPKAATLAERSAGLAFSLYQAMAKDQAVENILVSPVVVASSLGLVSLGGKATTASQAKAVLSAEQLRDEEVHAGLGELLRSLSNSTARNVTWKLGSRLYGPSSVSFADDFVRSSKQHYNCEHSKINFRDKRSALQSINEWAAQTTDGKLPEVTKDVERTDGALLVNAMFFKPHWDEKFHHKMVDNRGFMVTRSYTVGVMMMHRTGLYNYYDDEKEKLQIVEMPLAHKLSSLIILMPHHVEPLERLEKLLTKEQLKIWMGKMQKKAVAISLPKGVVEVTHDLQKHLAGLGLTEAIDKNKADLSRMSGKKDLYLASVFHATAFELDTDGNPFDQDIYGREELRSPKLFYADHPFIFLVRDTQSGSLLFIGRLVRPKGDKMRDEL

SEQ ID NO: 35484 - protein, 418 aa, Homo sapiens; identical to SEQ ID NO: 35483
  ENSP00000350894

SEQ ID NO: 35485 - protein, 85 aa, Homo sapiens
  ENSP00000431384
MRSLLLLSAFCLLEAATLAERSAGLAFSLYQAMAKDQAVENILVSPVVVASSLGLVSLGGKATTASQAKAVLSAEQLRDEEVHAG

SEQ ID NO: 35486 - protein, 249 aa, Homo sapiens
  ENSP00000434964
MRSLLLLSAFCLLEAALAAEVKKPAAAAAPGTAEKLSPKAATLAERSAGLAFSLYQAMAKDQAVENILVSPVVVASSLGLVSLGGKATTASQAKAVLSAEQLRDEEVHAGLGELLRSLSNSTARNVTWKLGSRLYGPSSVSFADDFVRSSKQHYNCEHSKINFRDKRSALQSINEWAAQTTDGKLPEVTKDVERTDGALLVNAMFFKPHWDEKFHHKMVDNRGFMVTRSYTVGVMMMHRTGLYNYYDDE

SEQ ID NO: 35487 - protein, 166 aa, Homo sapiens
  ENSP00000435936
MRSLLLLSAFCLLEAALAAEVKKPAAAAAPGTAEKLSPKAATLAERSAGLAFSLYQAMAKDQAVENILVSPVVVASSLGLVSLGGKATTASQAKAVLSAEQLRDEEVHAGLGELLRSLSNSTARNVTWKLGSRLYGPSSVSFADDFVRSSKQHYNCEHSKINFRDK

SEQ ID NO: 35488 - protein, 142 aa, Homo sapiens
  ENSP00000434482
MRSLLLLSAFCLLEAALAAEVKKPAAAAAPGTAEKLSPKATTASQAKAVLSAEQLRDEEVHAGLGELLRSLSNSTARNVTWKLGSRLYGPSSVSFADDFVRSSKQHYNCEHSKINFRDKRSALQSINEWAAQTTDGKLPEVT

SEQ ID NO: 35489 - protein, 324 aa, Homo sapiens
  ENSP00000436305
MRSLLLLSAFCLLEAALAAEVKKPAAAAAPGTAEKLSPKAATLAERSAGLAFSLYQAMAKDQAVENILVSPVVVASSLGLVSLGGKATTASQAKAVLSAEQLRDEEVHAGLGELLRSLSNSTARNVTWKLGSRLYGPSSVSFADDFVRSSKQHYNCEHSKINFRDKRSALQSINEWAAQTTDGKLPEVTKDVERTDGALLVNAMFFKPHWDEKFHHKMVDNRGFMVTRSYTVGVMMMHRTGLYNYYDDEKEKLQIVEMPLAHKLSSLIILMPHHVEPLERLEKLLTKEQLKIWMGKMQKKAVAISLPKGVVEVTHDLQVRGGPA

SEQ ID NO: 35490 - protein, 295 aa, Homo sapiens
  ENSP00000436040
MRSLLLLSAFCLLEAALAAEVKKPAAAAAPGTAEKLSPKAATLAERSAGLAFSLYQAMAKDQAVENILVSPVVVASSLGLVSLGGKATTASQAKAVLSAEQLRDEEVHAGLGELLRSLSNSTARNVTWKLGSRLYGPSSVSFADDFVRSSKQHYNCEHSKINFRDKRSALQSINEWAAQTTDGKLPEVTKDVERTDGALLVNAMFFKPHWDEKFHHKMVDNRGFMVTRSYTVGVMMMHRTGLYNYYDDEKEKLQIVEMPLAHKLSSLIILMPHHVEPLERLEKLLTKEQLKIWMG

SEQ ID NO: 35491 - protein, 418 aa, Homo sapiens; identical to SEQ ID NO: 35483
  ENSP00000434412

SEQ ID NO: 35492 - protein, 165 aa, Homo sapiens
  ENSP00000432007
MRSLLLLSAFCLLEAALAAEVKKPAAAAAPGTAEKLSPKAATLAERSAGLAFSLYQAMAKDQAVENILVSPVVVASSLGLVSLGGKATTASQAKAVLSAEQLRDEEVHAGLGELLRSLSNSTARNVTWKLGSRLYGPSSVSFADDFVRSSKQHYNCEHSKINFRD

SEQ ID NO: 35493 - protein, 150 aa, Homo sapiens
  ENSP00000431827
MRSLLLLSAFCLLEAALAAEVKKPAAAAAPGTAEKLSPKAATLAERSAGLAFSLYQAMAKDQAVENILVSPVVVASSLGLVSLGGKATTASQAKAVLSAEQLRDEEVHAGLGELLRSLSNSTARNVTWKLGSRLYGPSSVSFADDFVRSS

SEQ ID NO: 35494 - protein, 247 aa, Homo sapiens
  ENSP00000435452
MRSLLLLSAFCLLEAALAAEVKKPAAAAAPGTAEKLSPKAATLAERSAGLAFSLYQAMAKDQAVENILVSPVVVASSLGLVSLGGKATTASQAKAVLSAEQLRDEEVHAGLGELLRSLSNSTARNVTWKLGSRLYGPSSVSFADDFVRSSKQHYNCEHSKINFRDKRSALQSINEWAAQTTDGKLPEVTKDVERTDGALLVNAMFFKPHWDEKFHHKMVDNRGFMVTRSYTVGVMMMHRTGLYNYYD

SEQ ID NO: 35495 - protein, 203 aa, Homo sapiens
  ENSP00000437108
MRSLLLLSAFCLLEAALAAEVKKPAAAAAPGTAEKLSPKAATLAERSAGLAFSLYQAMAKDQAVENILVSPVVVASSLGLVSLGGKATTASQAKAVLSAEQLRDEEVHAGLGELLRSLSNSTARNVTWKLGSRLYGPSSVSFADDFVRSSKQHYNCEHSKINFRDKRSALQSINEWAAQTTDGKLPEVTKDVERTDGALLVNA

SEQ ID NO: 35496 - protein, 201 aa, Homo sapiens
  ENSP00000433532
MVDNRGFMVTRSYTVGVMMMHRTGLYNYYDDEKEKLQIVEMPLAHKLSSLIILMPHHVEPLERLEKLLTKEQLKIWMGKMQKKAVAISLPKGVVEVTHDLQKHLAGLGLTEAIDKNKADLSRMSGKKDLYLASVFHATAFELDTDGNPFDQDIYGREELRSPKLFYADHPFIFLVRDTQSGSLLFIGRLVRPKGDKMRDEL

SEQ ID NO: 35497 - protein, 56 aa, Homo sapiens
  ENSP00000436306
  MOD_RES (1)..(1): Any amino acid
XNPFDQDIYGREELRSPKLFYADHPFIFLVRDTQSGSLLFIGRLVRPKGDKMRDEL

SEQ ID NO: 35498 - protein, 160 aa, Homo sapiens
  ENSP00000420133
MAFLGLFSLLVLQSMATGATFPEEAIADLSVNMYNRLRATGEDENILFSPLSIALAMGMMELGAQGSTQKEIRHSMGYDSLKNGEEFSFLKEFSNMVTAKESQYVMKIANSLFVQNGFHVNEEFLQMMKKYFNAAVNHVDFSQNVAVANYINKWVENNTN

SEQ ID NO: 35499 - protein, 410 aa, Homo sapiens
  ENSP00000397373
MAFLGLFSLLVLQSMATGATFPEEAIADLSVNMYNRLRATGEDENILFSPLSIALAMGMMELGAQGSTQKEIRHSMGYDSLKNGEEFSFLKEFSNMVTAKESQYVMKIANSLFVQNGFHVNEEFLQMMKKYFNAAVNHVDFSQNVAVANYINKWVENNTNNLVKDLVSPRDFDAATYLALINAVYFKGNWKSQFRPENTRTFSFTKDDESEVQIPMMYQQGEFYYGEFSDGSNEAGGIYQVLEIPYEGDEISMMLVLSRQEVPLATLEPLVKAQLVEEWANSVKKQKVEVYLPRFTVEQEIDLKDVLKALGITEIFIKDANLTGLSDNKEIFLSKAIHKSFLEVNEEGSEAAAVSGMIAISRMAVLYPQVIVDHPFFFLIRNRRTGTILFMGRVMHPETMNTSGHDFEEL

SEQ ID NO: 35500 - protein, 410 aa, Homo sapiens; identical to SEQ ID NO: 35499
  ENSP00000295777

SEQ ID NO: 35501 - protein, 245 aa, Homo sapiens
  ENSP00000420561
MAFLGLFSLLVLQSMATGATFPEEAIADLSVNMYNRLRATGEDENILFSPLSIALAMGMMELGAQGSTQKEIRHSMGYDSLKNGEEFSFLKEFSNMVTAKESQYVMKIANSLFVQNGFHVNEEFLQMMKKYFNAAVNHVDFSQNVAVANYINKWVENNTNNLVKDLVSPRDFDAATYLALINAVYFKGNWKSQFRPENTRTFSFTKDDESEVQIPMMYQQGEFYYGEFSDGSNEAGGIYQVLEIP

SEQ ID NO: 35502 - protein, 119 aa, Homo sapiens
  ENSP00000420807
  MOD_RES (1)..(1): Any amino acid
XSRFTVEQEIDLKDVLKALGITEIFIKDANLTGLSDNKEIFLSKAIHKSFLEVNEEGSEAAAVSGMIAISRMAVLYPQVIVDHPFFFLIRNRRTGTILFMGRVMHPETMNTSGHDFEEL

SEQ ID NO: 35503 - protein, 405 aa, Homo sapiens
  ENSP00000420621
MDTIFLWSLLLLFFGSQASRCSAQKNTEFAVDLYQEVSLSHKDNIIFSPLGITLVLEMVQLGAKGKAQQQIRQTLKQQETSAGEEFFVLKSFFSAISEKKQEFTFNLANALYLQEGFTVKEQYLHGNKEFFQSAIKLVDFQDAKACAEMISTWVERKTDGKIKDMFSGEEFGPLTRLVLVNAIYFKGDWKQKFRKEDTQLINFTKKNGSTVKIPMMKALLRTKYGYFSESSLNYQVLELSYKGDEFSLIIILPAEGMDIEEVEKLITAQQILKWLSEMQEEEVEISLPRFKVEQKVDFKDVLYSLNITEIFSGGCDLSGITDSSEVYVSQVTQKVFFEINEDGSEAATSTGIHIPVIMSLAQSQFIANHPFLFIMKHNPTESILFMGRVTNPDTQEIKGRDLDSL

SEQ ID NO: 35504 - protein, 405 aa, Homo sapiens; identical to SEQ ID NO: 35503
  ENSP00000417692

SEQ ID NO: 35505 - protein, 405 aa, Homo sapiens; identical to SEQ ID NO: 35503
  ENSP00000419407

SEQ ID NO: 35506 - protein, 206 aa, Homo sapiens
  ENSP00000417752
MDTIFLWSLLLLFFGSQASRCSAQKNTEFAVDLYQEVSLSHKDNIIFSPLGITLVLEMVQLGAKGKAQQQIRQTLKQQETSAGEEFFVLKSFFSAISEKKQEFTFNLANALYLQEGFTVKEQYLHGNKEFFQSAIKLVDFQDAKACAEMISTWVERKTDGKIKDMFSGEEFGPLTRLVLVNAIYFKGDWKQKFRKEDTQLINFTKK

SEQ ID NO: 35507 - protein, 157 aa, Homo sapiens
  ENSP00000419255
MDTIFLWSLLLLFFGSQASRCSAQKNTEFAVDLYQEVSLSHKDNIIFSPLGITLVLEMVQLGAKGKAQQQIRQTLKQQETSAEKKQEFTFNLANALYLQEGFTVKEQYLHGNKEFFQSAIKLVDFQDAKACAEMISTWVERKTDGKIKDMFSGEEFG

SEQ ID NO: 35508 - protein, 405 aa, Homo sapiens; identical to SEQ ID NO: 35503
  ENSP00000264677

SEQ ID NO: 35509 - protein, 415 aa, Homo sapiens
  ENSP00000481699
MIQNLMREVKMDTIFLWSLLLLFFGSQASRCSAQKNTEFAVDLYQEVSLSHKDNIIFSPLGITLVLEMVQLGAKGKAQQQIRQTLKQQETSAGEEFFVLKSFFSAISEKKQEFTFNLANALYLQEGFTVKEQYLHGNKEFFQSAIKLVDFQDAKACAEMISTWVERKTDGKIKDMFSGEEFGPLTRLVLVNAIYFKGDWKQKFRKEDTQLINFTKKNGSTVKIPMMKALLRTKYGYFSESSLNYQVLELSYKGDEFSLIIILPAEGMDIEEVEKLITAQQILKWLSEMQEEEVEISLPRFKVEQKVDFKDVLYSLNITEIFSGGCDLSGITDSSEVYVSQVTQKVFFEINEDGSEAATSTGIHIPVIMSLAQSQFIANHPFLFIMKHNPTESILFMGRVTNPDTQEIKGRDLDSL

SEQ ID NO: 35510 - protein, 107 aa, Homo sapiens
  ENSP00000325776
MSEPDTSSGFSGSVENGTFLELFPTSLSTSVDPSSGHLSNVYIYVSIFLSLLAFLLLLLIIALQRLKNIISSSSSYPEYPSDAGSSFTNLEVCSISSQRSTFSNLSS

SEQ ID NO: 35511 - protein, 696 aa, Homo sapiens
  ENSP00000415332
MEASVILPILKKKLAFLSGGKDRRSGLILTIPLCLEQTNMDELSVTLDYLLSIPSEKCKARGFTVIVDGRKSQWNVVKTVVVMLQNVVPAEVSLVCVVKPDEFWDKKVTHFCFWKEKDRLGFEVILVSANKLTRYIEPCQLTEDFGGSLTYDHMDWLNKRLVFEKFTKESTSLLDELALINNGSDKGNQQEKERSVDLNFLPSVDPETVLQTGHELLSELQQRRFNGSDGGVSWSPMDDELLAQPQVMKLLDSLREQYTRYQEVCRQRSKRTQLEEIQQKVMQVVNWLEGPGSEQLRAQWGIGDSIRASQALQQKHEEIESQHSEWFAVYVELNQQIAALLNAGDEEDLVELKSLQQQLSDVCYRQASQLEFRQNLLQAALEFHGVAQDLSQQLDGLLGMLCVDVAPADGASIQQTLKLLEEKLKSVDVGLQGLREKGQGLLDQISNQASWAYGKDVTIENKENVDHIQGVMEDMQLRKQRCEDMVDVRRLKMLQMVQLFKCEEDAAQAVEWLSELLDALLKTHIRLGDDAQETKVLLEKHRKFVDVAQSTYDYGRQLLQATVVLCQSLRCTSRSSGDTLPRLNRVWKQFTIASEERVHRLEMAIAFHSNAEKILQDCPEEPEAINDEEQFDEIEAVGKSLLDRLTVPVVYPDGTEQYFGSPSDMASTAENIRDRMKLVNLKRQQLRHPEMVTTES

SEQ ID NO: 35512 - protein, 210 aa, Homo sapiens
  ENSP00000410632
  MOD_RES (1)..(1): Any amino acid
XQQQLSDVCYRQASQLEFRQNLLQAALEFHGVAQDLSQQLDGLLGMLCVDVAPADGASIQQTLKLLEEKLKSVDVGLQGLREKGQGLLDQISNQASWAYGKDVTIENKENVDHIQGVMEDMQLRKQRCEDMVDVRRLKMLQMVQLFKCEEDAAQAVEWLSELLDALLKTHIRLGDDAQETKVLLEKHRKFVDVAQVQNWLSSFSTSSVFE

SEQ ID NO: 35513 - protein, 106 aa, Homo sapiens
  ENSP00000334183
  MOD_RES (1)..(1): Any amino acid
XTKESTSLLDELALINNGSDKGNQQEKERSVDLNFLPSVDPETVLQTGHELLSELQQRRFNGSDGGVSWSPMDDELLAQPQVMKLLDSLREQYTRYQEVCREAEKC

SEQ ID NO: 35514 - protein, 225 aa, Homo sapiens
  ENSP00000391000
RSVDLNFLPSVDPETVLQTGHELLSELQQRRFNGSDGGVSWSPMDDELLAQPQVMKLLDSLREQYTRYQEVCRQRSKRTQLEEIQQKVMQVVNWLEGPGSEQLRAQWGIGDSIRASQALQQKHEEIESQHSEWFAVYVELNQQIAALLNAGDEEDLVELKSLQQQLSDVCYRQASQLEFRQNLLQAALEFHGVAQDMWDCKVCVKKVKVSWIRSPIRHPGPMERM

SEQ ID NO: 35515 - protein, 146 aa, Homo sapiens
  ENSP00000416164
MEASVILPILKKKLAFLSGGKDRRSGLILTIPLCLEQTNMDELSVTLDYLLSIPSEKCKARGFTVIVDGRKSQWNVVKTVVVMLQNVVPAEVSLVCVVKPDEFWDKKVTHFCFWKEKDRLGFEVILVSANKLTRYIEPCQLTEDFG

SEQ ID NO: 35516 - protein, 143 aa, Homo sapiens
  ENSP00000410286
MEASVILPILKKKLAFLSGGKDRRSGLILTIPLCLEQTNMDELSVTLDYLLSIPSEKCKARGFTVIVDGRKSQWNVVKTVVVMLQNVVPAEVSLVCVVKPDEFWDKKVTHFCFWKEKDRLGFEVILVSANKLTRYIEPCQLTE

SEQ ID NO: 35517 - protein, 93 aa, Homo sapiens
  ENSP00000387517
MEASVILPILKKKLAFLSGGKDRRSGLILTIPLCLEQTNMDELSVTLDYLLSIPSEKCKARGFTVIVDGRKSQWNVVKTVVVMLQMSCLGLAV

SEQ ID NO: 35518 - protein, 242 aa, Homo sapiens
  ENSP00000390687
MESRETLSSSRQRGGESDFLPVSSAKPPAAPGCAGEPLLSTPGPGKGIPVGGERMEPEEEDELGSGRDVDSNSNADSEKWVAGDGLEEQEFSIKEANFTEGSLKLKIQTTKRAKKPPKNLENYICPPEIKITIKQSGDQKVSRAGKNSKATKEEERSHSKKKLLTASDLAASDLKGFQPQIKDSSKEEVWKRRGGQGIPFKKQFLSQERAMCFSCPRNPFPAKPGSLTLPFHSEPAVWAQEV

SEQ ID NO: 35519 - protein, 1596 aa, Homo sapiens
  ENSP00000282030
MESRETLSSSRQRGGESDFLPVSSAKPPAAPGCAGEPLLSTPGPGKGIPVGGERMEPEEEDELGSGRDVDSNSNADSEKWVAGDGLEEQEFSIKEANFTEGSLKLKIQTTKRAKKPPKNLENYICPPEIKITIKQSGDQKVSRAGKNSKATKEEERSHSKKKLLTASDLAASDLKGFQPQAYERPQKHSTLHYDTGLPQDFTGDTLKPKHQQKSSSQNHMDWSTNSDSGPVTQNCFISPESGRETASTSKIPALEPVASFAKAQGKKGSAGNTWSQLSNNNKDLLLGGVAPSPSSHSSPAPPSSSAECNGLQPLVDQDGGGTKEPPEPPTVGSKKKSSKKDVISQTIPNPDLDWVKNAQKAFDNTEGKREGYSADSAQEASPARQNVSSASNPENDSSHVRITIPIKAPSLDPTNHKRKKRQSIKAVVEKIMPEKALASGITMSSEVVNRILSNSEGNKKDPRVPKLSKMIENESPSVGLETGGNAEKVIPGGVSKPRKPPMVMTPPTCTDHSPSRKLPEIQHPKFAAKRRWTCSKPKPSTMLREAVMATSDKLMLEPPSAYPITPSSPLYTNTDSLTVITPVKKKRGRPKKQPLLTVETIHEGTSTSPVSPISREFPGTKKRKRRRNLAKLAQLVPGEDKPMSEMKFHKKVGKLGVLDKKTIKTINKMKTLKRKNILNQILSCSSSVALKAKAPPETSPGAAAIESKLGKQINVSKRGTIYIGKKRGRKPRAELPPPSEEPKTAIKHPRPVSSQPDVPAVPSNFQSLVASSPAAMHPLSTQLGGSNGNLSPASTETNFSELKTMPNLQPISALPTKTQKGIHSGTWKLSPPRLMANSPSHLCEIGSLKEITLSPVSESHSEETIPSDSGIGTDNNSTSDQAEKSSESRRRYSFDFCSLDNPEAIPSDTSTKNRHGHRQKHLIVDNFLAHESLKKPKHKRKRKSLQNRDDLQFLADLEELITKFQVFRISHRSYTFYHENPYPSIFRINFDHYYPVPYIQYDPLLYLRRTSDLKSKKKRGRPAKTNDTMTKVPFLQGFSYPIPSGSYYAPYGMPYTSMPMMNLGYYGQYPAPLYLSHTLGAASPFMRPTVPPPQFHTNSHVKMSGAAKHKAKHGVHLQGPVSMGLGDMQPSLNPPKVGSASLSSGRLHKRKHKHKHKHKEDRILGTHDNLSGLFAGKATGFSSHILSERLSSADKELPLVSEKNKHKEKQKHQHSEAGHKASKNNFEVDTLSTLSLSDAQHWTQAKEKGDLSSEPVDSCTKRYSGSGGDGGSTRSENLDVFSEMNPSNDKWDSDVSGSKRRSYEGFGTYREKDIQAFKMNRKERSSYDSSMSPGMPSPHLKVDQTAVHSKNEGSVPTMMTRKKPAAVDSVTIPPAPVLSLLAASAATSDAVGSSLKKRFKRREIEAIQCEVRKMCNYTKILSTKKNLDHVNKILKAKRLQRQSKTGNNFVKKRRGRPRKQPTQFDEDSRDQMPVLEKCIDLPSKRGQKPSLSPLVLEPAASQDTIMATIEAVIHMAREAPPLPPPPPPPLPPPPPPPLPPPPPLPKTPRGGKRKHKPQAPAQPPQQSPPQQPLPQEEEVKAKRQRKSRGSESEVLP

SEQ ID NO: 35520 - protein, 137 aa, Homo sapiens
  ENSP00000468506
MESRETLSSSRQRGGESDFLPVSSAKPPAAPGCAGEPLLSTPGPGKGIPVGGERMEPEEEDELGSGRDVDSNSNADSEKWVAGDGLEEQEFSIKEANFTEGSLKLKIQTTKRAKKPPKNLENYICPPEIKITIKQSG

SEQ ID NO: 35521 - protein, 809 aa, Homo sapiens
  ENSP00000319215
MGTPRAQHPPPPQLLFLILLSCPWIQGLPLKEEEILPEPGSETPTVASEALAELLHGALLRRGPEMGYLPGSDRDPTLATPPAGQTLAVPSLPRATEPGTGPLTTAVTPNGVRGAGPTAPELLTPPPGTTAPPPPSPASPGPPLGPEGGEEETTTTIITTTTVTTTVTSPAYLLSCGFPPRPAHGDVSVTDLHPGGTATFHCDSGYQLQGEETLICLNGTRPSWNGETPSCMASCGGTIHNATLGRIVSPEPGGAVGPNLTCRWVIEAAEGRRLHLHFERVSLDEDNDRLMVRSGGSPLSPVIYDSDMDDVPERGLISDAQSLYVELLSETPANPLLLSLRFEAFEEDRCFAPFLAHGNVTTTDPEYRPGALATFSCLPGYALEPPGPPNAIECVDPTEPHWNDTEPACKAMCGGELSEPAGVVLSPDWPQSYSPGQDCVWGVHVQEEKRILLQVEILNVREGDMLTLFDGDGPSARVLAQLRGPQPRRRLLSSGPDLTLQFQAPPGPPNPGLGQGFVLHFKEVPRNDTCPELPPPEWGWRTASHGDLIRGTVLTYQCEPGYELLGSDILTCQWDLSWSAAPPACQKIMTCADPGEIANGHRTASDAGFPVGSHVQYRCLPGYSLEGAAMLTCYSRDTGTPKWSDRVPKCALKYEPCLNPGVPENGYQTLYKHHYQAGESLRFFCYEGFELIGEVTITCVPGHPSQWTSQPPLCKVAYEELLDNRKLEVTQTTDPSRQLEGGNLALAILLPLGLVIVLGSGVYIYYTKLQGKSLFGFSGSHSYSPITVESDFSNPLYEAGDTREYEVSI

SEQ ID NO: 35522 - protein, 853 aa, Homo sapiens
  ENSP00000310206
MGTPRAQHPPPPQLLFLILLSCPWIQGLPLKEEEILPEPGSETPTVASEALAELLHGALLRRGPEMGYLPGPPLGPEGGEEETTTTIITTTTVTTTVTSPVLCNNNISEGEGYVESPDLGSPVSRTLGLLDCTYSIHVYPGYGIEIQVQTLNLSQEEELLVLAGGGSPGLAPRLLANSSMLGEGQVLRSPTNRLLLHFQSPRVPRGGGFRIHYQAYLLSCGFPPRPAHGDVSVTDLHPGGTATFHCDSGYQLQGEETLICLNGTRPSWNGETPSCMASCGGTIHNATLGRIVSPEPGGAVGPNLTCRWVIEAAEGRRLHLHFERVSLDEDNDRLMVRSGGSPLSPVIYDSDMDDVPERGLISDAQSLYVELLSETPANPLLLSLRFEAFEEDRCFAPFLAHGNVTTTDPEYRPGALATFSCLPGYALEPPGPPNAIECVDPTEPHWNDTEPACKAMCGGELSEPAGVVLSPDWPQSYSPGQDCVWGVHVQEEKRILLQVEILNVREGDMLTLFDGDGPSARVLAQLRGPQPRRRLLSSGPDLTLQFQAPPGPPNPGLGQGFVLHFKEVPRNDTCPELPPPEWGWRTASHGDLIRGTVLTYQCEPGYELLGSDILTCQWDLSWSAAPPACQKIMTCADPGEIANGHRTASDAGFPVGSHVQYRCLPGYSLEGAAMLTCYSRDTGTPKWSDRVPKCALKYEPCLNPGVPENGYQTLYKHHYQAGESLRFFCYEGFELIGEVTITCVPGHPSQWTSQPPLCKVAYEELLDNRKLEVTQTTDPSRQLEGGNLALAILLPLGLVIVLGSGVYIYYTKLQGKSLFGFSGSHSYSPITVESDFSNPLYEAGDTREYEVSI

SEQ ID NO: 35523 - protein, 910 aa, Homo sapiens
  ENSP00000312550
MGTPRAQHPPPPQLLFLILLSCPWIQGLPLKEEEILPEPGSETPTVASEALAELLHGALLRRGPEMGYLPGSDRDPTLATPPAGQTLAVPSLPRATEPGTGPLTTAVTPNGVRGAGPTAPELLTPPPGTTAPPPPSPASPGPPLGPEGGEEETTTTIITTTTVTTTVTSPVLCNNNISEGEGYVESPDLGSPVSRTLGLLDCTYSIHVYPGYGIEIQVQTLNLSQEEELLVLAGGGSPGLAPRLLANSSMLGEGQVLRSPTNRLLLHFQSPRVPRGGGFRIHYQAYLLSCGFPPRPAHGDVSVTDLHPGGTATFHCDSGYQLQGEETLICLNGTRPSWNGETPSCMASCGGTIHNATLGRIVSPEPGGAVGPNLTCRWVIEAAEGRRLHLHFERVSLDEDNDRLMVRSGGSPLSPVIYDSDMDDVPERGLISDAQSLYVELLSETPANPLLLSLRFEAFEEDRCFAPFLAHGNVTTTDPEYRPGALATFSCLPGYALEPPGPPNAIECVDPTEPHWNDTEPACKAMCGGELSEPAGVVLSPDWPQSYSPGQDCVWGVHVQEEKRILLQVEILNVREGDMLTLFDGDGPSARVLAQLRGPQPRRRLLSSGPDLTLQFQAPPGPPNPGLGQGFVLHFKEVPRNDTCPELPPPEWGWRTASHGDLIRGTVLTYQCEPGYELLGSDILTCQWDLSWSAAPPACQKIMTCADPGEIANGHRTASDAGFPVGSHVQYRCLPGYSLEGAAMLTCYSRDTGTPKWSDRVPKCALKYEPCLNPGVPENGYQTLYKHHYQAGESLRFFCYEGFELIGEVTITCVPGHPSQWTSQPPLCKVTQTTDPSRQLEGGNLALAILLPLGLVIVLGSGVYIYYTKLQGKSLFGFSGSHSYSPITVESDFSNPLYEAGDTREYEVSI

SEQ ID NO: 35524 - protein, 303 aa, Homo sapiens
  ENSP00000454654
  MOD_RES (1)..(1): Any amino acid
XCLNGTRPSWNGETPSCMASCGGTIHNATLGRIVSPEPGGAVGPNLTCRWVIEAAEGRRLHLHFERVSLDEDNDRLMVRSGGSPLSPVIYDSDMDDVPERGLISDAQSLYVELLSETPANPLLLSLRFEAMCGGELSEPAGVVLSPDWPQSYSPGQDCVWGVHVQEEKRILLQVEILNVREGDMLTLFDGDGPSARVLAQLRGPQPRRRLLSSGPDLTLQFQAPPGPPNPGLGQGFVLHFKEVPRNDTCPELPPPEWGWRTASHGDLIRGTVLTYQCEPGYELLGSDILTCQWDLSWSAAPPA

SEQ ID NO: 35525 - protein, 80 aa, Homo sapiens
  ENSP00000458490
MGTPRAQHPPPPQLLFLILLSCPWIQGSDRDPTLATPPAGQTLAVPSLPRATEPGTGPLTTAVTPNGVRGAGPTAPELLT

SEQ ID NO: 35526 - protein, 879 aa, Homo sapiens
  ENSP00000439412
MGTPRAQHPPPPQLLFLILLSCPWIQGSDRDPTLATPPAGQTLAVPSLPRATEPGTGPLTTAVTPNGVRGAGPTAPELLTPPPGTTAPPPPSPASPGPPLGPEGGEEETTTTIITTTTVTTTVTSPVLCNNNISEGEGYVESPDLGSPVSRTLGLLDCTYSIHVYPGYGIEIQVQTLNLSQEEELLVLAGGGSPGLAPRLLANSSMLGEGQVLRSPTNRLLLHFQSPRVPRGGGFRIHYQAYLLSCGFPPRPAHGDVSVTDLHPGGTATFHCDSGYQLQGEETLICLNGTRPSWNGETPSCMASCGGTIHNATLGRIVSPEPGGAVGPNLTCRWVIEAAEGRRLHLHFERVSLDEDNDRLMVRSGGSPLSPVIYDSDMDDVPERGLISDAQSLYVELLSETPANPLLLSLRFEAFEEDRCFAPFLAHGNVTTTDPEYRPGALATFSCLPGYALEPPGPPNAIECVDPTEPHWNDTEPACKAMCGGELSEPAGVVLSPDWPQSYSPGQDCVWGVHVQEEKRILLQVEILNVREGDMLTLFDGDGPSARVLAQLRGPQPRRRLLSSGPDLTLQFQAPPGPPNPGLGQGFVLHFKEVPRNDTCPELPPPEWGWRTASHGDLIRGTVLTYQCEPGYELLGSDILTCQWDLSWSAAPPACQKIMTCADPGEIANGHRTASDAGFPVGSHVQYRCLPGYSLEGAAMLTCYSRDTGTPKWSDRVPKCALKYEPCLNPGVPENGYQTLYKHHYQAGESLRFFCYEGFELIGEVTITCVPGHPSQWTSQPPLCKVAYEELLDNRKLEVTQTTDPSRQLEGGNLALAILLPLGLVIVLGSGVYIYYTKLQGKSLFGFSGSHSYSPITVESDFSNPLYEAGDTREYEVSI

SEQ ID NO: 35527 - protein, 923 aa, Homo sapiens
  ENSP00000481917
MGTPRAQHPPPPQLLFLILLSCPWIQGLPLKEEEILPEPGSETPTVASEALAELLHGALLRRGPEMGYLPGSDRDPTLATPPAGQTLAVPSLPRATEPGTGPLTTAVTPNGVRGAGPTAPELLTPPPGTTAPPPPSPASPGPPLGPEGGEEETTTTIITTTTVTTTVTSPVLCNNNISEGEGYVESPDLGSPVSRTLGLLDCTYSIHVYPGYGIEIQVQTLNLSQEEELLVLAGGGSPGLAPRLLANSSMLGEGQVLRSPTNRLLLHFQSPRVPRGGGFRIHYQAYLLSCGFPPRPAHGDVSVTDLHPGGTATFHCDSGYQLQGEETLICLNGTRPSWNGETPSCMASCGGTIHNATLGRIVSPEPGGAVGPNLTCRWVIEAAEGRRLHLHFERVSLDEDNDRLMVRSGGSPLSPVIYDSDMDDVPERGLISDAQSLYVELLSETPANPLLLSLRFEAFEEDRCFAPFLAHGNVTTTDPEYRPGALATFSCLPGYALEPPGPPNAIECVDPTEPHWNDTEPACKAMCGGELSEPAGVVLSPDWPQSYSPGQDCVWGVHVQEEKRILLQVEILNVREGDMLTLFDGDGPSARVLAQLRGPQPRRRLLSSGPDLTLQFQAPPGPPNPGLGQGFVLHFKEVPRNDTCPELPPPEWGWRTASHGDLIRGTVLTYQCEPGYELLGSDILTCQWDLSWSAAPPACQKIMTCADPGEIANGHRTASDAGFPVGSHVQYRCLPGYSLEGAAMLTCYSRDTGTPKWSDRVPKCALKYEPCLNPGVPENGYQTLYKHHYQAGESLRFFCYEGFELIGEVTITCVPGHPSQWTSQPPLCKVAYEELLDNRKLEVTQTTDPSRQLEGGNLALAILLPLGLVIVLGSGVYIYYTKLQGKSLFGFSGSHSYSPITVESDFSNPLYEAGDTREYEVSI

SEQ ID NO: 35528 - protein, 424 aa, Homo sapiens
  ENSP00000271628
MAAGPISERNQDATVYVGGLDEKVSEPLLWELFLQAGPVVNTHMPKDRVTGQHQGYGFVEFLSEEDADYAIKIMNMIKLYGKPIRVNKASAHNKNLDVGANIFIGNLDPEIDEKLLYDTFSAFGVILQTPKIMRDPDTGNSKGYAFINFASFDASDAAIEAMNGQYLCNRPITVSYAFKKDSKGERHGSAAERLLAAQNPLSQADRPHQLFADAPPPPSAPNPVVSSLGSGLPPPGMPPPGSFPPPVPPPGALPPGIPPAMPPPPMPPGAAGHGPPSAGTPGAGHPGHGHSHPHPFPPGGMPHPGMSQMQLAHHGPHGLGHPHAGPPGSGGQPPPRPPPGMPHPGPPPMGMPPRGPPFGSPMGHPGPMPPHGMRGPPPLMPPHGYTGPPRPPPYGYQRGPLPPPRPTPRPPVPPRGPLRGPLPQ

SEQ ID NO: 35529 - protein, 190 aa, Homo sapiens
  ENSP00000391114
MPKDRVTGQHQGYGFVEFLSEEDADYAIKIMNMIKLYGKPIRVNKASAHNKNLDVGANIFIGNLDPEIDEKLLYDTFSAFGVILQTPKIMRDPDTGNSKGYAFINFASFDASDAAIEAMNGQYLCNRPITVSYAFKKDSKGERHGSAAERLLAAQNPLSQADRPHQLFADAPPPPSAPNPVVSSLGSGLP

SEQ ID NO: 35530 - protein, 340 aa, Homo sapiens
  ENSP00000272433
MADTATTASAAAASAASASSDAPPFQLGKPRFQQTSFYGRFRHFLDIIDPRTLFVTERRLREAVQLLEDYKHGTLRPGVTNEQLWSAQKIKQAILHPDTNEKIFMPFRMSGYIPFGTPIVVGLLLPNQTLASTVFWQWLNQSHNACVNYANRNATKPSPASKFIQGYLGAVISAVSIAVGLNVLVQKANKFTPATRLLIQRFVPFPAVASANICNVVLMRYGELEEGIDVLDSDGNLVGSSKIAARHALLETALTRVVLPMPILVLPPIVMSMLEKTALLQARPRLLLPVQSLVCLAAFGLALPLAISLFPQMSEIETSQLEPEIAQATSSRTVVYNKGL

SEQ ID NO: 35531 - protein, 252 aa, Homo sapiens
  ENSP00000402141
  MOD_RES (1)..(1): Any amino acid
XAASAASASSDAPPFQLGKPRFQQTSFYGRFRHFLDIIDPRTLFVTERRLREAVQLLEDYKHGTLRPGVTNEQLWSAQKIKQAILHPDTNEKIFMPFRMSGYIPFGTPIVVGLLLPNQTLASTVFWQWLNQSHNACVNYANRNATKPSPASKFIQGYLGAVISAVSIAVGLNVLVQKANKFTPATRLLIQRFVPFPAVGPAGDGADASGPAHAHPGATPDRHVHAGEIETSQLEPEIAQATSSRTVVYNKGL

SEQ ID NO: 35532 - protein, 253 aa, Homo sapiens
  ENSP00000387076
MADTATTASAAAASAASASSDAPPFQLGKPRFQQTSFYGRFRHFLDIIDPRTLFVTERRLREAVQLLEDYKHGTLRPGVTNEQLWSAQKIKQAILHPDTNEKIFMPFRMSGYIPFGTPIVVGLLLPNQTLASTVFWQWLNQSHNACVNYANRNATKPSPASKFIQGYLGAVISAVSIAVGLNVLVQKANKFTPATRLLIQRFVPFPAVGRLSCRHAPGCSSLCKASCAWQPSAWPCRWPSASSRKCQRLKHPN

SEQ ID NO: 35533 - protein, 88 aa, Homo sapiens
  ENSP00000398580
MADTATTASAAAASAASASSDAPPFQLGKPRFQQTSFYGRFRHFLDIIDPRTLFVTEMESCTVPQAHCNPCLLGSETSQRGCAAAGGL

SEQ ID NO: 35534 - protein, 156 aa, Homo sapiens
  ENSP00000396825
MADTATTASAAAASAASASSDAPPFQLGKPRFQQTSFYGRFRHFLDIIDPRTLFVTERRLREAVQLLEDYKHGTLRPGVTNEQLWSAQKIKQVIFLLGRQFRSSLAQPDTGIHCLLWLNQSHNACVNYANRNATKPSPASKFIQGYLGAVISAVSI

SEQ ID NO: 35535 - protein, 65 aa, Homo sapiens
  ENSP00000423168
MAETLFWTPLLVGKLGPCSAGRPRMRGQDLGVFSWQGWGTPRPSRPRYTHLWAVSLCTPWTMRRF

SEQ ID NO: 35536 - protein, 298 aa, Homo sapiens
  ENSP00000426571
MAETLFWTPLLVVLLAGLGDTEAQQTTLHPLVGRVFVHTLDHETFLSLPEHVAVPPAVHITYHAHLQGHPDLPRWLRYTQRSPHHPGFLYGSATPEDRGLQVIEVTAYNRDSFDTTRQRLVLEIGDPEGPLLPYQAEFLVRSHDAEEVLPSTPASRFLSALGGLWEPGELQLLNVTSALDRGGRVPLPIEGRKEGVYIKVGSASPFSTCLKMVASPDSHARCAQGQPPLLSCYDTLAPHFRVDWCNVTLAEERPGYLRHPDGPPLHHPREHRGAAADGGQPRGAPATLHPAHVQCAHR

SEQ ID NO: 35537 - protein, 263 aa, Homo sapiens
  ENSP00000345522
MAETLFWTPLLVVLLAGLGDTEAQQTTLHPLVGRVFVHTLDHETFLSLPEHVAVPPAVHITYHAHLQGHPDLPRWLRYTQRSPHHPGFLYGSATPEDRGLQVIEVTAYNRDSFDTTRQRLVLEIGDPEGPLLPYQAEFLVRSHDAEEVLPSTPASRFLSALGGLWEPGELQLLNVTSALDRGGRVPLPIEGRKEGLKRDLATSDIQMVHHCTIHGNTEELRQMAASREVPRPLSTLPMFNVHTGERLPPRVDSAQVPLILDQH

SEQ ID NO: 35538 - protein, 387 aa, Homo sapiens
  ENSP00000262018
MAETLFWTPLLVVLLAGLGDTEAQQTTLHPLVGRVFVHTLDHETFLSLPEHVAVPPAVHITYHAHLQGHPDLPRWLRYTQRSPHHPGFLYGSATPEDRGLQVIEVTAYNRDSFDTTRQRLVLEIGDPEGPLLPYQAEFLVRSHDAEEVLPSTPASRFLSALGGLWEPGELQLLNVTSALDRGGRVPLPIEGRKEGVYIKVGSASPFSTCLKMVASPDSHARCAQGQPPLLSCYDTLAPHFRVDWCNVTLVDKSVPEPADEVPTPGDGILEHDPFFCPPTEAPDRDFLVDALVTLLVPLLVALLLTLLLAYVMCCRREGRLKRDLATSDIQMVHHCTIHGNTEELRQMAASREVPRPLSTLPMFNVHTGERLPPRVDSAQVPLILDQH

SEQ ID NO: 35539 - protein, 61 aa, Homo sapiens
  ENSP00000422817
MAETLFWTPLLVVLLAGLGDTEAQQTTLHPLVGRVFVHTLDHETFLSLPEHVGHSLQSGQL

SEQ ID NO: 35540 - protein, 196 aa, Homo sapiens
  ENSP00000426104
LRHSSGLLSSWVTAYNRDSFDTTRQRLVLEIGDPEGPLLPYQAEFLVRSHDAEEVLPSTPASRFLSALGGLWEPGELQLLNVTSALDRGGRVPLPIEGRKEGLKRDLATSDIQMVHHCTIHGNTEELRQMAASREVPRPLSTLPMFNVHTVVPGPALTSSSLLCPHHEWHIPPADSSSWPSWNPGSKQAGRGGGVG

SEQ ID NO: 35541 - protein, 58 aa, Homo sapiens
  ENSP00000426606
  MOD_RES (1)..(1): Any amino acid
XCPTRCPHHLPRPPPGTPRPAPVAPLHPAQPPPPWLPLRLCHPRRSWAPGHSLQSGQL

SEQ ID NO: 35542 - protein, 160 aa, Homo sapiens
  ENSP00000422030
  MOD_RES (1)..(1): Any amino acid
XLDRGGRVPLPIEGRKEGVYIKVDKSVPEPADEVPTPGDGILEHDPFFCPPTEAPDRDFLVDALVTLLVPLLVALLLTLLLAYVMCCRREGRLKRDLATSDIQMVHHCTIHGNTEELRQMAASREVPRPLSTLPMFNVHTGERLPPRVDSAQVPLILDQH

SEQ ID NO: 35543 - protein, 256 aa, Homo sapiens
  ENSP00000429378
MMPQEQYTHHRSTMPGSVGPQVYKVGIYGWRKRCLYFFVLLLMILILVNLAMTIWILKVMNFTIDGMGNLRITEKGLKLEGDSEFLQPLYAKEIQSRPGNALYFKSARNVTVNILNDQTKVLTQLITGPKAVEAYGKKFEVKTVSGKLLFSADNNEVVVGAERLRVLGAEGTVFPKSIETPNVRADPFKELRLESPTRSLVMEAPKGVEINAEAGNMEATCRTELRLESKDGEVRDEKDRSSKSYSFNRPTLPITG

SEQ ID NO: 35544 - protein, 289 aa, Homo sapiens
  ENSP00000403003
MPQEQYTHHRSTMPGSVGPQVYKVGIYGWRKRCLYFFVLLLMILILVNLAMTIWILKVMNFTIDGMGNLRITEKGLKLEGDSEFLQPLYAKEIQSRPGNALYFKSARNVTVNILNDQTKVLTQLITGPKAVEAYGKKFEVKTVSGKLLFSADNNEVVVGAERLRVLGAEGTVFPKSIETPNVRADPFKELRLESPTRSLVMEAPKGVEINAEAGNMEATCRTELRLESKDGEIKLDAAKIRLPRLPHGSYTPTGTRQKVFEICVCANGRLFLSQAGAGSTCQINTSVCL

SEQ ID NO: 35545 - protein, 290 aa, Homo sapiens
  ENSP00000338343
MMPQEQYTHHRSTMPGSVGPQVYKVGIYGWRKRCLYFFVLLLMILILVNLAMTIWILKVMNFTIDGMGNLRITEKGLKLEGDSEFLQPLYAKEIQSRPGNALYFKSARNVTVNILNDQTKVLTQLITGPKAVEAYGKKFEVKTVSGKLLFSADNNEVVVGAERLRVLGAEGTVFPKSIETPNVRADPFKELRLESPTRSLVMEAPKGVEINAEAGNMEATCRTELRLESKDGEIKLDAAKIRLPRLPHGSYTPTGTRQKVFEICVCANGRLFLSQAGAGSTCQINTSVCL

SEQ ID NO: 35546 - protein, 82 aa, Homo sapiens
  ENSP00000430794
MMPQEQYTHHRSTMPGSVGPQVYKVGIYGWRKRCLYFFVLLLMILILVNLAMTIWILKVMNFTISIHLLLRFNWLFRCCGMS

SEQ ID NO: 35547 - protein, 367 aa, Homo sapiens
  ENSP00000362192
MNSSPAGTPSPQPSRANGNINLGPSANPNAQPTDFDFLKVIGKGNYGKVLLAKRKSDGAFYAVKVLQKKSILKKKEQSHIMAERSVLLKNVRHPFLVGLRYSFQTPEKLYFVLDYVNGGELFFHLQRERRFLEPRARFYAAEVASAIGYLHSLNIIYRDLKPENILLDCQGHVVLTDFGLCKEGVEPEDTTSTFCGTPEYLAPEVLRKEPYDRAVDWWCLGAVLYEMLHGLPPFYSQDVSQMYENILHQPLQIPGGRTVAACDLLQSLLHKDQRQRLGSKADFLEIKNHVFFSPINWDDLYHKRLTPPFNPNVTGPADLKHFDPEFTQEAVSKSIGCTPDTVASSSGASSAFLGFSYAPEDDDILDC

SEQ ID NO: 35548 - protein, 358 aa, Homo sapiens
  ENSP00000362168
MNSSPAGTPSPQPSRANGNINLGPSANPNAQPTDFDFLKVIGKGNYGKVLLAKRKSDGAFYAVKVLQKKSILKKKEQSHIMAERSVLLKNVRHPFLVGLRYSFQTPEKLYFVLDYVNGGELFFHLQRERRFLEPRARFYAAEVASAIGYLHSLNIIYRDLKPENILLDCQGHVVLTDFGLCKEGVEPEDTTSTFCGTPEYLAPEVLRKEPYDRAVDWWCLGAVLYEMLHGLPPFYSQDVSQMYENILHQPLQIPGGRTVAACDLLQSLLHKDQRQRLGSKADFLEIKNHVFFSPINWDDLYHKRLTPPFNPNVDTLGPGTRKASFRWDFKKTVKIMSNLYPGERTIHGILGRDEWTLE

SEQ ID NO: 35549 - protein, 367 aa, Homo sapiens; identical to SEQ ID NO: 35547
  ENSP00000362184

SEQ ID NO: 35550 - protein, 285 aa, Homo sapiens
  ENSP00000436841
MNSSPAGTPSPQPSRANGNINLGPSANPNAQPTDFDFLKVIGKGNYGKVLLAKRKSDGAFYAVKVLQKKSILKKKEQSHIMAERSVLLKNVRHPFLVGLRYSFQTPEKLYFVLDYVNGGELFFHLQRERRFLEPRARFYAAEVASAIGYLHSLNIIYRDLKPENILLDCQGHVVLTDFGLCKEGVEPEDTTSTFCGTPEYLAPEVLRKEPYDRAVDWWCLGAVLYEMLHGLPPFYSQDVSQMYENILHQPLQIPGGRTVAACDLLQSLLHKDQRQRLGSKADFVA

SEQ ID NO: 35551 - protein, 10 aa, Homo sapiens
  ENSP00000481432
MNSSPAGTPS

SEQ ID NO: 35552 - protein, 198 aa, Homo sapiens
  ENSP00000396222
MNSSPAGTPSPQPSRANGNINLGPSANPNAQPTDFDFLKVIGKGNYGKVLLAKRKSDGAFYAVKVLQKKSILKKKESHIMAERSVLLKNVRHPFLVGLRYSFQTPEKLYFVLDYVNGGELFFHLQRERRFLEPRARFYAAEVASAIGYLHSLNIIYRDLKPENILLDCQGHVVLTDFGLCKEGVEPEDTTSTFCGTPE

SEQ ID NO: 35553 - protein, 427 aa, Homo sapiens
  ENSP00000340608
MQGLLTSGRKPSGGGRCTGRGGWRGQWCLKPWMGGADPPTPTLSCLLLPVPPELPDHCYRMNSSPAGTPSPQPSRANGNINLGPSANPNAQPTDFDFLKVIGKGNYGKVLLAKRKSDGAFYAVKVLQKKSILKKKEQSHIMAERSVLLKNVRHPFLVGLRYSFQTPEKLYFVLDYVNGGELFFHLQRERRFLEPRARFYAAEVASAIGYLHSLNIIYRDLKPENILLDCQGHVVLTDFGLCKEGVEPEDTTSTFCGTPEYLAPEVLRKEPYDRAVDWWCLGAVLYEMLHGLPPFYSQDVSQMYENILHQPLQIPGGRTVAACDLLQSLLHKDQRQRLGSKADFLEIKNHVFFSPINWDDLYHKRLTPPFNPNVTGPADLKHFDPEFTQEAVSKSIGCTPDTVASSSGASSAFLGFSYAPEDDDILDC

SEQ ID NO: 35554 - protein, 393 aa, Homo sapiens
  ENSP00000412214
MQGLLTSGRKPSGGGRCTELPDHCYRMNSSPAGTPSPQPSRANGNINLGPSANPNAQPTDFDFLKVIGKGNYGKVLLAKRKSDGAFYAVKVLQKKSILKKKEQSHIMAERSVLLKNVRHPFLVGLRYSFQTPEKLYFVLDYVNGGELFFHLQRERRFLEPRARFYAAEVASAIGYLHSLNIIYRDLKPENILLDCQGHVVLTDFGLCKEGVEPEDTTSTFCGTPEYLAPEVLRKEPYDRAVDWWCLGAVLYEMLHGLPPFYSQDVSQMYENILHQPLQIPGGRTVAACDLLQSLLHKDQRQRLGSKADFLEIKNHVFFSPINWDDLYHKRLTPPFNPNVTGPADLKHFDPEFTQEAVSKSIGCTPDTVASSSGASSAFLGFSYAPEDDDILDC

SEQ ID NO: 35555 - protein, 367 aa, Homo sapiens; identical to SEQ ID NO: 35547
  ENSP00000392795

SEQ ID NO: 35556 - protein, 365 aa, Homo sapiens
  ENSP00000378176
MDIIETAKLEEHLENQPSDPTNTYARPAEPVEEENKNGNGKPKSLSSGLRKGTKKYPDYIQIAMPTESRNKFPLEWWKTGIAFIYAVFNLVLTTVMITVVHERVPPKELSPPLPDKFFDYIDRVKWAFSVSEINGIILVGLWITQWLFLRYKSIVGRRFCFIIGTLYLYRCITMYVTTLPVPGMHFQCAPKLNGDSQAKVQRILRLISGGGLSITGSHILCGDFLFSGHTVTLTLTYLFIKEYSPRHFWWYHLICWLLSAAGIICILVAHEHYTIDVIIAYYITTRLFWWYHSMANEKNLKVSSQTNFLSRAWWFPIFYFFEKNVQGSIPCCFSWPLSWPPGCFKSSCKKYSRVQKIGEDNEKST

SEQ ID NO: 35557 - protein, 125 aa, Homo sapiens
  ENSP00000428176
MYVTTLPVPGMHFQCAPKLNGDSQAKVQRILRLISGGGLSITGSHILCGDFLFSGHTVTLTLTYLFIKEYSPRHFWWYHLICWLLSAAGIICILVAHEHYTIDVIIAYYITTRLFWWYHSMANEK

SEQ ID NO: 35558 - protein, 365 aa, Homo sapiens; identical to SEQ ID NO: 35556
  ENSP00000351981

SEQ ID NO: 35559 - protein, 34 aa, Homo sapiens
  ENSP00000428294
MDIIETAKLEEHLENQPSDPTNTYARPAEPVEEE

SEQ ID NO: 35560 - protein, 365 aa, Homo sapiens; identical to SEQ ID NO: 35556
  ENSP00000378178

SEQ ID NO: 35561 - protein, 44 aa, Homo sapiens
  ENSP00000430172
MDIIETAKLEEHLENQPSDPTNTYARPAEPVEEENKNGNGKPKS

SEQ ID NO: 35562 - protein, 47 aa, Homo sapiens
  ENSP00000483034
MDPSYCPAHGFPSQDPLWPLSSQQWSSAHYSEPGLQAQGQHPTVSHH

SEQ ID NO: 35563 - protein, 675 aa, Homo sapiens
  ENSP00000440273
MDPSYCPAHGFPSQDPLWPLSSQQWSSAHYSEPAAGGCDGTEAMNGAGPGPAAAAPVPVPVPVPDWRQFCELHAQAAAVDFAHKFCRFLRDNPAYDTPDAGASFSRHFAANFLDVFGEEVRRVLVAGPTTRGAAVSAEAMEPELADTSALKAAPYGHSRSSEDVSTHAATKARVRKGFSLRNMSLCVVDGVRDMWHRRASPEPDAAAAPRTAEPRDKWTRRLRLSRTLAAKVELVDIQREGALRFMVADDAAAGSGGSAQWQKCRLLLRRAVAEERFRLEFFVPPKASRPKVSIPLSAIIEVRTTMPLEMPEKDNTFVLKVENGAEYILETIDSLQKHSWVADIQGCVDPGDSEEDTELSCTRGGCLASRVASCSCELLTDAVDLPRPPETTAVGAVVTAPHSRGRDAVRESLIHVPLETFLQTLESPGGSGSDSNNTGEQGAETDPEAEPELELSDYPWFHGTLSRVKAAQLVLAGGPRNHGLFVIRQSETRPGEYVLTFNFQGKAKHLRLSLNGHGQCHVQHLWFQSVLDMLRHFHTHPIPLESGGSADITLRSYVRAQDPPPEPGPTPPAAPASPACWSDSPGQHYFSSLAAAACPPASPSDAAGASSSSASSSSAASGPAPPRPVEGQLSARSRSNSAERLLEAVAATAAEEPPEAAPGRARAVENQYSFY

SEQ ID NO: 35564 - protein, 243 aa, Homo sapiens
  ENSP00000401883
MNGAGPGPAAAAPVPVPVPVPDWRQFCELHAQAAAVDFAHKFCRFLRDNPAYDTPDAGASFSRHFAANFLDVFGEEVRRVLVAGPTTRGAAVSAEAMEPELADTSALKAAPYGHSRSSEDVSTHAATKARVRKGFSLRNMSLCVVDGVRDMWHRRASPEPDAAAAPRTAEPRDKWTRRLRLSRTLAAKVELVDIQREGALRFMVADDAAAGSGGSAQWQKCRLLLRRAVAEERFRLEFFVPPK

SEQ ID NO: 35565 - protein, 128 aa, Homo sapiens
  ENSP00000360181
MDAVAVYHGKISRETGEKLLLATGLDGSYLLRDSESVPGVYCLCVLYHGYIYTYRVSQTETGSWSAETAPGVHKRYFRKIKNLISAFQKPDQGIVIPLQYPVEKKSSARSTQGTTGIREDPDVCLKAP

SEQ ID NO: 35566 - protein, 125 aa, Homo sapiens
  ENSP00000353126
MDAVAVYHGKISRETGEKLLLATGLDGSYLLRDSESVPGVYCLCVLYHGYIYTYRVSQTETGSWSAETAPGVHKRYFRKIKNLISAFQKPDQGIVIPLQYPVEKKSSARSTQGIREDPDVCLKAP

SEQ ID NO: 35567 - protein, 76 aa, Homo sapiens
  ENSP00000477094
MDAVAVYHGKISRETGEKLLLATGLDGSYLLRDSESVPGITVTFIHTECPRQKQVLGVLSISEARSRHCNTSAVSS

SEQ ID NO: 35568 - protein, 357 aa, Homo sapiens
  ENSP00000345295
MLQQILHDMYIDPELLAELSDVQKHILFYKMREEQLRRWKERETWEALAQDEGLRPPKTKRAASDKHIQWLLGADGEVWVWIMGEGPGDKPYEEISEELIAERARLQAQREAEELWRQKEAEITKKFRDALANEKARILAEKWKVEMEDRKAAKVLEERIHEEFKRKEEEERKRGEEQIRLQEEQRAKELYWTLKQAQLHCQASEKEEREWEEQLRRSKAADEERSRRAQRARDEYRHHSLRAIQKGTVAGLSSMFRELGQSHEQEARLYHHLPDPGLPQPLALPVRTWERPLRPVSRDVIVRWFKEEQLPRRAGFERNTKFIAPWFHGGNYHCFRRRVTSGTLRTEGQPTRLPSVV

SEQ ID NO: 35569 - protein, 309 aa, Homo sapiens
  ENSP00000314242
MLPEDSGGSPDAAASDKHIQWLLGADGEVWVWIMGEGPGDKPYEEISEELIAERARLQAQREAEELWRQKEAEITKKFRDALANEKARILAEKWKVEMEDRKAAKVLEERIHEEFKRKEEEERKRGEEQIRLQEEQRAKELYWTLKQAQLHCQASEKEEREWEEQLRRSKAADEERSRRAQRARDEYRHHSLRAIQKGTVAGLSSMFRELGQSHEQEARLYHHLPDPGLPQPLALPVSRTWERPLRPVSRDVIVRWFKEEQLPRRAGFERNTKFIAPWFHGGNYHCFRRRVTSGTLRTEGQPTRLPSVV

SEQ ID NO: 35570 - protein, 107 aa, Homo sapiens
  ENSP00000358853
MVIRVFIASSSGFVAIKKKQQDVVRFLEANKIEFEEVDITMSEEQRQWMYKNVPPEKKPTQGNPLPPQIFNGDRYCGDYDSFFESKESNTVFSFLGLKPRLASKAEP

SEQ ID NO: 35571 - protein, 561 aa, Homo sapiens
  ENSP00000409746
MAAEEMHWPVPMKAIGAQNLLTMPGGVAKAGYLHKKGGTQLQLLKWPLRFVIIHKRCVYYFKSSTSASPQGAFSLSGYNRVMRAAEETTSNNVFPFKIIHISKKHRTWFFSASSEEERKSWMALLRREIGHFHEKKDLPLDTSDSSSDTDSFYGAVERPVDISLSPYPTDNEDYEHDDEDDSYLEPDSPEPGRLEDALMHPPAYPPPPVPTPRKPAFSDMPRAHSFTSKGPGPLLPPPPPKHGLPDVGLAAEDSKRDPLCPRRAEPCPRVPATPRRMSDPPLSTMPTAPGLRKPPCFRESASPSPEPWTPGHGACSTSSAAIMATATSRNCDKLKSFHLSPRGPPTSEPPPVPANKPKFLKIAEEDPPREAAMPGLFVPPVAPRPPALKLPVPEAMARPAVLPRPEKPQLPHLQRSPPDGQSFRSFSFEKPRQPSQADTGGDDSDEDYEKVPLPNSVFVNTTESCEVERLFKATSPRGEPQDGLYCIRNSSTKSGKVLVVWDETSNKVRNYRIFEKDSKFYLEGEVLFVSVGSMVEHYHTHVLPSHQSLLLRHPYGYTGPR

SEQ ID NO: 35572 - protein, 142 aa, Homo sapiens
  ENSP00000422796
MAAEEMHWPVPMKAIGAQNLLTMPGGVAKAGYLHKKGGTQLQLLKWPLRFVIIHKRCVYYFKSSTSASPQGAFSLSGYNRVMRAAEETTSNNVFPFKIIHISKKHRTWFFSASSEEERKSWMALLRREIGHFHEKKDLPLDT

SEQ ID NO: 35573 - protein, 172 aa, Homo sapiens
  ENSP00000423275
MAAEEMHWPVPMKAIGAQNLLTMPGGVAKAGYLHKKGGTQLQLLKWPLRFVIIHKRCVYYFKSSTSASPQGAFSLSGYNRVMRAAEETTSNNVFPFKIIHISKKHRTWFFSASSEEERKSWMALLRREIGHFHEKKDLPLDTSDSSSDTDSFYGAVERPVDISLSPYPTDNE

SEQ ID NO: 35574 - protein, 188 aa, Homo sapiens
  ENSP00000424917
MAAEEMHWPVPMKAIGAQNLLTMPGGVAKAGYLHKKGGTQLQLLKWPLRFVIIHKRCVYYFKSSTSASPQGAFSLSGYNRVMRAAEETTSNNVFPFKIIHISKKHRTWFFSASSEEERKSWMALLRREIGHFHEKKDLPLDTSDSSSDTDSFYGAVERPVDISLSPYPTDNEDYEHDDEDDSYLEPDS

SEQ ID NO: 35575 - protein, 97 aa, Homo sapiens
  ENSP00000424072
MAAEEMHWPVPMKAIGAQNLLTMPGGVAKAGYLHKKGGTQLQLLKWPLRFVIIHKRCVYYFKSSTSASPQGAFSLSGYNRQPRPQPAQALSQTEAGP

SEQ ID NO: 35576 - protein, 194 aa, Homo sapiens
  ENSP00000424105
MAAEEMHWPVPMKAIGAQNLLTMPGGVAKAGYLHKKGGTQLQLLKWPLRFVIIHKRCVYYFKSSTSASPQGAFSLSGYNRVMRAAEETTSNNVFPFKIIHISKKHRTWFFSASSEEERKSWMALLRREIGHFHEKKDLPLDTSDSSSDTDSFYGAVERPVDISLSPYPTDNEDYEHDDEDDSYLEPDSPEPGRL

SEQ ID NO: 35577 - protein, 136 aa, Homo sapiens
  ENSP00000423823
MAAEEMHWPVPMKAIGAQNLLTMPGGVAKAGYLHKKGGTQLQLLKWPLRFVIIHKRCVYYFKSSTSASPQGAFSLSGYNRVMRAAEETTSNNVFPFKIIHISKKHRTWFFSASSEEERKSWMALLRREIGHFHEKK

SEQ ID NO: 35578 - protein, 142 aa, Homo sapiens; identical to SEQ ID NO: 35572
  ENSP00000425537

SEQ ID NO: 35579 - protein, 561 aa, Homo sapiens; identical to SEQ ID NO: 35571
  ENSP00000403231

SEQ ID NO: 35580 - protein, 561 aa, Homo sapiens; identical to SEQ ID NO: 35571
  ENSP00000424846

SEQ ID NO: 35581 - protein, 97 aa, Homo sapiens; identical to SEQ ID NO: 35575
  ENSP00000422605

SEQ ID NO: 35582 - protein, 561 aa, Homo sapiens; identical to SEQ ID NO: 35571
  ENSP00000348685

SEQ ID NO: 35583 - protein, 190 aa, Homo sapiens
  ENSP00000426818
  MOD_RES (1)..(1): Any amino acid
XRESASPSPEPWTPGHGACSTSSAAIMATATSRNCDKLKSFHLSPRGPPTSEPPPVPANKPKFLKIAEEDPPREAAMPGLFVPPVAPRPPALKLPVPEAMARPAVLPRPEKPQLPHLQRSPPDGQSFRSFSFEKPRQPSQADTGGDDSDEDYEKVVQGYKPPGRAPGWTLLHPELLYQVGEGPGCVGRNL

SEQ ID NO: 35584 - protein, 589 aa, Homo sapiens
  ENSP00000388152
MASLGPRTPAPSRSRGRRAMCWVSTISFMAAEEMHWPVPMKAIGAQNLLTMPGGVAKAGYLHKKGGTQLQLLKWPLRFVIIHKRCVYYFKSSTSASPQGAFSLSGYNRVMRAAEETTSNNVFPFKIIHISKKHRTWFFSASSEEERKSWMALLRREIGHFHEKKDLPLDTSDSSSDTDSFYGAVERPVDISLSPYPTDNEDYEHDDEDDSYLEPDSPEPGRLEDALMHPPAYPPPPVPTPRKPAFSDMPRAHSFTSKGPGPLLPPPPPKHGLPDVGLAAEDSKRDPLCPRRAEPCPRVPATPRRMSDPPLSTMPTAPGLRKPPCFRESASPSPEPWTPGHGACSTSSAAIMATATSRNCDKLKSFHLSPRGPPTSEPPPVPANKPKFLKIAEEDPPREAAMPGLFVPPVAPRPPALKLPVPEAMARPAVLPRPEKPQLPHLQRSPPDGQSFRSFSFEKPRQPSQADTGGDDSDEDYEKVPLPNSVFVNTTESCEVERLFKATSPRGEPQDGLYCIRNSSTKSGKVLVVWDETSNKVRNYRIFEKDSKFYLEGEVLFVSVGSMVEHYHTHVLPSHQSLLLRHPYGYTGPR

SEQ ID NO: 35585 - protein, 618 aa, Homo sapiens
  ENSP00000422168
MAGSGPRPRSWGRREAGARDEAAAAGGRGPGPCRCSQGRRAWIAPGKPAMPAAWTPFMAAEEMHWPVPMKAIGAQNLLTMPGGVAKAGYLHKKGGTQLQLLKWPLRFVIIHKRCVYYFKSSTSASPQGAFSLSGYNRVMRAAEETTSNNVFPFKIIHISKKHRTWFFSASSEEERKSWMALLRREIGHFHEKKDLPLDTSDSSSDTDSFYGAVERPVDISLSPYPTDNEDYEHDDEDDSYLEPDSPEPGRLEDALMHPPAYPPPPVPTPRKPAFSDMPRAHSFTSKGPGPLLPPPPPKHGLPDVGLAAEDSKRDPLCPRRAEPCPRVPATPRRMSDPPLSTMPTAPGLRKPPCFRESASPSPEPWTPGHGACSTSSAAIMATATSRNCDKLKSFHLSPRGPPTSEPPPVPANKPKFLKIAEEDPPREAAMPGLFVPPVAPRPPALKLPVPEAMARPAVLPRPEKPQLPHLQRSPPDGQSFRSFSFEKPRQPSQADTGGDDSDEDYEKVPLPNSVFVNTTESCEVERLFKATSPRGEPQDGLYCIRNSSTKSGKVLVVWDETSNKVRNYRIFEKDSKFYLEGEVLFVSVGSMVEHYHTHVLPSHQSLLLRHPYGYTGPR

SEQ ID NO: 35586 - protein, 963 aa, Homo sapiens
  ENSP00000375867
MAAQRIRAANSNGLPRCKSEGTLIDLSEGFSETSFNDIKVPSPSALLVDNPTPFGNAKEVIAIKDYCPTNFTTLKFSKGDHLYVLDTSGGEWWYAHNTTEMGYIPSSYVQPLNYRNSTLSDSGMIDNLPDSPDEVAKELELLGGWTDDKKVPGRMYSNNPFWNGVQTNPFLNGNVPVMPSLDELNPKSTVDLLLFDAGTSSFTESSSATTNSTGNIFDELPVTNGLHAEPPVRRDNPFFRSKRSYSLSELSVLQAKSDAPTSSSFFTGLKSPAPEQFQSREDFRTAWLNHRKLARSCHDLDLLGQSPGWGQTQAVETNIVCKLDSSGGAVQLPDTSISIHVPEGHVAPGETQQISMKALLDPPLELNSDRSCSISPVLEVKLSNLEVKTSIILEMKVSAEIKNDLFSKSTVGLQCLRSDSKEGPYVSVPLNCSCGDTVQAQLHNLEPCMYVAVVAHGPSILYPSTVWDFINKKVTVGLYGPKHIHPSFKTVVTIFGHDCAPKTLLVSEVTRQAPNPAPVALQLWGKHQFVLSRPQDLKVCMFSNMTNYEVKASEQAKVVRGFQLKLGKVSRLIFPITSQNPNELSDFTLRVQVKDDQEAILTQFCVQTPQPPPKSAIKPSGQRRFLKKNEVGKIILSPFATTTKYPTFQDRPVSSLKFGKLLKTVVRQNKNHYLLEYKKGDGIALLSEERVRLRGQLWTKEWYIGYYQGRVGLVHTKNVLVVGRARPSLCSGPELSTSVLLEQILRPCKFLTYIYASVRTLLMENISSWRSFADALGYVNLPLTFFCRAELDSEPERVASVLEKLKEDCNNTENKERKSFQKELVMALLKMDCQGLVVRLIQDFVLLTTAVEVAQRWRELAEKLAKVSKQQMDAYESPHRDRNGVVDSEAMWKPAYDFLLTWSHQIGDSYRDVIQELHLGLDKMKNPITKRWKHLTGTLILVNSLDVLRAAAFSPADQDDFVI

SEQ ID NO: 35587 - protein, 122 aa, Homo sapiens
  ENSP00000403251
MAAQRIRAANSNGLPRCKSEGTLIDLSEGFSETSFNDIKVPSPSALLVDNPTPFGNAKEVIAIKDYCPTNFTTLKFSKGDHLYVLDTSGGEWWYAHNTTEMGYIPSSYVQPLNYRNSTLSDS

SEQ ID NO: 35588 - protein, 963 aa, Homo sapiens; identical to SEQ ID NO: 35586
  ENSP00000386862

SEQ ID NO: 35589 - protein, 963 aa, Homo sapiens; identical to SEQ ID NO: 35586
  ENSP00000340237

SEQ ID NO: 35590 - protein, 56 aa, Homo sapiens
  ENSP00000387995
MAAQRIRAANSNGLPRCKSEGTLIDLSEGFSETSFNDIKVPSPSALLVDNPTPFGN

SEQ ID NO: 35591 - protein, 173 aa, Homo sapiens
  ENSP00000415391
MAAQRIRAANSNGLPRCKSEGTLIDLSEGFSETSFNDIKVPSPSALLVDNPTPFGNAKEVIAIKDYCPTNFTTLKFSKGDHLYVLDTSGGEWWYAHNTTEMGYIPSSYVQPLNYRNSTLSDSGMIDNLPDSPDEVAKELELLGGWTDDKKVPGRMYSNNPFWNGVQTNPFLNG

SEQ ID NO: 35592 - protein, 57 aa, Homo sapiens
  ENSP00000414740
MAAQRIRAANSNGLPRCKSEGTLIDLSEGFSETSFNDIKVPSPSALLVDNPTPFGNA

SEQ ID NO: 35593 - protein, 767 aa, Homo sapiens
  ENSP00000387030
MNIMNTEQSQNSIVSRIKVFEGQTNIETSGLPKKPEITPRSLPPKPTVSSGKPSVAPKPAANRASGEWDSGTENRLKVTSKEGLTPYPPLQEAGSIPVTKPELPKKPNPGLIRSVNPEIPGRGPLAESSDSGKKVPTPAPRPLLLKKSVSSENPTYPSAPLKPVTVPPRLAGASQAKAYKSLGEGPPANPPVPVLQSKPLVDIDLISFDDDVLPTPSGNLAEESVGSEMVLDPFQLPAKTEPIKERAVQPAPTRKPTVIRIPAKPGKCLHEDPQSPPPLPAEKPIGNTFSTVSGKLSNVERTRNLESNHPGQTGGFVRVPPRLPPRPVNGKTIPTQQPPTKVPPERPPPPKLSATRRSNKKLPFNRSSSDMDLQKKQSNLATGLSKAKSQVFKNQDPVLPPRPKPGHPLYSKYMRGDVLVMLKQTENNYLECQKGEDTGRVHLSQMKIITPLDEHLRSRPNDPSHAQKPVDSGAPHAVVLHDFPAEQVDDLNLTSGEIVYLLEKIDTDWYRGNCRNQIGIFPANYVKVIIDIPEGGNGKRECVSSHCVKGSRCVARFEYIGEQKDELSFSEGEIIILKEYVNEEWARGEVRGRTGIFPLNFVEPVEDYPTSGANVLSTKVPLKTKKEDSGSNSQVNSLPAEWCEALHSFTAETSDDLSFKRGDRIQILERLDSDWCRGRLQDREGIFPAVFVRPCPAEAKSMLAIVPKGRKAKALYDFRGENEDELSFKAGDIITELESVDDDWMSGELMGKSGIFPKNYIQFLQIS

SEQ ID NO: 35594 - protein, 790 aa, Homo sapiens
  ENSP00000386848
MNIMNTEQSQNSIVSRIKVFEGQTNIETSGLPKKPEITPRSLPPKPTVSSGKPSVAPKPAANRASGEWDSGTENRLKVTSKEGLTPYPPLQEAGSIPVTKPELPKKPNPGLIRSVNPEIPGRGPLAESSDSGKKVPTPAPRPLLLKKSVSSENPTYPSAPLKPVTVPPRLAGASQAKAYKSLGEGPPANPPVPVLQSKPLVDIDLISFDDDVLPTPSGNLAEESVGSEMVLDPFQLPAKTEPIKERAVQPAPTRKPTVIRIPAKPGKCLHEDPQSPPPLPAEKPIGNTFSTVSGKLSNVERTRNLESNHPGQTGGFVRVPPRLPPRPVNGKTIPTQQPPTKVPPERPPPPKLSATRRSNKKLPFNRSSSDMDLQKKQSNLATGLSKAKSQVFKNQDPVLPPRPKPGHPLYSKYMLSVPHGIANEDIVSQNPGELSCKRGDVLVMLKQTENNYLECQKGEDTGRVHLSQMKIITPLDEHLRSRPNDPSHAQKPVDSGAPHAVVLHDFPAEQVDDLNLTSGEIVYLLEKIDTDWYRGNCRNQIGIFPANYVKVIIDIPEGGNGKRECVSSHCVKGSRCVARFEYIGEQKDELSFSEGEIIILKEYVNEEWARGEVRGRTGIFPLNFVEPVEDYPTSGANVLSTKVPLKTKKEDSGSNSQVNSLPAEWCEALHSFTAETSDDLSFKRGDRIQILERLDSDWCRGRLQDREGIFPAVFVRPCPAEAKSMLAIVPKGRKAKALYDFRGENEDELSFKAGDIITELESVDDDWMSGELMGKSGIFPKNYIQFLQIS

SEQ ID NO: 35595 - protein, 767 aa, Homo sapiens; identical to SEQ ID NO: 35593
  ENSP00000423449

SEQ ID NO: 35596 - protein, 1047 aa, Homo sapiens
  ENSP00000488951
MAEGRRREDEEEELRERRELGGQRRARGRALSGHSAADRNERNKPEHRSSSQGPLSSIRAVIKRSSRTSIQSELHRDRRRPEITIVAAEPLRPASWFPGTPPPGLGFPTSSAAGSWRPNELVPAELPPSYEQVIKEINQVQVNTTNNNNAAATPRHTITSATQTDFSEEIDNDLPQTLQAPLKPLQPFSAVSSGNLPTNVAPLIVFDISEEPNCPENPSATRCPVPKPRSKSNLRPIPRDSHIKEQSQQKISPAAVGEESSPGRPQSLLDNASTSDSQAVMNIMNTEQSQNSIVSRIKVFEGQTNIETSGLPKKPEITPRSLPPKPTVSSGKPSVAPKPAANRASGEWDSGTENRLKVTSKEGLTPYPPLQEAGSIPVTKPELPKKPNPGLIRSVNPEIPGRGPLAESSDSGKKVPTPAPRPLLLKKSVSSENPTYPSAPLKPVTVPPRLAGASQAKAYKSLGEGPPANPPVPVLQSKPLVDIDLISFDDDVLPTPSGNLAEESVGSEMVLDPFQLPAKTEPIKERAVQPAPTRKPTVIRIPAKPGKCLHEDPQSPPPLPAEKPIGNTFSTVSGKLSNVERTRNLESNHPGQTGGFVRVPPRLPPRPVNGKTIPTQQPPTKVPPERPPPPKLSATRRSNKKLPFNRSSSDMDLQKKQSNLATGLSKAKSQVFKNQDPVLPPRPKPGHPLYSKYMRGDVLVMLKQTENNYLECQKGEDTGRVHLSQMKIITPLDEHLRSRPNDPSHAQKPVDSGAPHAVVLHDFPAEQVDDLNLTSGEIVYLLEKIDTDWYRGNCRNQIGIFPANYVKVIIDIPEGGNGKRECVSSHCVKGSRCVARFEYIGEQKDELSFSEGEIIILKEYVNEEWARGEVRGRTGIFPLNFVEPVEDYPTSGANVLSTKVPLKTKKEDSGSNSQVNSLPAEWCEALHSFTAETSDDLSFKRGDRIQILERLDSDWCRGRLQDREGIFPAVFVRPCPAEAKSMLAIVPKGRKAKALYDFRGENEDELSFKAGDIITELESVDDDWMSGELMGKSGIFPKNYIQFLQIS

SEQ ID NO: 35597 - protein, 731 aa, Homo sapiens
  ENSP00000415694
MNIMNTEQSQNSIVSRIKVFEGQTNIETSGLPKKPEITPRSLPPKPTVSSGKPSVAPKPAANRASGEWDSGTENRLKVTSKEGLTPYPPLQEAGSIPVTKPELPKKPNPGLIRSVNPEIPGRGPLAESSDSGKKVPTPAPRPLLLKKSVSSENPTYPSAPLKPVTVPPRLAGASQAKAYKSLGEGPPANPPVPVLQSKPLVDIDLISFDDDVLPTPSGNLAEESVGSEMVLGLHEDPQSPPPLPAEKPIGNTFSTVSGKLSNVERTRNLESNHPGQTGGFVRVPPRLPPRPVNGKTIPTQQPPTKVPPERPPPPKLSATRRSNKKLPFNRSSSDMDLQKKQSNLATGLSKAKSQVFKNQDPVLPPRPKPGHPLYSKYMRGDVLVMLKQTENNYLECQKGEDTGRVHLSQMKIITPLDEHLRSRPNDPSHAQKPVDSGAPHAVVLHDFPAEQVDDLNLTSGEIVYLLEKIDTDWYRGNCRNQIGIFPANYVKVIIDIPEGGNGKRECVSSHCVKGSRCVARFEYIGEQKDELSFSEGEIIILKEYVNEEWARGEVRGRTGIFPLNFVEPVEDYPTSGANVLSTKVPLKTKKEDSGSNSQVNSLPAEWCEALHSFTAETSDDLSFKRGDRIQILERLDSDWCRGRLQDREGIFPAVFVRPCPAEAKSMLAIVPKGRKAKALYDFRGENEDELSFKAGDIITELESVDDDWMSGELMGKSGIFPKNYIQFLQIS

SEQ ID NO: 35598 - protein, 233 aa, Homo sapiens
  ENSP00000489087
  MOD_RES (1)..(1): Any amino acid
XNIETSGLPKKPEITPRSLPPKPTVSSGKPSVAPKPAANRASGEWDSGTENRLKVTSKEGLTPYPPLQEAGSIPVTKPELPKKPNPGLIRSVNPEIPGRGPLAESSDSGKKVPTPAPRPLLLKKSVSSENPTYPSAPLKPVTVPPRLAGASQAKAYKSLGEGPPANPPVPVLQSKPLVDIDLISFDDDVLPTPSGNLAEESVGSEMVLDHVEALPLTRELINNLFKRAEHKHN

SEQ ID NO: 35599 - protein, 790 aa, Homo sapiens; identical to SEQ ID NO: 35594
  ENSP00000302913

SEQ ID NO: 35600 - protein, 347 aa, Homo sapiens
  ENSP00000391372
MSVAGLKKQFHKASQLFSEKISGAEGTKLDDEFLDMERKIDVTNKVVAEILSKTTEYLQPNPAYRAKLGMLNTVSKIRGQVKTTGYPQTEGLLGDCMLKYGKELGEDSTFGNALIEVGESMKLMAEVKDSLDINVKQTFIDPLQLLQDKDLKEIGHHLKKLEGRRLDYDYKKKRVGKIPDEEVRQAVEKFEESKELAERSMFNFLENDVEQVSQLAVFIEAALDYHRQSTEILQELQSKLQMRISAASSVPRREYKPRPVKRSSSELNGVSTTSVVKTTGSNIPMDQPCCRGLYDFEPENQGELGFKEGDIITLTNQIDENWYEGMIHGESGFFPINYVEVIVPLPQ

SEQ ID NO: 35601 - protein, 65 aa, Homo sapiens
  ENSP00000456249
MSVAGLKKQFHKASQLFSEKISGAEGTKLDDEFLDMERKIDVTNKVVAEILSKTTEYLQPNPELS

SEQ ID NO: 35602 - protein, 355 aa, Homo sapiens
  ENSP00000320092
MDGIFAGIICNQANRCLTWTSQQLFSEKISGAEGTKLDDEFLDMERKIDVTNKVVAEILSKTTEYLQPNPAYRAKLGMLNTVSKIRGQVKTTGYPQTEGLLGDCMLKYGKELGEDSTFGNALIEVGESMKLMAEVKDSLDINVKQTFIDPLQLLQDKDLKEIGHHLKKLEGRRLDYDYKKKRVGKIPDEEVRQAVEKFEESKELAERSMFNFLENDVEQVSQLAVFIEAALDYHRQSTEILQELQSKLQMRISAASSVPRREYKPRPVKRSSSELNGVSTTSVVKTTGSNIPMDQPCCRGLYDFEPENQGELGFKEGDIITLTNQIDENWYEGMIHGESGFFPINYVEVIVPLPQ

SEQ ID NO: 35603 - protein, 888 aa, Homo sapiens
  ENSP00000284637
MDESALLDLLECPVCLERLDASAKVLPCQHTFCKRCLLGIVGSRNELRCPECRTLVGSGVEELPSNILLVRLLDGIKQRPWKPGPGGGSGTNCTNALRSQSSTVANCSSKDLQSSQGGQQPRVQSWSPPVRGIPQLPCAKALYNYEGKEPGDLKFSKGDIIILRRQVDENWYHGEVNGIHGFFPTNFVQIIKPLPQPPPQCKALYDFEVKDKEADKDCLPFAKDDVLTVIRRVDENWAEGMLADKIGIFPISYVEFNSAAKQLIEWDKPPVPGVDAGECSSAAAQSSTAPKHSDTKKNTKKRHSFTSLTMANKSSQASQNRHSMEISPPVLISSSNPTAAARISELSGLSCSAPSQVHISTTGLIVTPPPSSPVTTGPSFTFPSDVPYQAALGTLNPPLPPPPLLAATVLASTPPGATAAAAAAGMGPRPMAGSTDQIAHLRPQTRPSVYVAIYPYTPRKEDELELRKGEMFLVFERCQDGWFKGTSMHTSKIGVFPGNYVAPVTRAVTNASQAKVPMSTAGQTSRGVTMVSPSTAGGPAQKLQGNGVAGSPSVVPAAVVSAAHIQTSPQAKVLLHMTGQMTVNQARNAVRTVAAHNQERPTAAVTPIQVQNAAGLSPASVGLSHHSLASPQPAPLMPGSATHTAAISISRASAPLACAAAAPLTSPSITSASLEAEPSGRIVTVLPGLPTSPDSASSACGNSSATKPDKDSKKEKKGLLKLLSGASTKRKPRVSPPASPTLEVELGSAELPLQGAVGPELPPGGGHGRAGSCPVDGDGPVTTAVAGAALAQDAFHRKASSLDSAVPIAPPPRQACSSLGPVLNESRPVVCERHRVVVSYPPQSEAELELKEGDIVFVHKKREDGWFKGTLQRNGKTGLFPGSFVENI

SEQ ID NO: 35604 - protein, 303 aa, Homo sapiens
  ENSP00000426418
  MOD_RES (1)..(1): Any amino acid
XKALYNYEGKEPGDLKFSKGDIIILRRQVDENWYHGEVNGIHGFFPTNFVQIIKPLPQPPPQCKALYDFEVKDKEADKDCLPFAKDDVLTVIRRVDENWAEGMLADKIGIFPISYVEFNSAAKQLIEWDKPPVPGVDAGECSSAAAQSSTAPKHSDTKKNTKKRHSFTSLTMANKSSQASQNRHSMEISPPVLISSSNPTAAARISELSGLSCSAPSQVHISTTGLIVTPPPSSPVTTGPSFTFPSDVPYQAALGAPPPLLLLLEWDRGPWQDPLTRLHIYGRRLAPVCMLLYIHTLLGKRMN

SEQ ID NO: 35605 - protein, 99 aa, Homo sapiens
  ENSP00000427585
MDESALLDLLECPVCLERLDASAKVLPCQHTFCKRCLLGIVGSRNELRCPECRTLVGSGVEELPSNILLVRLLDGIKQRPWKPGPGGGSGTNCTNALRS

SEQ ID NO: 35606 - protein, 79 aa, Homo sapiens
  ENSP00000421714
MDESALLDLLECPVCLERLDASAKVLPCQHTFCKRCLLGIVGSRNELRCPECRTLVGSGVEELPSNILLVRLLDGIKQR

SEQ ID NO: 35607 - protein, 882 aa, Homo sapiens
  ENSP00000309186
MLLGASWLCASKAAAAAAQSEGDEDRPGERRRRRAAATAAGAGEDMDESSLLDLLECSVCLERLDTTAKVLPCQHTFCRRCLESIVCSRHELRCPECRILVGCGVDELPANILLVRLLDGIRQRPRAGTSPGGSPPARPIPGQSAAPTLAGGGGGAAGSTPGSPVFLSAAAGSTAGSLRELATSRTAPAAKNPCLLPYGKALYSYEGKEPGDLKFNKGDIIVLRRKVDEQWYHGELHGTQGFLPASYIQCIQPLPHAPPQGKALYDFEMKDKDQDKDCLTFTKDEILTVLRRVDENWAEGMLGDKIGIFPLLYVELNDSAKQLIEMDKPCPAAASSCNASLPSDSGAVASVAPSPTLSSSGAVSAFQRRVDGKKNTKKRHSFTALSVTHRSSQAASHRHSMEISAPVLISSSDPRAAARIGDLAHLSCAAPTQDVSSSAGSTPTAVPRAASVSGEQGTPPKVQLPLNVYLALYAYKPQKSDELELHKGEMYRVLEKCQDGWFKGASLRTGVSGVFPGNYVTPVSRVPAGGAGPPRNNVVGGSPLAKGITTTMHPGSGSLSSLATATRPALPITTPQAHAQHPTASPPTGSCLRHSAQPTASQARSTISTAAHSAAQAQDRPTATVSPLRTQNSPSRLPATSLRPHSVVSPQHSHQPPVQMCPRPAIPLTSAASAITPPNVSAANLNGEAGGGPIGVLSTSSPTNTGCKLDEKKSEKKEKKSGLLKLLAGASTKKKSRSPPSVSPTHDPQVAVDALLQGAVGPEVSSLSIHGRAGSCPIESEMQGAMGMEPLHRKAGSLDLNFTSPSRQAPLSMAAIRPEPKLLPRERYRVVVSYPPQSEAEIELKEGDIVFVHKKREDGWYKGTLQRNGRTGLFPGSFVESF

SEQ ID NO: 35608 - protein, 1259 aa, Homo sapiens
  ENSP00000425627
MGGCFCIPRERSLTRGPGKETPSKDPTVSSECIASSEYKEKCFLPQNINPDLTLSFCVKSRSRRCVNGPLQEAARRRLWALENEDQEVRMLFKDLSARLVSIQSQRAQFLITFKTMEEIWKFSTYLNLGYVSMCLEHLLFDHKYWLNCILVEDTEIQVSVDDKHLETIYLGLLIQEGHFFCRALCSVTPPAEKEGECLTLCKNELISVKMAEAGSELEGVSLVTGQRGLVLVSALEPLPLPFHQWFLKNYPGSCGLSRKRDWTGSYQIGRGRCKALTGYEPGEKDELNFYQGESIEIIGFVIPGLQWFIGKSTSSGQVGFVPTRNIDPDSYSPMSRNSAFLSDEERCSLLALGSDKQTECSSFLHTLARTDITSVYRLSGFESIQNPPNDLSASQPEGFKEVRPGRAWEEHQAVGSRQSSSSEDSSLEEELLSATSDSYRLPEPDDLDDPELLMDLSTGQEEEAENFAPILAFLDHEGYADHFKSLYDFSFSFLTSSFYSFSEEDEFVAYLEASRKWAKKSHMTWAHARLCFLLGRLSIRKVKLSQARVYFEEAIHILNGAFEDLSLVATLYINLAAIYLKQRLRHKGSALLEKAGALLACLPDRESSAKHELDVVAYVLRQGIVVGSSPLEARACFLAIRLLLSLGRHEEVLPFAERLQLLSGHPPASEAVASVLSFLYDKKYLPHLAVASVQQHGIQSAQGMSLPIWQVHLVLQNTTKLLGFPSPGWGEVSALACPMLRQALAACEELADRSTQRALCLILSKVYLEHRSPDGAIHYLSQALVLGQLLGEQESFESSLCLAWAYLLASQAKKALDVLEPLLCSLKETESLTQRGVIYNLLGLALQGEGRVNRAAKSYLRALNRAQEVGDVHNQAVAMANLGHLSLKSWAQHPARNYLLQAVRLYCELQASKETDMELVQVFLWLAQVLVSGHQLTHGLLCYEMALLFGLRHRHLKSQLQATKSLCHFYSSVSPNPEACITYHEHWLALAQQLRDREMEGRLLESLGQLYRNLNTARSLRRSLTCIKESLRIFIDLGETDKAAEAWLGAGRLHYLMQEDELVELCLQAAIQTALKSEEPLLALKLYEEAGDVFFNGTRHRHHAVEYYRAGAVPLARRLKAVRTELRIFNKLTELQISLEGYEKALEFATLAARLSTVTGDQRQELVAFHRLATVYYSLHMYEMAEDCYLKTLSLCPPWLQSPKEALYYAKVYYRLGRLTFCQLKFLLCCPGWSSVVQSGLPATSDSGAQVILQCQPPE

SEQ ID NO: 35609 - protein, 227 aa, Homo sapiens
  ENSP00000313025
MGGCFCIPRERSLTRGPGKETPSKDPTVSSECIASSEYKEKCFLPQNINPDLTLSFCVKSRSRRCVNGPLQEAARRRLWALENEDQEVRMLFKDLSARLVSIQSQRAQFLITFKTMEEIWKFSTYLNLGYVSMCLEHLLFDHKYWLNCILVEDTEIQVSVDDKHLETIYLGLLIQEGHFFCRALCSVTPPAEKEGECLTLCKNELISVKMAEAGSELEGVSLVTGGS

SEQ ID NO: 35610 - protein, 141 aa, Homo sapiens
  ENSP00000421779
CKNELISVKMAEAGSELEGVSLVTGQRGLVLVSALEPLPLPFHQWFLKNYPGSCGLSRKRDWTGSYQIGRGRCKALTGYEPGEKDELNFYQGESIEIIGFVIPGLQWFIGKSTSSGQVGFVPTRNIDPDSYSPMTWCVSSI

SEQ ID NO: 35611 - protein, 150 aa, Homo sapiens
  ENSP00000421092
MSEQMMQSVGCRISLSVFQFLGDQRQELVAFHRLATVYYSLHMYEMAEDCYLKTLSLCPPWLQSPKEALYYAKVYYRLGRLTFCQLKDAHDATEYFLLALAAAVLLGDEELQDTIRSRLDNICQSPLWHSRPSGCSSERARWLSGGGLAL

SEQ ID NO: 35612 - protein, 37 aa, Homo sapiens
  ENSP00000423940
  MOD_RES (1)..(1): Any amino acid
XECSSFLHTLARTDITSVYRLSGFESIQNPPNDLSGE

SEQ ID NO: 35613 - protein, 1288 aa, Homo sapiens
  ENSP00000423660
MGGCFCIPRERSLTRGPGKETPSKDPTVSSECIASSEYKEKCFLPQNINPDLTLSFCVKSRSRRCVNGPLQEAARRRLWALENEDQEVRMLFKDLSARLVSIQSQRAQFLITFKTMEEIWKFSTYLNLGYVSMCLEHLLFDHKYWLNCILVEDTEIQVSVDDKHLETIYLGLLIQEGHFFCRALCSVTPPAEKEGECLTLCKNELISVKMAEAGSELEGVSLVTGQRGLVLVSALEPLPLPFHQWFLKNYPGSCGLSRKRDWTGSYQIGRGRCKALTGYEPGEKDELNFYQGESIEIIGFVIPGLQWFIGKSTSSGQVGFVPTRNIDPDSYSPMSRNSAFLSDEERCSLLALGSDKQTECSSFLHTLARTDITSVYRLSGFESIQNPPNDLSASQPEGFKEVRPGRAWEEHQAVGSRQSSSSEDSSLEEELLSATSDSYRLPEPDDLDDPELLMDLSTGQEEEAENFAPILAFLDHEGYADHFKSLYDFSFSFLTSSFYSFSEEDEFVAYLEASRKWAKKSHMTWAHARLCFLLGRLSIRKVKLSQARVYFEEAIHILNGAFEDLSLVATLYINLAAIYLKQRLRHKGSALLEKAGALLACLPDRESSAKHELDVVAYVLRQGIVVGSSPLEARACFLAIRLLLSLGRHEEVLPFAERLQLLSGHPPASEAVASVLSFLYDKKYLPHLAVASVQQHGIQSAQGMSLPIWQVHLVLQNTTKLLGFPSPGWGEVSALACPMLRQALAACEELADRSTQRALCLILSKVYLEHRSPDGAIHYLSQALVLGQLLGEQESFESSLCLAWAYLLASQAKKALDVLEPLLCSLKETESLTQRGVIYNLLGLALQGEGRVNRAAKSYLRALNRAQEVGDVHNQAVAMANLGHLSLKSWAQHPARNYLLQAVRLYCELQASKETDMELVQVFLWLAQVLVSGHQLTHGLLCYEMALLFGLRHRHLKSQLQATKSLCHFYSSVSPNPEACITYHEHWLALAQQLRDREMEGRLLESLGQLYRNLNTARSLRRSLTCIKESLRIFIDLGETDKAAEAWLGAGRLHYLMQEDELVELCLQAAIQTALKSEEPLLALKLYEEAGDVFFNGTRHRHHAVEYYRAGAVPLARRLKAVRTELRIFNKLTELQISLEGYEKALEFATLAARLSTVTGDQRQELVAFHRLATVYYSLHMYEMAEDCYLKTLSLCPPWLQSPKEALYYAKVYYRLGRLTFCQLKDAHDATEYFLLALAAAVLLGDEELQDTIRSRLDNICQSPLWHSRPSGCSSERARWLSGGGLAL

SEQ ID NO: 35614 - protein, 1281 aa, Homo sapiens
  ENSP00000421860
MGGCFCIPRERSLTRGPGKETPSKDPTVSSECIASSEYKEKCFLPQNINPDLTLSFCVKSRSRRCVNGPLQEAARRRLWALENEDQEVRMLFKDLSARLVSIQSQRAQFLITFKTMEEIWKFSTYLNLEHLLFDHKYWLNCILVEDTEIQVSVDDKHLETIYLGLLIQEGHFFCRALCSVTPPAEKEGECLTLCKNELISVKMAEAGSELEGVSLVTGQRGLVLVSALEPLPLPFHQWFLKNYPGSCGLSRKRDWTGSYQIGRGRCKALTGYEPGEKDELNFYQGESIEIIGFVIPGLQWFIGKSTSSGQVGFVPTRNIDPDSYSPMSRNSAFLSDEERCSLLALGSDKQTECSSFLHTLARTDITSVYRLSGFESIQNPPNDLSASQPEGFKEVRPGRAWEEHQAVGSRQSSSSEDSSLEEELLSATSDSYRLPEPDDLDDPELLMDLSTGQEEEAENFAPILAFLDHEGYADHFKSLYDFSFSFLTSSFYSFSEEDEFVAYLEASRKWAKKSHMTWAHARLCFLLGRLSIRKVKLSQARVYFEEAIHILNGAFEDLSLVATLYINLAAIYLKQRLRHKGSALLEKAGALLACLPDRESSAKHELDVVAYVLRQGIVVGSSPLEARACFLAIRLLLSLGRHEEVLPFAERLQLLSGHPPASEAVASVLSFLYDKKYLPHLAVASVQQHGIQSAQGMSLPIWQVHLVLQNTTKLLGFPSPGWGEVSALACPMLRQALAACEELADRSTQRALCLILSKVYLEHRSPDGAIHYLSQALVLGQLLGEQESFESSLCLAWAYLLASQAKKALDVLEPLLCSLKETESLTQRGVIYNLLGLALQGEGRVNRAAKSYLRALNRAQEVGDVHNQAVAMANLGHLSLKSWAQHPARNYLLQAVRLYCELQASKETDMELVQVFLWLAQVLVSGHQLTHGLLCYEMALLFGLRHRHLKSQLQATKSLCHFYSSVSPNPEACITYHEHWLALAQQLRDREMEGRLLESLGQLYRNLNTARSLRRSLTCIKESLRIFIDLGETDKAAEAWLGAGRLHYLMQEDELVELCLQAAIQTALKSEEPLLALKLYEEAGDVFFNGTRHRHHAVEYYRAGAVPLARRLKAVRTELRIFNKLTELQISLEGYEKALEFATLAARLSTVTGDQRQELVAFHRLATVYYSLHMYEMAEDCYLKTLSLCPPWLQSPKEALYYAKVYYRLGRLTFCQLKDAHDATEYFLLALAAAVLLGDEELQDTIRSRLDNICQSPLWHSRPSGCSSERARWLSGGGLAL

SEQ ID NO: 35615 - protein, 227 aa, Homo sapiens; identical to SEQ ID NO: 35609
  ENSP00000423111

SEQ ID NO: 35616 - protein, 95 aa, Homo sapiens
  ENSP00000421420
MGGCFCIPRERSLTRGPGKETPSKDPTVSSECIASSEYKEKCFLPQNINPDLTLSFCVKSRSRRCVNGPLQEAARRRLWALENEDQEVRMLFKVL

SEQ ID NO: 35617 - protein, 1548 aa, Homo sapiens
  ENSP00000375689
MQLMALEQRFGSGLPGGGQPLCLMMSSPLPPPPPHFSCLPASDYIIKEKTVLLQKKDSEGFGFVLRGAKAQTPIEEFTPTPAFPALQYLESVDEGGVAWRAGLRMGDFLIEVNGQNVVKVGHRQVVNMIRQGGNTLMVKVVMVTRHPDMDEAVHKKAPQQAKRLPPPTISLRSKSMTSELEEMEYEQQPAPVPSMEKKRTVYQMALNKLDEILAAAQQTISASESPGPGGLASLGKHRPKGFFATESSFDPHHRAQPSYERPSFLPPGPGLMLRQKSIGAAEDDRPYLAPPAMKFSRSLSVPGSEDIPPPPTTSPPEPPYSTPPVPSSSGRLTPSPRGGPFNPGSGGPLPASSPASFDGPSPPDTRVGSREKSLYHSGPLPPAHHHPPHHHHHHAPPPQPHHHHAHPPHPPEMETGGSPDDPPPRLALGPQPSLRGWRGGGPSPTPGAPSPSHHGSAGGGGGSSQGPALRYFQLPPRAASAAMYVPARSGRGRKGPLVKQTKVEGEPQKGGGLPPAPSPTSPASPQPPPAVAAPSEKNSIPIPTIIIKAPSTSSSGRSSQGSSTEAEPPTQPEPTGGGGGGGSSPSPAPAMSPVPPSPSPVPTPASPSGPATLDFTSQFGAALVGAARREGGWQNEARRRSTLFLSTDAGDEDGGDGGLGTGAAPGPRLRHSKSIDEGMFSAEPYLRLESAGSGAGYGGYGAGSRAYGGGGGSSAFTSFLPPRPLVHPLTGKALDPASPLGLALAARERALKESSEGGGAPQPPPRPPSPRYEAPPPTPHHHSPHAHHEPVLRLWGASPPDPARRELGYRAGLGSQEKSLPASPPAARRSLLHRLPPTAPGVGPLLLQLGTEPPAPHPGVSKPWRSAAPEEPERLPLHVRFLENCQPRAPVTSGRGPPSEDGPGVPPPSPRRSVPPSPTSPRASEENGLPLLVLPPPAPSVDVEDGEFLFVEPLPPPLEFSNSFEKPESPLTPGPPHPLPDTPAPATPLPPVPPPAVAAAPPTLDSTASSLTSYDSEVATLTQGASAAPGDPHPPGPPAPAAPAPAAPQPGPDPPPGTDSGIEEVDSRSSSDHPLETISSASTLSSLSAEGGGSAGGGGGAGAGVASGPELLDTYVAYLDGQAFGGSSTPGPPYPPQLMTPSKLRGRALGASGGLRPGPSGGLRDPVTPTSPTVSVTGAGTDGLLALRACSGPPTAGVAGGPVAVEPEVPPVPLPTASSLPRKLLPWEEGPGPPPPPLPGPLAQPQASALATVKASIISELSSKLQQFGGSSAAGGALPWARGGSGGGGDSHHGGASYVPERTSSLQRQRLSDDSQSSLLSKPVSSLFQNWPKPPLPPLPTGTGVSPTAAAAPGATSPSASSSSTSTRHLQGVEFEMRPPLLRRAPSPSLLPASEHKVSPAPRPSSLPILPSGPLYPGLFDIRGSPTGGAGGSADPFAPVFVPPHPGISGGLGGALSGASRSLSPTRLLSLPPDKPFGAKPLGFWTKFDVADWLEWLGLAEHRAQFLDHEIDGSHLPALTKEDYVDLGVTRVGHRMNIDRALKFFLER

SEQ ID NO: 35618 - protein, 2161 aa, Homo sapiens
  ENSP00000293441
MTHSPATSEDEERHSASECPEGGSESDSSPDGPGRGPRGTRGQGSGAPGSLASVRGLQGRSMSVPDDAHFSMMVFRIGIPDLHQTKCLRFNPDATIWTAKQQVLCALSESLQDVLNYGLFQPATSGRDANFLEEERLLREYPQSFEKGVPYLEFRYKTRVYKQTNLDEKQLAKLHTKTGLKKFLEYVQLGTSDKVARLLDKGLDPNYHDSDSGETPLTLAAQTEGSVEVIRTLCLGGAHIDFRARDGMTALHKAACARHCLALTALLDLGGSPNYKDRRGLTPLFHTAMVGGDPRCCELLLFNRAQLGIADENGWQEIHQACQRGHSQHLEHLLFYGAEPGAQNASGNTALHICALYNKETCARILLYRGADKDVKNNNGQTPFQVAVIAGNFELGELIRNHREQDVVPFQESPKYAARRRGPPGTGLTVPPALLRANSDTSMALPDWMVFSAPGAASSGAPGPTSGSQGQSQPSAPTTKLSSGTLRSASSPRGARARSPSRGRHPEDAKRQPRGRPSSSGTPREGPAGGTGGSGGPGGSLGSRGRRRKLYSAVPGRSFMAVKSYQAQAEGEISLSKGEKIKVLSIGEGGFWEGQVKGRVGWFPSDCLEEVANRSQESKQESRSDKAKRLFRHYTVGSYDSFDAPSLMDGIGPGSDYIIKEKTVLLQKKDSEGFGFVLRGAKAQTPIEEFTPTPAFPALQYLESVDEGGVAWRAGLRMGDFLIEVNGQNVVKVGHRQVVNMIRQGGNTLMVKVVMVTRHPDMDEAVHKKAPQQAKRLPPPTISLRSKSMTSELEEMEYEQQPAPVPSMEKKRTVYQMALNKLDEILAAAQQTISASESPGPGGLASLGKHRPKGFFATESSFDPHHRAQPSYERPSFLPPGPGLMLRQKSIGAAEDDRPYLAPPAMKFSRSLSVPGSEDIPPPPTTSPPEPPYSTPPVPSSSGRLTPSPRGGPFNPGSGGPLPASSPASFDGPSPPDTRVGSREKSLYHSGPLPPAHHHPPHHHHHHAPPPQPHHHHAHPPHPPEMETGGSPDDPPPRLALGPQPSLRGWRGGGPSPTPGAPSPSHHGSAGGGGGSSQGPALRYFQLPPRAASAAMYVPARSGRGRKGPLVKQTKVEGEPQKGGGLPPAPSPTSPASPQPPPAVAAPSEKNSIPIPTIIIKAPSTSSSGRSSQGSSTEAEPPTQPEPTGGGGGGGSSPSPAPAMSPVPPSPSPVPTPASPSGPATLDFTSQFGAALVGAARREGGWQNEARRRSTLFLSTDAGDEDGGDGGLGTGAAPGPRLRHSKSIDEGMFSAEPYLRLESAGSGAGYGGYGAGSRAYGGGGGSSAFTSFLPPRPLVHPLTGKALDPASPLGLALAARERALKESSEGGGAPQPPPRPPSPRYEAPPPTPHHHSPHAHHEPVLRLWGASPPDPARRELGYRAGLGSQEKSLPASPPAARRSLLHRLPPTAPGVGPLLLQLGTEPPAPHPGVSKPWRSAAPEEPERLPLHVRFLENCQPRAPVTSGRGPPSEDGPGVPPPSPRRSVPPSPTSPRASEENGLPLLVLPPPAPSVDVEDGEFLFVEPLPPPLEFSNSFEKPESPLTPGPPHPLPDTPAPATPLPPVPPPAVAAAPPTLDSTASSLTSYDSEVATLTQGASAAPGDPHPPGPPAPAAPAPAAPQPGPDPPPGTDSGIEEVDSRSSSDHPLETISSASTLSSLSAEGGGSAGGGGGAGAGVASGPELLDTYVAYLDGQAFGGSSTPGPPYPPQLMTPSKLRGRALGASGGLRPGPSGGLRDPVTPTSPTVSVTGAGTDGLLALRACSGPPTAGVAGGPVAVEPEVPPVPLPTASSLPRKLLPWEEGPGPPPPPLPGPLAQPQASALATVKASIISELSSKLQQFGGSSAAGGALPWARGGSGGGGDSHHGGASYVPERTSSLQRQRLSDDSQSSLLSKPVSSLFQNWPKPPLPPLPTGTGVSPTAAAAPGATSPSASSSSTSTRHLQGVEFEMRPPLLRRAPSPSLLPASEHKVSPAPRPSSLPILPSGPLYPGLFDIRGSPTGGAGGSADPFAPVFVPPHPGISGGLGGALSGASRSLSPTRLLSLPPDKPFGAKPLGFWTKFDVADWLEWLGLAEHRAQFLDHEIDGSHLPALTKEDYVDLGVTRVGHRMNIDRALKFFLER

SEQ ID NO: 35619 - protein, 2169 aa, Homo sapiens
  ENSP00000375690
MTHSPATSEDEERHSASECPEGGSESDSSPDGPGRGPRGTRGQGSGAPGSLASVRGLQGRSMSVPDDAHFSMMVFRIGIPDLHQTKCLRFNPDATIWTAKQQVLCALSESLQDVLNYGLFQPATSGRDANFLEEERLLREYPQSFEKGVPYLEFRYKTRVYKQTNLDEKQLAKLHTKTGLKKFLEYVQLGTSDKVARLLDKGLDPNYHDSDSGETPLTLAAQTEGSVEVIRTLCLGGAHIDFRARDGMTALHKAACARHCLALTALLDLGGSPNYKDRRGLTPLFHTAMVGGDPRCCELLLFNRAQLGIADENGWQEIHQACQRGHSQHLEHLLFYGAEPGAQNASGNTALHICALYNKETCARILLYRGADKDVKNNNGQTPFQVAVIAGNFELGELIRNHREQDVVPFQESPKYAARRRGPPGTGLTVPPALLRANSDTSMALPDWMVFSAPGAASSGAPGPTSGSQGQSQPSAPTTKLSSGTLRSASSPRGARARSPSRGRHPEDAKRQPRGRPSSSGTPREGPAGGTGGSGGPGGSLGSRGRRRKLYSAVPGRSFMAVKSYQAQAEGEISLSKGEKIKVLSIGEGGFWEGQVKGRVGWFPSDCLEEVANRSQESKQESRSDKAKRLFRHYTVGSYDSFDAPSLMDGIGPGSDYIIKEKTVLLQKKDSEGFGFVLRGAKAQTPIEEFTPTPAFPALQYLESVDEGGVAWRAGLRMGDFLIEVNGQNVVKVGHRQVVNMIRQGGNTLMVKVVMVTRHPDMDEAVHKKAPQQAKRLPPPTISLRSKSMTSELEEMVSPWKKKSEYEQQPAPVPSMEKKRTVYQMALNKLDEILAAAQQTISASESPGPGGLASLGKHRPKGFFATESSFDPHHRAQPSYERPSFLPPGPGLMLRQKSIGAAEDDRPYLAPPAMKFSRSLSVPGSEDIPPPPTTSPPEPPYSTPPVPSSSGRLTPSPRGGPFNPGSGGPLPASSPASFDGPSPPDTRVGSREKSLYHSGPLPPAHHHPPHHHHHHAPPPQPHHHHAHPPHPPEMETGGSPDDPPPRLALGPQPSLRGWRGGGPSPTPGAPSPSHHGSAGGGGGSSQGPALRYFQLPPRAASAAMYVPARSGRGRKGPLVKQTKVEGEPQKGGGLPPAPSPTSPASPQPPPAVAAPSEKNSIPIPTIIIKAPSTSSSGRSSQGSSTEAEPPTQPEPTGGGGGGGSSPSPAPAMSPVPPSPSPVPTPASPSGPATLDFTSQFGAALVGAARREGGWQNEARRRSTLFLSTDAGDEDGGDGGLGTGAAPGPRLRHSKSIDEGMFSAEPYLRLESAGSGAGYGGYGAGSRAYGGGGGSSAFTSFLPPRPLVHPLTGKALDPASPLGLALAARERALKESSEGGGAPQPPPRPPSPRYEAPPPTPHHHSPHAHHEPVLRLWGASPPDPARRELGYRAGLGSQEKSLPASPPAARRSLLHRLPPTAPGVGPLLLQLGTEPPAPHPGVSKPWRSAAPEEPERLPLHVRFLENCQPRAPVTSGRGPPSEDGPGVPPPSPRRSVPPSPTSPRASEENGLPLLVLPPPAPSVDVEDGEFLFVEPLPPPLEFSNSFEKPESPLTPGPPHPLPDTPAPATPLPPVPPPAVAAAPPTLDSTASSLTSYDSEVATLTQGASAAPGDPHPPGPPAPAAPAPAAPQPGPDPPPGTDSGIEEVDSRSSSDHPLETISSASTLSSLSAEGGGSAGGGGGAGAGVASGPELLDTYVAYLDGQAFGGSSTPGPPYPPQLMTPSKLRGRALGASGGLRPGPSGGLRDPVTPTSPTVSVTGAGTDGLLALRACSGPPTAGVAGGPVAVEPEVPPVPLPTASSLPRKLLPWEEGPGPPPPPLPGPLAQPQASALATVKASIISELSSKLQQFGGSSAAGGALPWARGGSGGGGDSHHGGASYVPERTSSLQRQRLSDDSQSSLLSKPVSSLFQNWPKPPLPPLPTGTGVSPTAAAAPGATSPSASSSSTSTRHLQGVEFEMRPPLLRRAPSPSLLPASEHKVSPAPRPSSLPILPSGPLYPGLFDIRGSPTGGAGGSADPFAPVFVPPHPGISGGLGGALSGASRSLSPTRLLSLPPDKPFGAKPLGFWTKFDVADWLEWLGLAEHRAQFLDHEIDGSHLPALTKEDYVDLGVTRVGHRMNIDRALKFFLER

SEQ ID NO: 35620 - protein, 2152 aa, Homo sapiens
  ENSP00000351984
MTHSPATSEDEERHSASECPEGGSESDSSPDGPGRGPRGTRGQGSGAPGSLASVRGLQGRSMSVPDDAHFSMMVFRIGIPDLHQTKCLRFNPDATIWTAKQQVLCALSESLQDVLNYGLFQPATSGRDANFLEEERLLREYPQSFEKGVPYLEFRYKTRVYKQTNLDEKQLAKLHTKTGLKKFLEYVQLGTSDKVARLLDKGLDPNYHDSDSGETPLTLAAQTEGSVEVIRTLCLGGAHIDFRARDGMTALHKAACARHCLALTALLDLGGSPNYKDRRGLTPLFHTAMVGGDPRCCELLLFNRAQLGIADENGWQEIHQACQRGHSQHLEHLLFYGAEPGAQNASGNTALHICALYNKETCARILLYRGADKDVKNNNGQTPFQVAVIAGNFELGELIRNHREQDVVPFQESPKYAARRRGPPGTGLTVPPALLRANSDTSMALPDWMVFSAPGAASSGAPGPTSGSQGQSQPSAPTTKLSSGTLRSASSPRGARARSPSRGRHPEDAKRQPRGRPSSSGTPREGPAGGTGGSGGPGGSLGSRGRRRKLYSAVPGRSFMAVKSYQAQAEGEISLSKGEKIKVLSIGEGGFWEGQVKGRVGWFPSDCLEEVANRSQESKQESRSDKAKRLFRHYTVGSYDSFDAPSDYIIKEKTVLLQKKDSEGFGFVLRGAKAQTPIEEFTPTPAFPALQYLESVDEGGVAWRAGLRMGDFLIEVNGQNVVKVGHRQVVNMIRQGGNTLMVKVVMVTRHPDMDEAVHKKAPQQAKRLPPPTISLRSKSMTSELEEMEYEQQPAPVPSMEKKRTVYQMALNKLDEILAAAQQTISASESPGPGGLASLGKHRPKGFFATESSFDPHHRAQPSYERPSFLPPGPGLMLRQKSIGAAEDDRPYLAPPAMKFSRSLSVPGSEDIPPPPTTSPPEPPYSTPPVPSSSGRLTPSPRGGPFNPGSGGPLPASSPASFDGPSPPDTRVGSREKSLYHSGPLPPAHHHPPHHHHHHAPPPQPHHHHAHPPHPPEMETGGSPDDPPPRLALGPQPSLRGWRGGGPSPTPGAPSPSHHGSAGGGGGSSQGPALRYFQLPPRAASAAMYVPARSGRGRKGPLVKQTKVEGEPQKGGGLPPAPSPTSPASPQPPPAVAAPSEKNSIPIPTIIIKAPSTSSSGRSSQGSSTEAEPPTQPEPTGGGGGGGSSPSPAPAMSPVPPSPSPVPTPASPSGPATLDFTSQFGAALVGAARREGGWQNEARRRSTLFLSTDAGDEDGGDGGLGTGAAPGPRLRHSKSIDEGMFSAEPYLRLESAGSGAGYGGYGAGSRAYGGGGGSSAFTSFLPPRPLVHPLTGKALDPASPLGLALAARERALKESSEGGGAPQPPPRPPSPRYEAPPPTPHHHSPHAHHEPVLRLWGASPPDPARRELGYRAGLGSQEKSLPASPPAARRSLLHRLPPTAPGVGPLLLQLGTEPPAPHPGVSKPWRSAAPEEPERLPLHVRFLENCQPRAPVTSGRGPPSEDGPGVPPPSPRRSVPPSPTSPRASEENGLPLLVLPPPAPSVDVEDGEFLFVEPLPPPLEFSNSFEKPESPLTPGPPHPLPDTPAPATPLPPVPPPAVAAAPPTLDSTASSLTSYDSEVATLTQGASAAPGDPHPPGPPAPAAPAPAAPQPGPDPPPGTDSGIEEVDSRSSSDHPLETISSASTLSSLSAEGGGSAGGGGGAGAGVASGPELLDTYVAYLDGQAFGGSSTPGPPYPPQLMTPSKLRGRALGASGGLRPGPSGGLRDPVTPTSPTVSVTGAGTDGLLALRACSGPPTAGVAGGPVAVEPEVPPVPLPTASSLPRKLLPWEEGPGPPPPPLPGPLAQPQASALATVKASIISELSSKLQQFGGSSAAGGALPWARGGSGGGGDSHHGGASYVPERTSSLQRQRLSDDSQSSLLSKPVSSLFQNWPKPPLPPLPTGTGVSPTAAAAPGATSPSASSSSTSTRHLQGVEFEMRPPLLRRAPSPSLLPASEHKVSPAPRPSSLPILPSGPLYPGLFDIRGSPTGGAGGSADPFAPVFVPPHPGISGGLGGALSGASRSLSPTRLLSLPPDKPFGAKPLGFWTKFDVADWLEWLGLAEHRAQFLDHEIDGSHLPALTKEDYVDLGVTRVGHRMNIDRALKFFLER

SEQ ID NO: 35621 - protein, 183 aa, Homo sapiens
  ENSP00000469719
PGPPYPPQLMTPSKLRGRALGASGGLRPGPSGGLRDPVTPTSPTVSVTGAGTDGLLALRACSGPPTAGVAGGPVAVEPEVPPVPLPTASSLPRKLLPWEEGPGPPPPPLPGPLAQPQASALATVKASIISELSSKLQQFGGSSAAGGALPWARGGSGGGGDSHHGGASYVPERTSSLQRQSIE

SEQ ID NO: 35622 - protein, 126 aa, Homo sapiens
  ENSP00000476264
MPRSPTSSEDEMAQSFSDYSVGSESDSSKEETIYDTIRATAEKPGGARTEESQGNTLVIRVVIHDLQQTKCIRFNPDATVWVAKQRILCTLTQSLKDVLNYGLFQPASNGRDGRSFPGVSIQEAGV

SEQ ID NO: 35623 - protein, 108 aa, Homo sapiens
  ENSP00000482553
  MOD_RES (1)..(1): Any amino acid
XEHATVCCKDENGWHEIHQACRYGHVQHLEHLLFYGADMSAQNASGNTALHICALYNQDSCARVLLFRGGNKELKNYNSQTPFQVAIIAGNFELAEYIKNHKETDIGE

SEQ ID NO: 35624 - protein, 186 aa, Homo sapiens
  ENSP00000392674
  MOD_RES (1)..(1): Any amino acid
XFYKLQGPSCRFHLPEGRHPGGRGTRMDVGTTSALPFSQCPSERPRRTPTAGGGPPTRWPPPGSCCAPTVTTTSMPALPTGPSAPRPPRTAACHPSCCSRCPASPRGPRRPLGATCPGPAAGPHRSTGWAAQARTARGRSLSGMSGRLLLLVPTRTHSRPSSTRGPSGSSTVPCPGGSSSLSSHTN

SEQ ID NO: 35625 - protein, 74 aa, Homo sapiens
  ENSP00000483920
  MOD_RES (1)..(1): Any amino acid
XAGFESSPSTCSWFPADRQNMGWALSPARWVWHAQLCSEVHRAQTPATSPRVPAALAPRGRAARLSFLPSRKVI

SEQ ID NO: 35626 - protein, 281 aa, Homo sapiens
  ENSP00000387324
MMMNVPGGGAAAVMMTGYNNGRCPRNSLYSDCIIEEKTVVLQKKDNEGFGFVLRGAKADTPIEEFTPTPAFPALQYLESVDEGGVAWQAGLRTGDFLIEVNNENVVKVGHRQVVNMIRQGGNHLVLKVVTVTRNLDPDDTARKKAPPPPKRAPTTALTLRSKSMTSELEELVDKASVRKKKDKPEEIVPASKPSRAAENMAVEPRVATIKQRPSSRCFPAGSDMNSVYERQGIAVMTPTVPGSPKAPFLGIPRGTMRRQKSIGKKCGTPPQKLPLGFQTQP

SEQ ID NO: 35627 - protein, 257 aa, Homo sapiens
  ENSP00000414876
  MOD_RES (1)..(1): Any amino acid
XMNVPGGGAAAVMMTGYNNGRCPRNSLYSDCIIEEKTVVLQKKDNEGFGFVLRGAKADTPIEEFTPTPAFPALQYLESVDEGGVAWQAGLRTGDFLIEVNNENVVKVGHRQVVNMIRQGGNHLVLKVVTVTRNLDPDDTARKKAPPPPKRAPTTALTLRSKSMTSELEELVDKASVRKKKDKPEEIVPASKPSRAAENMAVEPRVATIKQRPSSRCFPAGSDMNSVYERQGIAVMTPTVPGSPKAPFLGIPREARRS

SEQ ID NO: 35628 - protein, 1261 aa, Homo sapiens [sequence omitted]

SEQ ID NO: 35629 - protein, 244 aa, Homo sapiens [sequence omitted]

SEQ ID NO: 35630 - protein, 212 aa, Homo sapiens
  ENSP00000390636
  MOD_RES (1)..(1): Any amino acid
XTPLTLAAQLDDSVEVIKALKNGGAHLDFRAKDGMTALHKAARARNQVALKTLLELGASPDYKDSYGLTPLYHTAIVGGDPYCCELLLHEHATVCCKDENGWHEIHQACRYGHVQHLEHLLFYGADMSAQNASGNTALHICALYNQDSCARVLLFRGGNKELKNYNSQTPFQPQKAATRDHRWVSVPTLLLLRPPRTHEARAALPSASPRVL

SEQ ID NO: 35631 - protein, 153 aa, Homo sapiens
  ENSP00000391570
  MOD_RES (1)..(1): Any amino acid
XTETRADRSKKLFRHYTVGSYDSFDTSSDCIIEEKTVVLQKKDNEGFGFVLRGAKADTPIEEFTPTPAFPALQYLESVDEGGVAWQAGLRTGDFLIEVNNENVVKVGHRQVVNMIRQGGNHLVLKVVTVTRNLDPDDTARKKDKPEEIVPASK

SEQ ID NO: 35632 - protein, 271 aa, Homo sapiens
  ENSP00000394939
MMMNVPGGGAAAVMMTGYNNGRCPRNSLYSDCIIEEKTVVLQKKDNEGFGFVLRGAKADTPIEEFTPTPAFPALQYLESVDEGGVAWQAGLRTGDFLIEVNNENVVKVGHRQVVNMIRQGGNHLVLKVVTVTRNLDPDDTARKKAPPPPKRAPTTALTLRSKSMTSELEELDKPEEIVPASKPSRAAENMAVEPRVATIKQRPSSRCFPAGSDMNSVYERQGIAVMTPTVPGSPKAPFLGIPRGTMRRQKSIGKKCGTPPQKLPLGFQTQP

SEQ ID NO: 35633 - protein, 1849 aa, Homo sapiens
  ENSP00000469689
MPRSPTSSEDEMAQSFSDYSVGSESDSSKEETIYDTIRATAEKPGGARTEESQGNTLVIRVVIHDLQQTKCIRFNPDATVWVAKQRILCTLTQSLKDVLNYGLFQPASNGRDGKFLDEERLLREYPQPVGEGVPSLEFRYKKRVYKQASLDEKQLAKLHTKTNLKKCMDHIQHRLVEKITKMLDRGLDPNFHDPETGETPLTLAAQLDDSVEVIKALKNGGAHLDFRAKDGMTALHKAARARNQVALKTLLELGASPDYKDSYGLTPLYHTAIVGGDPYCCELLLHEHATVCCKDENGWHEIHQACRYGHVQHLEHLLFYGADMSAQNASGNTALHICALYNQDSCARVLLFRGGNKELKNYNSQTPFQVAIIAGNFELAEYIKNHKETDIVPFREAPAYSNRRRRPPNTLAAPRVLLRSNSDNNLNASAPDWAVCSTATSHRSLSPQLLQQMPSKPEGAAKTIGSYVPGPRSRSPSLNRLGGAGEDGKRPQPLWHVGSPFALGANKDSLSAFEYPGPKRKLYSAVPGRLFVAVKPYQPQVDGEIPLHRGDRVKVLSIGEGGFWEGSARGHIGWFPAECVEEVQCKPRDSQAETRADRSKKLFRHYTVGSYDSFDTSSDCIIEEKTVVLQKKDNEGFGFVLRGAKADTPIEEFTPTPAFPALQYLESVDEGGVAWQAGLRTGDFLIEVNNENVVKVGHRQVVNMIRQGGNHLVLKVVTVTRNLDPDDTARKKAPPPPKRAPTTALTLRSKSMTSELEELVDKASVRKKKDKPEEIVPASKPSRAAENMAVEPRVATIKQRPSSRCFPAGSDMNSVYERQGIAVMTPTVPGSPKAPFLGIPRGTMRRQKSIDSRIFLSGITEEERQFLAPPMLKFTRSLSMPDTSEDIPPPPQSVPPSPPPPSPTTYNCPKSPTPRVYGTIKPAFNQNSAAKVSPATRSDTVATMMREKGMYFRRELDRYSLDSEDLYSRNAGPQANFRNKRGQMPENPYSEVGKIASKAVYVPAKPARRKGMLVKQSNVEDSPEKTCSIPIPTIIVKEPSTSSSGKSSQGSSMEIDPQAPEPPSQLRPDESLTVSSPFAAAIAGAVRDREKRLEARRNSPAFLSTDLGDEDVGLGPPAPRTRPSMFPEEGDFADEDSAEQLSSPMPSATPREPENHFVGGAEASAPGEAGRPLNSTSKAQGPESSPAVPSASSGTAGPGNYVHPLTGRLLDPSSPLALALSARDRAMKESQQGPKGEAPKADLNKPLYIDTKMRPSLDAGFPTVTRQNTRGPLRRQETENKYETDLGRDRKGDDKKNMLIDIMDTSQQKSAGLLMVHTVDATKLDNALQEEDEKAEVEMKPDSSPSEVPEGVSETEGALQISAAPEPTTVPGRTIVAVGSMEEAVILPFRIPPPPLASVDLDEDFIFTEPLPPPLEFANSFDIPDDRAASVPALSDLVKQKKSDTPQSPSLNSSQPTNSADSKKPASLSNCLPASFLPPPESFDAVADSGIEEVDSRSSSDHHLETTSTISTVSSISTLSSEGGENVDTCTVYADGQAFMVDKPPVPPKPKMKPIIHKSNALYQDALVEEDVDSFVIPPPAPPPPPGSAQPGMAKVLQPRTSKLWGDVTEIKSPILSGPKANVISELNSILQQMNREKLAKPGEGLDSPMGAKSASLAPRSPEIMSTISGTRSTTVTFTVRPGTSQPITLQSRPPDYESRTSGTRRAPSPVVSPTEMNKETLPAPLSAATASPSPALSDVFSLPSQPPSGDLFGLNPAGRSRSPSPSILQQPISNKPFTTKPVHLWTKPDVADWLESLNLGEHKEAFMDNEIDGSHLPNLQKEDLIDLGVTRVGHRMNIERALKQLLDR

SEQ ID NO: 35634 - protein, 1261 aa, Homo sapiens
  ENSP00000345193
MMMNVPGGGAAAVMMTGYNNGRCPRNSLYSDCIIEEKTVVLQKKDNEGFGFVLRGAKADTPIEEFTPTPAFPALQYLESVDEGGVAWQAGLRTGDFLIEVNNENVVKVGHRQVVNMIRQGGNHLVLKVVTVTRNLDPDDTARKKAPPPPKRAPTTALTLRSKSMTSELEELVDKASVRKKKDKPEEIVPASKPSRAAENMAVEPRVATIKQRPSSRCFPAGSDMNSVYERQGIAVMTPTVPGSPKAPFLGIPRGTMRRQKSIDSRIFLSGITEEERQFLAPPMLKFTRSLSMPDTSEDIPPPPQSVPPSPPPPSPTTYNCPKSPTPRVYGTIKPAFNQNSAAKVSPATRSDTVATMMREKGMYFRRELDRYSLDSEDLYSRNAGPQANFRNKRGQMPENPYSEVGKIASKAVYVPAKPARRKGMLVKQSNVEDSPEKTCSIPIPTIIVKEPSTSSSGKSSQGSSMEIDPQAPEPPSQLRPDESLTVSSPFAAAIAGAVRDREKRLEARRNSPAFLSTDLGDEDVGLGPPAPRTRPSMFPEEGDFADEDSAEQLSSPMPSATPREPENHFVGGAEASAPGEAGRPLNSTSKAQGPESSPAVPSASSGTAGPGNYVHPLTGRLLDPSSPLALALSARDRAMKESQQGPKGEAPKADLNKPLYIDTKMRPSLDAGFPTVTRQNTRGPLRRQETENKYETDLGRDRKGDDKKNMLIDIMDTSQQKSAGLLMVHTVDATKLDNALQEEDEKAEVEMKPDSSPSEVPEGVSETEGALQISAAPEPTTVPGRTIVAVGSMEEAVILPFRIPPPPLASVDLDEDFIFTEPLPPPLEFANSFDIPDDRAASVPALSDLVKQKKSDTPQSPSLNSSQPTNSADSKKPASLSNCLPASFLPPPESFDAVADSGIEEVDSRSSSDHHLETTSTISTVSSISTLSSEGGENVDTCTVYADGQAFMVDKPPVPPKPKMKPIIHKSNALYQDALVEEDVDSFVIPPPAPPPPPGSAQPGMAKVLQPRTSKLWGDVTEIKSPILSGPKANVISELNSILQQMNREKLAKPGEGLDSPMGAKSASLAPRSPEIMSTISGTRSTTVTFTVRPGTSQPITLQSRPPDYESRTSGTRRAPSPVVSPTEMNKETLPAPLSAATASPSPALSDVFSLPSQPPSGDLFGLNPAGRSRSPSPSILQQPISNKPFTTKPVHLWTKPDVADWLESLNLGEHKEAFMDNEIDGSHLPNLQKEDLIDLGVTRVGHRMNIERALKQLLDR

SEQ ID NO: 35635 - protein, 1128 aa, Homo sapiens
  ENSP00000402944
LVLKVVTVTRNLDPDDTARKKAPPPPKRAPTTALTLRSKSMTSELEELDKPEEIVPASKPSRAAENMAVEPRVATIKQRPSSRCFPAGSDMNSVYERQGIAVMTPTVPGSPKAPFLGIPRGTMRRQKSIDSRIFLSGITEEERQFLAPPMLKFTRSLSMPDTSEDIPPPPQSVPPSPPPPSPTTYNCPKSPTPRVYGTIKPAFNQNSAAKVSPATRSDTVATMMREKGMYFRRELDRYSLDSEDLYSRNAGPQANFRNKRGQMPENPYSEVGKIASKAVYVPAKPARRKGMLVKQSNVEDSPEKTCSIPIPTIIVKEPSTSSSGKSSQGSSMEIDPQAPEPPSQLRPDESLTVSSPFAAAIAGAVRDREKRLEARRNSPAFLSTDLGDEDVGLGPPAPRTRPSMFPEEGDFADEDSAEQLSSPMPSATPREPENHFVGGAEASAPGEAGRPLNSTSKAQGPESSPAVPSASSGTAGPGNYVHPLTGRLLDPSSPLALALSARDRAMKESQQGPKGEAPKADLNKPLYIDTKMRPSLDAGFPTVTRQNTRGPLRRQETENKYETDLGRDRKGDDKKNMLIDIMDTSQQKSAGLLMVHTVDATKLDNALQEEDEKAEVEMKPDSSPSEVPEGVSETEGALQISAAPEPTTVPGRTIVAVGSMEEAVILPFRIPPPPLASVDLDEDFIFTEPLPPPLEFANSFDIPDDRAASVPALSDLVKQKKSDTPQSPSLNSSQPTNSADSKKPASLSNCLPASFLPPPESFDAVADSGIEEVDSRSSSDHHLETTSTISTVSSISTLSSEGGENVDTCTVYADGQAFMVDKPPVPPKPKMKPIIHKSNALYQDALVEEDVDSFVIPPPAPPPPPGSAQPGMAKVLQPRTSKLWGDVTEIKSPILSGPKANVISELNSILQQMNREKLAKPGEGLDSPMGAKSASLAPRSPEIMSTISGTRSTTVTFTVRPGTSQPITLQSRPPDYESRTSGTRRAPSPVVSPTEMNKETLPAPLSAATASPSPALSDVFSLPSQPPSGDLFGLNPAGRSRSPSPSILQQPISNKPFTTKPVHLWTKPDVADWLESLNLGEHKEAFMDNEIDGSHLPNLQKEDLIDLGVTRVGHRMNIERALKQLLDR

SEQ ID NO: 35636 - protein, 1253 aa, Homo sapiens
  ENSP00000386491
MMNVPGGGAAAVMMTGYNNGRCPRNSLYSDCIIEEKTVVLQKKDNEGFGFVLRGAKADTPIEEFTPTPAFPALQYLESVDEGGVAWQAGLRTGDFLIEVNNENVVKVGHRQVVNMIRQGGNHLVLKVVTVTRNLDPDDTARKKAPPPPKRAPTTALTLRSKSMTSELEELVDKDKPEEIVPASKPSRAAENMAVEPRVATIKQRPSSRCFPAGSDMNSVYERQGIAVMTPTVPGSPKAPFLGIPRGTMRRQKSIDSRIFLSGITEEERQFLAPPMLKFTRSLSMPDTSEDIPPPPQSVPPSPPPPSPTTYNCPKSPTPRVYGTIKPAFNQNSAAKVSPATRSDTVATMMREKGMYFRRELDRYSLDSEDLYSRNAGPQANFRNKRGQMPENPYSEVGKIASKAVYVPAKPARRKGMLVKQSNVEDSPEKTCSIPIPTIIVKEPSTSSSGKSSQGSSMEIDPQAPEPPSQLRPDESLTVSSPFAAAIAGAVRDREKRLEARRNSPAFLSTDLGDEDVGLGPPAPRTRPSMFPEEGDFADEDSAEQLSSPMPSATPREPENHFVGGAEASAPGEAGRPLNSTSKAQGPESSPAVPSASSGTAGPGNYVHPLTGRLLDPSSPLALALSARDRAMKESQQGPKGEAPKADLNKPLYIDTKMRPSLDAGFPTVTRQNTRGPLRRQETENKYETDLGRDRKGDDKKNMLIDIMDTSQQKSAGLLMVHTVDATKLDNALQEEDEKAEVEMKPDSSPSEVPEGVSETEGALQISAAPEPTTVPGRTIVAVGSMEEAVILPFRIPPPPLASVDLDEDFIFTEPLPPPLEFANSFDIPDDRAASVPALSDLVKQKKSDTPQSPSLNSSQPTNSADSKKPASLSNCLPASFLPPPESFDAVADSGIEEVDSRSSSDHHLETTSTISTVSSISTLSSEGGENVDTCTVYADGQAFMVDKPPVPPKPKMKPIIHKSNALYQDALVEEDVDSFVIPPPAPPPPPGSAQPGMAKVLQPRTSKLWGDVTEIKSPILSGPKANVISELNSILQQMNREKLAKPGEGLDSPMGAKSASLAPRSPEIMSTISGTRSTTVTFTVRPGTSQPITLQSRPPDYESRTSGTRRAPSPVVSPTEMNKETLPAPLSAATASPSPALSDVFSLPSQPPSGDLFGLNPAGRSRSPSPSILQQPISNKPFTTKPVHLWTKPDVADWLESLNLGEHKEAFMDNEIDGSHLPNLQKEDLIDLGVTRVGHRMNIERALKQLLDR

SEQ ID NO: 35637 - protein, 1724 aa, Homo sapiens
  ENSP00000489407
MDGPGASAVVVRVGIPDLQQTKCLRLDPAAPVWAAKQRVLCALNHSLQDALNYGLFQPPSRGRAGKFLDEERLLQEYPPNLDTPLPYLEFRYKRRVYAQNLIDDKQFAKLHTKANLKKFMDYVQLHSTDKVARLLDKGLDPNFHDPDSGECPLSLAAQLDNATDLLKVLKNGGAHLDFRTRDGLTAVHCATRQRNAAALTTLLDLGASPDYKDSRGLTPLYHSALGGGDALCCELLLHDHAQLGITDENGWQEIHQACRFGHVQHLEHLLFYGADMGAQNASGNTALHICALYNQESCARVLLFRGANRDVRNYNSQTAFQVAIIAGNFELAEVIKTHKDSDVVPFRETPSYAKRRRLAGPSGLASPRPLQRSASDINLKGEAQPAASPGPSLRSLPHQLLLQRLQEEKDRDRDADQESNISGPLAGRAGQSKIREGAGRPCPAPPAPPAPPPRGPKRKLYSAVPGRKFIAVKAHSPQGEGEIPLHRGEAVKVLSIGEGGFWEGTVKGRTGWFPADCVEEVQMRQHDTRPETREDRTKRLFRHYTVGSYDSLTSHSDYVIDDKVAVLQKRDHEGFGFVLRGAKAETPIEEFTPTPAFPALQYLESVDVEGVAWRAGLRTGDFLIEVNGVNVVKVGHKQVVALIRQGGNRLVMKVVSVTRKPEEDGARRRAPPPPKRAPSTTLTLRSKSMTAELEELASIRRRKGEKLDEMLAAAAEPTLRPDIADADSRAATVKQRPTSRRITPAEISSLFERQGLPGPEKLPGSLRKGIPRTKSVGEDEKLASLLEGRFPRSTSMQDPVREGRGIPPPPQTAPPPPPAPYYFDSGPPPAFSPPPPPGRAYDTVRSSFKPGLEARLGAGAAGLYEPGAALGPLPYPERQKRARSMIILQDSAPESGDAPRPPPAATPPERPKRRPRPPGPDSPYANLGAFSASLFAPSKPQRRKSPLVKQLQVEDAQERAALAVGSPGPGGGSFAREPSPTHRGPRPGGLDYGAGDGPGLAFGGPGPAKDRRLEERRRSTVFLSVGAIEGSAPGADLPSLQPSRSIDERLLGTGPTAGRDLLLPSPVSALKPLVSGPSLGPSGSTFIHPLTGKPLDPSSPLALALAARERALASQAPSRSPTPVHSPDADRPGPLFVDVQARDPERGSLASPAFSPRSPAWIPVPARREAEKVPREERKSPEDKKSMILSVLDTSLQRPAGLIVVHATSNGQEPSRLGGAEEERPGTPELAPAPMQSAAVAEPLPSPRAQPPGGTPADAGPGQGSSEEEPELVFAVNLPPAQLSSSDEETREELARIGLVPPPEEFANGVLLATPLAGPGPSPTTVPSPASGKPSSEPPPAPESAADSGVEEADTRSSSDPHLETTSTISTVSSMSTLSSESGELTDTHTSFADGHTFLLEKPPVPPKPKLKSPLGKGPVTFRDPLLKQSSDSELMAQQHHAASAGLASAAGPARPRYLFQRRSKLWGDPVESRGLPGPEDDKPTVISELSSRLQQLNKDTRSLGEEPVGGLGSLLDPAKKSPIAAARLFSSLGELSSISAQRSPGGPGGGASYSVRPSGRYPVARRAPSPVKPASLERVEGLGAGAGGAGRPFGLTPPTILKSSSLSIPHEPKEVRFVVRSVSARSRSPSPSPLPSPASGPGPGAPGPRRPFQQKPLQLWSKFDVGDWLESIHLGEHRDRFEDHEIEGAHLPALTKDDFVELGVTRVGHRMNIERALRQLDGS

SEQ ID NO: 35638 - protein, 1730 aa, Homo sapiens
  ENSP00000489147
MDGPGASAVVVRVGIPDLQQTKCLRLDPAAPVWAAKQRVLCALNHSLQDALNYGLFQPPSRGRAGKFLDEERLLQEYPPNLDTPLPYLEFRYKRRVYAQNLIDDKQFAKLHTKANLKKFMDYVQLHSTDKVARLLDKGLDPNFHDPDSGECPLSLAAQLDNATDLLKVLKNGGAHLDFRTRDGLTAVHCATRQRNAAALTTLLDLGASPDYKDSRGLTPLYHSALGGGDALCCELLLHDHAQLGITDENGWQEIHQACRFGHVQHLEHLLFYGADMGAQNASGNTALHICALYNQESCARVLLFRGANRDVRNYNSQTAFQVAIIAGNFELAEVIKTHKDSDVVPFRETPSYAKRRRLAGPSGLASPRPLQRSASDINLKGEAQPAASPGPSLRSLPHQLLLQRLQEEKDRDRDADQESNISGPLAGRAGQSKISPAGPGDPGPGPGGPAPPAPPAPPPRGPKRKLYSAVPGRKFIAVKAHSPQGEGEIPLHRGEAVKVLSIGEGGFWEGTVKGRTGWFPADCVEEVQMRQHDTRPETREDRTKRLFRHYTVGSYDSLTSHSDYVIDDKVAVLQKRDHEGFGFVLRGAKAETPIEEFTPTPAFPALQYLESVDVEGVAWRAGLRTGDFLIEVNGVNVVKVGHKQVVALIRQGGNRLVMKVVSVTRKPEEDGARRRAPPPPKRAPSTTLTLRSKSMTAELEELASIRRRKGEKLDEMLAAAAEPTLRPDIADADSRAATVKQRPTSRRITPAEISSLFERQGLPGPEKLPGSLRKGIPRTKSVGEDEKLASLLEGRFPRSTSMQDPVREGRGIPPPPQTAPPPPPAPYYFDSGPPPAFSPPPPPGRAYDTVRSSFKPGLEARLGAGAAGLYEPGAALGPLPYPERQKRARSMIILQDSAPESGDAPRPPPAATPPERPKRRPRPPGPDSPYANLGAFSASLFAPSKPQRRKSPLVKQLQVEDAQERAALAVGSPGPGGGSFAREPSPTHRGPRPGGLDYGAGDGPGLAFGGPGPAKDRRLEERRRSTVFLSVGAIEGSAPGADLPSLQPSRSIDERLLGTGPTAGRDLLLPSPVSALKPLVSGPSLGPSGSTFIHPLTGKPLDPSSPLALALAARERALASQAPSRSPTPVHSPDADRPGPLFVDVQARDPERGSLASPAFSPRSPAWIPVPARREAEKVPREERKSPEDKKSMILSVLDTSLQRPAGLIVVHATSNGQEPSRLGGAEEERPGTPELAPAPMQSAAVAEPLPSPRAQPPGGTPADAGPGQGSSEEEPELVFAVNLPPAQLSSSDEETREELARIGLVPPPEEFANGVLLATPLAGPGPSPTTVPSPASGKPSSEPPPAPESAADSGVEEADTRSSSDPHLETTSTISTVSSMSTLSSESGELTDTHTSFADGHTFLLEKPPVPPKPKLKSPLGKGPVTFRDPLLKQSSDSELMAQQHHAASAGLASAAGPARPRYLFQRRSKLWGDPVESRGLPGPEDDKPTVISELSSRLQQLNKDTRSLGEEPVGGLGSLLDPAKKSPIAAARLFSSLGELSSISAQRSPGGPGGGASYSVRPSGRYPVARRAPSPVKPASLERVEGLGAGAGGAGRPFGLTPPTILKSSSLSIPHEPKEVRFVVRSVSARSRSPSPSPLPSPASGPGPGAPGPRRPFQQKPLQLWSKFDVGDWLESIHLGEHRDRFEDHEIEGAHLPALTKDDFVELGVTRVGHRMNIERALRQLDGS

SEQ ID NO: 35639 - protein, 1731 aa, Homo sapiens
  ENSP00000490818
MDGPGASAVVVRVGIPDLQQTKCLRLDPAAPVWAAKQRVLCALNHSLQDALNYGLFQPPSRGRAGKFLDEERLLQEYPPNLDTPLPYLEFRYKRRVYAQNLIDDKQFAKLHTKANLKKFMDYVQLHSTDKVARLLDKGLDPNFHDPDSGECPLSLAAQLDNATDLLKVLKNGGAHLDFRTRDGLTAVHCATRQRNAAALTTLLDLGASPDYKDSRGLTPLYHSALGGGDALCCELLLHDHAQLGITDENGWQEIHQACRFGHVQHLEHLLFYGADMGAQNASGNTALHICALYNQESCARVLLFRGANRDVRNYNSQTAFQVAIIAGNFELAEVIKTHKDSDVVPFRETPSYAKRRRLAGPSGLASPRPLQRSASDINLKGEAQPAASPGPSLRSLPHQLLLQRLQEEKDRDRDADQESNISGPLAGRAGQSKISPSGPGGPGPAPGPGPAPPAPPAPPPRGPKRKLYSAVPGRKFIAVKAHSPQGEGEIPLHRGEAVKVLSIGEGGFWEGTVKGRTGWFPADCVEEVQMRQHDTRPETREDRTKRLFRHYTVGSYDSLTSHSDYVIDDKVAVLQKRDHEGFGFVLRGAKAETPIEEFTPTPAFPALQYLESVDVEGVAWRAGLRTGDFLIEVNGVNVVKVGHKQVVALIRQGGNRLVMKVVSVTRKPEEDGARRRAPPPPKRAPSTTLTLRSKSMTAELEELASIRRRKGEKLDEMLAAAAEPTLRPDIADADSRAATVKQRPTSRRITPAEISSLFERQGLPGPEKLPGSLRKGIPRTKSVGEDEKLASLLEGRFPRSTSMQDPVREGRGIPPPPQTAPPPPPAPYYFDSGPPPAFSPPPPPGRAYDTVRSSFKPGLEARLGAGAAGLYEPGAALGPLPYPERQKRARSMIILQDSAPESGDAPRPPPAATPPERPKRRPRPPGPDSPYANLGAFSASLFAPSKPQRRKSPLVKQLQVEDAQERAALAVGSPGPGGGSFAREPSPTHRGPRPGGLDYGAGDGPGLAFGGPGPAKDRRLEERRRSTVFLSVGAIEGSAPGADLPSLQPSRSIDERLLGTGPTAGRDLLLPSPVSALKPLVSGPSLGPSGSTFIHPLTGKPLDPSSPLALALAARERALASQAPSRSPTPVHSPDADRPGPLFVDVQARDPERGSLASPAFSPRSPAWIPVPARREAEKVPREERKSPEDKKSMILSVLDTSLQRPAGLIVVHATSNGQEPSRLGGAEEERPGTPELAPAPMQSAAVAEPLPSPRAQPPGGTPADAGPGQGSSEEEPELVFAVNLPPAQLSSSDEETREELARIGLVPPPEEFANGVLLATPLAGPGPSPTTVPSPASGKPSSEPPPAPESAADSGVEEADTRSSSDPHLETTSTISTVSSMSTLSSESGELTDTHTSFADGHTFLLEKPPVPPKPKLKSPLGKGPVTFRDPLLKQSSDSELMAQQHHAASAGLASAAGPARPRYLFQRRSKLWGDPVESRGLPGPEDDKPTVISELSSRLQQLNKDTRSLGEEPVGGLGSLLDPAKKSPIAAARLFSSLGELSSISAQRSPGGPGGGASYSVRPSGRYPVARRAPSPVKPASLERVEGLGAGAGGAGRPFGLTPPTILKSSSLSIPHEPKEVRFVVRSVSARSRSPSPSPLPSPASGPGPGAPGPRRPFQQKPLQLWSKFDVGDWLESIHLGEHRDRFEDHEIEGAHLPALTKDDFVELGVTRVGHRMNIERALRQLDGS

SEQ ID NO: 35640 - protein, 594 aa, Homo sapiens
  ENSP00000364995
MLPRTKYNRFRNDSVTSVDDLLHSLSVSGGGGKVSAARATPAAAPYLVSGEALRKAPDDGPGSLGHLLHKVSHLKLSSSGLRGLSSAARERAGARLSGSCSAPSLAAPDGSAPSAPRAPAMSAARKGRPGDEPLPRPPRGAPHASDQVLGPGVTYVVKYLGCIEVLRSMRSLDFSTRTQITREAISRVCEAVPGAKGAFKKRKPPSKMLSSILGKSNLQFAGMSISLTISTASLNLRTPDSKQIIANHHMRSISFASGGDPDTTDYVAYVAKDPVNRRACHILECCDGLAQDVIGSIGQAFELRFKQYLQCPTKIPALHDRMQSLDEPWTEEEGDGSDHPYYNSIPSKMPPPGGFLDTRLKPRPHAPDTAQFAGKEQTYYQGRHLGDTFGEDWQQTPLRQGSSDIYSTPEGKLHVAPTGEAPTYVNTQQIPPQAWPAAVSSAESSPRKDLFDMKPFEDALKNQPLGPVLSKAASVECISPVSPRAPDAKMLEELQAETWYQGEMSRKEAEGLLEKDGDFLVRKSTTNPGSFVLTGMHNGQAKHLLLVDPEGTIRTKDRVFDSISHLINHHLESSLPIVSAGSELCLQQPVERKQ

SEQ ID NO: 35641 - protein, 105 aa, Homo sapiens
  ENSP00000364991
MKPFEDALKNQPLGPVLSKAASVECISPVSPRAPDAKMLEELQAETWYQGEMSRKEAEGLLEKDGDFLVRKSTTNPGSFVLTGMHNGQAKHLLLVDPEGTRSNSY

SEQ ID NO: 35642 - protein, 630 aa, Homo sapiens
  ENSP00000329668
MRERGQDSLAGLVLYVGLFGHPGMLHRAKYSRFRNESITSLDEGSSGGSVGNKGSPQPPHPALAPHLPTEDATLPSQESPTPLCTLIPRMASMKLANPATLLSLKNFCLGTKEVPRLKLQESRDPGSSGPSSPETSLSRSGTAPPPQQDLVGHRATALTPDSCPLPGPGEPTLRSRQDRHFLQHLLGMGMNYCVRYMGCVEVLQSMRSLDFGMRTQVTREAISRLCEAVPGANGAIKKRKPPVKFLSTVLGKSNLQFSGMNIKLTISTCSLTLMNLDNQQIIANHHMQSISFASGGDPDTTDYVAYVAKDPVNQRACHILECHNGMAQDVISTIGQAFELRFKQYLKNPSLNTSCESEEVHIDSHAEEREDHEYYNEIPGKQPPVGGVSDMRIKVQATEQMAYCPIQCEKLCYLPGNSKCSSVYENCLEQSRAIGNVHPRGVQSQRDTSLLKHTCRVDLFDDPCYINTQALQSTPGSAGNQRSAQPLGSPWHCGKAPETVQPGATAQPASSHSLPHIKQQLWSEECYHGKLSRKAAESLLVKDGDFLVRESATSPGQYVLSGLQGGQAKHLLLVDPEGKVRTKDHVFDNVGHLIRYHMDNSLPIISSGSEVSLKQPVRKDNNPALLHSNK

SEQ ID NO: 35643 - protein, 387 aa, Homo sapiens
  ENSP00000379786
MLPALEHWIPKFFSFRTRTGSPLSLACRQPIVGPCDHIIANHHMQSISFASGGDPDTTDYVAYVAKDPVNQRACHILECHNGMAQDVISTIGQAFELRFKQYLKNPSLNTSCESEEVHIDSHAEEREDHEYYNEIPGKQPPVGGVSDMRIKVQATEQMAYCPIQCEKLCYLPGNSKCSSVYENCLEQSRAIGNVHPRGVQSQRDTSLLKHTCRVDLFDDPCYINTQALQSTPGSAGNQRSAQPLGSPWHCGKAPETVQPGATAQPASSHSLPHIKQQLWSEECYHGKLSRKAAESLLVKDGDFLVRESATSPGQYVLSGLQGGQAKHLLLVDPEGKVRTKDHVFDNVGHLIRYHMDNSLPIISSGSEVSLKQPVRKDNNPALLHSNK

SEQ ID NO: 35644 - protein, 344 aa, Homo sapiens
  ENSP00000443300
MQSISFASGGDPDTTDYVAYVAKDPVNQRACHILECHNGMAQDVISTIGQAFELRFKQYLKNPSLNTSCESEEVHIDSHAEEREDHEYYNEIPGKQPPVGGVSDMRIKVQATEQMAYCPIQCEKLCYLPGNSKCSSVYENCLEQSRAIGNVHPRGVQSQRDTSLLKHTCRVDLFDDPCYINTQALQSTPGSAGNQRSAQPLGSPWHCGKAPETVQPGATAQPASSHSLPHIKQQLWSEECYHGKLSRKAAESLLVKDGDFLVRESATSPGQYVLSGLQGGQAKHLLLVDPEGKVRTKDHVFDNVGHLIRYHMDNSLPIISSGSEVSLKQPVRKDNNPALLHSNK

SEQ ID NO: 35645 - protein, 144 aa, Homo sapiens
  ENSP00000453344
MQSISFASGGDPDTTDYVAYVAKDPVNQRACHILECHNGMAQDVISTIGQAFELRFKQYLKNPSLNTSCESEEVHIDSHAEEREDHEYYNEIPGKQPPVGGVSDMRIKVQATEQMAYCPIQCEKLCYLVMSIQEGCSPSEIPHY

SEQ ID NO: 35646 - protein, 128 aa, Homo sapiens
  ENSP00000453397
MQSISFASGGDPDTTDYVAYVAKDPVNQRACHILECHNGMAQDVISTIGQAFELRFKQYLKNPSLNTSCESEEVHIDSHAEEREDHEYYNEIPGKQPPVGGVSDMRIKVQATEQMAYCPIQCEKLCYL

SEQ ID NO: 35647 - protein, 367 aa, Homo sapiens
  ENSP00000453370
MLLSGAPPAGSRPGPRTQGSAGGGPGGSRRGAGGAGAGPGGGGSGGVAKWLREHLGFRGGGGGGGGSKPAPPEPDYRPPAPSPAAPPAPPPDILAAYRLQRERDFEDPYSGGSSGSAALATPVAPGPTPPPRHGSPPHRLIRVETPGPPAPPADERISGPPASSDRLAILEDYADPFDVQETGEGSAGASGAPEKVPENDGYMEPYEAQKMMAEIRGSKETATQPLPLYDTPYEPEEDGATAEGEGAPWPRESRLPEDDERPPEEYDQPWEWKKERISKAFAAQFEGPEKSCLSPGREEKGRLPPRLSAGNPKSAKPLSMEPSSPLGEWTDPALPLENQLVSRGHQPNRRREPAPAVQRGQLPGAQQ

SEQ ID NO: 35648 - protein, 423 aa, Homo sapiens
  ENSP00000290894
MQQEGGPVRSAPCRTGTLEGSRQGSPGHRKRASPKGSLSSAQPHSWMLTPSPLNSHCAHREPISSSPQPVANGPKQKKKSNWRSTTRLRIIRLRDRLEPRPLAILEDYADPFDVQETGEGSAGASGAPEKVPENDGYMEPYEAQKMMAEIRGSKETATQPLPLYDTPYEPEEDGATAEGEGAPWPRESRLPEDDERPPEEYDQPWEWKKERISKAFAVDIKVIKDLPWPPPVGQLDSSPSLPDGDRDISGPASPLPEPSLEDSSAQFEGPEKSCLSPGREEKGRLPPRLSAGNPKSAKPLSMEPSSPLGEWTDPALPLENQVWYHGAISRTDAENLLRLCKEASYLVRNSETSKNDFSLSLKSSQGFMHMKLSRTKEHKYVLGQNSPPFSSVPEIVHHYASRKLPIKGAEHMSLLYPVAIRTL

SEQ ID NO: 35649 - protein, 290 aa, Homo sapiens
  ENSP00000453168
MLLSGAPPAGSRPGPRTQGSAGGGPGGSRRGAGGAGAGPGGGGSGGVAKWLREHLGFRGGGGGGGGSKPAPPEPDYRPPAPSPAAPPAPPPDILAAYRLQRERDFEDPYSGGSSGSAALATPVAPGPTPPPRHGSPPHRLIRVETPGPPAPPADERISGPPASSDRLAILEDYADPFDVQETGEGSAGASGAPEKVPENDGYMEPYEAQKMMAEIRGSKETATQPLPLYDTPYEPEEDGATAEGEGAPWPRESRLPEDDERPPEEYDQPWEWKKERISKAFAGAARDSCT

SEQ ID NO: 35650 - protein, 239 aa, Homo sapiens
  ENSP00000411530
MEPYEAQKMMAEIRGSKETATQPLPLYDTPYEPEEDGATAEGEGAPWPRESRLPEDDERPPEEYDQPWEWKKERISKAFAAQFEGPEKSCLSPGREEKGRLPPRLSAGNPKSAKPLSMEPSSPLGEWTDPALPLENQVWYHGAISRTDAENLLRLCKEASYLVRNSETSKNDFSLSLKSSQGFMHMKLSRTKEHKYVLGQNSPPFSSVPEIVHHYASRKLPIKGAEHMSLLYPVAIRTL

SEQ ID NO: 35651 - protein, 163 aa, Homo sapiens
  ENSP00000454034
  MOD_RES (1)..(1): Any amino acid
XPWPRESRLPEDDERPPEEYDQPWEWKKERISKAFAGDTHNGWAWTARDPAEMPPFLSLILSWYHGAISRTDAENLLRLCKEASYLVRNSETSKNDFSLSLKSSQGFMHMKLSRTKEHKYVLGQNSPPFSSVPEIVHHYASRKLPIKGAEHMSLLYPVAIRTL

SEQ ID NO: 35652 - protein, 161 aa, Homo sapiens
  ENSP00000453676
  MOD_RES (1)..(1): Any amino acid
XSPSLPDGDRDISGPASPLPEPSLEDSSAQFEGPEKSCLSPGREEKGRLPPRLSAGNPKSAKPLSMEPSSPLGEWTDPALPLENQVWYHGAISRTDAENLLRLCKEASYLLSYSRSLNCKIKEAFPRKVFVKNLIYITSEMCIALKIIKFMEHTKQPVYHF

SEQ ID NO: 35653 - protein, 414 aa, Homo sapiens
  ENSP00000453260
MLLSGAPPAGSRPGPRTQGSAGGGPGGSRRGAGGAGAGPGGGGSGGVAKWLREHLGFRGGGGGGGGSKPAPPEPDYRPPAPSPAAPPAPPPDILAAYRLQRERDFEDPYSGGSSGSAALATPVAPGPTPPPRHGSPPHRLIRVETPGPPAPPADERISGPPASSDRLAILEDYADPFDVQETGEGSAGASGAPEKVPENDGYMEPYEAQKMMAEIRGSKETATQPLPLYDTPYEPEEDGATAEGEGAPWPRESRLPEDDERPPEEYDQPWEWKKERISKAFAVDIKVIKDLPWPPPVGQLDSSPSLPDGDRDISGPASPLPEPSLEDSSAQFEGPEKSCLSPGREEKGRLPPRLSAGNPKSAKPLSMEPSSPLGEWTDPALPLENQLVSRGHQPNRRREPAPAVQRGQLPGAQQ

SEQ ID NO: 35654 - protein, 199 aa, Homo sapiens
  ENSP00000452726
  MOD_RES (1)..(1): Any amino acid
XGEGSAGASGAPEKVPENDGYMEPYEAQKMMAEIRGSKETATQPLPLYDTPYEPEEDGATAEGEGAPWPRESRLPEDDERPPEEYDQPWEWKKERISKAFAAQFEGPEKSCLSPGREEKGRLPPRLSAGNPKSAKPLSMEPSSPLGEWTDPALPLENQVWYHGAISRTDAENLLRLCKEASYLVRNSETSKNDFSLSLK

SEQ ID NO: 35655 - protein, 146 aa, Homo sapiens
  ENSP00000453827
  MOD_RES (1)..(1): Any amino acid
XDQPWEWKKERISKAFAVDIKVIKDLPWPPPVGQLDSSPSLPDGDRDISGPASPLPEPSLEDSSAQFEGPEKSCLSPGREEKGRLPPRLSAGNPKSAKPLSMEPSSPLGEWTDPALPLENQVGHPQWVGLDSEGPSRDAPLPLSHP

SEQ ID NO: 35656 - protein, 26 aa, Homo sapiens
  ENSP00000453986
MEPYEAQKMMAEIRGSKETATQPLPL

SEQ ID NO: 35657 - protein, 551 aa, Homo sapiens
  ENSP00000390084
MALRRLLLLLLLSLESLDLLPSVHGARGRAANRTLSAGGAAVGGRRAGGALARGGRELNGTARAPGIPEAGSRRGQPAAAVAAAASAAVTYETCWGYYDVSGQYDKEFECNNSESGYLYCCGTCYYRFCCKKRHEKLDQRQCTNYQSPVWVQTPSTKVVSPGPENKYDPEKDKTNFTVYITCGVIAFVIVAGVFAKVSYDKAHRPPREMNIHRALADILRQQGPIPIAHCERETISAIDTSPKENTPVRSSSKNHYTPVRTAKQTPGHYGKDAYRSGGPDLHNFISSGFVTLGRGHTKGDHQYNHPILSSVTQIPPHEKPRMNNILTSATEPYDLSFSRSFQNLAHLPPSYESAVKTNPSKYSSLKRLTDKEADEYYMRRRHLPDLAARGTLPLNVIQMSQQKPLPRERPRRPIRAMSQDRVLSPDRGLPDEFSMPYDRILSDEQLLSTERLHSQDPLLSPERTAFPEQSLSRAISHTDVFVSTPVLDRYRMSKMHSHPSASNNSYATLGQSQTAAKRHAFASRRHNTVEQLHYIPGHHTCYTASKTEVTV

SEQ ID NO: 35658 - protein, 532 aa, Homo sapiens
  ENSP00000388659
MALRRLLLLLLLSLESLDLLPSVHGARGRAANRTLSAGGAAVGGRRAGGALARGGRELNGTARAPGIPEAGSRRGQPAAAVAAAASAAVTYETCWGYYDVSGQYDKEFECNNSESGYLYCCGTCYYRFCCKKRHEKLDQRQCTNYQSPVWVQTPSTKVVSPGPENKYDPEKDKTNFTVYITCGVIAFVIVAGVFAKVSYDKAHRPPREMNIHRALADILRQQGPIPIAHCERETISAIDTSPKENTPVRSSSKNHYTPVRTAKQTPGHYGKDAYRSGGPDLHNFISSGFVTLGRGHTKEKPRMNNILTSATEPYDLSFSRSFQNLAHLPPSYESAVKTNPSKYSSLKRLTDKEADEYYMRRRHLPDLAARGTLPLNVIQMSQQKPLPRERPRRPIRAMSQDRVLSPDRGLPDEFSMPYDRILSDEQLLSTERLHSQDPLLSPERTAFPEQSLSRAISHTDVFVSTPVLDRYRMSKMHSHPSASNNSYATLGQSQTAAKRHAFASRRHNTVEQLHYIPGHHTCYTASKTEVTV

SEQ ID NO: 35659 - protein, 500 aa, Homo sapiens
  ENSP00000387157
MALRRLLLLLLLSLESLDLLPSVHGARGRAANRTLSAGGAAVGGRRAGGALARGGRELNGTARAPGIPEAGSRRGQPAAAVAAAASAAVTYETCWGYYDVSGQYDKEFECNNSESGYLYCCGTCYYRFCCKKRHEKLDQRQCTNYQSPVWVQTPSTKVVSPGPENKYDPEKDKTNFTVYITCGVIAFVIVAGVFAKVSYDKAHRPPREMNIHRALADILRQQGPIPIAHCERETISAIDTSPKENTPVRSSSKNHYTPVRTAKQTPEKPRMNNILTSATEPYDLSFSRSFQNLAHLPPSYESAVKTNPSKYSSLKRLTDKEADEYYMRRRHLPDLAARGTLPLNVIQMSQQKPLPRERPRRPIRAMSQDRVLSPDRGLPDEFSMPYDRILSDEQLLSTERLHSQDPLLSPERTAFPEQSLSRAISHTDVFVSTPVLDRYRMSKMHSHPSASNNSYATLGQSQTAAKRHAFASRRHNTVEQLHYIPGHHTCYTASKTEVTV

SEQ ID NO: 35660 - protein, 134 aa, Homo sapiens
  ENSP00000477331
  MOD_RES (1)..(1): Any amino acid
XTNFTVYITCGVIAFVIVAGVFAKVSYDKAHRPPREMNIHRALADILRQQGPIPIAHCERETISAIDTSPKENTPVRSSSKNHYTPVRTAKQTPGHYGKDAYRSGGPDLHNFISSGFVTLGRGHTKGTVETIFY

SEQ ID NO: 35661 - protein, 538 aa, Homo sapiens
  ENSP00000365503
MPALLLLVLLASSAGQARARPSNATSAEPAGPLPALLAHLRRLTGALTGGGGAASPGANGTRTGPAGGAGAAARAPPPAELCHGYYDVMGQYDATFNCSTGSYRFCCGTCHYRFCCEHRHMRLAQASCSNYDTPRWATTPPPLAGGAGGAGGAGGGPGPGQAGWLEGGRTGGAGGRGGEGPGGSTAYVVCGVISFALAVGVGAKVAFSKASRAPRAHRDINVPRALVDILRHQAGPGTRPDRARSSSLTPGIGGPDSMPPRTPKNLYNTVKTPNLDWRALPPPSPSLHYSTLSCSRSFHNLSHLPPSYEAAVKSELNRYSSLKRLAEKDLDEAYLKRRPLELPRGTLPLHALRRPGTGGGYRMEAWGGPEELGLAPAPNPRRVMSQEHLLGDGGRSRYEFTLPRARLVSQEHLLLSSPEALRQSREHLLSPPRSPALPPDPTARASLAASHSNLLLGPGGPPTPLRGLPPPSSLHAHHHHALHGSPQPAWMSDAGGGGGTLARRPPFQRQGTLEQLQFIPGHHLPQHLRTASKNEVTV

SEQ ID NO: 35662 - protein, 153 aa, Homo sapiens
  ENSP00000401307
  MOD_RES (1)..(1): Any amino acid
XGGEGPGGSTAYVVCGVISFALAVGVGAKVAFSKASRAPRAHRDINVPRALVDILRHQAGPGTRPDRARSSSLTPGIGGPDSMPPRTPKNLYNTVKTPNLATCTSTSTAPSTTPPHWTGEPCRRPAPPCTTPRCPALGPSTTSRICPRPTRLP

SEQ ID NO: 35663 - protein, 162 aa, Homo sapiens
  ENSP00000389964
  MOD_RES (1)..(1): Any amino acid
XSGRAGAPEAQGPAAPGTTAPEGGDRCRGYYDVMGQWDPPFNCSSGAYSFCCGTCGYRFCCHDGPRRLDQSRCSNYDTPAWVQTGRPPARARDTAAPRDPGRERSHTAVYAVCGVAALLVLAGIGARLGLERAHSPRARRTVTRALTELLKQPGPQEPLPPT

SEQ ID NO: 35664 - protein, 397 aa, Homo sapiens
  ENSP00000481203
MARAGARGLLGGRRPPGLRLALALRLALLLARPPSGRAGAPEAQGPAAPGTTAPEGGDRCRGYYDVMGQWDPPFNCSSGAYSFCCGTCGYRFCCHDGPRRLDQSRCSNYDTPAWVQTGRPPARARDTAAPRDPGRERSHTAVYAVCGVAALLVLAGIGARLGLERAHSPRARRTVTRALTELLKQPGPQEPLPPTLGPPLGGCVQVQMGDGLPRGSPHNSADKKRLNNAPRGSAAPGPPRGPRLQGGGSLTLQPDYAKYATFKAAALKAAEAAPRDFCQRFPALEPSPRQPPARAPRPSPDLPAPLDACPWAPPVYAPPAAPGPYAAWTSSRPARPAPLSHPTARAFQVPRRPGHAARRQFSVKMPETFNPQLPGLYGSAGRGSRYLRTNSKTEVTV

SEQ ID NO: 35665 - protein, 1616 aa, Homo sapiens
  ENSP00000370299
MEGAEPRARPERLAEAETRAADGGRLVEVQLSGGAPWGFTLKGGREHGEPLVITKIEEGSKAAAVDKLLAGDEIVGINDIGLSGFRQEAICLVKGSHKTLKLVVKRRSELGWRPHSWHATKFSDSHPELAASPFTSTSGCPSWSGRHHASSSSHDLSSSWEQTNLQRTLDHFSSLGSVDSLDHPSSRLSVAKSNSSIDHLGSHSKRDSAYGSFSTSSSTPDHTLSKADTSSAENILYTVGLWEAPRQGGRQAQAAGDPQGSEEKLSCFPPRVPGDSGKGPRPEYNAEPKLAAPGRSNFGPVWYVPDKKKAPSSPPPPPPPLRSDSFAATKSHEKAQGPVFSEAAAAQHFTALAQAQPRGDRRPELTDRPWRSAHPGSLGKGSGGPGCPQEAHADGSWPPSKDGASSRLQASLSSSDVRFPQSPHSGRHPPLYSDHSPLCADSLGQEPGAASFQNDSPPQVRGLSSCDQKLGSGWQGPRPCVQGDLQAAQLWAGCWPSDTALGALESLPPPTVGQSPRHHLPQPEGPPDARETGRCYPLDKGAEGCSAGAQEPPRASRAEKASQRLAASITWADGESSRICPQETPLLHSLTQEGKRRPESSPEDSATRPPPFDAHVGKPTRRSDRFATTLRNEIQMHRAKLQKSRSTVALTAAGEAEDGTGRWRAGLGGGTQEGPLAGTYKDHLKEAQARVLRATSFKRRDLDPNPGDLYPESLEHRMGDPDTVPHFWEAGLAQPPSSTSGGPHPPRIGGRRRFTAEQKLKSYSEPEKMNEVGLTRGYSPHQHPRTSEDTVGTFADRWKFFEETSKPVPQRPAQKQALHGIPRDKPERPRTAGRTCEGTEPWSRTTSLGDSLNAHSAAEKAGTSDLPRRLGTFAEYQASWKEQRKPLEARSSGRCHSADDILDVSLDPQERPQHVHGRSRSSPSTDHYKQEASVELRRQAGDPGEPREELPSAVRAEEGQSTPRQADAQCREGSPGSQQHPPSQKAPNPPTFSELSHCRGAPELPREGRGRAGTLPRDYRYSEESTPADLGPRAQSPGSPLHARGQDSWPVSSALLSKRPAPQRPPPPKREPRRYRATDGAPADAPVGVLGRPFPTPSPASLDVYVARLSLSHSPSVFSSAQPQDTPKATVCERGSQHVSGDASRPLPEALLPPKQQHLRLQTATMETSRSPSPQFAPQKLTDKPPLLIQDEDSTRIERVMDNNTTVKMVPIKIVHSESQPEKESRQSLACPAEPPALPHGLEKDQIKTLSTSEQFYSRFCLYTRQGAEPEAPHRAQPAEPQPLGTQVPPEKDRCTSPPGLSYMKAKEKTVEDLKSEELAREIVGKDKSLADILDPSVKIKTTMDLMEGIFPKDEHLLEEAQQRRKLLPKIPSPRSTEERKEEPSVPAAVSLATNSTYYSTSAPKAELLIKMKDLQEQQEHEEDSGSDLDHDLSVKKQELIESISRKLQVLREARESLLEDVQANTVLGAEVEAIVKGVCKPSEFDKFRMFIGDLDKVVNLLLSLSGRLARVENALNNLDDGASPGDRQSLLEKQRVLIQQHEDAKELKENLDRRERIVFDILANYLSEESLADYEHFVKMKSALIIEQRELEDKIHLGEEQLKCLLDSLQPERGK

SEQ ID NO: 35666 - protein, 375 aa, Homo sapiens
  ENSP00000406724
METSRSPSPQFAPQKLTDKPPLLIQDEDSTRIERVMDNNTTVKMVPIKIVHSESQPEKESRQSLACPAEPPALPHGLEKDQIKTLSTSEQFYSRFCLYTRQGAEPEAPHRAQPAEPQPLGTQVPPEKDRCTSPPGLSYMKAKEKTVEDLKSEELAREIVGKDKSLADILDPSVKIKTTMDLMEGIFPKDEHLLEEAQQRRKLLPKIPSPRSTEERKEEPSVPAAVSLATNSTYYSTSAPKAELLIKMKDLQEQQEHEEDSGSDLDHDLSVKKQELIESISRKLQVLREARESLLEDVQANTVLGAEVEAIVKGVCKPSEFDKFRMFIGDLDKVVNLLLSLSGRLARVENALNNLDDGASPGDRQSLLEKQRVLIQ

SEQ ID NO: 35667 - protein, 450 aa, Homo sapiens
  ENSP00000415229
METSRSPSPQFAPQKLTDKPPLLIQDEDSTRIERVMDNNTTVKMVPIKIVHSESQPEKESRQSLACPAEPPALPHGLEKDQIKTLSTSEQFYSRFCLYTRQGAEPEAPHRAQPAEPQPLGTQVPPEKDRCTSPPGLSYMKAKEKTVEDLKSEELAREIVGKDKSLADILDPSVKIKTTMDLMEGIFPKDEHLLEEAQQRRKLLPKIPSPRSTEERKEEPSVPAAVSLATNSTYYSTSAPKAELLIKMKDLQEQQEHEEDSGSDLDHDLSVKKELIESISRKLQVLREARESLLEDVQANTVLGAEVEAIVKGVCKPSEFDKFRMFIGDLDKVVNLLLSLSGRLARVENALNNLDDGASPGDRQSLLEKQRVLIQQHEDAKELKENLDRRERIVFDILANYLSEESLADYEHFVKMKSALIIEQRELEDKIHLGEEQLKCLLDSLQPERGK

SEQ ID NO: 35668 - protein, 1996 aa, Homo sapiens
  ENSP00000296043
MMRTTEDFHKPSATLNSNTATKGRYIYLEAFLEGGAPWGFTLKGGLEHGEPLIISKVEEGGKADTLSSKLQAGDEVVHINEVTLSSSRKEAVSLVKGSYKTLRLVVRRDVCTDPGHADTGASNFVSPEHLTSGPQHRKAAWSGGVKLRLKHRRSEPAGRPHSWHTTKSGEKQPDASMMQISQGMIGPPWHQSYHSSSSTSDLSNYDHAYLRRSPDQCSSQGSMESLEPSGAYPPCHLSPAKSTGSIDQLSHFHNKRDSAYSSFSTSSSILEYPHPGISGRERSGSMDNTSARGGLLEGMRQADIRYVKTVYDTRRGVSAEYEVNSSALLLQGREARASANGQGYDKWSNIPRGKGVPPPSWSQQCPSSLETATDNLPPKVGAPLPPARSDSYAAFRHRERPSSWSSLDQKRLCRPQANSLGSLKSPFIEEQLHTVLEKSPENSPPVKPKHNYTQKAQPGQPLLPTSIYPVPSLEPHFAQVPQPSVSSNGMLYPALAKESGYIAPQGACNKMATIDENGNQNGSGRPGFAFCQPLEHDLLSPVEKKPEATAKYVPSKVHFCSVPENEEDASLKRHLTPPQGNSPHSNERKSTHSNKPSSHPHSLKCPQAQAWQAGEDKRSSRLSEPWEGDFQEDHNANLWRRLEREGLGQSLSGNFGKTKSAFSSLQNIPESLRRHSSLELGRGTQEGYPGGRPTCAVNTKAEDPGRKAAPDLGSHLDRQVSYPRPEGRTGASASFNSTDPSPEEPPAPSHPHTSSLGRRGPGPGSASALQGFQYGKPHCSVLEKVSKFEQREQGSQRPSVGGSGFGHNYRPHRTVSTSSTSGNDFEETKAHIRFSESAEPLGNGEQHFKNGELKLEEASRQPCGQQLSGGASDSGRGPQRPDARLLRSQSTFQLSSEPEREPEWRDRPGSPESPLLDAPFSRAYRNSIKDAQSRVLGATSFRRRDLELGAPVASRSWRPRPSSAHVGLRSPEASASASPHTPRERHSVTPAEGDLARPVPPAARRGARRRLTPEQKKRSYSEPEKMNEVGIVEEAEPAPLGPQRNGMRFPESSVADRRRLFERDGKACSTLSLSGPELKQFQQSALADYIQRKTGKRPTSAAGCSLQEPGPLRERAQSAYLQPGPAALEGSGLASASSLSSLREPSLQPRREATLLPATVAETQQAPRDRSSSFAGGRRLGERRRGDLLSGANGGTRGTQRGDETPREPSSWGARAGKSMSAEDLLERSDVLAGPVHVRSRSSPATADKRQDVLLGQDSGFGLVKDPCYLAGPGSRSLSCSERGQEEMLPLFHHLTPRWGGSGCKAIGDSSVPSECPGTLDHQRQASRTPCPRPPLAGTQGLVTDTRAAPLTPIGTPLPSAIPSGYCSQDGQTGRQPLPPYTPAMMHRSNGHTLTQPPGPRGCEGDGPEHGVEEGTRKRVSLPQWPPPSRAKWAHAAREDSLPEESSAPDFANLKHYQKQQSLPSLCSTSDPDTPLGAPSTPGRISLRISESVLRDSPPPHEDYEDEVFVRDPHPKATSSPTFEPLPPPPPPPPSQETPVYSMDDFPPPPPHTVCEAQLDSEDPEGPRPSFNKLSKVTIARERHMPGAAHVVGSQTLASRLQTSIKGSEAESTPPSFMSVHAQLAGSLGGQPAPIQTQSLSHDPVSGTQGLEKKVSPDPQKSSEDIRTEALAKEIVHQDKSLADILDPDSRLKTTMDLMEGLFPRDVNLLKENSVKRKAIQRTVSSSGCEGKRNEDKEAVSMLVNCPAYYSVSAPKAELLNKIKEMPAEVNEEEEQADVNEKKAELIGSLTHKLETLQEAKGSLLTDIKLNNALGEEVEALISELCKPNEFDKYRMFIGDLDKVVNLLLSLSGRLARVENVLSGLGEDASNEERSSLYEKRKILAGQHEDARELKENLDRRERVVLGILANYLSEEQLQDYQHFVKMKSTLLIEQRKLDDKIKLGQEQVKCLLESLPSDFIPKAGALALPPNLTSEPIPAGGCTFSGIFPTLTSPL

SEQ ID NO: 35669 - protein, 1493 aa, Homo sapiens
  ENSP00000289292
MENRPGSFQYVPVQLQGGAPWGFTLKGGLEHCEPLTVSKIEDGGKAALSQKMRTGDELVNINGTPLYGSRQEALILIKGSFRILKLIVRRRNAPVSRPHSWHVAKLLEGCPEAATTMHFPSEAFSLSWHSGCNTSDVCVQWCPLSRHCSTEKSSSIGSMESLEQPGQATYESHLLPIDQNMYPNQRDSAYSSFSASSNASDCALSLRPEEPASTDCIMQGPGPTKAPSGRPNVAETSGGSRRTNGGHLTPSSQMSSRPQEGYQSGPAKAVRGPPQPPVRRDSLQASRAQLLNGEQRRASEPVVPLPQKEKLSLEPVLPARNPNRFCCLSGHDQVTSEGHQNCEFSQPPESSQQGSEHLLMQASTKAVGSPKACDRASSVDSNPLNEASAELAKASFGRPPHLIGPTGHRHSAPEQLLASHLQHVHLDTRGSKGMELPPVQDGHQWTLSPLHSSHKGKKSPCPPTGGTHDQSSKERKTRQVDDRSLVLGHQSQSSPPHGEADGHPSEKGFLDPNRTSRAASELANQQPSASGSLVQQATDCSSTTKAASGTEAGEEGDSEPKECSRMGGRRSGGTRGRSIQNRRKSERFATNLRNEIQRRKAQLQKSKGPLSQLCDTKEPVEETQEPPESPPLTASNTSLLSSCKKPPSPRDKLFNKSMMLRARSSECLSQAPESHESRTGLEGRISPGQRPGQSSLGLNTWWKAPDPSSSDPEKAHAHCGVRGGHWRWSPEHNSQPLVAAAMEGPSNPGDNKELKASTAQAGEDAILLPFADRRKFFEESSKSLSTSHLPGLTTHSNKTFTQRPKPIDQNFQPMSSSCRELRRHPMDQSYHSADQPYHATDQSYHSMSPLQSETPTYSECFASKGLENSMCCKPLHCGDFDYHRTCSYSCSVQGALVHDPCIYCSGEICPALLKRNMMPNCYNCRCHHHQCIRCSVCYHNPQHSALEDSSLAPGNTWKPRKLTVQEFPGDKWNPITGNRKTSQSGREMAHSKTSFSWATPFHPCLENPALDLSSYRAISSLDLLGDFKHALKKSEETSVYEEGSSLASMPHPLRSRAFSESHISLAPQSTRAWGQHRRELFSKGDETQSDLLGARKKAFPPPRPPPPNWEKYRLFRAAQQQKQQQQQQKQQEEEEEEEEEEEEEEEEEEEEAEEEEEELPPQYFSSETSGSCALNPEEVLEQPQPLSFGHLEGSRQGSQSVPAEQESFALHSSDFLPPIRGHLGSQPEQAQPPCYYGIGGLWRTSGQEATESAKQEFQHFSPPSGAPGIPTSYSAYYNISVAKAELLNKLKDQPEMAEIGLGEEEVDHELAQKKIQLIESISRKLSVLREAQRGLLEDINANSALGEEVEANLKAVCKSNEFEKYHLFVGDLDKVVNLLLSLSGRLARVENALNSIDSEANQEKLVLIEKKQQLTGQLADAKELKEHVDRREKLVFGMVSRYLPQDQLQDYQHFVKMKSALIIEQRELEEKIKLGEEQLKCLRESLLLGPSNF

SEQ ID NO: 35670 - protein, 1377 aa, Homo sapiens
  ENSP00000421450
MHFPSEAFSLSWHSGCNTSDVCVQWCPLSRHCSTEKSSSIGSMESLEQPGQATYESHLLPIDQNMYPNQRDSAYSSFSASSNASDCALSLRPEEPASTDCIMQGPGPTKAPSGRPNVAETSGGSRRTNGGHLTPSSQMSSRPQEGYQSGPAKAVRGPPQPPVRRDSLQASRAQLLNGEQRRASEPVVPLPQKEKLSLEPVLPARNPNRFCCLSGHDQVTSEGHQNCEFSQPPESSQQGSEHLLMQASTKAVGSPKACDRASSVDSNPLNEASAELAKASFGRPPHLIGPTGHRHSAPEQLLASHLQHVHLDTRGSKGMELPPVQDGHQWTLSPLHSSHKGKKSPCPPTGGTHDQSSKERKTRQVDDRSLVLGHQSQSSPPHGEADGHPSEKGFLDPNRTSRAASELANQQPSASGSLVQQATDCSSTTKAASGTEAGEEGDSEPKECSRMGGRRSGGTRGRSIQNRRKSERFATNLRNEIQRRKAQLQKSKGPLSQLCDTKEPVEETQEPPESPPLTASNTSLLSSCKKPPSPRDKLFNKSMMLRARSSECLSQAPESHESRTGLEGRISPGQRPGQSSLGLNTWWKAPDPSSSDPEKAHAHCGVRGGHWRWSPEHNSQPLVAAAMEGPSNPGDNKELKASTAQAGEDAILLPFADRRKFFEESSKSLSTSHLPGLTTHSNKTFTQRPKPIDQNFQPMSSSCRELRRHPMDQSYHSADQPYHATDQSYHSMSPLQSETPTYSECFASKGLENSMCCKPLHCGDFDYHRTCSYSCSVQGALVHDPCIYCSGEICPALLKRNMMPNCYNCRCHHHQCIRCSVCYHNPQHSALEDSSLAPGNTWKPRKLTVQEFPGDKWNPITGNRKTSQSGREMAHSKTSFSWATPFHPCLENPALDLSSYRAISSLDLLGDFKHALKKSEETSVYEEGSSLASMPHPLRSRAFSESHISLAPQSTRAWGQHRRELFSKGDETQSDLLGARKKAFPPPRPPPPNWEKYRLFRAAQQQKQQQQQQKQQEEEEEEEEEEEEEEEEEEEEAEEEEEELPPQYFSSETSGSCALNPEEVLEQPQPLSFGHLEGSRQGSQSVPAEQESFALHSSDFLPPIRGHLGSQPEQAQPPCYYGIGGLWRTSGQEATESAKQEFQHFSPPSGAPGIPTSYSAYYNISVAKAELLNKLKDQPEMAEIGLGEEEVDHELAQKKIQLIESISRKLSVLREAQRGLLEDINANSALGEEVEANLKAVCKSNEFEKYHLFVGDLDKVVNLLLSLSGRLARVENALNSIDSEANQEKLVLIEKKQQLTGQLADAKELKEHVDRREKLVFGMVSRYLPQDQLQDYQHFVKMKSALIIEQRELEEKIKLGEEQLKCLRESLLLGPSNF

SEQ ID NO: 35671 - protein, 1493 aa, Homo sapiens; identical to SEQ ID NO: 35669
  ENSP00000365188

SEQ ID NO: 35672 - protein, 456 aa, Homo sapiens
  ENSP00000480109
MNSSDEEKQLQLITSLKEQAIGEYEDLRAENQKTKEKCDKIRQERDEAVKKLEEFQKISHMVIEEVNFMQNHLEIEKTCRESAEALATKLNKENKTLKRISMLYMAKLGPDVITEEINIDDEDSTTDTDGAAETCVSVQCQKQIKELRDQIVSVQEEKKILAIELENLKSKLVEVIEEVNKVKQEKTVLNSEVLEQRKVLEKCNRVSMLAVEEYEEMQVNLELEKDLRKKAESFAQEMFIEQNKLKRQSHLLLQSSIPDQQLLKALDENAKLTQQLEEERIQHQQKVKELEEQLENETLHKEIHNLKQQLELLEEDKKELELKYQNSEEKARNLKHSVDELQKRVNQSENSVPPPPPPPPPLPPPPPNPIRSLMSMIRKRSHPSGSGAKKEKATQPETTEEVTDLKRQAVEEMMDRIKKGVHLRPVNQTARPKTKPESSKGCESAVDELKGILASQ

SEQ ID NO: 35673 - protein, 498 aa, Homo sapiens
  ENSP00000376635
MVIEEVNFMQNHLEIEKTCRESAEALATKLNKENKTLKRISMLYMAKLGPDVITEEINIDDEDSTTDTDGAAETCVSVQCQKQIKELRDQIVSVQEEKKILAIELENLKSKLVEVIEEVNKVKQEKTVLNSEVLEQRKVLEKCNRVSMLAVEEYEEMQVNLELEKDLRKKAESFAQEMFIEQNKLKRQSHLLLQSSIPDQQLLKALDENAKLTQQLEEERIQHQQKVKELEEQLENETLHKEIHNLKQQLELLEEDKKELELKYQNSEEKARNLKHSVDELQKRVNQSENSVPPPPPPPPPLPPPPPNPIRSLMSMIRKRSHPSGSGAKKEKATQPETTEEVTDLKRQAVEEMMDRIKKGVHLRPVNQTARPKTKPESSKGCESAVDELKGILGTLNKSTSSRSLKSLDPENSETELERILRRRKVTAEADSSSPTGILATSESKSMPVLGSVSSVTKTALNKKTLEAEFNSPSPPTPEPGEGPRKLEGCTSSKVTFQ

SEQ ID NO: 35674 - protein, 571 aa, Homo sapiens
  ENSP00000260777
MVIEEVNFMQNHLEIEKTCRESAEALATKLNKENKTLKRISMLYMAKLGPDVITEEINIDDEDSTTDTDGAAETCVSVQCQKQIKELRDQIVSVQEEKKILAIELENLKSKLVEVIEEVNKVKQEKTVLNSEVLEQRKVLEKCNRVSMLAVEEYEEMQVNLELEKDLRKKAESFAQEMFIEQNKLKRQSHLLLQSSIPDQQLLKALDENAKLTQQLEEERIQHQQKVKELEEQLENETLHKEIHNLKQQLELLEEDKKELELKYQNSEEKARNLKHSVDELQKRVNQSENSVPPPPPPPPPLPPPPPNPIRSLMSMIRKRSHPSGSGAKKEKATQPETTEEVTDLKRQAVEEMMDRIKKGVHLRPVNQTARPKTKPESSKGCESAVDELKGILGTLNKSTSSRSLKSLDPENSETELERILRRRKVTAEADSSSPTGILATSESKSMPVLGSVSSVTKTALNKKTLEAEFNSPSPPTPEPGEGPRKLEGCTSSKVTFQPPSSIGCRKKYIDGEKQAEPVVVLDPVSTHEPQTKDQVAEKDPTQHKEDEGEIQPENKEDSIENVRETDSSNC

SEQ ID NO: 35675 - protein, 558 aa, Homo sapiens
  ENSP00000376636
MNSSDEEKQLQLITSLKEQAIGEYEDLRAENQKTKEKCDKIRQERDEAVKKLEEFQKISHMVIEEVNFMQNHLEIEKTCRESAEALATKLNKENKTLKRISMLYMAKLGPDVITEEINIDDEDSTTDTDGAAETCVSVQCQKQIKELRDQIVSVQEEKKILAIELENLKSKLVEVIEEVNKVKQEKTVLNSEVLEQRKVLEKCNRVSMLAVEEYEEMQVNLELEKDLRKKAESFAQEMFIEQNKLKRQSHLLLQSSIPDQQLLKALDENAKLTQQLEEERIQHQQKVKELEEQLENETLHKEIHNLKQQLELLEEDKKELELKYQNSEEKARNLKHSVDELQKRVNQSENSVPPPPPPPPPLPPPPPNPIRSLMSMIRKRSHPSGSGAKKEKATQPETTEEVTDLKRQAVEEMMDRIKKGVHLRPVNQTARPKTKPESSKGCESAVDELKGILGTLNKSTSSRSLKSLDPENSETELERILRRRKVTAEADSSSPTGILATSESKSMPVLGSVSSVTKTALNKKTLEAEFNSPSPPTPEPGEGPRKLEGCTSSKVTFQ

SEQ ID NO: 35676 - protein, 631 aa, Homo sapiens
  ENSP00000347532
MNSSDEEKQLQLITSLKEQAIGEYEDLRAENQKTKEKCDKIRQERDEAVKKLEEFQKISHMVIEEVNFMQNHLEIEKTCRESAEALATKLNKENKTLKRISMLYMAKLGPDVITEEINIDDEDSTTDTDGAAETCVSVQCQKQIKELRDQIVSVQEEKKILAIELENLKSKLVEVIEEVNKVKQEKTVLNSEVLEQRKVLEKCNRVSMLAVEEYEEMQVNLELEKDLRKKAESFAQEMFIEQNKLKRQSHLLLQSSIPDQQLLKALDENAKLTQQLEEERIQHQQKVKELEEQLENETLHKEIHNLKQQLELLEEDKKELELKYQNSEEKARNLKHSVDELQKRVNQSENSVPPPPPPPPPLPPPPPNPIRSLMSMIRKRSHPSGSGAKKEKATQPETTEEVTDLKRQAVEEMMDRIKKGVHLRPVNQTARPKTKPESSKGCESAVDELKGILGTLNKSTSSRSLKSLDPENSETELERILRRRKVTAEADSSSPTGILATSESKSMPVLGSVSSVTKTALNKKTLEAEFNSPSPPTPEPGEGPRKLEGCTSSKVTFQPPSSIGCRKKYIDGEKQAEPVVVLDPVSTHEPQTKDQVAEKDPTQHKEDEGEIQPENKEDSIENVRETDSSNC

SEQ ID NO: 35677 - protein, 324 aa, Homo sapiens
  ENSP00000322457
MSRPSSTGPSANKPCSKQPPPQPQHTPSPAAPPAAATISAAGPGSSAVPAAAAVISGPGGGGGAGPVSPQHHELTSLFECPVCFDYVLPPILQCQAGHLVCNQCRQKLSCCPTCRGALTPSIRNLAMEKVASAVLFPCKYATTGCSLTLHHTEKPEHEDICEYRPYSCPCPGASCKWQGSLEAVMSHLMHAHKSITTLQGEDIVFLATDINLPGAVDWVMMQSCFGHHFMLVLEKQEKYEGHQQFFAIVLLIGTRKQAENFAYRLELNGNRRRLTWEATPRSIHDGVAAAIMNSDCLVFDTAIAHLFADNGNLGINVTISTCCP

SEQ ID NO: 35678 - protein, 83 aa, Homo sapiens
  ENSP00000417619
MEKVASAVLFPCKYATTGCSLTLHHTEKPEHEDICEYRPYSCPCPGASCKWQGSLEAVMSHLMHAHKSITTLQGEDIVFLATD

SEQ ID NO: 35679 - protein, 269 aa, Homo sapiens
  ENSP00000383256
MLFFTQCFGAVLDLIHLRFQHYKAKRVFSAAGQLVCVVNPTHNLKYVSSRRAVTQSAPEQGSFHPHHLSHHHCHHRHHHHLRHHAHPHHLHHQEAGLHANPVTPCLCMCPLFSCQWEGRLEVVVPHLRQIHRVDILQGAEIVFLATDMHLPAPADWIIMHSCLGHHFLLVLRKQERHEGHPQFFATMMLIGTPTQADCFTYRLELNRNHRRLKWEATPRSVLECVDSVITDGDCLVLNTSLAQLFSDNGSLAIGIAITATEVLPSEAEM

SEQ ID NO: 35680 - protein, 827 aa, Homo sapiens
  ENSP00000264852
MRGCLRLALLCALPWLLLAASPGHPAKSPRQPPAPRRDPFDAARGADFDHVYSGVVNLSTENIYSFNYTSQPDQVTAVRVYVNSSSENLNYPVLVVVRQQKEVLSWQVPLLFQGLYQRSYNYQEVSRTLCPSEATNETGPLQQLIFVDVASMAPLGAQYKLLVTKLKHFQLRTNVAFHFTASPSQPQYFLYKFPKDVDSVIIKVVSEMAYPCSVVSVQNIMCPVYDLDHNVEFNGVYQSMTKKAAITLQKKDFPGEQFFVVFVIKPEDYACGGSFFIQEKENQTWNLQRKKNLEVTIVPSIKESVYVKSSLFSVFIFLSFYLGCLLVGFVHYLRFQRKSIDGSFGSNDGSGNMVASHPIAASTPEGSNYGTIDESSSSPGRQMSSSDGGPPGQSDTDSSVEESDFDTMPDIESDKNIIRTKMFLYLSDLSRKDRRIVSKKYKIYFWNIITIAVFYALPVIQLVITYQTVVNVTGNQDICYYNFLCAHPLGVLSAFNNILSNLGHVLLGFLFLLIVLRRDILHRRALEAKDIFAVEYGIPKHFGLFYAMGIALMMEGVLSACYHVCPNYSNFQFDTSFMYMIAGLCMLKLYQTRHPDINASAYSAYASFAVVIMVTVLGVVFGKNDVWFWVIFSAIHVLASLALSTQIYYMGRFKIDLGIFRRAAMVFYTDCIQQCSRPLYMDRMVLLVVGNLVNWSFALFGLIYRPRDFASYMLGIFICNLLLYLAFYIIMKLRSSEKVLPVPLFCIVATAVMWAAALYFFFQNLSSWEGTPAESREKNRECILLDFFDDHDIWHFLSATALFFSFLVLLTLDDDLDVVRRDQIPVF

SEQ ID NO: 35681 - protein, 832 aa, Homo sapiens
  ENSP00000377416
MRGCLRLALLCALPWLLLAASPGHPAKSPRQPPAPRRDPFDAARGADFDHVYSGVVNLSTENIYSFNYTSQPDQVTAVRVYVNSSSENLNYPVLVVVRQQKEVLSWQVPLLFQGLYQRSYNYQEVSRTLCPSEATNETGPLQQLIFVDVASMAPLGAQYKLLVTKLKHFQLRTNVAFHFTASPSQPQYFLYKFPKDVDSVIIKVVSEMAYPCSVVSVQNIMCPVYDLDHNVEFNGVYQSMTKKAAITLQKKDFPGEQFFVVFVIKPEDYACGGSFFIQEKENQTWNLQRKKNLEVTIVPSIKESVYVKSSLFSVFIFLSFYLGCLLVGFVHYLRFQRKSIDGSFGSNDGSGNMVASHPIAASTPEGSNYGTIDESSSSPGRQMSSSDGGPPGQSDTDSSVEESDFDTMPDIESDKNIIRTKMFLYLSDLSRKDRRIVSKKYKIYFWNIITIAVFYALPVIQLVITYQTVVNVTGNQDICYYNFLCAHPLGVLSAFNNILSNLGHVLLGFLFLLIVLRRDILHRRALEAKDIFAVEYGIPKHFGLFYAMGIALMMEGVLSACYHVCPNYSNFQFDTSFMYMIAGLCMLKLYQTRHPDINASAYSAYASFAVVIMVTVLGVVFGKNDVWFWVIFSAIHVLASLALSTQIYYMGRFKIDVSDTDLGIFRRAAMVFYTDCIQQCSRPLYMDRMVLLVVGNLVNWSFALFGLIYRPRDFASYMLGIFICNLLLYLAFYIIMKLRSSEKVLPVPLFCIVATAVMWAAALYFFFQNLSSWEGTPAESREKNRECILLDFFDDHDIWHFLSATALFFSFLVLLTLDDDLDVVRRDQIPVF

SEQ ID NO: 35682 - protein, 1363 aa, Homo sapiens
  ENSP00000391295
  MOD_RES (1)..(1): Any amino acid
XGAGGAAGAGTGGAGPAGRLLPPPAPGSPAAPAAVSPAAGQPRPPAPASRGPMPARIGYYEIDRTIGKGNFAVVKRATHLVTKAKVAIKIIDKTQLDEENLKKIFREVQIMKMLCHPHIIRLYQVMETERMIYLVTEYASGGEIFDHLVAHGRMAEKEARRKFKQIVTAVYFCHCRNIVHRDLKAENLLLDANLNIKIADFGFSNLFTPGQLLKTWCGSPPYAAPELFEGKEYDGPKVDIWSLGVVLYVLVCGALPFDGSTLQNLRARVLSGKFRIPFFMSTECEHLIRHMLVLDPNKRLSMEQICKHKWMKLGDADPNFDRLIAECQQLKEERQVDPLNEDVLLAMEDMGLDKEQTLQSLRSDAYDHYSAIYSLLCDRHKRHKTLRLGALPSMPRALAFQAPVNIQAEQAGTAMNISVPQVQLINPENQIVEPDGTLNLDSDEGEEPSPEALVRYLSMRRHTVGVADPRTEVMEDLQKLLPGFPGVNPQAPFLQVAPNVNFMHNLLPMQNLQPTGQLEYKEQSLLQPPTLQLLNGMGPLGRRASDGGANIQLHAQQLLKRPRGPSPLVTMTPAVPAVTPVDEESSDGEPDQEAVQRYLANRSKRHTLAMTNPTAEIPPDLQRQLGQQPFRSRVWPPHLVPDQHRSTYKDSNTLHLPTERFSPVRRFSDGAASIQAFKAHLEKMGNNSSIKQLQQECEQLQKMYGGQIDERTLEKTQQQHMLYQQEQHHQILQQQIQDSICPPQPSPPLQAACENQPALLTHQLQRLRIQPSSPPPNHPNNHLFRQPSNSPPPMSSAMIQPHGAASSSQFQGLPSRSAIFQQQPENCSSPPNVALTCLGMQQPAQSQQVTIQVQEPVDMLSNMPGTAAGSSGRGISISPSAGQMQMQHRTNLMATLSYGHRPLSKQLSADSAEAHSLNVNRFSPANYDQAHLHPHLFSDQSRGSPSSYSPSTGVGFSPTQALKVPPLDQFPTFPPSAHQQPPHYTTSALQQALLSPTPPDYTRHQQVPHILQGLLSPRHSLTGHSDIRLPPTEFAQLIKRQQQQRQQQQQQQQQQEYQELFRHMNQGDAGSLAPSLGGQSMTERQALSYQNADSYHHHTSPQHLLQIRAQECVSQASSPTPPHGYAHQPALMHSESMEEDCSCEGAKDGFQDSKSSSTLTKGCHDSPLLLSTGGPGDPESLLGTVSHAQELGIHPYGHQPTAAFSKNKVPSREPVIGNCMDRSSPGQAVELPDHNGLGYPARPSVHEHHRPRALQRHHTIQNSDDAYVQLDNLPGMSLVAGKALSSARMSDAVLSQSSLMGSQQFQDGENEECGASLGGHEHPDLSDGSQHLNSSCYPSTCITDILLSYKHPEVSFSMEQAGV

SEQ ID NO: 35683 - protein, 1321 aa, Homo sapiens
  ENSP00000364449
MAAAAASGAGGAAGAGTGGAGPAGRLLPPPAPGSPAAPAAVSPAAGQPRPPAPASRGPMPARIGYYEIDRTIGKGNFAVVKRATHLVTKAKVAIKIIDKTQLDEENLKKIFREVQIMKMLCHPHIIRLYQVMETERMIYLVTEYASGGEIFDHLVAHGRMAEKEARRKFKQIVTAVYFCHCRNIVHRDLKAENLLLDANLNIKIADFGFSNLFTPGQLLKTWCGSPPYAAPELFEGKEYDGPKVDIWSLGVVLYVLVCGALPFDGSTLQNLRARVLSGKFRIPFFMSTECEHLIRHMLVLDPNKRLSMEQICKHKWMKLGDADPNFDRLIAECQQLKEERQVDPLNEDVLLAMEDMGLDKEQTLQSLRSDAYDHYSAIYSLLCDRHKRHKTLRLGALPSMPRALAFQAPVNIQAEQAGTAMNISVPQVQLINPENQIVEPDGTLNLDSDEGEEPSPEALVRYLSMRRHTVGVADPRTEVMEDLQKLLPGFPGVNPQAPFLQVAPNVNFMHNLLPMQNLQPTGQLEYKEQSLLQPPTLQLLNGMGPLGRRASDGGANIQLHAQQLLKRPRGPSPLVTMTPAVPAVTPVDEESSDGEPDQEAVQSSTYKDSNTLHLPTERFSPVRRFSDGAASIQAFKAHLEKMGNNSSIKQLQQECEQLQKMYGGQIDERTLEKTQQQHMLYQQEQHHQILQQQIQDSICPPQPSPPLQAACENQPALLTHQLQRLRIQPSSPPPNHPNNHLFRQPSNSPPPMSSAMIQPHGAASSSQFQGLPSRSAIFQQQPENCSSPPNVALTCLGMQQPAQSQQVTIQVQEPVDMLSNMPGTAAGSSGRGISISPSAGQMQMQHRTNLMATLSYGHRPLSKQLSADSAEAHSLNVNRFSPANYDQAHLHPHLFSDQSRGSPSSYSPSTGVGFSPTQALKVPPLDQFPTFPPSAHQQPPHYTTSALQQALLSPTPPDYTRHQQVPHILQGLLSPRHSLTGHSDIRLPPTEFAQLIKRQQQQRQQQQQQQQQQEYQELFRHMNQGDAGSLAPSLGGQSMTERQALSYQNADSYHHHTSPQHLLQIRAQECVSQASSPTPPHGYAHQPALMHSESMEEDCSCEGAKDGFQDSKSSSTLTKGCHDSPLLLSTGGPGDPESLLGTVSHAQELGIHPYGHQPTAAFSKNKVPSREPVIGNCMDRSSPGQAVELPDHNGLGYPARPSVHEHHRPRALQRHHTIQNSDDAYVQLDNLPGMSLVAGKALSSARMSDAVLSQSSLMGSQQFQDGENEECGASLGGHEHPDLSDGSQHLNSSCYPSTCITDILLSYKHPEVSFSMEQAGV

SEQ ID NO: 35684 - protein, 71 aa, Homo sapiens
  ENSP00000392849
  MOD_RES (1)..(1): Any amino acid
XNSDDAYVQLDNLPGMSLVAGKALSSARMSDAVLSQSSLMGSQQFQDGENEDILLSYKHPEVSFSMEQAGV

SEQ ID NO: 35685 - protein, 151 aa, Homo sapiens
  ENSP00000392761
RPPAPASRGPMPARIGYYEIDRTIGKGNFAVVKRATHLVTKAKVAIKIIDKTQLDEENLKKIFREVQIMKMLCHPHIIRLYQVMETERMIYLVTEYASGGEIFGGFGHQQFSFCPELPIAESWRSAVKRWGPLLLLSPHLWNLIRPPGGPW

SEQ ID NO: 35686 - protein, 1261 aa, Homo sapiens
  ENSP00000390442
MAAAAASGAGGAAGAGTGGAGPAGRLLPPPAPGSPAAPAAVSPAAGQPRPPAPASRGPMPARIGYYEIDRTIGKGNFAVVKRATHLVTKAKVAIKIIDKTQLDEENLKKIFREVQIMKMLCHPHIIRLYQVMETERMIYLVTEYASGGEIFDHLVAHGRMAEKEARRKFKQIVTAVYFCHCRNIVHRDLKAENLLLDANLNIKIADFGFSNLFTPGQLLKTWCGSPPYAAPELFEGKEYDGPKVDIWSLGVVLYVLVCGALPFDGSTLQNLRARVLSGKFRIPFFMSTECEHLIRHMLVLDPNKRLSMEQICKHKWMKLGDADPNFDRLIAECQQLKEERQVDPLNEDVLLAMEDMGLDKEQTLQAEQAGTAMNISVPQVQLINPENQIVEPDGTLNLDSDEGEEPSPEALVRYLSMRRHTVGVADPRTEVMEDLQKLLPGFPGVNPQAPFLQVAPNVNFMHNLLPMQNLQPTGQLEYKEQSLLQPPTLQLLNGMGPLGRRASDGGANIQLHAQQLLKRPRGPSPLVTMTPAVPAVTPVDEESSDGEPDQEAVQRYLANRSKRHTLAMTNPTAEIPPDLQRQLGQQPFRSRVWPPHLVPDQHRSTYKDSNTLHLPTERFSPVRRFSDGAASIQAFKAHLEKMGNNSSIKQLQQECEQLQKMYGGQIDERTLEKTQQQHMLYQQEQHHQILQQQIQDSICPPQPSPPLQAACENQPALLTHQLQRLRIQPSSPPPNHPNNHLFRQPSNSPPPMSSAMIQPHGAASSSQFQGLPSRSAIFQQQPENCSSPPNVALTCLGMQQPAQSQQVTIQVQEPVDMLSNMPGTAAGSSGRGISISPSAGQMQMQHRTNLMATLSYGHRPLSKQLSADSAEAHSAHQQPPHYTTSALQQALLSPTPPDYTRHQQVPHILQGLLSPRHSLTGHSDIRLPPTEFAQLIKRQQQQRQQQQQQQQQQEYQELFRHMNQGDAGSLAPSLGGQSMTERQALSYQNADSYHHHTSPQHLLQIRAQECVSQASSPTPPHGYAHQPALMHSESMEEDCSCEGAKDGFQDSKSSSTLTKGCHDSPLLLSTGGPGDPESLLGTVSHAQELGIHPYGHQPTAAFSKNKVPSREPVIGNCMDRSSPGQAVELPDHNGLGYPARPSVHEHHRPRALQRHHTIQNSDDAYVQLDNLPGMSLVAGKALSSARMSDAVLSQSSLMGSQQFQDGENEECGASLGGHEHPDLSDGSQHLNSSCYPSTCITDILLSYKHPEVSFSMEQAGV

SEQ ID NO: 35687 - protein, 506 aa, Homo sapiens
  ENSP00000414347
  MOD_RES (1)..(1): Any amino acid
XKTQLDEENLKKIFREVQIMKMLCHPHIIRLYQVMETERMIYLVTEYASGGEIFDHLVAHGRMAEKEARRKFKQIVTAVYFCHCRNIVHRDLKAENLLLDANLNIKIADFGFSNLFTPGQLLKTWCGSPPYAAPELFEGKEYDGPKVDIWSLGVVLYVLVCGALPFDGSTLQNLRARVLSGKFRIPFFMSTECEHLIRHMLVLDPNKRLSMEQICKHKWMKLGDADPNFDRLIAECQQLKEERQVDPLNEDVLLAMEDMGLDKEQTLQSLRSDAYDHYSAIYSLLCDRHKRHKTLRLGALPSMPRALAFQAPVNIQAEQAGTAMNISVPQVQLINPENQIVEPDGTLNLDSDEGEEPSPEALVRYLSMRRHTVGVADPRTEVMEDLQKLLPGFPGVNPQAPFLQVAPNVNFMHNLLPMQNLQPTGQLEYKEQSLLQPPTLQLLNGMGPLGRRASDGGANIQLHAQQLLKRPRGPSPLVTMTPAVPAVTPVDEESSDGEPDQEAVQR

SEQ ID NO: 35688 - protein, 32 aa, Homo sapiens
  ENSP00000452080
MTSLKRSQTERPLATDRASVVGTDGTPKVHTD

SEQ ID NO: 35689 - protein, 1783 aa, Homo sapiens
  ENSP00000370630
MTSLKRSQTERPLATDRASVVGTDGTPKVHTDDFYMRRFRSQNGSLGSSVMAPVGPPRSEGSHHITSTPGVPKMGVRARIADWPPRKENIKESSRSSQEIETSSCLDSLSSKSSPVSQGSSVSLNSNDSAMLKSIQNTLKNKTRPSENMDSRFLMPEAYPSSPRKALRRIRQRSNSDITISELDVDSFDECISPTYKTGPSLHREYGSTSSIDKQGTSGESFFDLLKGYKDDKSDRGPTPTKLSDFLITGGGKGSGFSLDVIDGPISQRENLRLFKEREKPLKRRSKSETGDSSIFRKLRNAKGEELGKSSDLEDNRSEDSVRPWTCPKCFAHYDVQSILFDLNEAIMNRHNVIKRRNTTTGASAAAVASLVSGPLSHSASFSSPMGSTEDLNSKGSLSMDQGDDKSNELVMSCPYFRNEIGGEGERKISLSKSNSGSFSGCESASFESTLSSHCTNAGVAVLEVPKENLVLHLDRVKRYIVEHVDLGAYYYRKFFYQKEHWNYFGADENLGPVAVSIRREKPDEMKENGSPYNYRIIFRTSELMTLRGSVLEDAIPSTAKHSTARGLPLKEVLEHVVPELNVQCLRLAFNTPKVTEQLMKLDEQGLNYQQKVGIMYCKAGQSTEEEMYNNESAGPAFEEFLQLLGERVRLKGFEKYRAQLDTKTDSTGTHSLYTTYKDYEIMFHVSTMLPYTPNNKQQLLRKRHIGNDIVTIVFQEPGAQPFSPKNIRSHFQHVFVIVRVHNPCSDSVCYSVAVTRSRDVPSFGPPIPKGVTFPKSNVFRDFLLAKVINAENAAHKSEKFRAMATRTRQEYLKDLAEKNVTNTPIDPSGKFPFISLASKKKEKSKPYPGAELSSMGAIVWAVRAEDYNKAMELDCLLGISNEFIVLIEQETKSVVFNCSCRDVIGWTSTDTSLKIFYERGECVSVGSFINIEEIKEIVKRLQFVSKGCESVEMTLRRNGLGQLGFHVNYEGIVADVEPYGYAWQAGLRQGSRLVEICKVAVATLSHEQMIDLLRTSVTVKVVIIPPHDDCTPRRSCSETYRMPVMEYKMNEGVSYEFKFPFRNNNKWQRNASKGPHSPQVPSQVQSPMTSRLNAGKGDGKMPPPERAANIPRSISSDGRPLERRLSPGSDIYVTVSSMALARSQCRNSPSNLSSSSDTGSVGGTYRQKSMPEGFGVSRRSPASIDRQNTQSDIGGSGKSTPSWQRSEDSIADQMEPTCHLPAVSKVLPAFRESPSGRLMRQDPVVHLSPNKQGHSDSHYSSHSSSNTLSSNASSAHSDEKWYDGDRTESELNSYNYLQGTSADSGIDTTSYGPSHGSTASLGAATSSPRSGPGKEKVAPLWHSSSEVISMADRTLETESHGLDRKTESSLSLDIHSKSQAGSTPLTRENSTFSINDAASHTSTMSSRHSASPVVFTSARSSPKEELHPAAPSQLAPSFSSSSSSSSGPRSFYPRQGATSKYLIGWKKPEGTINSVGFMDTRKRHQSDGNEIAHTRLRASTRDLRASPKPTSKSTIEEDLKKLIDLESPTPESQKSFKFHALSSPQSPFPSTPTSRRALHRTLSDESIYNSQREHFFTSRASLLDQALPNDVLFSSTYPSLPKSLPLRRPSYTLGMKSLHGEFSASDSSLTDIQETRRQPMPDPGLMPLPDTAADLDWSNLVDAAKAYEVQRASFFAASDENHRPLSAASNSDQLEDQALAQMKPYSSSKDSSPTLASKVDQLEGMLKMLREDLKKEKEDKAHLQAEVQHLREDNLRLQEESQNASDKLKKFTEWVFNTIDMS

SEQ ID NO: 35690 - protein, 1804 aa, Homo sapiens
  ENSP00000450832
MTSLKRSQTERPLATDRASVVGTDGTPKVHTDDFYMRRFRSQNGSLGSSVMAPVGPPRSEGSHHITSTPGVPKMGVRARIADWPPRKENIKESSRSSQEIETSSCLDSLSSKSSPVSQGSSVSLNSNDSAMLKSIQNTLKNKTRPSENMDSRFLMPEAYPSSPRKALRRIRQRSNSDITISELDVDSFDECISPTYKTGPSLHREYGSTSSIDKQGTSGESFFDLLKGYKDDKSDRGPTPTKLSDFLITGGGKGSGFSLDVIDGPISQRENLRLFKEREKPLKRRSKSETGDSSIFRKLRNAKGEELGKSSDLEDNRSEDSVRPWTCPKCFAHYDVQSILFDLNEAIMNRHNVIKRRNTTTGASAAAVASLVSGPLSHSASFSSPMGSTEDLNSKGSLSMDQGDDKSNELVMSCPYFRNEIGGEGERKISLSKSNSGSFSGCESASFESTLSSHCTNAGVAVLEVPKENLVLHLDRVKRYIVEHVDLGAYYYRKFFYQKEHWNYFGADENLGPVAVSIRREKPDEMKENGSPYNYRIIFRTSELMTLRGSVLEDAIPSTAKHSTARGLPLKEVLEHVVPELNVQCLRLAFNTPKVTEQLMKLDEQGLNYQQKVGIMYCKAGQSTEEEMYNNESAGPAFEEFLQLLGERVRLKGFEKYRAQLDTKTDSTGTHSLYTTYKDYEIMFHVSTMLPYTPNNKQQLLRKRHIGNDIVTIVFQEPGAQPFSPKNIRSHFQHVFVIVRVHNPCSDSVCYSVAVTRSRDVPSFGPPIPKGVTFPKSNVFRDFLLAKVINAENAAHKSEKFRAMATRTRQEYLKDLAEKNVTNTPIDPSGKFPFISLASKKKEKSKPYPGAELSSMGAIVWAVRAEDYNKAMELDCLLGISNEFIVLIEQETKSVVFNCSCRDVIGWTSTDTSLKIFYERGECVSVGSFINIEEIKEIVKRLQFVSKGCESVEMTLRRNGLGQLGFHVNYEGIVADVEPYGYAWQAGLRQGSRLVEICKVAVATLSHEQMIDLLRTSVTVKVVIIPPHDDCTPRRSCSETYRMPVMEYKMNEGVSYEFKFPFRNNNKWQRNASKGPHSPQVPSQVQSPMTSRLNAGKGDGKMPPPERAANIPRSISSDGRPLERRLSPGSDIYVTVSSMALARSQCRNSPSNLSSSSDTGSVGGTYRQKSMPEGFGVSRRSPASIDRQNTQSDIGGSGKSTPSWQRSEDSIADQMAYSYRGPQDFNSFVLEQHEYTEPTCHLPAVSKVLPAFRESPSGRLMRQDPVVHLSPNKQGHSDSHYSSHSSSNTLSSNASSAHSDEKWYDGDRTESELNSYNYLQGTSADSGIDTTSYGPSHGSTASLGAATSSPRSGPGKEKVAPLWHSSSEVISMADRTLETESHGLDRKTESSLSLDIHSKSQAGSTPLTRENSTFSINDAASHTSTMSSRHSASPVVFTSARSSPKEELHPAAPSQLAPSFSSSSSSSSGPRSFYPRQGATSKYLIGWKKPEGTINSVGFMDTRKRHQSDGNEIAHTRLRASTRDLRASPKPTSKSTIEEDLKKLIDLESPTPESQKSFKFHALSSPQSPFPSTPTSRRALHRTLSDESIYNSQREHFFTSRASLLDQALPNDVLFSSTYPSLPKSLPLRRPSYTLGMKSLHGEFSASDSSLTDIQETRRQPMPDPGLMPLPDTAADLDWSNLVDAAKAYEVQRASFFAASDENHRPLSAASNSDQLEDQALAQMKPYSSSKDSSPTLASKVDQLEGMLKMLREDLKKEKEDKAHLQAEVQHLREDNLRLQEESQNASDKLKKFTEWVFNTIDMS

SEQ ID NO: 35691 - protein, 1782 aa, Homo sapiens
  ENSP00000351352
MTSLKRSQTERPLATDRASVVGTDGTPKVHTDDFYMRRFRSQNGSLGSSVMAPVGPPRSEGSHHITSTPGVPKMGVRARIADWPPRKENIKESSRSSQEIETSSCLDSLSSKSSPVSQGSSVSLNSNDSAMLKSIQNTLKNKTRPSENMDSRFLMPEAYPSSPRKALRRIRQRSNSDITISELDVDSFDECISPTYKTGPSLHREYGSTSSIDKQGTSGESFFDLLKGYKDDKSDRGPTPTKLSDFLITGGGKGSGFSLDVIDGPISQRENLRLFKEREKPLKRRSKSETGDSSIFRKLRNAKGEELGKSSDLEDNRSEDSVRPWTCPKCFAHYDVQSILFDLNEAIMNRHNVIKRRNTTTGASAAAVASLVSGPLSHSASFSSPMGSTEDLNSKGSLSMDQGDDKSNELVMSCPYFRNEIGGEGERKISLSKSNSGSFSGCESASFESTLSSHCTNAGVAVLEVPKENLVLHLDRVKRYIVEHVDLGAYYYRKFFYQKEHWNYFGADENLGPVAVSIRREKPDEMKENGSPYNYRIIFRTSELMTLRGSVLEDAIPSTAKHSTARGLPLKEVLEHVVPELNVQCLRLAFNTPKVTEQLMKLDEQGLNYQQKVGIMYCKAGQSTEEEMYNNESAGPAFEEFLQLLGERVRLKGFEKYRAQLDTKTDSTGTHSLYTTYKDYEIMFHVSTMLPYTPNNKQQLLRKRHIGNDIVTIVFQEPGAQPFSPKNIRSHFQHVFVIVRVHNPCSDSVCYSVAVTRSRDVPSFGPPIPKGVTFPKSNVFRDFLLAKVINAENAAHKSEKFRAMATRTRQEYLKDLAEKNVTNTPIDPSGKFPFISLASKKKEKSKPYPGAELSSMGAIVWAVRAEDYNKAMELDCLLGISNEFIVLIEQETKSVVFNCSCRDVIGWTSTDTSLKIFYERGECVSVGSFINIEEIKEIVKRLQFVSKGCESVEMTLRRNGLGQLGFHVNYEGIVADVEPYGYAWQAGLRQGSRLVEICKVAVATLSHEQMIDLLRTSVTVKVVIIPPHDDCTPRRSCSETYRMPVMEYKMNEGVSYEFKFPFRNNNKWQRNASKGPHSPQVPSQVQSPMTSRLNAGKGDGKMPPPERAANIPRSISSDGRPLERRLSPGSDIYVTVSSMALARSQCRNSPSNLSSSSDTGSVGGTYRQKSMPEGFGVSRRSPASIDRQNTQSDIGGSGKSTPSWQRSEDSIADQMEPTCHLPAVSKVLPAFRESPSGRLMRQDPVVHLSPNKQGHSDSHYSSHSSSNTLSSNASSAHSDEKWYDGDRTESELNSYNYLQGTSADSGIDTTSYGPSHGSTASLGAATSSPRSGPGKEKVAPLWHSSSEVISMADRTLETESHGLDRKTESSLSLDIHSKSQAGSTPLTRENSTFSINDAASHTSTMSSRHSASPVVFTSARSSPKEELHPAAPSQLAPSFSSSSSSSSGPRSFYPRQGATSKYLIGWKKPEGTINSVGFMDTRKRHQSDGNEIAHTRLRASTRDLRASPKPTSKSTIEEDLKKLIDLESPTPESQKSFKFHALSSPQSPFPSTPTSRRALHRTLSDESIYNSQREHFFTSRASLLDQALPNDVLFSSTYPSLPKSLPLRRPSYTLGMKSLHGEFSASDSSLTDIQETRRQPMPDPGLMPLPDTAADLDWSNLVDAAKAYEVQRASFFAASDENHRPLSAASNSDQLEDQALAQMKPYSSKDSSPTLASKVDQLEGMLKMLREDLKKEKEDKAHLQAEVQHLREDNLRLQEESQNASDKLKKFTEWVFNTIDMS

SEQ ID NO: 35692 - protein, 1257 aa, Homo sapiens
  ENSP00000440682
MKENGSPYNYRIIFRTSELMTLRGSVLEDAIPSTAKHSTARGLPLKEVLEHVVPELNVQCLRLAFNTPKVTEQLMKLDEQGLNYQQKVGIMYCKAGQSTEEEMYNNESAGPAFEEFLQLLGERVRLKGFEKYRAQLDTKTDSTGTHSLYTTYKDYEIMFHVSTMLPYTPNNKQQLLRKRHIGNDIVTIVFQEPGAQPFSPKNIRSHFQHVFVIVRVHNPCSDSVCYSVAVTRSRDVPSFGPPIPKGVTFPKSNVFRDFLLAKVINAENAAHKSEKFRAMATRTRQEYLKDLAEKNVTNTPIDPSGKFPFISLASKKKEKSKPYPGAELSSMGAIVWAVRAEDYNKAMELDCLLGISNEFIVLIEQETKSVVFNCSCRDVIGWTSTDTSLKIFYERGECVSVGSFINIEEIKEIVKRLQFVSKGCESVEMTLRRNGLGQLGFHVNYEGIVADVEPYGYAWQAGLRQGSRLVEICKVAVATLSHEQMIDLLRTSVTVKVVIIPPHDDCTPRRSCSETYRMPVMEYKMNEGVSYEFKFPFRNNNKWQRNASKGPHSPQVPSQVQSPMTSRLNAGKGDGKMPPPERAANIPRSISSDGRPLERRLSPGSDIYVTVSSMALARSQCRNSPSNLSSSSDTGSVGGTYRQKSMPEGFGVSRRSPASIDRQNTQSDIGGSGKSTPSWQRSEDSIADQMEPTCHLPAVSKVLPAFRESPSGRLMRQDPVVHLSPNKQGHSDSHYSSHSSSNTLSSNASSAHSDEKWYDGDRTESELNSYNYLQGTSADSGIDTTSYGPSHGSTASLGAATSSPRSGPGKEKVAPLWHSSSEVISMADRTLETESHGLDRKTESSLSLDIHSKSQAGSTPLTRENSTFSINDAASHTSTMSSRHSASPVVFTSARSSPKEELHPAAPSQLAPSFSSSSSSSSGPRSFYPRQGATSKYLIGWKKPEGTINSVGFMDTRKRHQSDGNEIAHTRLRASTRDLRASPKPTSKSTIEEDLKKLIDLESPTPESQKSFKFHALSSPQSPFPSTPTSRRALHRTLSDESIYNSQREHFFTSRASLLDQALPNDVLFSSTYPSLPKSLPLRRPSYTLGMKSLHGEFSASDSSLTDIQETRRQPMPDPGLMPLPDTAADLDWSNLVDAAKAYEVQRASFFAASDENHRPLSAASNSDQLEDQALAQMKPYSSKDSSPTLASKVDQLEGMLKMLREDLKKEKEDKAHLQAEVQHLREDNLRLQEESQNASDKLKKFTEWVFNTIDMS

SEQ ID NO: 35693 - protein, 261 aa, Homo sapiens
  ENSP00000452450
EHWNYFGADENLGPVAVSIRREKPDEMKENGSPYNYRIIFRTSELMTLRGSVLEDAIPSTAKHSTARGLPLKEVLEHVVPELNVQCLRLAFNTPKVTEQLMKLDEQGWICLYLYASYYLPSQLNYQQKVGIMYCKAGQSTEEEMYNNESAGPAFEEFLQLLGERVRLKGFEKYRAQLDTKTDSTGTHSLYTTYKDYEIMFHVSTMLPYTPNNKQQLLRKRHIGNDIVTIVFQEPGAQPFSPKNIRSHFQHVFVIVRVHNPC

SEQ ID NO: 35694 - protein, 1722 aa, Homo sapiens
  ENSP00000355589
MSDPRQSQEEKHKLGRASSKFKDPPRIMQSDDYFARKFKAINGNMGPTTSLNASNSNETGGGGPANGTPAVPKMGVRARVSEWPPKKDCSKELTCKALWESRSQTSYESITSVLQNGQSDQSEGQQDEQLDLDFVEAKYTIGDIFVHSPQRGLHPIRQRSNSDVTISDIDAEDVLDQNAVNPNTGAALHREYGSTSSIDRQGLSGENFFAMLRGYRVENYDHKAMVPFGFPEFFRCDPAISPSLHAAAQISRGEFVRISGLDYVDSALLMGRDRDKPFKRRLKSESVETSLFRKLRTVKSEHETFKFTSELEESRLERGIRPWNCQRCFAHYDVQSILFNINEAMATRANVGKRKNITTGASAASQTQMPTGQTGNCESPLGSKEDLNSKENLDADEGDGKSNDLVLSCPYFRNETGGEGDRRIALSRANSSSFSSGESCSFESSLSSHCTNAGVSVLEVPRENQPIHREKVKRYIIEHIDLGAYYYRKFFYGKEHQNYFGIDENLGPVAVSIRREKVEDAKEKEGSQFNYRVAFRTSELTTLRGAILEDAIPSTARHGTARGLPLKEVLEYVIPELSIQCLRQASNSPKVSEQLLKLDEQGLSFQHKIGILYCKAGQSTEEEMYNNETAGPAFEEFLDLLGQRVRLKGFSKYRAQLDNKTDSTGTHSLYTTYKDYELMFHVSTLLPYMPNNRQQLLRKRHIGNDIVTIVFQEPGALPFTPKSIRSHFQHVFVIVKVHNPCTENVCYSVGVSRSKDVPPFGPPIPKGVTFPKSAVFRDFLLAKVINAENAAHKSEKFRAMATRTRQEYLKDLAENFVTTATVDTSVKFSFITLGAKKKEKVKPRKDAHLFSIGAIMWHVIARDFGQSADIECLLGISNEFIMLIEKDSKNVVFNCSCRDVIGWTSGLVSIKVFYERGECVLLSSVDNCAEDIREIVQRLVIVTRGCETVEMTLRRNGLGQLGFHVNFEGIVADVEPFGFAWKAGLRQGSRLVEICKVAVATLTHEQMIDLLRTSVTVKVVIIQPHDDGSPRRGCSELCRIPMVEYKLDSEGTPCEYKTPFRRNTTWHRVPTPALQPLSRASPIPGTPDRLPCQQLLQQAQAAIPRSTSFDRKLPDGTRSSPSNQSSSSDPGPGGSGPWRPQVGYDGCQSPLLLEHQGSGPLECDGAREREDTMEASRHPETKWHGPPSKVLGSYKERALQKDGSCKDSPNKLSHIGDKSCSSHSSSNTLSSNTSSNSDDKHFGSGDLMDPELLGLTYIKGASTDSGIDTAPCMPATILGPVHLAGSRSLIHSRAEQWADAADVSGPDDEPAKLYSVHGYASTISAGSAAEGSMGDLSEISSHSSGSHHSGSPSAHCSKSSGSLDSSKVYIVSHSSGQQVPGSMSKPYHRQGAVNKYVIGWKKSEGSPPPEEPEVTECPGMYSEMDVMSTATQHQTVVGDAVAETQHVLSKEDFLKLMLPDSPLVEEGRRKFSFYGNLSPRRSLYRTLSDESICSNRRGSSFGSSRSSVLDQALPNDILFSTTPPYHSTLPPRAHPAPSMGSLRNEFWFSDGSLSDKSKCADPGLMPLPDTATGLDWTHLVDAARAFEGLDSDEELGLLCHHTSYLDQRVASFCTLTDMQHGQDLEGAQELPLCVDPGSGKEFMDTTGERSPSPLTGKVNQLELILRQLQTDLRKEKQDKAVLQAEVQHLRQDNMRLQEESQTATAQLRKFTEWFFTTIDKKS

SEQ ID NO: 35695 - protein, 778 aa, Homo sapiens
  ENSP00000309102
MSPCFSFIGCKLCSIVTRGCETVEMTLRRNGLGQLGFHVNFEGIVADVEPFGFAWKAGLRQGSRLVEICKVAVATLTHEQMIDLLRTSVTVKVVIIQPHDDGSPRRGCSELCRIPMVEYKLDSEGTPCEYKTPFRRNTTWHRVPTPALQPLSRASPIPGTPDRLPCQQLLQQAQAAIPRSTSFDRKLPDGTRSSPSNQSSSSDPGPGGSGPWRPQVGYDGCQSPLLLEHQGSGPLECDGAREREDTMEASRHPETKWHGPPSKVLGSYKERALQKDGSCKDSPNKLSHIGDKSCSSHSSSNTLSSNTSSNSDDKHFGSGDLMDPELLGLTYIKGASTDSGIDTAPCMPATILGPVHLAGSRSLIHSRAEQWADAADVSGPDDEPAKLYSVHGYASTISAGSAAEGSMGDLSEISSHSSGSHHSGSPSAHCSKSSGSLDSSKVYIVSHSSGQQVPGSMSKPYHRQGAVNKYVIGWKKSEGSPPPEEPEVTECPGMYSEMDVMSTATQHQTVVGDAVAETQHVLSKEDFLKLMLPDSPLVEEGRRKFSFYGNLSPRRSLYRTLSDESICSNRRGSSFGSSRSSVLDQALPNDILFSTTPPYHSTLPPRAHPAPSMGSLRNEFWFSDGSLSDKSKCADPGLMPLPDTATGLDWTHLVDAARAFEDQRVASFCTLTDMQHGQDLEGAQELPLCVDPGSGKEFMDTTGERSPSPLTGKVNQLELILRQLQTDLRKEKQDKAVLQAEVQHLRQDNMRLQEESQTATAQLRKFTEWFFTTIDKKS

SEQ ID NO: 35696 - protein, 1722 aa, Homo sapiens; identical to SEQ ID NO: 35694
  ENSP00000262861

SEQ ID NO: 35697 - protein, 1781 aa, Homo sapiens
  ENSP00000222345
MTTYRAIPSDGVDLAASCGARVGDVLPGPHTGDYAPLGFWAQNGSMSQPLGESPATATATATATTRPSPTTPAMPKMGVRARVADWPPKREALREHSNPSPSQDTDGTKATKMAHSMRSIQNGQPPTSTPASSGSKAFHRLSRRRSKDVEFQDGWPRSPGRAFLPLRHRSSSEITLSECDAEDAGEPRGARHTGALPLFREYGSTSSIDVQGMPEQSFFDILNEFRSEQPDARGCQALTELLRADPGPHLMGGGGGAKGDSHNGQPAKDSLLPLQPTKEKEKARKKPARGLGGGDTVDSSIFRKLRSSKPEGEAGRSPGEADEGRSPPEASRPWVCQKSFAHFDVQSMLFDLNEAAANRVSVSQRRNTTTGASAASAASAMASLTASRAHSLGGLDPAFTSTEDLNCKENLEQDLGDDNSNDLLLSCPHFRNEIGGECERNVSFSRASVGSPSSGEGHLAEPALSAYRTNASISVLEVPKEQQRTQSRPRQYSIEHVDLGARYYQDYFVGKEHANYFGVDEKLGPVAVSIKREKLEDHKEHGPQYQYRIIFRTRELITLRGSILEDATPTATKHGTGRGLPLKDALEYVIPELNIHCLRLALNTPKVTEQLLKLDEQGLCRKHKVGILYCKAGQSSEEEMYNNEEAGPAFEEFLSLIGEKVCLKGFTKYAAQLDVKTDSTGTHSLYTMYQDYEIMFHVSTLLPYTPNNRQQLLRKRHIGNDIVTIIFQEPGALPFTPKNIRSHFQHVFIIVRVHNPCTDNVCYSMAVTRSKDAPPFGPPIPSGTTFRKSDVFRDFLLAKVINAENAAHKSDKFHTMATRTRQEYLKDLAENCVSNTPIDSTGKFNLISLTSKKKEKTKARAGAEQHSAGAIAWRVVAQDYAQGVEIDCILGISNEFVVLLDLRTKEVVFNCYCGDVIGWTPDSSTLKIFYGRGDHIFLQATEGSVEDIREIVQRLKVMTSGWETVDMTLRRNGLGQLGFHVKYDGTVAEVEDYGFAWQAGLRQGSRLVEICKVAVVTLTHDQMIDLLRTSVTVKVVIIPPFEDGTPRRGWPETYDMNTSEPKTEQESITPGGRPPYRSNAPWQWSGPASHNSLPASKWATPTTPGHAQSLSRPLKQTPIVPFRESQPLHSKRPVSFPETPYTVSPAGADRVPPYRQPSGSFSTPGSATYVRYKPSPERYTAAPHPLLSLDPHFSHDGTSSGDSSSGGLTSQESTMERQKPEPLWHVPAQARLSAIAGSSGNKHPSRQDAAGKDSPNRHSKGEPQYSSHSSSNTLSSNASSSHSDDRWFDPLDPLEPEQDPLSKGGSSDSGIDTTLYTSSPSCMSLAKAPRPAKPHKPPGSMGLCGGGREAAGRSHHADRRREVSPAPAVAGQSKGYRPKLYSSGSSTPTGLAGGSRDPPRQPSDMGSRVGYPAQVYKTASAETPRPSQLAQPSPFQLSASVPKSFFSKQPVRNKHPTGWKRTEEPPPRPLPFSDPKKQVDTNTKNVFGQPRLRASLRDLRSPRKNYKSTIEDDLKKLIIMDNLGPEQERDTGQSPQKGLQRTLSDESLCSGRREPSFASPAGLEPGLPSDVLFTSTCAFPSSTLPARRQHQHPHPPVGPGATPAAGSGFPEKKSTISASELSLADGRDRPLRRLDPGLMPLPDTAAGLEWSSLVNAAKAYEVQRAVSLFSLNDPALSPDIPPAHSPVHSHLSLERGPPTPRTTPTMSEEPPLDLTGKVYQLEVMLKQLHTDLQKEKQDKVVLQSEVASLRQNNQRLQEESQAASEQLRKFAEIFCREKKEL

SEQ ID NO: 35698 - protein, 165 aa, Homo sapiens
  ENSP00000468981
  MOD_RES (1)..(1): Any amino acid
XILEDATPTATKHGTGRGLPLKDALEYVIPELNIHCLRLALNTPKVTEQLLKLDEQGLCRKHKVGILYCKAGQSSEEEMYNNEEAGPAFEEFLSLIGEKVCLKGFTKYAAQLDVKIETGFHHVGQAGLELLTSDDPPASASQSAGIIGVNHQAWPVYLIFKSRLK

SEQ ID NO: 35699 - protein, 184 aa, Homo sapiens
  ENSP00000472734
MPFWGHSPESDMGSRVGYPAQVYKTASAETPRPSQLAQPSPFQLSASVPKSFFSKQPVRNKHPTGWKRTEEPPPRPLPFSDPKKQVDTNTKNVFGQPRLRASLRDLRSPRKNYKSTIEDDLKKLIIMDNLGPEQERDTGSPQKGLQRTLSDESLCSGRREPSFASPAGLEPGLPSDVLFTSTCA

SEQ ID NO: 35700 - protein, 508 aa, Homo sapiens
  ENSP00000478763
MEPAGPAPGRLGPLLCLLLAASCAWSGVAGEEELQVIQPDKSVLVAAGETATLRCTATSLIPVGPIQWFRGAGPGRELIYNQKEGHFPRVTTVSDLTKRNNMDFSIRIGNITPADAGTYYCVKFRKGSPDDVEFKSGAGTELSVRAKPSAPVVSGPAARATPQHTVSFTCESHGFSPRDITLKWFKNGNELSDFQTNVDPVGESVSYSIHSTAKVVLTREDVHSQVICEVAHVTLQGDPLRGTANLSETIRVPPTLEVTQQPVRAENQVNVTCQVRKFYPQRLQLTWLENGNVSRTETASTVTENKDGTYNWMSWLLVNVSAHRDDVKLTCQVEHDGQPAVSKSHDLKVSAHPKEQGSNTAAENTGSNERNIYIVVGVVCTLLVALLMAALYLVRIRQKKAQGSTSSTRLHEPEKNAREITQVQSLDTNDITYADLNLPKGKKPAPQAAEPNNHTEYASIQTSPQPASEDTLTYADLDMVHLNRTPKQPAPKPEPSFSEYASVQVPRK

SEQ ID NO: 35701 - protein, 504 aa, Homo sapiens
  ENSP00000348307
MEPAGPAPGRLGPLLCLLLAASCAWSGVAGEEELQVIQPDKSVLVAAGETATLRCTATSLIPVGPIQWFRGAGPGRELIYNQKEGHFPRVTTVSDLTKRNNMDFSIRIGNITPADAGTYYCVKFRKGSPDDVEFKSGAGTELSVRAKPSAPVVSGPAARATPQHTVSFTCESHGFSPRDITLKWFKNGNELSDFQTNVDPVGESVSYSIHSTAKVVLTREDVHSQVICEVAHVTLQGDPLRGTANLSETIRVPPTLEVTQQPVRAENQVNVTCQVRKFYPQRLQLTWLENGNVSRTETASTVTENKDGTYNWMSWLLVNVSAHRDDVKLTCQVEHDGQPAVSKSHDLKVSAHPKEQGSNTAAENTGSNERNIYIVVGVVCTLLVALLMAALYLVRIRQKKAQGSTSSTRLHEPEKNAREITQDTNDITYADLNLPKGKKPAPQAAEPNNHTEYASIQTSPQPASEDTLTYADLDMVHLNRTPKQPAPKPEPSFSEYASVQVPRK

SEQ ID NO: 35702 - protein, 504 aa, Homo sapiens; identical to SEQ ID NO: 35701
  ENSP00000351621

SEQ ID NO: 35703 - protein, 504 aa, Homo sapiens; identical to SEQ ID NO: 35701
  ENSP00000382941

SEQ ID NO: 35704 - protein, 781 aa, Homo sapiens
  ENSP00000216513
MSSSSPTGQIASAADIKQENGMESASEGQEAHREVAGGAAVGLSPPAPAPFPLEPGDAATAAARVSGEEGAVAAAAAGAAADQVQLHSELLGRHHHAAAAAAQTPLAFSPDHVACVCEALQQGGNLDRLARFLWSLPQSDLLRGNESLLKARALVAFHQGIYPELYSILESHSFESANHPLLQQLWYKARYTEAERARGRPLGAVDKYRLRRKFPLPRTIWDGEETVYCFKEKSRNALKELYKQNRYPSPAEKRHLAKITGLSLTQVSNWFKNRRQRDRNPSETQSKSESDGNPSTEDESSKGHEDLSPHPLSSSSDGITNLSLSSHMEPVYMQQIGNAKISLSSSGVLLNGSLVPASTSPVFLNGNSFIQGPSGVILNGLNVGNTQAVALNPPKMSSNIVSNGISMTDILGSTSQDVKEFKVLQSSANSATTTSYSPSVPVSFPGLIPSTEVKREGIQTVASQDGGSVVTFTTPVQINQYGIVQIPNSGANSQFLNGSIGFSPLQLPPVSVAASQGNISVSSSTSDGSTFTSESTTVQQGKVFLSSLAPSAVVYTVPNTGQTIGSVKQEGLERSLVFSQLMPVNQNAQVNANLSSENISGSGLHPLASSLVNVSPTHNFSLSPSTLLNPTELNRDIADSQPMSAPVASKSTVTSVSNTNYATLQNCSLITGQDLLSVPMTQAALGEIVPTAEDQVGHPSPAVHQDFVQEHRLVLQSVANMKENFLSNSESKATSSLMMLDSKSKYVLDGMVDTVCEDLETDKKELAKLQTVQLDEDMQDL

SEQ ID NO: 35705 - protein, 494 aa, Homo sapiens
  ENSP00000450761
MIASAADIKQENGMESASEGQEAHREVAGGAAVGLSPPAPAPFPLEPGDAATAAARVSGEEGAVAAAAAGAAADQVQLHSELLGRHHHAAAAAAQTPLAFSPDHVACVCEALQQGGNLDRLARFLWSLPQSDLLRGNESLLKARALVAFHQGIYPELYSILESHSFESANHPLLQQLWYKARYTEAERARGRPLGAVDKYRLRRKFPLPRTIWDGEETVYCFKEKSRNALKELYKQNRYPSPAEKRHLAKITGLSLTQVSNWFKNRRQRDRNPSETQSKSESDGNPSTEDESSKGHEDLSPHPLSSSSDGITNLSLSSHMEPVYMQQIGNAKISLSSSGVLLNGSLVPASTSPVFLNGNSFIQGPSGVILNGLNVGNTQAVALNPPKMSSNIVSNGISMTDILGSTSQDVKEFKVLQSSANSATTTSYSPSVPVSFPGLIPSTEVKREGIQTVASQDGGSVVTFTTPVQINQYGIVQIPNSGANSQFLNGSIGF

SEQ ID NO: 35706 - protein, 359 aa, Homo sapiens
  ENSP00000005587
MPNPSSTSSPYPLPEEIRNLLADVETFVADILKGENLSKKAKEKRESLIKKIKDVKSIYLQEFQDKGDAEDGEEYDDPFAGPPDTISLASERYDKDDEAPSDGAQFPPIAAQDLPFVLKAGYLEKRRKDHSFLGFEWQKRWCALSKTVFYYYGSDKDKQQKGEFAIDGYSVRMNNTLRKDGKKDCCFEISAPDKRIYQFTAASPKDAEEWVQQLKFVLQDMESDIIPEDYDERGELYDDVDHPLPISNPLTSSQPIDDEIYEELPEEEEDSAPVKVEEQRKMSQDSVHHTSGDKSTDYANFYQGLWDCTGAFSDELSFKRGDVIYILSKEYNRYGWWVGEMKGAIGLVPKAYIMEMYDI

SEQ ID NO: 35707 - protein, 126 aa, Homo sapiens
  ENSP00000408163
MTTRSVLDVETFVADILKGENLSKKAKEKRESLIKKIKDVKSIYLQEFQDKGDAEDGEEYDDPFAGPPDTISLASERYDKDDEAPSDGAQFPPIAAQDLPFVLKAGYLEKRRKDHSFLGFEWQKRW

SEQ ID NO: 35708 - protein, 868 aa, Homo sapiens
  ENSP00000343200
MIPKSLVQAAETQRGLCEPGGKGREGRSGGKGETRPRGVGTQEGKGTIPGSPREKRGERGEGDPALLPAEDLWRLPGSKDRLRSSLLPPPGPPSSDSGPGPPSSHSGKTAQGPRTLNWARKQSARTSSNLCAWSLAMATKMAEIPSSPYEPGQRGMKDTQRGDAPQRGSPEPRILQLARVGNVYLKEESSRSGRLEAKKWIPTKFLENLSVPHVDLGGNQLWSGGMEALTTQLGPGREGSSSPNSKQELQPYSGSSALKPNQVGETSLYGVPIVSLVIDGQERLCLAQISNTLLKNYSYNEIHNRRVALGITCVQCTPVQLEILRRAGAMPISSRRCGMITKREAERLCKSFLGEHKPPKLPENFAFDVVHECAWGSRGSFIPARYNSSRAKCIKCGYCSMYFSPNKFIFHSHRTPDAKYTQPDAANFNSWRRHLKLSDKSATDELSHAWEDRGLGLATGASGPAGPGGPGGGAGVRSYPVIPVPSKGFGLLQKLPPPLFPHPYGFPTAFGLCPKKDDPVLGAGEPKGGSYVSAFRPVVKDTESIAKLYGSAREAYGAGPARGPGPGAGSGGYVSPDFLSEGSSSYNSASPDVDTADEPEVDVESNRFPDDEDAQEETEPSAPSAGGGPDAGRPAFGDLAAEDLVRRPERSPPSGGGGYELREPCGPLGGPAPAKVFAPERDEHVKSAAVALGPAASYVCTPEAHEPDKEDNHSPADDLETRKSYPDQRSISQPSPANTDRGEDGLTLDVTGTHLVEKDIENLAREELQKLLLEQMELRKKLEREFQSLKDNFQDQMKRELAYREEMVQQLQIVRDTLCNELDQERKARYAIQQKLKEAHDALHHFSCKMLTPRHCTGNCSFKPPLLP

SEQ ID NO: 35709 - protein, 926 aa, Homo sapiens
  ENSP00000451193
MEALTTQLGPGREGSSSPNSKQELQPYSGSSALKPNQVGETSLYGVPIVSLVIDGQERLCLAQISNTLLKNYSYNEIHNRRVALGITCVQCTPVQLEILRRAGAMPISSRRCGMITKREAERLCKSFLGEHKPPKLPENFAFDVVHECAWGSRGSFIPARYNSSRAKCIKCGYCSMYFSPNKFIFHSHRTPDAKYTQPDAANFNSWRRHLKLSDKSATDELSHAWEDVKAMFNGGTRKRTFSLQGGGGGGANGGSGGQGKGGAGGGGGGGPGCGAEMAPGPPPHKSLRCGEDEAAGPPGPPPPHPQRGLGLATGASGPAGPGGPGGGAGVRSYPVIPVPSKGFGLLQKLPPPLFPHPYGFPTAFGLCPKKDDPVLGAGEPKGGPGTGSGGGGAGTGGGAGGPGASHLPPGAGAGPGGGAMFWGHQPSGAAKDAAAVAAAAAAATVYPTFPMFWPAAGSLPVPSYPAAQSQAKAVAAAVAAAAAAAAAAAGSGAPEPLDGAEPAKESGLGAEERCPSALSRGPLDEDGTDEALPPPLAPLPPPPPPPARKGSYVSAFRPVVKDTESIAKLYGSAREAYGAGPARGPGPGAGSGGYVSPDFLSEGSSSYNSASPDVDTADEPEVDVESNRFPDDEDAQEETEPSAPSAGGGPDGEQPTGPPSATSSGADGPANSPDGGSPRPRRRLGPPPAGRPAFGDLAAEDLVRRPERSPPSGGGGYELREPCGPLGGPAPAKVFAPERDEHVKSAAVALGPAASYVCTPEAHEPDKEDNHSPADDLETRKSYPDQRSISQPSPANTDRGEDGLTLDVTGTHLVEKDIENLAREELQKLLLEQMELRKKLEREFQSLKDNFQDQMKRELAYREEMVQQLQIVRDTLCNELDQERKARYAIQQKLKEAHDALHHFSCKMLTPRHCTGNCSFKPPLLP

SEQ ID NO: 35710 - protein, 937 aa, Homo sapiens
  ENSP00000452361
MALLCGLGSGGMEALTTQLGPGREGSSSPNSKQELQPYSGSSALKPNQVGETSLYGVPIVSLVIDGQERLCLAQISNTLLKNYSYNEIHNRRVALGITCVQCTPVQLEILRRAGAMPISSRRCGMITKREAERLCKSFLGEHKPPKLPENFAFDVVHECAWGSRGSFIPARYNSSRAKCIKCGYCSMYFSPNKFIFHSHRTPDAKYTQPDAANFNSWRRHLKLSDKSATDELSHAWEDVKAMFNGGTRKRTFSLQGGGGGGANGGSGGQGKGGAGGGGGGGPGCGAEMAPGPPPHKSLRCGEDEAAGPPGPPPPHPQRGLGLATGASGPAGPGGPGGGAGVRSYPVIPVPSKGFGLLQKLPPPLFPHPYGFPTAFGLCPKKDDPVLGAGEPKGGPGTGSGGGGAGTGGGAGGPGASHLPPGAGAGPGGGAMFWGHQPSGAAKDAAAVAAAAAAATVYPTFPMFWPAAGSLPVPSYPAAQSQAKAVAAAVAAAAAAAAAAAGSGAPEPLDGAEPAKESGLGAEERCPSALSRGPLDEDGTDEALPPPLAPLPPPPPPPARKGSYVSAFRPVVKDTESIAKLYGSAREAYGAGPARGPGPGAGSGGYVSPDFLSEGSSSYNSASPDVDTADEPEVDVESNRFPDDEDAQEETEPSAPSAGGGPDGEQPTGPPSATSSGADGPANSPDGGSPRPRRRLGPPPAGRPAFGDLAAEDLVRRPERSPPSGGGGYELREPCGPLGGPAPAKVFAPERDEHVKSAAVALGPAASYVCTPEAHEPDKEDNHSPADDLETRKSYPDQRSISQPSPANTDRGEDGLTLDVTGTHLVEKDIENLAREELQKLLLEQMELRKKLEREFQSLKDNFQDQMKRELAYREEMVQQLQIVRDTLCNELDQERKARYAIQQKLKEAHDALHHFSCKMLTPRHCTGNCSFKPPLLP

SEQ ID NO: 35711 - protein, 965 aa, Homo sapiens
  ENSP00000369374
MALLCGLGQVTLRIWVSLPSQSENGIGFLAARAFLRSGGMEALTTQLGPGREGSSSPNSKQELQPYSGSSALKPNQVGETSLYGVPIVSLVIDGQERLCLAQISNTLLKNYSYNEIHNRRVALGITCVQCTPVQLEILRRAGAMPISSRRCGMITKREAERLCKSFLGEHKPPKLPENFAFDVVHECAWGSRGSFIPARYNSSRAKCIKCGYCSMYFSPNKFIFHSHRTPDAKYTQPDAANFNSWRRHLKLSDKSATDELSHAWEDVKAMFNGGTRKRTFSLQGGGGGGANGGSGGQGKGGAGGGGGGGPGCGAEMAPGPPPHKSLRCGEDEAAGPPGPPPPHPQRGLGLATGASGPAGPGGPGGGAGVRSYPVIPVPSKGFGLLQKLPPPLFPHPYGFPTAFGLCPKKDDPVLGAGEPKGGPGTGSGGGGAGTGGGAGGPGASHLPPGAGAGPGGGAMFWGHQPSGAAKDAAAVAAAAAAATVYPTFPMFWPAAGSLPVPSYPAAQSQAKAVAAAVAAAAAAAAAAAGSGAPEPLDGAEPAKESGLGAEERCPSALSRGPLDEDGTDEALPPPLAPLPPPPPPPARKGSYVSAFRPVVKDTESIAKLYGSAREAYGAGPARGPGPGAGSGGYVSPDFLSEGSSSYNSASPDVDTADEPEVDVESNRFPDDEDAQEETEPSAPSAGGGPDGEQPTGPPSATSSGADGPANSPDGGSPRPRRRLGPPPAGRPAFGDLAAEDLVRRPERSPPSGGGGYELREPCGPLGGPAPAKVFAPERDEHVKSAAVALGPAASYVCTPEAHEPDKEDNHSPADDLETRKSYPDQRSISQPSPANTDRGEDGLTLDVTGTHLVEKDIENLAREELQKLLLEQMELRKKLEREFQSLKDNFQDQMKRELAYREEMVQQLQIVRDTLCNELDQERKARYAIQQKLKEAHDALHHFSCKMLTPRHCTGNCSFKPPLLP

SEQ ID NO: 35712 - protein, 1015 aa, Homo sapiens
  ENSP00000414750
MASSPLPGPNDILLASPSSAFQPDTLSQPRPGHANLKPNQVGQVILYGIPIVSLVIDGQERLCLAQISNTLLKNFSYNEIHNRRVALGITCVQCTPVQLEILRRAGAMPISSRRCGMITKREAERLCKSFLGENRPPKLPDNFAFDVSHECAWGCRGSFIPARYNSSRAKCIKCSYCNMYFSPNKFIFHSHRTPDAKYTQPDAANFNSWRRHLKLTDKSPQDELVFAWEDVKAMFNGGSRKRALPQPGAHPACHPLSSVKAAAVAAAAAVAGGGGLLGPHLLGAPPPPPPPPPPLAELAGAPHAHHKRPRFDDDDDSLQEAAVVAAASLSAAAASLSVAAASGGAGTGGGGAGGGCVAGVGVGAGAGAGAGAGAKGPRSYPVIPVPSKGSFGGVLQKFPGCGGLFPHPYTFPAAAAAFSLCHKKEDAGAAAEALGGAGAGGAGAAPKAGLSGLFWPAGRKDAFYPPFCMFWPPRTPGGLPVPTYLQPPPQPPSALGCALGESPALLRQAFLDLAEPGGAAGSAEAAPPPGQPPQVVANGPGSGPPPPAGGAGSRDALFESPPGGSGGDCSAGSTPPADSVAAAGAGAAAAGSGPAGSRVPAPHHPHLLEGRKAGGGSYHHSSAFRPVGGKDDAESLAKLHGASAGAPHSAQTHPHHHHHPHHHHHHHHPPQPPSPLLLLPPQPDEPGSERHHPAPPPPPPPPPPPPLAQHPHHRGLLSPGGTSCCYPSEDSSEDEDDEEEEQEVDVEGHKPPEGEEEEEGRDPDDDEEEDEETEVLLGDPLVGGGRFLQGRGPSEKGSSRDRAPAVAGAFPLGLNSSRLLQEDGKLGDPGSDLPPPPPPPLAPQKASGGGSSSPGSPVHHPSLEEQPSYKDSQKTKENNQVIVSTKDDNSFSDKNKEHSFFITDSDASGGDFWRERSGEHTQETNSPHSLKKDVENMGKEELQKVLFEQIDLRRRLEQEFQVLKGNTSFPVFNNFQDQMKRELAYREEMVQQLQIIPYAASLIRKEKLGAHLSKS

SEQ ID NO: 35713 - protein, 296 aa, Homo sapiens
  ENSP00000383255
MASSPLPGPNDILLASPSSAFQPDTLSQPRPGHANLKPNQVGQVILYGIPIVSLVIDGQERLCLAQISNTLLKNFSYNEIHNRRVALGITCVQCTPVQLEILRRAGAMPISSRRCGMITKREAERLCKSFLGENRPPKLPDNFAFDVSHECAWGCRGSFIPARYNSSRAKCIKCSYCNMYFSPNKFIFHSHRTPDAKYTQPDAANFNSWRRHLKLTDKSPQDELVFAWEDVKAMFNGGSRKRALPQPGAHPACHPLSSIRTRSIAFSSQTLMLLEEIFGEKDQEDYMRINEDNIWL

SEQ ID NO: 35714 - protein, 1015 aa, Homo sapiens; identical to SEQ ID NO: 35712
  ENSP00000483333

SEQ ID NO: 35715 - protein, 1212 aa, Homo sapiens
  ENSP00000262461
MEPRPTAPSSGAPGLAGVGETPSAAALAAARVELPGTAVPSVPEDAAPASRDGGGVRDEGPAAAGDGLGRPLGPTPSQSRFQVDLVSENAGRAAAAAAAAAAAAAAAGAGAGAKQTPADGEASGESEPAKGSEEAKGRFRVNFVDPAASSSAEDSLSDAAGVGVDGPNVSFQNGGDTVLSEGSSLHSGGGGGSGHHQHYYYDTHTNTYYLRTFGHNTMDAVPRIDHYRHTAAQLGEKLLRPSLAELHDELEKEPFEDGFANGEESTPTRDAVVTYTAESKGVVKFGWIKGVLVRCMLNIWGVMLFIRLSWIVGQAGIGLSVLVIMMATVVTTITGLSTSAIATNGFVRGGGAYYLISRSLGPEFGGAIGLIFAFANAVAVAMYVVGFAETVVELLKEHSILMIDEINDIRIIGAITVVILLGISVAGMEWEAKAQIVLLVILLLAIGDFVIGTFIPLESKKPKGFFGYKSEIFNENFGPDFREEETFFSVFAIFFPAATGILAGANISGDLADPQSAIPKGTLLAILITTLVYVGIAVSVGSCVVRDATGNVNDTIVTELTNCTSAACKLNFDFSSCESSPCSYGLMNNFQVMSMVSGFTPLISAGIFSATLSSALASLVSAPKIFQALCKDNIYPAFQMFAKGYGKNNEPLRGYILTFLIALGFILIAELNVIAPIISNFFLASYALINFSVFHASLAKSPGWRPAFKYYNMWISLLGAILCCIVMFVINWWAALLTYVIVLGLYIYVTYKKPDVNWGSSTQALTYLNALQHSIRLSGVEDHVKNFRPQCLVMTGAPNSRPALLHLVHDFTKNVGLMICGHVHMGPRRQAMKEMSIDQAKYQRWLIKNKMKAFYAPVHADDLREGAQYLMQAAGLGRMKPNTLVLGFKKDWLQADMRDVDMYINLFHDAFDIQYGVVVIRLKEGLDISHLQGQEELLSSQEKSPGTKDVVVSVEYSKKSDLDTSKPLSEKPITHKVEEEDGKTATQPLLKKESKGPIVPLNVADQKLLEASTQFQKKQGKNTIDVWWLFDDGGLTLLIPYLLTTKKKWKDCKIRVFIGGKINRIDHDRRAMATLLSKFRIDFSDIMVLGDINTKPKKENIIAFEEIIEPYRLHEDDKEQDIADKMKEDEPWRITDNELELYKTKTYRQIRLNELLKEHSSTANIIVMSLPVARKGAVSSALYMAWLEALSKDLPPILLVRGNHQSVLTFYS

SEQ ID NO: 35716 - protein, 1150 aa, Homo sapiens
  ENSP00000427109
MEPRPTAPSSGAPGLAGVGETPSAAALAAARVELPGTAVPSVPEDAAPASRDGGGVRDEGPAAAGDGLGRPLGPTPSQSRFQVDLVSENAGRAAAAAAAAAAAAAAAGAGAGAKQTPADGEASGESEPAKGSEEAKGRFRVNFVDPAASSSAEDSLSDAAGVGVDGPNVSFQNGGDTVLSEGSSLHSGGGGGSGHHQHYYYDTHTNTYYLRTFGHNTMDAVPRIDHYRHTAAQLGEKLLRPSLAELHDELEKEPFEDGFANGEESTPTRDAVVTYTAESKGVVKFGWIKGVLVRCMLNIWGVMLFIRLSWIVGQAGIGLSVLVIMMATVVTTITGLSTSAIATNGFVRGGGAYYLISRSLGPEFGGAIGLIFAFANAVAVAMYVVGFAETVVELLKEHSILMIDEINDIRIIGAITVVILLGISVAGMEWEAKAQIVLLVILLLAIGDFVIGTFIPLESKKPKGFFGYKSEIFNENFGPDFREEETFFSVFAIFFPAATGILAGANISGDLADPQSAIPKGTLLAILITTLVYVGIAVSVGSCVVRDATGNVNDTIVTELTNCTSAACKLNFDFSSCESSPCSYGLMNNFQVMSMVSGFTPLISAGIFSATLSSALASLVSAPKIFQALCKDNIYPAFQMFAKGYGKNNEPLRGYILTFLIALGFILIAELNVIAPIISNFFLASYALINFSVFHASLAKSPGWRPAFKYYNMWISLLGAILCCIVMFVINWWAALLTYVIVLGLYIYVTYKKPDVNWGSSTQALTYLNALQHSIRLSGVEDHVKNFRPQCLVMTGAPNSRPALLHLVHDFTKNVGLMICGHVHMGPRRQAMKEMSIDQAKYQRWLIKNKMKAFYAPVHADDLREGAQYLMQAAGLGRMKPNTLVLGFKKDWLQADMRDVDMYINLFHDAFDIQYGVVVIRLKEGLDISHLQGQEELLSSQEKSPGTKDVVVSVEYSKKSDLDTSKPLSEKPITHKVEEEDGKTATQPLLKKESKGPIVPLNVADQKLLEASTQFQKKQGKNTIDVWWLFDDGGLTLLIPYLLTTKKKWKDCKIRVFIGGKINRIDHDRRAMATLLSKFRIDFSDIMVLGDINTKPKKENIIAFEEIIEPYRLHEDDKEQDIADKMKEDEPWRITDNELELYKTKFYEPC

SEQ ID NO: 35717 - protein, 1196 aa, Homo sapiens
  ENSP00000340878
MEPRPTAPSSGAPGLAGVGETPSAAALAAARVELPGTAVPSVPEDAAPASRDGGGVRDEGPAAAGDGLGRPLGPTPSQSRFQVDLVSENAGRAAAAAAAAAAAAAAAGAGAGAKQTPADGEASGESEPAKGSEEAKGRFRVNFVDPAASSSAEDSLSDAAGVGVDGPNVSFQNGGDTVLSEGSSLHSGGGGGSGHHQHYYYDTHTNTYYLRTFGHNTMDAVPRIDHYRHTAAQLGEKLLRPSLAELHDELEKEPFEDGFANGEESTPTRDAVVTYTAESKGVVKFGWIKGVLVRCMLNIWGVMLFIRLSWIVGQAGIGLSVLVIMMATVVTTITGLSTSAIATNGFVRGGGAYYLISRSLGPEFGGAIGLIFAFANAVAVAMYVVGFAETVVELLKEHSILMIDEINDIRIIGAITVVILLGISVAGMEWEAKAQIVLLVILLLAIGDFVIGTFIPLESKKPKGFFGYKSEIFNENFGPDFREEETFFSVFAIFFPAATGILAGANISGDLADPQSAIPKGTLLAILITTLVYVGIAVSVGSCVVRDATGNVNDTIVTELTNCTSAACKLNFDFSSCESSPCSYGLMNNFQVMSMVSGFTPLISAGIFSATLSSALASLVSAPKIFQALCKDNIYPAFQMFAKGYGKNNEPLRGYILTFLIALGFILIAELNVIAPIISNFFLASYALINFSVFHASLAKSPGWRPAFKYYNMWISLLGAILCCIVMFVINWWAALLTYVIVLGLYIYVTYKKPDVNWGSSTQALTYLNALQHSIRLSGVEDHVKNFRPQCLVMTGAPNSRPALLHLVHDFTKNVGLMICGHVHMGPRRQAMKEMSIDQAKYQRWLIKNKMKAFYAPVHADDLREGAQYLMQAAGLGRMKPNTLVLGFKKDWLQADMRDVDMYINLFHDAFDIQYGVVVIRLKEGLDISHLQGQEELLSSQEKSPGTKDVVVSVEYSKKSDLDTSKPLSEKPITHKESKGPIVPLNVADQKLLEASTQFQKKQGKNTIDVWWLFDDGGLTLLIPYLLTTKKKWKDCKIRVFIGGKINRIDHDRRAMATLLSKFRIDFSDIMVLGDINTKPKKENIIAFEEIIEPYRLHEDDKEQDIADKMKEDEPWRITDNELELYKTKTYRQIRLNELLKEHSSTANIIVMSLPVARKGAVSSALYMAWLEALSKDLPPILLVRGNHQSVLTFYS

SEQ ID NO: 35718 - protein, 1150 aa, Homo sapiens; identical to SEQ ID NO: 35716
  ENSP00000486323

SEQ ID NO: 35719 - protein, 1029 aa, Homo sapiens
  ENSP00000457552
MAELPTTETPGDATLCSGRFTISTLLSSDEPSPPAAYDSSHPSHLTHSSTFCMRTFGYNTIDVVPTYEHYANSTQPGEPRKVRPTLADLHSFLKEGRHLHALAFDSRPSHEMTDGLVEGEAGTSSEKNPEEPVRFGWVKGVMIRCMLNIWGVILYLRLPWITAQAGIVLTWIIILLSVTVTSITGLSISAISTNGKVKSGGTYFLISRSLGPELGGSIGLIFAFANAVGVAMHTVGFAETVRDLLQEYGAPIVDPINDIRIIAVVSVTVLLAISLAGMEWESKAQVLFFLVIMVSFANYLVGTLIPPSEDKASKGFFSYRADIFVQNLVPDWRGPDGTFFGMFSIFFPSATGILAGANISGDLKDPAIAIPKGTLMAIFWTTISYLAISATIGSCVVRDASGVLNDTVTPGWGACEGLACSYGWNFTECTQQHSCHYGLINYYQTMSMVSGFAPLITAGIFGATLSSALACLVSAAKVFQCLCEDQLYPLIGFFGKGYGKNKEPVRGYLLAYAIAVAFIIIAELNTIAPIISNFFLCSYALINFSCFHASITNSPGWRPSFQYYNKWAALFGAIISVVIMFLLTWWAALIAIGVVLFLLLYVIYKKPEVNWGSSVQAGSYNLALSYSVGLNEVEDHIKNYRPQCLVLTGPPNFRPALVDFVGTFTRNLSLMICGHVLIGPHKQRMPELQLIANGHTKWLNKRKIKAFYSDVIAEDLRRGVQILMQAAGLGRMKPNILVVGFKKNWQSAHPATVEDYIGILHDAFDFNYGVCVMRMREGLNVSKMMQAHINPVFDPAEDGKEASARGARPSVSGALDPKALVKEEQATTIFQSEQGKKTIDIYWLFDDGGLTLLIPYLLGRKRRWSKCKIRVFVGGQINRMDQERKAIISLLSKFRLGFHEVHILPDINQNPRAEHTKRFEDMIAPFRLNDGFKDEATVNEMRRDCPWKISDEEITKNRVKSLRQVRLNEIVLDYSRDAALIVITLPIGRKGKCPSSLYMAWLETLSQDLRPPVILIRGNQENVLTFYCQ

SEQ ID NO: 35720 - protein, 1030 aa, Homo sapiens
  ENSP00000402152
MAELPTTETPGDATLCSGRFTISTLLSSDEPSPPAAYDSSHPSHLTHSSTFCMRTFGYNTIDVVPTYEHYANSTQPGEPRKVRPTLADLHSFLKQEGRHLHALAFDSRPSHEMTDGLVEGEAGTSSEKNPEEPVRFGWVKGVMIRCMLNIWGVILYLRLPWITAQAGIVLTWIIILLSVTVTSITGLSISAISTNGKVKSGGTYFLISRSLGPELGGSIGLIFAFANAVGVAMHTVGFAETVRDLLQEYGAPIVDPINDIRIIAVVSVTVLLAISLAGMEWESKAQVLFFLVIMVSFANYLVGTLIPPSEDKASKGFFSYRADIFVQNLVPDWRGPDGTFFGMFSIFFPSATGILAGANISGDLKDPAIAIPKGTLMAIFWTTISYLAISATIGSCVVRDASGVLNDTVTPGWGACEGLACSYGWNFTECTQQHSCHYGLINYYQTMSMVSGFAPLITAGIFGATLSSALACLVSAAKVFQCLCEDQLYPLIGFFGKGYGKNKEPVRGYLLAYAIAVAFIIIAELNTIAPIISNFFLCSYALINFSCFHASITNSPGWRPSFQYYNKWAALFGAIISVVIMFLLTWWAALIAIGVVLFLLLYVIYKKPEVNWGSSVQAGSYNLALSYSVGLNEVEDHIKNYRPQCLVLTGPPNFRPALVDFVGTFTRNLSLMICGHVLIGPHKQRMPELQLIANGHTKWLNKRKIKAFYSDVIAEDLRRGVQILMQAAGLGRMKPNILVVGFKKNWQSAHPATVEDYIGILHDAFDFNYGVCVMRMREGLNVSKMMQAHINPVFDPAEDGKEASARGARPSVSGALDPKALVKEEQATTIFQSEQGKKTIDIYWLFDDGGLTLLIPYLLGRKRRWSKCKIRVFVGGQINRMDQERKAIISLLSKFRLGFHEVHILPDINQNPRAEHTKRFEDMIAPFRLNDGFKDEATVNEMRRDCPWKISDEEITKNRVKSLRQVRLNEIVLDYSRDAALIVITLPIGRKGKCPSSLYMAWLETLSQDLRPPVILIRGNQENVLTFYCQ

SEQ ID NO: 35721 - protein, 1021 aa, Homo sapiens
  ENSP00000456149
MAELPTTETPGDATLCSGRFTISTLLSSDEPSPPAAYDSSHPSHLTHSSTFCMRTFGYNTIDVVPTYEHYANSTQPGEPRKVRPTLADLHSFLKQEGRHLHALAFDSRPSHEMTDGLVEGEAGTSSEKNPEEPVRFGWVKGVMIRCMLNIWGVILYLRLPWITAQAGIVLTWIIILLSVTVTSITGLSISAISTNGKVKSGGTYFLISRSLGPELGGSIGLIFAFANAVGVAMHTVGFAETVRDLLQEYGAPIVDPINDIRIIAVVSVTVLLAISLAGMEWESKAQVLFFLVIMVSFANYLVGTLIPPSEDKASKGFFSYRADIFVQNLVPDWRGPDGTFFGMFSIFFPSATGILAGANISGDLKDPAIAIPKGTLMAIFWTTISYLAISATIGSCVVRDASGVLNDTVTPGWGACEGLACSYGWNFTECTQQHSCHYGLINYYQTMSMVSGFAPLITAGIFGATLSSALACLVSAAKVFQCLCEDQLYPLIGFFGKGYGKNKEPVRGYLLAYAIAVAFIIIAELNTIAPIISNFFLCSYALINFSCFHASITNSPGWRPSFQYYNKWAALFGAIISVVIMFLLTWWAALIAIGVVLFLLLYVIYKKPEVNWGSSVQAGSYNLALSYSVGLNEVEDHIKNYRPQCLVLTGPPNFRPALVDFVGTFTRNLSLMICGHVLIGPHKQRMPELQLIANGHTKWLNKRKIKAFYSDVIAEDLRRGVQILMQAAGLGRMKPNILVVGFKKNWQSAHPATVEDYIGILHDAFDFNYGVCVMRMREGLNVSKMMQAHINPVFDPAEDGKEASARVDPKALVKEEQATTIFQSEQGKKTIDIYWLFDDGGLTLLIPYLLGRKRRWSKCKIRVFVGGQINRMDQERKAIISLLSKFRLGFHEVHILPDINQNPRAEHTKRFEDMIAPFRLNDGFKDEATVNEMRRDCPWKISDEEITKNRVKSLRQVRLNEIVLDYSRDAALIVITLPIGRKGKCPSSLYMAWLETLSQDLRPPVILIRGNQENVLTFYCQ

SEQ ID NO: 35722 - protein, 1020 aa, Homo sapiens
  ENSP00000262502
MAELPTTETPGDATLCSGRFTISTLLSSDEPSPPAAYDSSHPSHLTHSSTFCMRTFGYNTIDVVPTYEHYANSTQPGEPRKVRPTLADLHSFLKEGRHLHALAFDSRPSHEMTDGLVEGEAGTSSEKNPEEPVRFGWVKGVMIRCMLNIWGVILYLRLPWITAQAGIVLTWIIILLSVTVTSITGLSISAISTNGKVKSGGTYFLISRSLGPELGGSIGLIFAFANAVGVAMHTVGFAETVRDLLQEYGAPIVDPINDIRIIAVVSVTVLLAISLAGMEWESKAQVLFFLVIMVSFANYLVGTLIPPSEDKASKGFFSYRADIFVQNLVPDWRGPDGTFFGMFSIFFPSATGILAGANISGDLKDPAIAIPKGTLMAIFWTTISYLAISATIGSCVVRDASGVLNDTVTPGWGACEGLACSYGWNFTECTQQHSCHYGLINYYQTMSMVSGFAPLITAGIFGATLSSALACLVSAAKVFQCLCEDQLYPLIGFFGKGYGKNKEPVRGYLLAYAIAVAFIIIAELNTIAPIISNFFLCSYALINFSCFHASITNSPGWRPSFQYYNKWAALFGAIISVVIMFLLTWWAALIAIGVVLFLLLYVIYKKPEVNWGSSVQAGSYNLALSYSVGLNEVEDHIKNYRPQCLVLTGPPNFRPALVDFVGTFTRNLSLMICGHVLIGPHKQRMPELQLIANGHTKWLNKRKIKAFYSDVIAEDLRRGVQILMQAAGLGRMKPNILVVGFKKNWQSAHPATVEDYIGILHDAFDFNYGVCVMRMREGLNVSKMMQAHINPVFDPAEDGKEASARVDPKALVKEEQATTIFQSEQGKKTIDIYWLFDDGGLTLLIPYLLGRKRRWSKCKIRVFVGGQINRMDQERKAIISLLSKFRLGFHEVHILPDINQNPRAEHTKRFEDMIAPFRLNDGFKDEATVNEMRRDCPWKISDEEITKNRVKSLRQVRLNEIVLDYSRDAALIVITLPIGRKGKCPSSLYMAWLETLSQDLRPPVILIRGNQENVLTFYCQ

SEQ ID NO: 35723 - protein, 1085 aa, Homo sapiens
  ENSP00000318557
MPHFTVVPVDGPRRGDYDNLEGLSWVDYGERAELDDSDGHGNHRESSPFLSPLEASRGIDYYDRNLALFEEELDIRPKVSSLLGKLVSYTNLTQGAKEHEEAESGEGTRRRAAEAPSMGTLMGVYLPCLQNIFGVILFLRLTWMVGTAGVLQALLIVLICCCCTLLTAISMSAIATNGVVPAGGSYFMISRSLGPEFGGAVGLCFYLGTTFAAAMYILGAIEILLTYIAPPAAIFYPSGAHDTSNATLNNMRVYGTIFLTFMTLVVFVGVKYVNKFASLFLACVIISILSIYAGGIKSIFDPPVFPVCMLGNRTLSRDQFDICAKTAVVDNETVATQLWSFFCHSPNLTTDSCDPYFMLNNVTEIPGIPGAAAGVLQENLWSAYLEKGDIVEKHGLPSADAPSLKESLPLYVVADIATSFTVLVGIFFPSVTGIMAGSNRSGDLRDAQKSIPVGTILAIITTSLVYFSSVVLFGACIEGVVLRDKYGDGVSRNLVVGTLAWPSPWVIVIGSFFSTCGAGLQSLTGAPRLLQAIAKDNIIPFLRVFGHGKVNGEPTWALLLTALIAELGILIASLDMVAPILSMFFLMCYLFVNLACAVQTLLRTPNWRPRFKYYHWALSFLGMSLCLALMFVSSWYYALVAMLIAGMIYKYIEYQGAEKEWGDGIRGLSLSAARYALLRLEEGPPHTKNWRPQLLVLLKLDEDLHVKYPRLLTFASQLKAGKGLTIVGSVIQGSFLESYGEAQAAEQTIKNMMEIEKVKGFCQVVVASKVREGLAHLIQSCGLGGMRHNSVVLGWPYGWRQSEDPRAWKTFIDTVRCTTAAHLALLVPKNIAFYPSNHERYLEGHIDVWWIVHDGGMLMLLPFLLRQHKVWRKCRMRIFTVAQMDDNSIQMKKDLAVFLYHLRLEAEVEVVEMHNSDISAYTYERTLMMEQRSQMLRQMRLTKTEREREAQLVKDRHSALRLESLYSDEEDESAVGADKIQMTWTRDKYMTETWDPSHAPDNFRELVHIKPDQSNVRRMHTAVKLNEVIVTRSHDARLVLLNMPGPPRNSEGDENYMEFLEVLTEGLERVLLVRGGGREVITIYS

SEQ ID NO: 35724 - protein, 1037 aa, Homo sapiens
  ENSP00000461403
MTTSRGSVGWTTGSAPSWMTRTEELDIRPKVSSLLGKLVSYTNLTQGAKEHEEAESGEGTRRRAAEAPSMGTLMGVYLPCLQNIFGVILFLRLTWMVGTAGVLQALLIVLICCCCTLLTAISMSAIATNGVVPAGGSYFMISRSLGPEFGGAVGLCFYLGTTFAAAMYILGAIEILLTYIAPPAAIFYPSGAHDTSNATLNNMRVYGTIFLTFMTLVVFVGVKYVNKFASLFLACVIISILSIYAGGIKSIFDPPVFPVCMLGNRTLSRDQFDICAKTAVVDNETVATQLWSFFCHSPNLTTDSCDPYFMLNNVTEIPGIPGAAAGVLQENLWSAYLEKGDIVEKHGLPSADAPSLKESLPLYVVADIATSFTVLVGIFFPSVTGIMAGSNRSGDLRDAQKSIPVGTILAIITTSLVYFSSVVLFGACIEGVVLRDKYGDGVSRNLVVGTLAWPSPWVIVIGSFFSTCGAGLQSLTGAPRLLQAIAKDNIIPFLRVFGHGKVNGEPTWALLLTALIAELGILIASLDMVAPILSMFFLMCYLFVNLACAVQTLLRTPNWRPRFKYYHWALSFLGMSLCLALMFVSSWYYALVAMLIAGMIYKYIEYQGAEKEWGDGIRGLSLSAARYALLRLEEGPPHTKNWRPQLLVLLKLDEDLHVKYPRLLTFASQLKAGKGLTIVGSVIQGSFLESYGEAQAAEQTIKNMMEIEKVKGFCQVVVASKVREGLAHLIQSCGLGGMRHNSVVLGWPYGWRQSEDPRAWKTFIDTVRCTTAAHLALLVPKNIAFYPSNHERYLEGHIDVWWIVHDGGMLMLLPFLLRQHKVWRKCRMRIFTVAQMDDNSIQMKKDLAVFLYHLRLEAEVEVVEMHNSDISAYTYERTLMMEQRSQMLRQMRLTKTEREREAQLVKDRHSALRLESLYSDEEDESAVGADKIQMTWTRDKYMTETWDPSHAPDNFRELVHIKPDQSNVRRMHTAVKLNEVIVTRSHDARLVLLNMPGPPRNSEGDENYMEFLEVLTEGLERVLLVRGGGREVITIYS

SEQ ID NO: 35725 - protein, 1054 aa, Homo sapiens
  ENSP00000438334
MGDTLSPGHGNHRESSPFLSPLEASRGIDYYDRNLALFEEELDIRPKVSSLLGKLVSYTNLTQGAKEHEEAESGEGTRRRAAEAPSMGTLMGVYLPCLQNIFGVILFLRLTWMVGTAGVLQALLIVLICCCCTLLTAISMSAIATNGVVPAGGSYFMISRSLGPEFGGAVGLCFYLGTTFAAAMYILGAIEILLTYIAPPAAIFYPSGAHDTSNATLNNMRVYGTIFLTFMTLVVFVGVKYVNKFASLFLACVIISILSIYAGGIKSIFDPPVFPVCMLGNRTLSRDQFDICAKTAVVDNETVATQLWSFFCHSPNLTTDSCDPYFMLNNVTEIPGIPGAAAGVLQENLWSAYLEKGDIVEKHGLPSADAPSLKESLPLYVVADIATSFTVLVGIFFPSVTGIMAGSNRSGDLRDAQKSIPVGTILAIITTSLVYFSSVVLFGACIEGVVLRDKYGDGVSRNLVVGTLAWPSPWVIVIGSFFSTCGAGLQSLTGAPRLLQAIAKDNIIPFLRVFGHGKVNGEPTWALLLTALIAELGILIASLDMVAPILSMFFLMCYLFVNLACAVQTLLRTPNWRPRFKYYHWALSFLGMSLCLALMFVSSWYYALVAMLIAGMIYKYIEYQGAEKEWGDGIRGLSLSAARYALLRLEEGPPHTKNWRPQLLVLLKLDEDLHVKYPRLLTFASQLKAGKGLTIVGSVIQGSFLESYGEAQAAEQTIKNMMEIEKVKGFCQVVVASKVREGLAHLIQSCGLGGMRHNSVVLGWPYGWRQSEDPRAWKTFIDTVRCTTAAHLALLVPKNIAFYPSNHERYLEGHIDVWWIVHDGGMLMLLPFLLRQHKVWRKCRMRIFTVAQMDDNSIQMKKDLAVFLYHLRLEAEVEVVEMHNSDISAYTYERTLMMEQRSQMLRQMRLTKTEREREAQLVKDRHSALRLESLYSDEEDESAVGADKIQMTWTRDKYMTETWDPSHAPDNFRELVHIKPDQSNVRRMHTAVKLNEVIVTRSHDARLVLLNMPGPPRNSEGDENYMEFLEVLTEGLERVLLVRGGGREVITIYS

SEQ ID NO: 35726 - protein, 1068 aa, Homo sapiens
  ENSP00000458902
MPHFTVVPVDGPRRGDYDNLEGLSWVDYGERAELDDSDGHGNHRESSPFLSPLEASRGIDYYDRNLALFEEELDIRPKVSSLLGKLVSYTNLTQGAKEHEEAESGEGTRRRAAEAPSMGTLMGVYLPCLQNIFGVILFLRLTWMVGTAGVLQALLIVLICCCCTLLTAISMSAIATNGVVPAGGSYFMISRSLGPEFGGAVGLCFYLGTTFAAAMYILGAIEILLTYIAPPAAIFYPSGAHDTSNATLNNMRVYGTIFLTFMTLVVFVGVKYVNKFASLFLACVIISILSIYAGGIKSIFDPPVFPVCMLGNRTLSRDQFDICAKTAVVDNETVATQLWSFFCHSPNLTTDSCDPYFMLNNVTEIPGIPGAAAGVLQENLWSAYLEKGDIVEKHGLPSADAPSLKESLPLYVVADIATSFTVLVGIFFPSVTGIMAGSNRSGDLRDAQKSIPVGTILAIITTSLVYFSSVVLFGACIEGVVLRDKYGDGVSRNLVVGTLAWPSPWVIVIGSFFSTCGAGLQSLTGAPRLLQAIAKDNIIPFLRVFGHGKVNGEPTWALLLTALIAELGILIASLDMVAPILSMFFLMCYLFVNLACAVQTLLRTPNWRPRFKYYHWALSFLGMSLCLALMFVSSWYYALVAMLIAGMIYKYIEYQGAEKEWGDGIRGLSLSAARYALLRLEEGPPHTKNWRPQLLVLLKLDEDLHVKYPRLLTFASQLKAGKGLTIVGSVIQGSFLESYGEAQAAEQTIKNMMEIEKVKGFCQVVVASKVREGLAHLIQSCGLGGMRHNSVVLGWPYGWRQSEDPRAWKTFIDTVRCTTAAHLALLVPKNIAFYPSNHERYLEGHIDVWWIVHDGGMLMLLPFLLRQHKVWRKCRMRIFTVAQMDDNSIQMKKDLAVFLYHLRLEAEVEVVEMHNSDISAYTYERTLMMEQRSQMLRQMRLTKTEREREAQLVKDRHSALRLESLYSDEEDESAVGADKIQMTWTRDKYMTETWDPSHAPDNFRELVHIKPDQSNVRRMHTAVKLNEVIVTRSHDARLVLLNMPGPPRNSEGDENCIPLWRGRQLGGG

SEQ ID NO: 35727 - protein, 1079 aa, Homo sapiens
  ENSP00000445962
MAAEGAVCGFVYLEGTAWAVPEDTEPLASCTLGHGNHRESSPFLSPLEASRGIDYYDRNLALFEEELDIRPKVSSLLGKLVSYTNLTQGAKEHEEAESGEGTRRRAAEAPSMGTLMGVYLPCLQNIFGVILFLRLTWMVGTAGVLQALLIVLICCCCTLLTAISMSAIATNGVVPAGGSYFMISRSLGPEFGGAVGLCFYLGTTFAAAMYILGAIEILLTYIAPPAAIFYPSGAHDTSNATLNNMRVYGTIFLTFMTLVVFVGVKYVNKFASLFLACVIISILSIYAGGIKSIFDPPVFPVCMLGNRTLSRDQFDICAKTAVVDNETVATQLWSFFCHSPNLTTDSCDPYFMLNNVTEIPGIPGAAAGVLQENLWSAYLEKGDIVEKHGLPSADAPSLKESLPLYVVADIATSFTVLVGIFFPSVTGIMAGSNRSGDLRDAQKSIPVGTILAIITTSLVYFSSVVLFGACIEGVVLRDKYGDGVSRNLVVGTLAWPSPWVIVIGSFFSTCGAGLQSLTGAPRLLQAIAKDNIIPFLRVFGHGKVNGEPTWALLLTALIAELGILIASLDMVAPILSMFFLMCYLFVNLACAVQTLLRTPNWRPRFKYYHWALSFLGMSLCLALMFVSSWYYALVAMLIAGMIYKYIEYQGAEKEWGDGIRGLSLSAARYALLRLEEGPPHTKNWRPQLLVLLKLDEDLHVKYPRLLTFASQLKAGKGLTIVGSVIQGSFLESYGEAQAAEQTIKNMMEIEKVKGFCQVVVASKVREGLAHLIQSCGLGGMRHNSVVLGWPYGWRQSEDPRAWKTFIDTVRCTTAAHLALLVPKNIAFYPSNHERYLEGHIDVWWIVHDGGMLMLLPFLLRQHKVWRKCRMRIFTVAQMDDNSIQMKKDLAVFLYHLRLEAEVEVVEMHNSDISAYTYERTLMMEQRSQMLRQMRLTKTEREREAQLVKDRHSALRLESLYSDEEDESAVGADKIQMTWTRDKYMTETWDPSHAPDNFRELVHIKPDQSNVRRMHTAVKLNEVIVTRSHDARLVLLNMPGPPRNSEGDENYMEFLEVLTEGLERVLLVRGGGREVITIYS

SEQ ID NO: 35728 - protein, 19 aa, Homo sapiens
  ENSP00000463148
  MOD_RES (1)..(1): Any amino acid
XPDNFRELVHIKPMAHGDL

SEQ ID NO: 35729 - protein, 90 aa, Homo sapiens
  ENSP00000464660
  MOD_RES (1)..(1): Any amino acid
XPQLLVLLKLDEDLHVKYPRLLTFASQLKAGKGLTIVGSVIQGSFLESYGEAQAAEQTPCAALRLPTWPCSCPRTSPSTPATTSATWRAT

SEQ ID NO: 35730 - protein, 54 aa, Homo sapiens
  ENSP00000458975
MPHFTVVPVDGPRRGDYDNLEGLSWVDYGERAELDDSDDLHCPTSCHFLPIGCS

SEQ ID NO: 35731 - protein, 178 aa, Homo sapiens
  ENSP00000464168
MGTLMGVYLPCLQNIFGVILFLRLTWMVGTAGVLQALLIVLICCCCTLLTAISMSAIATNGVVPAGGSYFMISRSLGPEFGGAVGLCFYLGTTFAAAMYILGAIEILLTYIAPPAAIFYPSGAHDTSNATLNNMRVYGTIFLTFMTLVVFVGVKYVNKFASLFLACVIISILSIYAGG

SEQ ID NO: 35732 - protein, 1087 aa, Homo sapiens
  ENSP00000395983
MRAGGACRPGAAGTAAGTAAGGWDGGCGGAEPARCLTSPWCQWTGRGAATMTTSRGSVGWTTGSAPSWMTRTEELDIRPKVSSLLGKLVSYTNLTQGAKEHEEAESGEGTRRRAAEAPSMGTLMGVYLPCLQNIFGVILFLRLTWMVGTAGVLQALLIVLICCCCTLLTAISMSAIATNGVVPAGGSYFMISRSLGPEFGGAVGLCFYLGTTFAAAMYILGAIEILLTYIAPPAAIFYPSGAHDTSNATLNNMRVYGTIFLTFMTLVVFVGVKYVNKFASLFLACVIISILSIYAGGIKSIFDPPVFPVCMLGNRTLSRDQFDICAKTAVVDNETVATQLWSFFCHSPNLTTDSCDPYFMLNNVTEIPGIPGAAAGVLQENLWSAYLEKGDIVEKHGLPSADAPSLKESLPLYVVADIATSFTVLVGIFFPSVTGIMAGSNRSGDLRDAQKSIPVGTILAIITTSLVYFSSVVLFGACIEGVVLRDKYGDGVSRNLVVGTLAWPSPWVIVIGSFFSTCGAGLQSLTGAPRLLQAIAKDNIIPFLRVFGHGKVNGEPTWALLLTALIAELGILIASLDMVAPILSMFFLMCYLFVNLACAVQTLLRTPNWRPRFKYYHWALSFLGMSLCLALMFVSSWYYALVAMLIAGMIYKYIEYQGAEKEWGDGIRGLSLSAARYALLRLEEGPPHTKNWRPQLLVLLKLDEDLHVKYPRLLTFASQLKAGKGLTIVGSVIQGSFLESYGEAQAAEQTIKNMMEIEKVKGFCQVVVASKVREGLAHLIQSCGLGGMRHNSVVLGWPYGWRQSEDPRAWKTFIDTVRCTTAAHLALLVPKNIAFYPSNHERYLEGHIDVWWIVHDGGMLMLLPFLLRQHKVWRKCRMRIFTVAQMDDNSIQMKKDLAVFLYHLRLEAEVEVVEMHNSDISAYTYERTLMMEQRSQMLRQMRLTKTEREREAQLVKDRHSALRLESLYSDEEDESAVGADKIQMTWTRDKYMTETWDPSHAPDNFRELVHIKPDQSNVRRMHTAVKLNEVIVTRSHDARLVLLNMPGPPRNSEGDENYMEFLEVLTEGLERVLLVRGGGREVITIYS

SEQ ID NO: 35733 - protein, 1139 aa, Homo sapiens
  ENSP00000387694
MSRRFTVTSLPPAGPARSPDPESRRHSVADPRHLPGEDVKGDGNPKESSPFINSTDTEKGKEYDGKNMALFEEEMDTSPMVSSLLSGLANYTNLPQGSREHEEAENNEGGKKKPVQAPRMGTFMGVYLPCLQNIFGVILFLRLTWVVGIAGIMESFCMVFICCSCTMLTAISMSAIATNGVVPAGGSYYMISRSLGPEFGGAVGLCFYLGTTFAGAMYILGTIEILLAYLFPAMAIFKAEDASGEAAAMLNNMRVYGTCVLTCMATVVFVGVKYVNKFALVFLGCVILSILAIYAGVIKSAFDPPNFPICLLGNRTLSRHGFDVCAKLAWEGNETVTTRLWGLFCSSRFLNATCDEYFTRNNVTEIQGIPGAASGLIKENLWSSYLTKGVIVERSGMTSVGLADGTPIDMDHPYVFSDMTSYFTLLVGIYFPSVTGIMAGSNRSGDLRDAQKSIPTGTILAIATTSAVYISSVVLFGACIEGVVLRDKFGEAVNGNLVVGTLAWPSPWVIVIGSFFSTCGAGLQSLTGAPRLLQAISRDGIVPFLQVFGHGKANGEPTWALLLTACICEIGILIASLDEVAPILSMFFLMCYMFVNLACAVQTLLRTPNWRPRFRYYHWTLSFLGMSLCLALMFICSWYYALVAMLIAGLIYKYIEYRGAEKEWGDGIRGLSLSAARYALLRLEEGPPHTKNWRPQLLVLVRVDQDQNVVHPQLLSLTSQLKAGKGLTIVGSVLEGTFLENHPQAQRAEESIRRLMEAEKVKGFCQVVISSNLRDGVSHLIQSGGLGGLQHNTVLVGWPRNWRQKEDHQTWRNFIELVRETTAGHLALLVTKNVSMFPGNPERFSEGSIDVWWIVHDGGMLMLLPFLLRHHKVWRKCKMRIFTVAQMDDNSIQMKKDLTTFLYHLRITAEVEVVEMHESDISAYTYEKTLVMEQRSQILKQMHLTKNEREREIQSITDESRGSIRRKNPANTRLRLNVPEETAGDSEEKPEEEVQLIHDQSAPSCPSSSPSPGEEPEGEGETDPEKVHLTWTKDKSVAEKNKGPSPVSSEGIKDFFSMKPEWENLNQSNVRRMHTAVRLNEVIVKKSRDAKLVLLNMPGPPRNRNGDENYMEFLEVLTEHLDRVMLVRGGGREVITIYS

SEQ ID NO: 35734 - protein, 53 aa, Homo sapiens
  ENSP00000486382
MSRRFTVTSLPPAGPARSPDPESRRHSVADPRHLPGEDVKANPTDPHVLAIHL

SEQ ID NO: 35735 - protein, 120 aa, Homo sapiens
  ENSP00000487372
MSRRFTVTSLPPAGPARSPDPESRRHSVADPRHLPGEDVKVSPQGALIRGPLPGSEALGSGRNKANRLVVAPARGGGGGGGGGGGRGGGGRGGGRGGGGEGGGEASPDRQGSLPSRSKSN

SEQ ID NO: 35736 - protein, 67 aa, Homo sapiens
  ENSP00000487291
  MOD_RES (1)..(1): Any amino acid
XHSVADPRHLPGEDVKVAPARGGGGGGGGGGGRGGGGRGGGRGGGGEGGGEASPDRQGSLPSRSKSN

SEQ ID NO: 35737 - protein, 123 aa, Homo sapiens
  ENSP00000476885
MALFEEEMDTSPMVSSLLSGLANYTNLPQGSREHEEAENNEGGKKKPVQAPRMGTFMGVYLPCLQNIFGVILFLRLTWVVGIAGIMESFCMVFICCSCTMLTAISMSAIATNGVVPAGGSYYM

SEQ ID NO: 35738 - protein, 180 aa, Homo sapiens
  ENSP00000485953
MLNNLTDCEDGDGGANPGDGNPKESSPFINSTDTEKGKEYDGKNMALFEEEMDTSPMVSSLLSGLANYTNLPQGSREHEEAENNEGGKKKPVQAPRMGTFMGVYLPCLQNIFGVILFLRLTWVVGIAGIMESFCMVFICCSCTMLTAISMSAIATNGVVPAGGSYYMISRLSGWQEQSFR

SEQ ID NO: 35739 - protein, 289 aa, Homo sapiens
  ENSP00000478369
MLNNLTDCEDGDGGANPGDGNPKESSPFINSTDTEKGKEYDGKNMALFEEEMDTSPMVSSLLSGLANYTNLPQGSREHEEAENNEGGKKKPVQAPRMGTFMGVYLPCLQNIFGVILFLRLTWVVGIAGIMESFCMVFICCSCTMLTAISMSAIATNGVVPAGGSYYMISRSLGPEFGGAVGLCFYLGTTFAGAMYILGTIEILLRREQPLLIGSYASWGQDRGGVLLKRKKPRGPRPTEEAPPRCLRWGAGVSPQSACRLLPVSHGSSPKTEIVELEGAPSPEFPPWDK

SEQ ID NO: 35740 - protein, 1116 aa, Homo sapiens
  ENSP00000243964
MLNNLTDCEDGDGGANPGDGNPKESSPFINSTDTEKGKEYDGKNMALFEEEMDTSPMVSSLLSGLANYTNLPQGSREHEEAENNEGGKKKPVQAPRMGTFMGVYLPCLQNIFGVILFLRLTWVVGIAGIMESFCMVFICCSCTMLTAISMSAIATNGVVPAGGSYYMISRSLGPEFGGAVGLCFYLGTTFAGAMYILGTIEILLAYLFPAMAIFKAEDASGEAAAMLNNMRVYGTCVLTCMATVVFVGVKYVNKFALVFLGCVILSILAIYAGVIKSAFDPPNFPICLLGNRTLSRHGFDVCAKLAWEGNETVTTRLWGLFCSSRFLNATCDEYFTRNNVTEIQGIPGAASGLIKENLWSSYLTKGVIVERSGMTSVGLADGTPIDMDHPYVFSDMTSYFTLLVGIYFPSVTGIMAGSNRSGDLRDAQKSIPTGTILAIATTSAVYISSVVLFGACIEGVVLRDKFGEAVNGNLVVGTLAWPSPWVIVIGSFFSTCGAGLQSLTGAPRLLQAISRDGIVPFLQVFGHGKANGEPTWALLLTACICEIGILIASLDEVAPILSMFFLMCYMFVNLACAVQTLLRTPNWRPRFRYYHWTLSFLGMSLCLALMFICSWYYALVAMLIAGLIYKYIEYRGAEKEWGDGIRGLSLSAARYALLRLEEGPPHTKNWRPQLLVLVRVDQDQNVVHPQLLSLTSQLKAGKGLTIVGSVLEGTFLENHPQAQRAEESIRRLMEAEKVKGFCQVVISSNLRDGVSHLIQSGGLGGLQHNTVLVGWPRNWRQKEDHQTWRNFIELVRETTAGHLALLVTKNVSMFPGNPERFSEGSIDVWWIVHDGGMLMLLPFLLRHHKVWRKCKMRIFTVAQMDDNSIQMKKDLTTFLYHLRITAEVEVVEMHESDISAYTYEKTLVMEQRSQILKQMHLTKNEREREIQSITDESRGSIRRKNPANTRLRLNVPEETAGDSEEKPEEEVQLIHDQSAPSCPSSSPSPGEEPEGEGETDPEKVHLTWTKDKSVAEKNKGPSPVSSEGIKDFFSMKPEWENLNQSNVRRMHTAVRLNEVIVKKSRDAKLVLLNMPGPPRNRNGDENYMEFLEVLTEHLDRVMLVRGGGREVITIYS

SEQ ID NO: 35741 - protein, 58 aa, Homo sapiens
  ENSP00000487449
MLNNLTDCEDGDGGANPGDGNPKESSPFINSTDTEKGKEYDGKNMALFEPPSTDTLPP

SEQ ID NO: 35742 - protein, 186 aa, Homo sapiens
  ENSP00000446091
MLNNLTDCEDGDGGANPGDGNPKESSPFINSTDTEKGKEYDGKNMALFEEEMDTSPMVSSLLSGLANYTNLPQGSREHEEAENNEGGKKKPVQAPRMGTFMGVYLPCLQNIFGVILFLRLTWVVGIAGIMESFCMVFICCSCTMLTAISMSAIATNGVVPAGGSYYMISRSLAMARPMESRPGPCS

SEQ ID NO: 35743 - protein, 24 aa, Homo sapiens
  ENSP00000490442
  MOD_RES (1)..(1): Any amino acid
XSRDAKLVLLNMPGPPRNRNGDEN

SEQ ID NO: 35744 - protein, 262 aa, Homo sapiens
  ENSP00000477569
MLNNLTDCEDGDGGANPGDGNPKESSPFINSTDTEKGKEYDGKNMALFEEEMDTSPMVSSLLSGLANYTNLPQGSREHEEAENNEGGKKKPVQAPRMGTFMGVYLPCLQNIFGVILFLRLTWVVGIAGIMESFCMVFICCSCTMLTAISMSAIATNGVVPAGGSYYMISRSLGPEFGGAVGLCFYLGTTFAGAMYILGTIEILLSLTLLPRLEGSGAVTDSLDFPGSNDPPHQFSLPSSWLTSSQPWPSSRQKMPVGRQQPC

SEQ ID NO: 35745 - protein, 459 aa, Homo sapiens [sequence omitted]

SEQ ID NO: 35746 - protein, 515 aa, Homo sapiens
  ENSP00000415713
MRRAAAGGLAVGQLPGEGPAGEEGAALGKAMRGGGCSPHSPSGCLSGVMAGFNMGGDLREPAASIPLGSLAAVGISWFLYIIFVFLLGAICTREALRYDFLIAEKVSLMGFLFLLGLYISSLASCMGGLYGAPRILQCIAQEKVIPALACLGQGKGPNKTPVAAICLTSLVTMAFVFVGQVNVLAPIVTINFMLTYVAVDYSYFSLSMCSCSLTPVPEPVLREGAEGLHCSEHLLLEKAPSYGSEGPAQRVLEGTLLEFTKDMDQLLQLTRKLESSQPRQGEGNRTPESQKRKSKKATKQTLQDSFLLDLKSPPSFPVEISDRLPAASWEGQESCWNKQTSKSEGTQPEGTYGEQLVPELCNQSESSGEDFFLKSRLQEQDVWRRSTSFYTHMCNPWVSLLGAVGSLLIMFVIQWVYTLVNMGVAAIVYFYIGRASPGLHLGSASNFSFFRWMRSLLLPSCRSLRSPQEQIILAPSLAKVDMEMTQLTQENADFATRDRYHHSSLVNREQLMPHY

SEQ ID NO: 35747 - protein, 714 aa, Homo sapiens
  ENSP00000377112
MTQMSQVQELFHEAAQQDALAQPQPWWKTQLFMWEPVLFGTWDGVFTSCMINIFGVVLFLRTGWLVGNTGVLLGMFLVSFVILVALVTVLSGIGVGERSSIGSGGVYSMISSVLGGQTGGTIGLLYVFGQCVAGAMYITGFAESISDLLGLGNIWAVRGISVAVLLALLGINLAGVKWIIRLQLLLLFLLAVSTLDFVVGSFTHLDPEHGFIGYSPELLQNNTLPDYSPGESFFTVFGVFFPAATGVMAGFNMGGDLREPAASIPLGSLAAVGISWFLYIIFVFLLGAICTREALRYDFLIAEKVSLMGFLFLLGLYISSLASCMGGLYGAPRILQCIAQEKVIPALACLGQGKGPNKTPVAAICLTSLVTMAFVFVGQVNVLAPIVTINFMLTYVAVDYSYFSLSMCSCSLTPVPEPVLREGAEGLHCSEHLLLEKAPSYGSEGPAQRVLEGTLLEFTKDMDQLLQLTRKLESSQPRQGEGNRTPESQKRKSKKATKQTLQDSFLLDLKSPPSFPVEISDRLPAASWEGQESCWNKQTSKSEGTQPEGTYGEQLVPELCNQSESSGEDFFLKSRLQEQDVWRRSTSFYTHMCNPWVSLLGAVGSLLIMFVIQWVYTLVNMGVAAIVYFYIGRASPGLHLGSASNFSFFRWMRSLLLPSCRSLRSPQEQIILAPSLAKVDMEMTQLTQENADFATRDRYHHSSLVNREQLMPHY

SEQ ID NO: 35748 - protein, 160 aa, Homo sapiens
  ENSP00000419424
  MOD_RES (1)..(1): Any amino acid
XQDALAQPQPWWKTQLFMWEPVLFGTWDGVFTSCMINIFGVVLFLRTGWLVGNTGVLLGMFLVSFVILVALVTVLSGIGVGERSSIGSGGVYSMISSVLGGQTGGTIGLLYVFGQVPCISPALLNPSRICWASGISGLCEEFQLRCFWPCWALTSQVSNG

SEQ ID NO: 35749 - protein, 714 aa, Homo sapiens; identical to SEQ ID NO: 35747
  ENSP00000418783

SEQ ID NO: 35750 - protein, 207 aa, Homo sapiens
  ENSP00000420197
LGWCVHILHDQHLWGCALPEDWLAGGKHRSAPGHVPGVLRHPGGPRHGAVWHWRRGAQQHRQRWRLLHDLLGPGWADGRHHRAALCVWTEHGFIGYSPELLQNNTLPDYSPGESFFTVFGVFFPAATGVMAGFNMGGDLREPAASIPLGSLAAVGISWFLYIIFVFLLGAICTREALRYDFLIAEKVSLMGFLFLLGLYISSLASCM

SEQ ID NO: 35751 - protein, 112 aa, Homo sapiens
  ENSP00000418636
MWEPVLFGTWDGVFTSCMINIFGVVLFLRTGWLVGNTGVLLGMFLVSFVILVALVTVLSGIGVGERSSIGSGGVYSMISSVLGGQTGGTIGLLYVFGQCVAGAMYITGFAES

SEQ ID NO: 35752 - protein, 568 aa, Homo sapiens [sequence omitted]

SEQ ID NO: 35753 - protein, 551 aa, Homo sapiens
  ENSP00000293800
MASALSYVSKFKSFVILFVTPLLLLPLVILMPAKFVRCAYVIILMAIYWCTEVIPLAVTSLMPVLLFPLFQILDSRQVCVQYMKDTNMLFLGGLIVAVAVERWNLHKRIALRTLLWVGAKPARNTATTAMMVPIVEAILQQMEATSAATEAGLELVDKGKAKELPGSQVIFEGPTLGQQEDQERKRLCKAMTLCICYAASIGGTATLTGTGPNVVLLGQMNELFPDSKDLVNFASWFAFAFPNMLVMLLFAWLWLQFVYMRFNFKKSWGCGLESKKNEKAALKVLQEEYRKLGPLSFAEINVLICFFLLVILWFSRDPGFMPGWLTVAWVEGETKYVSDATVAIFVATLLFIVPSQKPKFNFRSQTEEERKTPFYPPPLLDWKVTQEKVPWGIVLLLGGGFALAKGSEASGLSVWMGKQMEPLHAVPPAAITLILSLLVAVFTECTSNVATTTLFLPIFASMSRSIGLNPLYIMLPCTLSASFAFMLPVATPPNAIVFTYGHLKVADMVKTGVIMNIIGVFCVFLAVNTWGRAIFDLDHFPDWANVTHIET

SEQ ID NO: 35754 - protein, 525 aa, Homo sapiens
  ENSP00000370464
MASALSYVSKFKSFVILFVTPLLLLPLVILMPAKVCVQYMKDTNMLFLGGLIVAVAVERWNLHKRIALRTLLWVGAKPARLMLGFMGVTALLSMWISNTATTAMMVPIVEAILQQMEATSAATEAGLELVDKGKAKELPGSQVIFEGPTLGQQEDQERKRLCKAMTLCICYAASIGGTATLTGTGPNVVLLGQMNELFPDSKDLVNFASWFAFAFPNMLVMLLFAWLWLQFVYMRFNFKKSWGCGLESKKNEKAALKVLQEEYRKLGPLSFAEINVLICFFLLVILWFSRDPGFMPGWLTVAWVEGETKYVSDATVAIFVATLLFIVPSQKPKFNFRSQTEEERKTPFYPPPLLDWKVTQEKVPWGIVLLLGGGFALAKGSEASGLSVWMGKQMEPLHAVPPAAITLILSLLVAVFTECTSNVATTTLFLPIFASMSRSIGLNPLYIMLPCTLSASFAFMLPVATPPNAIVFTYGHLKVADMVKTGVIMNIIGVFCVFLAVNTWGRAIFDLDHFPDWANVTHIET

SEQ ID NO: 35755 - protein, 522 aa, Homo sapiens
  ENSP00000459372
MASALSYVSKFKSFVILFVTPLLLLPLVILMPAKFVRCAYVIILMAIYWCTEVIPLAVTSLMPVLLFPLFQILDSRQVCVQYMKDTNMLFLGGLIVAVAVERWNLHKRIALRTLLWVGAKPARLMLGFMGVTALLSMWISNTATTAMMVPIVEAILQQMEATSAATEAGLELVDKGKAKELPGSQVIFEGPTLGQQEDQERKRLCKAMTLCICYAASIGGTATLTGTGPNVVLLGQMNELFPDSKDLVNFASWFAFAFPNMLVMLLFAWLWLQFVYMRFNFKKSWGCGLESKKNEKAALKVLQEEYRKLGPLSFAEINVLICFFLLVILWFSRDPGFMPGWLTVAWVEGETKYVSDATVAIFVATLLFIVPSQKPKFNFRSQTEEERKTPFYPPPLLDWKVTQEKVPWGIVLLLGGGFALAKGSEASGLSVWMGKQMEPLHAVPPAAITLILSLLVAVFTECTSNVATTTLFLPIFASMVKTGVIMNIIGVFCVFLAVNTWGRAIFDLDHFPDWANVTHIET

SEQ ID NO: 35756 - protein, 94 aa, Homo sapiens
  ENSP00000460037
  MOD_RES (1)..(1): Any amino acid
XPAAITLILSLLVAVFTECTSNVATTTLFLPIFASMSRSIGLNPLYIMLPCTLSASFAFMLPVATPPNAIVFTYGHLKVADMVTQLFLFTPVGL

SEQ ID NO: 35757 - protein, 81 aa, Homo sapiens
  ENSP00000461495
MASALSYVSKFKSFVILFVTPLLLLPLVILMPAKFVRCAYVIILMAIYWCTEVIPLAVTSLMPVLLFPLFQILDSRCVSST

SEQ ID NO: 35758 - protein, 167 aa, Homo sapiens
  ENSP00000461622
MASALSYVSKFKSFVILFVTPLLLLPLVILMPAKILDSRQVCVQYMKDTNMLFLGGLIVAVAVERWNLHKRIALRTLLWVGAKPARLMLGFMGVTALLSMWISNTATTAMMVPIVEAILQQMEATSAATEAGLELVDKGKAKELPGSQVIFEGPTLGQQEDQERKRL

SEQ ID NO: 35759 - protein, 91 aa, Homo sapiens
  ENSP00000460903
MASALSYVSKFKSFVILFVTPLLLLPLVILMPAKFVRCAYVIILMAIYWCTEVIPLAVTSLMPVLLFPLFQILDSRQGDTTRACIPTPSCP

SEQ ID NO: 35760 - protein, 389 aa, Homo sapiens
  ENSP00000318546
MEDSPTMVRVDSPTMVRGENQVSPCQGRRCFPKALGYVTGDMKELANQLKDKPVVLQFIDWILRGISQVVFVNNPVSGILILVGLLVQNPWWALTGWLGTVVSTLMALLLSQDRSLIASGLYGYNATLVGVLMAVFSDKGDYFWWLLLPVCAMSMTCPIFSSALNSMLSKWDLPVFTLPFNMALSMYLSATGHYNPFFPAKLVIPITTAPNISWSDLSALELLKSIPVGVGQIYGCDNPWTGGIFLGAILLSSPLMCLHAAIGSLLGIAAGLSLSAPFEDIYFGLWGFNSSLACIAMGGMFMALTWQTHLLALGCALFTAYLGVGMANFMAEVGLPACTWPFCLATLLFLIMTTKNSNIYKMPLSKVTYPEENRIFYLQAKKRMVESPL

SEQ ID NO: 35761 - protein, 28 aa, Homo sapiens
  ENSP00000465029
MALLLSQDRSLIASGLYGYNATLVGVLM

SEQ ID NO: 35762 - protein, 281 aa, Homo sapiens
  ENSP00000442180
MGRRNRSLIASGLYGYNATLVGVLMAVFSDKGDYFWWLLLPVCAMSMTCPIFSSALNSMLSKWDLPVFTLPFNMALSMYLSATGHYNPFFPAKLVIPITTAPNISWSDLSALELLKSIPVGVGQIYGCDNPWTGGIFLGAILLSSPLMCLHAAIGSLLGIAAGLSLSAPFEDIYFGLWGFNSSLACIAMGGMFMALTWQTHLLALGCALFTAYLGVGMANFMAEVGLPACTWPFCLATLLFLIMTTKNSNIYKMPLSKVTYPEENRIFYLQAKKRMVESPL

SEQ ID NO: 35763 - protein, 102 aa, Homo sapiens
  ENSP00000465702
MEDSPTMVRVDSPTMVRGENQVSPCQGRRCFPKALGYVTGDMKELANQLKDKPVVLQFIDWILRGISQVVFVNNPVSGILILVGLLVQNPWWALTGWLGTVV

SEQ ID NO: 35764 - protein, 169 aa, Homo sapiens
  ENSP00000466273
MAVFSDKGDYFWWLLLPVCAMSMTCPIFSSALNSMLSKWDLPVFTLPFNMALSMYLSATGHYNPFFPAKLVIPITTAPNISWSDLSALELLKSIPVGVGQIYGCDNPWTGGIFLGAILLSSPLMCLHAAIGSLLGIAAGLSLSAPFEDIYFGLWGFNSSLACIAMGGMF

SEQ ID NO: 35765 - protein, 445 aa, Homo sapiens
  ENSP00000412309
MNGRSLIGGAGDARHGPVWKDPFGTKAGDAARRGIARLSLALADGSQEQEPEEEIAMEDSPTMVRVDSPTMVRGENQVSPCQGRRCFPKALGYVTGDMKELANQLKDKPVVLQFIDWILRGISQVVFVNNPVSGILILVGLLVQNPWWALTGWLGTVVSTLMALLLSQDRSLIASGLYGYNATLVGVLMAVFSDKGDYFWWLLLPVCAMSMTCPIFSSALNSMLSKWDLPVFTLPFNMALSMYLSATGHYNPFFPAKLVIPITTAPNISWSDLSALELLKSIPVGVGQIYGCDNPWTGGIFLGAILLSSPLMCLHAAIGSLLGIAAGLSLSAPFEDIYFGLWGFNSSLACIAMGGMFMALTWQTHLLALGCALFTAYLGVGMANFMAEVGLPACTWPFCLATLLFLIMTTKNSNIYKMPLSKVTYPEENRIFYLQAKKRMVESPL

SEQ ID NO: 35766 - protein, 257 aa, Homo sapiens
  ENSP00000441998
MAVFSDKGDYFWWLLLPVCAMSMTCPIFSSALNSMLSKWDLPVFTLPFNMALSMYLSATGHYNPFFPAKLVIPITTAPNISWSDLSALELLKSIPVGVGQIYGCDNPWTGGIFLGAILLSSPLMCLHAAIGSLLGIAAGLSLSAPFEDIYFGLWGFNSSLACIAMGGMFMALTWQTHLLALGCALFTAYLGVGMANFMAEVGLPACTWPFCLATLLFLIMTTKNSNIYKMPLSKVTYPEENRIFYLQAKKRMVESPL

SEQ ID NO: 35767 - protein, 284 aa, Homo sapiens
  ENSP00000385320
MALLLSQDRSLIASGLYGYNATLVGVLMAVFSDKGDYFWWLLLPVCAMSMTCPIFSSALNSMLSKWDLPVFTLPFNMALSMYLSATGHYNPFFPAKLVIPITTAPNISWSDLSALELLKSIPVGVGQIYGCDNPWTGGIFLGAILLSSPLMCLHAAIGSLLGIAAGLSLSAPFEDIYFGLWGFNSSLACIAMGGMFMALTWQTHLLALGCALFTAYLGVGMANFMAEVGLPACTWPFCLATLLFLIMTTKNSNIYKMPLSKVTYPEENRIFYLQAKKRMVESPL

SEQ ID NO: 35768 - protein, 214 aa, Homo sapiens
  ENSP00000467898
MNGRSLIGGAGDARHGPVWKDPFGTKAGDAARRGIARLSLALADGSQEQEPEEEIAMEDSPTMVRVDSPTMVRGENQVSPCQGRRCFPKALGYVTGDMKELANQLKDKPVVLQFIDWILRGISQVVFVNNPVSGILILVGLLVQNPWWALTGWLGTVVSTLMALLLSQDRSLIASGLYGYNATLVGVLMAVFSDKGDYFWWLLLPVCAMSMTCC

SEQ ID NO: 35769 - protein, 136 aa, Homo sapiens
  ENSP00000470055
MEDSPTMVRVDSPTMVRGENQVSPCQGRRCFPKALGYVTGDMKELANQLKDKPVVLQFIDWILRGISQVVFVNNPVSGILILVGLLVQNPWWALTGWLGTVVSTLMALLLSQDRSLIASGLYGYNATLVGVLMAVF

SEQ ID NO: 35770 - protein, 445 aa, Homo sapiens; identical to SEQ ID NO: 35765
  ENSP00000390637

SEQ ID NO: 35771 - protein, 129 aa, Homo sapiens
  ENSP00000466093
MNGRSLIGGAGDARHGPVWKDPFGTKAGDAARRGIARLSLALADGSQEQEPEEEIAMEDSPTMVRVDSPTMVRGENQVSPCQGRRCFPKALGYVTGDMKELANQLKDKPVVLQFIDWILRGISQVVFVN

SEQ ID NO: 35772 - protein, 116 aa, Homo sapiens
  ENSP00000468763
MALLLSQDRSLIASGLYGYNATLVGVLMAVFSDKGDYFWWLLLPVCAMSMTCPIFSSALNSMLSKWDLPVFTLPFNMALSMYLSATGHYNPFFPAKLVIPITTAPNISWSDLSALE

SEQ ID NO: 35773 - protein, 389 aa, Homo sapiens; identical to SEQ ID NO: 35760
  ENSP00000470476

SEQ ID NO: 35774 - protein, 302 aa, Homo sapiens
  ENSP00000465044
MEDSPTMVRVDSPTMVRGENQVSPCQGRRCFPKALGYVTGDMKELANQLKDKPVVLQFIDWILRGISQVVFVNNPVSGILILVGLLVQNPWWALTGWLGTVVSTLMALLLSQDRSLIASGLYGYNATLVGVLMAVFSDKGDYFWWLLLPVCAMSMTCPIFSSALNSMLSKWDLPVFTLPFNMALSMYLSATGHYNPFFPAKLVIPITTAPNISWSDLSALEDSVFQPHLRTSTLDSGVSTALWPALQWEECSWRSPGKPTSWLLAVPCSRPILESAWQTLWLRLDCQLVPGPSVWPRYCSSS

SEQ ID NO: 35775 - protein, 173 aa, Homo sapiens
  ENSP00000465150
  MOD_RES (1)..(1): Any amino acid
XLTGWLGTVVSTLMALLLSQDRSLIASGLYGYNATLVGVLMAVFSDKGDYFWWLLLPVCAMSMTCPIFSSALNSMLSKWDLPVFTLPFNMALSMYLSATGHYNPFFPAKLVIPITTAPNISWSDLSALEPCSRPILESAWQTLWLRERVKEELWGKKSKHNQRSSAVKNLGCG

SEQ ID NO: 35776 - protein, 302 aa, Homo sapiens; identical to SEQ ID NO: 35774
  ENSP00000479595

SEQ ID NO: 35777 - protein, 920 aa, Homo sapiens
  ENSP00000465953
MSDPHSSPLLPEPLSSRYKLYEAEFTSPSWPSTSPDTHPALPLLEMPEEKDLRSSNEDSHIVKIEKLNERSKRKDDGVAHRDSAGQRCICLSKAVGYLTGDMKEYRIWLKDKHLALQFIDWVLRGTAQVMFINNPLSGLIIFIGLLIQNPWWTITGGLGTVVSTLTALALGQDRSAIASGLHGYNGMLVGLLMAVFSEKLDYYWWLLFPVTFTAMSCPVLSSALNSIFSKWDLPVFTLPFNIAVTLYLAATGHYNLFFPTTLVEPVSSVPNITWTEMEMPLLLQAIPVGVGQVYGCDNPWTGGVFLVALFISSPLICLHAAIGSIVGLLAALSVATPFETIYTGLWSYNCVLSCIAIGGMFYALTWQTHLLALICALFCAYMEAAISNIMSVVGVPPGTWAFCLATIIFLLLTTNNPAIFRLPLSKVTYPEANRIYYLTVKSGEEEKAPSGGGGEHPPTAGPKVEEGSEAVLSKHRSVFHIEWSSIRRRSKVFGKGEHQERQNKDPFPYRYRKPTVELLDLDTMEESSEIKVETNISKTSWIRSSMAASGKRVSKALSYITGEMKECGEGLKDKSPVFQFFDWVLRGTSQVMFVNNPLSGILIILGLFIQNPWWAISGCLGTIMSTLTALILSQDKSAIAAGFHGYNGVLVGLLMAVFSDKGDYYWWLLLPVIIMSMSCPILSSALGTIFSKWDLPVFTLPFNITVTLYLAATGHYNLFFPTTLLQPASAMPNITWSEVQVPLLLRAIPVGIGQVYGCDNPWTGGIFLIALFISSPLICLHAAIGSTMGMLAALTIATPFDSIYFGLCGFNSTLACIAIGGMFYVITWQTHLLAIACALFAAYLGAALANMLSVFGLPPCTWPFCLSALTFLLLTTNNPAIYKLPLSKVTYPEANRIYYLSQERNRRASIITKYQAYDVS

SEQ ID NO: 35778 - protein, 920 aa, Homo sapiens; identical to SEQ ID NO: 35777
  ENSP00000255226

SEQ ID NO: 35779 - protein, 235 aa, Homo sapiens
  ENSP00000320689
MSDPHSSPLLPEPLSSRYKLYEAEFTSPSWPSTSPDTHPALPLLEMPEEKDLRSSNEDSHIVKIEKLNERSKRKDDGVAHRDSAGQRCICLSKAVGYLTGDMKEYRIWLKDKHLALQFIDWVLRGTAQVMFINNPLSGLIIFIGLLIQNPWWTITGGLGTVVSTLTALALGQDRSAIASGLHGYNGMLVGLLMAVFSEKLDYYWWLLFPVTFTAMSWMETDFNWSKSGCWKHLLQ

SEQ ID NO: 35780 - protein, 729 aa, Homo sapiens
  ENSP00000417085
MNPFQKNESKETLFSPVSIEEVPPRPPSPPKKPSPTICGSNYPLSIAFIVVNEFCERFSYYGMKAVLILYFLYFLHWNEDTSTSIYHAFSSLCYFTPILGAAIADSWLGKFKTIIYLSLVYVLGHVIKSLGALPILGGQVVHTVLSLIGLSLIALGTGGIKPCVAAFGGDQFEEKHAEERTRYFSVFYLSINAGSLISTFITPMLRGDVQCFGEDCYALAFGVPGLLMVIALVVFAMGSKIYNKPPPEGNIVAQVFKCIWFAISNRFKNRSGDIPKRQHWLDWAAEKYPKQLIMDVKALTRVLFLYIPLPMFWALLDQQGSRWTLQAIRMNRNLGFFVLQPDQMQVLNPLLVLIFIPLFDFVIYRLVSKCGINFSSLRKMAVGMILACLAFAVAAAVEIKINEMAPAQPGPQEVFLQVLNLADDEVKVTVVGNENNSLLIESIKSFQKTPHYSKLHLKTKSQDFHFHLKYHNLSLYTEHSVQEKNWYSLVIREDGNSISSMMVKDTESRTTNGMTTVRFVNTLHKDVNISLSTDTSLNVGEDYGVSAYRTVQRGEYPAVHCRTEDKNFSLNLGLLDFGAAYLFVITNNTNQGLQAWKIEDIPANKMSIAWQLPQYALVTAGEVMFSVTGLEFSYSQAPSSMKSVLQAAWLLTIAVGNIIVLVVAQFSGLVQWAEFILFSCLLLVICLIFSIMGYYYVPVKTEDMRGPADKHIPHIQGNMIKLETKKTKL

SEQ ID NO: 35781 - protein, 698 aa, Homo sapiens
  ENSP00000295605
MNPFQKNESKETLFSPVSIEEVPPRPPSPPKKPSPTICGSNYPLSIAFIVVNEFCERFSYYGMKAVLILYFLYFLHWNEDTSTSIYHAFSSLCYFTPILGAAIADSWLGKFKVLSLIGLSLIALGTGGIKPCVAAFGGDQFEEKHAEERTRYFSVFYLSINAGSLISTFITPMLRGDVQCFGEDCYALAFGVPGLLMVIALVVFAMGSKIYNKPPPEGNIVAQVFKCIWFAISNRFKNRSGDIPKRQHWLDWAAEKYPKQLIMDVKALTRVLFLYIPLPMFWALLDQQGSRWTLQAIRMNRNLGFFVLQPDQMQVLNPLLVLIFIPLFDFVIYRLVSKCGINFSSLRKMAVGMILACLAFAVAAAVEIKINEMAPAQPGPQEVFLQVLNLADDEVKVTVVGNENNSLLIESIKSFQKTPHYSKLHLKTKSQDFHFHLKYHNLSLYTEHSVQEKNWYSLVIREDGNSISSMMVKDTESRTTNGMTTVRFVNTLHKDVNISLSTDTSLNVGEDYGVSAYRTVQRGEYPAVHCRTEDKNFSLNLGLLDFGAAYLFVITNNTNQGLQAWKIEDIPANKMSIAWQLPQYALVTAGEVMFSVTGLEFSYSQAPSSMKSVLQAAWLLTIAVGNIIVLVVAQFSGLVQWAEFILFSCLLLVICLIFSIMGYYYVPVKTEDMRGPADKHIPHIQGNMIKLETKKTKL

SEQ ID NO: 35782 - protein, 152 aa, Homo sapiens
  ENSP00000418704
MKAVLILYFLYFLHWNEDTSTSIYHAFSSLCYFTPILGAAIADSWLGKFKTIIYLSLVYVLGHVIKSLGALPILGGQVVHTVLSLIGLSLIALGTGGIKPCVAAFGGDQFEEKHAEERTRYFSVFYLSINAGSLISTFITPMLRGDVQCFGE

SEQ ID NO: 35783 - protein, 515 aa, Homo sapiens
  ENSP00000357844
MVLSQEEPDSARGTSEAQPLGPAPTGAAPPPGPGPSDSPEAAVEKVEVELAGPATAEPHEPPEPPEGGWGWLVMLAAMWCNGSVFGIQNACGVLFVSMLETFGSKDDDKMVFKTAWVGSLSMGMIFFCCPIVSVFTDLFGCRKTAVVGAAVGFVGLMSSSFVSSIEPLYLTYGIIFACGCSFAYQPSLVILGHYFKKRLGLVNGIVTAGSSVFTILLPLLLRVLIDSVGLFYTLRVLCIFMFVLFLAGFTYRPLATSTKDKESGGSGSSLFSRKKFSPPKKIFNFAIFKVTAYAVWAVGIPLALFGYFVPYVHLMKHVNERFQDEKNKEVVLMCIGVTSGVGRLLFGRIADYVPGVKKVYLQVLSFFFIGLMSMMIPLCSIFGALIAVCLIMGLFDGCFISIMAPIAFELVGAQDVSQAIGFLLGFMSIPMTVGPPIAGLLRDKLGSYDVAFYLAGVPPLIGGAVLCFIPWIHSKKQREISKTTGKEKMEKMLENQNSLLSSSSGMFKKESDSII

SEQ ID NO: 35784 - protein, 206 aa, Homo sapiens
  ENSP00000387501
  MOD_RES (1)..(1): Any amino acid
XWVGSLSMGMIFFCCPIVSVFTDLFGCRKTAVVGAAVGFVGLMSSSFVSSIEPLYLTYGIIFACGCSFAYQPSLVILGHYFKKRLGLVNGIVTAGSSVFTILLPLLLRVLIDSVGLFYTLRVLCIFMFVLFLAGFTYRPLATSTKDKESGGSGSSLFSRKKFSPPKKIFNFAIFKVTAYAVWAVGIPLALFGYFVPYVHLVSMLLH

SEQ ID NO: 35785 - protein, 211 aa, Homo sapiens
  ENSP00000399601
  MOD_RES (1)..(1): Any amino acid
XWVGSLSMGMIFFCCPIVSVFTDLFGCRKTAVVGAAVGFVGLMSSSFVSSIEPLYLTYGIIFACGCSFAYQPSLVILGHYFKKRLGLVNGIVTAGSSVFTILLPLLLRVLIDSVGLFYTLRVLCIFMFVLFLAGFTYRPLATSTKDKESGGSGSSLFSRKKFSPPKKIFNFAIFKVTAYAVWAVGIPLALFGYFVPYVHLAKFSFVILKYE

SEQ ID NO: 35786 - protein, 201 aa, Homo sapiens
  ENSP00000357843
MKHVNERFQDEKNKEVVLMCIGVTSGVGRLLFGRIADYVPGVKKVYLQVLSFFFIGLMSMMIPLCSIFGALIAVCLIMGLFDGCFISIMAPIAFELVGAQDVSQAIGFLLGFMSIPMTVGPPIAGLLRDKLGSYDVAFYLAGVPPLIGGAVLCFIPWIHSKKQREISKTTGKEKMEKMLENQNSLLSSSSGMFKKESDSII

SEQ ID NO: 35787 - protein, 326 aa, Homo sapiens
  ENSP00000483868
MVLSQEEPDSARGTSEAQPLGPAPTGAAPPPGPGPSDSPEAAVEKVEVELAGPATAEPHEPPEPPEGGWGWLVMLAAMWCNGSVFGIQNACGVLFVSMLETFGSKDDDKMVFKTAWVGSLSMGMIFFCCPIVSVFTDLFGCRKTAVVGAAVGFVGLMSSSFVSSIEPLYLTYGIIFACGCSFAYQPSLVILGHYFKKRLGLVNGIVTAGSSVFTILLPLLLRVLIDSVGLFYTLRVLCIFMFVLFLAGFTYRPLATSTKDKESGGSGSSLFSRKKFSPPKNFQFCHLQGDSLCSVGSWNTTCTFWILCALCSLGEYAPSLIMNITI

SEQ ID NO: 35788 - protein, 497 aa, Homo sapiens
  ENSP00000367137
MSTGPDVKATVGDISSDGNLNVAQEECSRKGFCSVRHGLALILQLCNFSIYTQQMNLSIAIPAMVNNTAPPSQPNASTERPSTDSQGYWNETLKEFKAMAPAYDWSPEIQGIILSSLNYGSFLAPIPSGYVAGIFGAKYVVGAGLFISSFLTLFIPLAANAGVALLIVLRIVQGIAQVMVLTGQYSIWVKWAPPLERSQLTTIAGSGSMLGSFIVLLAGGLLCQTIGWPYVFYIFGGIGCACCPLWFPLIYDDPVNHPFISAGEKRYIVCSLAQQDCSPGWSLPIRAMIKSLPLWAILVSYFCEYWLFYTIMAYTPTYISSVLQANLRDSGILSALPFVVGCICIILGGLLADFLLSRKILRLITIRKLFTAIGVLFPSVILVSLPWVRSSHSMTMTFLVLSSAISSFCESGALVNFLDIAPRYTGFLKGLLQVFAHIAGAISPTAAGFFISQDSEFGWRNVFLLSAAVNISGLVFYLIFGRADVQDWAKEQTFTHL

SEQ ID NO: 35789 - protein, 443 aa, Homo sapiens
  ENSP00000391345
MNLSIAIPAMVNNTAPPSQPNASTERPSTDSQGYWNETLKEFKAMAPAYDWSPEIQGIILSSLNYGSFLAPIPSGYVAGIFGAKYVVGAGLFISSFLTLFIPLAANAGVALLIVLRIVQGIAQVMVLTGQYSIWVKWAPPLERSQLTTIAGSGSMLGSFIVLLAGGLLCQTIGWPYVFYIFGGIGCACCPLWFPLIYDDPVNHPFISAGEKRYIVCSLAQQDCSPGWSLPIRAMIKSLPLWAILVSYFCEYWLFYTIMAYTPTYISSVLQANLRDSGILSALPFVVGCICIILGGLLADFLLSRKILRLITIRKLFTAIGVLFPSVILVSLPWVRSSHSMTMTFLVLSSAISSFCESGALVNFLDIAPRYTGFLKGLLQVFAHIAGAISPTAAGFFISQDSEFGWRNVFLLSAAVNISGLVFYLIFGRADVQDWAKEQTFTHL

SEQ ID NO: 35790 - protein, 221 aa, Homo sapiens
  ENSP00000380266
MNLSIAIPAMVNNTAPPSQPNASTERPSTDSQGYWNETLKEFKAMDCSPGWSLPIRAMIKSLPLWAILVSYFCEYWLFYTIMAYTPTYISSVLQANLRDSGILSALPFVVGCICIILGGLLADFLLSRKILRLITIRKLFTAIGKGETGHRGERGKLRAAFSLLCVCPPTPGVLFPSVILVSLPWVRSSHSMTMTFLVLSSAISSFCESGALVNFLDIAPR

SEQ ID NO: 35791 - protein, 560 aa, Homo sapiens
  ENSP00000221485
MEFRQEEFRKLAGRALGKLHRLLEKRQEGAETLELSADGRPVTTQTRDPPVVDCTCFGLPRRYIIAIMSGLGFCISFGIRCNLGVAIVSMVNNSTTHRGGHVVVQKAQFSWDPETVGLIHGSFFWGYIVTQIPGGFICQKFAANRVFGFAIVATSTLNMLIPSAARVHYGCVIFVRILQGLVEGVTYPACHGIWSKWAPPLERSRLATTAFCGSYAGAVVAMPLAGVLVQYSGWSSVFYVYGSFGIFWYLFWLLVSYESPALHPSISEEERKYIEDAIGESAKLMNPLTKFSTPWRRFFTSMPVYAIIVANFCRSWTFYLLLISQPAYFEEVFGFEISKVGLVSALPHLVMTIIVPIGGQIADFLRSRRIMSTTNVRKLMNCGGFGMEATLLLVVGYSHSKGVAISFLVLAVGFSGFAISGFNVNHLDIAPRYASILMGISNGVGTLSGMVCPIIVGAMTKHKTREEWQYVFLIASLVHYGGVIFYGVFASGEKQPWAEPEEMSEEKCGFVGHDQLAGSDDSEMEDEAEPPGAPPAPPPSYGATHSTFQPPRPPPPVRDY

SEQ ID NO: 35792 - protein, 493 aa, Homo sapiens
  ENSP00000470338
MSGLGFCISFGIRCNLGVAIVSMVNNSTTHRGGHVVVQKAQFSWDPETVGLIHGSFFWGYIVTQIPGGFICQKFAANRVFGFAIVATSTLNMLIPSAARVHYGCVIFVRILQGLVEGVTYPACHGIWSKWAPPLERSRLATTAFCGSYAGAVVAMPLAGVLVQYSGWSSVFYVYGSFGIFWYLFWLLVSYESPALHPSISEEERKYIEDAIGESAKLMNPLTKFSTPWRRFFTSMPVYAIIVANFCRSWTFYLLLISQPAYFEEVFGFEISKVGLVSALPHLVMTIIVPIGGQIADFLRSRRIMSTTNVRKLMNCGGFGMEATLLLVVGYSHSKGVAISFLVLAVGFSGFAISGFNVNHLDIAPRYASILMGISNGVGTLSGMVCPIIVGAMTKHKTREEWQYVFLIASLVHYGGVIFYGVFASGEKQPWAEPEEMSEEKCGFVGHDQLAGSDDSEMEDEAEPPGAPPAPPPSYGATHSTFQPPRPPPPVRDY

SEQ ID NO: 35793 - protein, 116 aa, Homo sapiens
  ENSP00000472086
  MOD_RES (1)..(1): Any amino acid
XWSKWAPPLERSRLATTAFCGSYAGAVVAMPLAGVLVQYSGWSSVFYVYGSFGIFWYLFWLLVSYESPALHPSISEEERKYIEDAIGESAKLMNPLTNYTVVPEGTRRSPQPRSPS

SEQ ID NO: 35794 - protein, 269 aa, Homo sapiens
  ENSP00000393988
  MOD_RES (1)..(1): Any amino acid
XLRLWSLWWVFNSAGYYLVVYYVHILWNEVDPTTNSARVYNGAADAASTLLGAITSFAAGFVKIRWARWSKLLIAGVTATQAGLVFLLAHTRHPSSIWLCYAAFVLFRGSYQFLVPIATFQIASSLSKELCALVFGVNTFFATIVKTIITFIVSDVRGLGLPVRKQALRMSRPRLGLCLPGPFPPQSAAPARAGMAASSAEDPGSERGPWRRAGTVAARGDPGGERGPWRREGTLAARGDPGGERGPWWREGTLAAKPRMQWVTRATAP

SEQ ID NO: 35795 - protein, 545 aa, Homo sapiens
  ENSP00000457278
MVPSSPAVEKQVPVEPGPDPELRSWRHLVCYLCFYGFMAQIRPGESFITPYLLGPDKNFTREQVTNEITPVLSYSYLAVLVPVFLLTDYLRYTPVLLLQGLSFVSVWLLLLLGHSVAHMQLMELFYSVTMAARIAYSSYIFSLVRPARYQRVAGYSRAAVLLGVFTSSVLGQLLVTVGRVSFSTLNYISLAFLTFSVVLALFLKRPKRSLFFNRDDRGRCETSASELERMNPGPGGKLGHALRVACGDSVLARMLRELGDSLRRPQLRLWSLWWVFNSAGYYLVVYYVHILWNEVDPTTNSARVYNGAADAASTLLGAITSFAAGFVKIRWARWSKLLIAGVTATQAGLVFLLAHTRHPSSIWLCYAAFVLFRGSYQFLVPIATFQIASSLSKELCALVFGVNTFFATIVKTIITFIVSDVRGLGLPVRKQALRMSRPRLGLCLPGPFPPQSAAPARAGMAASSAEDPGSERGPWRRAGTVAARGDPGGERGPWRREGTLAARGDPGGERGPWWREGTLAVRGDPGGERGPWRREGTLVVKGARG

SEQ ID NO: 35796 - protein, 591 aa, Homo sapiens
  ENSP00000308895
MVPSSPAVEKQVPVEPGPDPELRSWRHLVCYLCFYGFMAQIRPGESFITPYLLGPDKNFTREQVTNEITPVLSYSYLAVLVPVFLLTDYLRYTPVLLLQGLSFVSVWLLLLLGHSVAHMQLMELFYSVTMAARIAYSSYIFSLVRPARYQRVAGYSRAAVLLGVFTSSVLGQLLVTVGRVSFSTLNYISLAFLTFSVVLALFLKRPKRSLFFNRDDRGRCETSASELERMNPGPGGKLGHALRVACGDSVLARMLRELGDSLRRPQLRLWSLWWVFNSAGYYLVVYYVHILWNEVDPTTNSARVYNGAADAASTLLGAITSFAAGFVKIRWARWSKLLIAGVTATQAGLVFLLAHTRHPSSIWLCYAAFVLFRGSYQFLVPIATFQIASSLSKELCALVFGVNTFFATIVKTIITFIVSDVRGLGLPVRKQFQLYSVYFLILSIIYFLGAMLDGLRHCQRGHHPRQPPAQGLRSAAEEKAAQALSVQDKGLGGLQPAQSPPLSPEDSLGAVGPASLEQRQSDPYLAQAPAPQAAEFLSPVTTPSPCTLCSAQASGPEAADETCPQLAVHPPGVSKLGLQCLPSDGVQNVNQ

SEQ ID NO: 35797 - protein, 489 aa, Homo sapiens
  ENSP00000369347
MVPSSPAVEKQVPVEPGPDPELRSWRHLVCYLCFYGFMAQIRPGESFITPYLLGPDKNFTREQVTNEITPVLSYSYLAVLVPVFLLTDYLRYTPVLLLQGLSFVSVWLLLLLGHSVAHMQLMELFYSVTMAARIAYSSYIFSLVRPARYQRVAGYSRAAVLLGVFTSSVLGQLLVTVGRVSFSTLNYISLAFLTFSVVLALFLKRPKRSLFFNRDDRGRCETSASELERMNPGPGGKLGHALRVACGDSVLARMLRELGDSLRRPQLRLWSLWWVFNSAGYYLVVYYVHILWNEVDPTTNSARVYNGAADAASTLLGAITSFAAGFVKIRWARWSKLLIAGVTATQAGLVFLLAHTRHPSSIWLCYAAFVLFRGSYQFLVPIATFQIASSLSKELCALVFGVNTFFATIVKTIITFIVSDVRGLGLPVRKQNEELHVASLSLWKSHLRLAADTLSSEGSSGSGPRSWFLSPTLRAALHGPVCPSEVCPS

SEQ ID NO: 35798 - protein, 551 aa, Homo sapiens
  ENSP00000441772
MRPQPAEPAPGGRGNEACSIHSEVTNEITPVLSYSYLAVLVPVFLLTDYLRYTPVLLLQGLSFVSVWLLLLLGHSVAHMQLMELFYSVTMAARIAYSSYIFSLVRPARYQRVAGYSRAAVLLGVFTSSVLGQLLVTVGRVSFSTLNYISLAFLTFSVVLALFLKRPKRSLFFNRDDRGRCETSASELERMNPGPGGKLGHALRVACGDSVLARMLRELGDSLRRPQLRLWSLWWVFNSAGYYLVVYYVHILWNEVDPTTNSARVYNGAADAASTLLGAITSFAAGFVKIRWARWSKLLIAGVTATQAGLVFLLAHTRHPSSIWLCYAAFVLFRGSYQFLVPIATFQIASSLSKELCALVFGVNTFFATIVKTIITFIVSDVRGLGLPVRKQFQLYSVYFLILSIIYFLGAMLDGLRHCQRGHHPRQPPAQGLRSAAEEKAAQALSVQDKGLGGLQPAQSPPLSPEDSLGAVGPASLEQRQSDPYLAQAPAPQAAEFLSPVTTPSPCTLCSAQASGPEAADETCPQLAVHPPGVSKLGLQCLPSDGVQNVNQ

SEQ ID NO: 35799 - protein, 182 aa, Homo sapiens
  ENSP00000401850
MVPSSPAVEKQVPVEPGPDPELRSWRHLVCYLCFYGFMAQIRPGESFITPYLLGPDKNFTREQVTNEITPVLSYSYLAVLVPVFLLTDYLRYTPVLLLQGLSFVSVWLLLLLGHSVAHMQLMELFYSVTMAARIAYSSYIFSLVRPARYQRVAGYSRAAVLLGVFTSSVLGQLLVTVGRVSF

SEQ ID NO: 35800 - protein, 154 aa, Homo sapiens
  ENSP00000411345
MVPSSPAVEKQVPVEPGPDPELRSWRHLVCYLCFYGFMAQIRPGESFITPYLLGPDKNFTREQVTNEITPVLSYSYLAVLVPVFLLTDYLRYTPVLLLQGLSFVSVWLLLLLGHSVAHMQLMELFYSVTMAARIAYSSYIFSLVRPARYQRVAG

SEQ ID NO: 35801 - protein, 60 aa, Homo sapiens
  ENSP00000435780
MVPSSPAVEKQVPVEPGPDPELRSWRHLVCYLCFYGFMAQIRPGESFITPYLLGPDKNFT

SEQ ID NO: 35802 - protein, 497 aa, Homo sapiens
  ENSP00000236137
MDVPGPVSRRAAAAAATVLLRTARVRRECWFLPTALLCAYGFFASLRPSEPFLTPYLLGPDKNLTEREVFNEIYPVWTYSYLVLLFPVFLATDYLRYKPVVLLQGLSLIVTWFMLLYAQGLLAIQFLEFFYGIATATEIAYYSYIYSVVDLGMYQKVTSYCRSATLVGFTVGSVLGQILVSVAGWSLFSLNVISLTCVSVAFAVAWFLPMPQKSLFFHHIPSTCQRVNGIKVQNGGIVTDTPASNHLPGWEDIESKIPLNMEEPPVEEPEPKPDRLLVLKVLWNDFLMCYSSRPLLCWSVWWALSTCGYFQVVNYTQGLWEKVMPSRYAAIYNGGVEAVSTLLGAVAVFAVGYIKISWSTWGEMTLSLFSLLIAAAVYIMDTVGNIWVCYASYVVFRIIYMLLITIATFQIAANLSMERYALVFGVNTFIALALQTLLTLIVVDASGLGLEITTQFLIYASYFALIAVVFLASGAVSVMKKCRKLEDPQSSSQVTTS

SEQ ID NO: 35803 - protein, 296 aa, Homo sapiens
  ENSP00000356778
MDVPGPVSRRAAAAAATVLLRTARVRRECWFLPTALLCAYGFFASLRPSEPFLTPYLLGPDKNLTEREEPKPDRLLVLKVLWNDFLMCYSSRPLLCWSVWWALSTCGYFQVVNYTQGLWEKVMPSRYAAIYNGGVEAVSTLLGAVAVFAVGYIKISWSTWGEMTLSLFSLLIAAAVYIMDTVGNIWVCYASYVVFRIIYMLLITIATFQIAANLSMERYALVFGVNTFIALALQTLLTLIVVDASGLGLEITTQFLIYASYFALIAVVFLASGAVSVMKKCRKLEDPQSSSQVTTS

SEQ ID NO: 35804 - protein, 524 aa, Homo sapiens
  ENSP00000262352
MGKPARKGCEWKRFLKNNWVLLSTVAAVVLGITTGVLVREHSNLSTLEKFYFAFPGEILMRMLKLIILPLIISSMITGVAALDSNVSGKIGLRAVVYYFCTTLIAVILGIVLVVSIKPGVTQKVGEIARTGSTPEVSTVDAMLDLIRNMFPENLVQACFQQYKTKREEVKPPSDPEMNMTEESFTAVMTTAISKNKTKEYKIVGMYSDGINVLGLIVFCLVFGLVIGKMGEKGQILVDFFNALSDATMKIVQIIMCYMPLGILFLIAGKIIEVEDWEIFRKLGLYMATVLTGLAIHSIVILPLIYFIVVRKNPFRFAMGMAQALLTALMISSSSATLPVTFRCAEENNQVDKRITRFVLPVGATINMDGTALYEAVAAVFIAQLNDLDLGIGQIITISITATSASIGAAGVPQAGLVTMVIVLSAVGLPAEDVTLIIAVDWLLDRFRTMVNVLGDAFGTGIVEKLSKKELEQMDVSSEVNIVNPFALESTILDNEDSDTKKSYVNGGFAVDKSDTISFTQTSQF

SEQ ID NO: 35805 - protein, 242 aa, Homo sapiens
  ENSP00000414620
  MOD_RES (1)..(1): Any amino acid
XFFNALSDATMKIVQIIMCYMPLGILFLIAGKIIEVEDWEIFRKLGLYMATVLTGLAIHSIVILPLIYFIVVRKNPFRFAMGMAQALLTALMISSSSATLPVTFRCAEENNQVDKRITRFVLPVGATINMDGTALYEAVAAVFIAQLNDLDLGIGQIITIRDRFRTMVNVLGDAFGTGIVEKLSKKELEQMDVSSEVNIVNPFALESTILDNEDSDTKKSYVNGGFAVDKSDTISFTQTSQF

SEQ ID NO: 35806 - protein, 234 aa, Homo sapiens
  ENSP00000431942
MNILGLVLFALVLGVALKKLGSEGEDLIRFFNSLNEATMVLVSWIMCSATLPSMMKCIEENNGVDKRISRFILPIGATVNMDGAAIFQCVAAVFIAQLNNVELNAGQIFTILVTATASSVGAAGVPAGGVLTIAIILEAIGLPTHDLPLILAVDWIVDRTTTVVNVEGDALGAGILHHLNQKATKKGEQELAEVKVEAIPNCKSEEETSPLVTHQNPAGPVASAPELESKESVL

SEQ ID NO: 35807 - protein, 532 aa, Homo sapiens
  ENSP00000234256
MEKSNETNGYLDSAQAGPAAGPGAPGTAAGRARRCAGFLRRQALVLLTVSGVLAGAGLGAALRGLSLSRTQVTYLAFPGEMLLRMLRMIILPLVVCSLVSGAASLDASCLGRLGGIAVAYFGLTTLSASALAVALAFIIKPGSGAQTLQSSDLGLEDSGPPPVPKETVDSFLDLARNLFPSNLVVAAFRTYATDYKVVTQNSSSGNVTHEKIPIGTEIEGMNILGLVLFALVLGVALKKLGSEGEDLIRFFNSLNEATMVLVSWIMWYVPVGIMFLVGSKIVEMKDIIVLVTSLGKYIFASILGHVIHGGIVLPLIYFVFTRKNPFRFLLGLLAPFATAFATCSSSATLPSMMKCIEENNGVDKRISRFILPIGATVNMDGAAIFQCVAAVFIAQLNNVELNAGQIFTILVTATASSVGAAGVPAGGVLTIAIILEAIGLPTHDLPLILAVDWIVDRTTTVVNVEGDALGAGILHHLNQKATKKGEQELAEVKVEAIPNCKSEEETSPLVTHQNPAGPVASAPELESKESVL

SEQ ID NO: 35808 - protein, 500 aa, Homo sapiens
  ENSP00000409386
MSIDHEQPWQQPVPAGERPAAGPGGLAAAAAGKPAAESTAHAPAPADHDPRARAALPAPKRLHSADGQRRGHWGQPGLCPAPISAHLPPDQVLLFSWRASDEDAADAGVTSHCLQPGHRNMFPPNLVEACFKQFKTQYSTRVVTRTMVRTENGSEPGASMPPPFSVENGTSFLENVTRALGTLQEMLSFEETVPVPGSANGINALGLVVFSVAFGLVIGGMKHKGRVLRDFFDSLNEAIMRLVGIIIWYAPVGILFLIAGKILEMEDMAVLGGQLGMYTLTVIVGLFLHAGIVLPLIYFLVTHRNPFPFIGGMLQALITAMGTSSSSATLPITFRCLEEGLGVDRRITRFVLPVGATVNMDGTALYEALAAIFIAQVNNYELNLGQITTISITATAASVGAAGIPQAGLVTMVIVLTSVGLPTEDITLIIAVDWFLDRLRTMTNVLGDSIGAAVIEHLSQRELELQEAELTLPSLGKPYKSLMAQEKGASRGRGGNESAM

SEQ ID NO: 35809 - protein, 564 aa, Homo sapiens
  ENSP00000221742
MSSHGNSLFLRESGQRLGRVGWLQRLQESLQQRALRTRLRLQTMTLEHVLRFLRRNAFILLTVSAVVIGVSLAFALRPYQLTYRQIKYFSFPGELLMRMLQMLVLPLIVSSLVTGMASLDNKATGRMGMRAAVYYMVTTIIAVFIGILMVTIIHPGKGSKEGLHREGRIETIPTADAFMDLIRNMFPPNLVEACFKQFKTQYSTRVVTRTMVRTENGSEPGASMPPPFSVENGTSFLENVTRALGTLQEMLSFEETVPVPGSANGINALGLVVFSVAFGLVIGGMKHKGRVLRDFFDSLNEAIMRLVGIIIWYAPVGILFLIAGKILEMEDMAVLGGQLGMYTLTVIVGLFLHAGIVLPLIYFLVTHRNPFPFIGGMLQALITAMGTSSSSATLPITFRCLEEGLGVDRRITRFVLPVGATVNMDGTALYEALAAIFIAQVNNYELNLGQITTISITATAASVGAAGIPQAGLVTMVIVLTSVGLPTEDITLIIAVDWFLDRLRTMTNVLGDSIGAAVIEHLSQRELELQEAELTLPSLGKPYKSLMAQEKGASRGRGGNESAM

SEQ ID NO: 35810 - protein, 486 aa, Homo sapiens
  ENSP00000471038
MSSHGNSLFLRESGQRLGRVGWLQRLQESLQQRALRTRLRLQTMTLEHVLRFLRRNAFILLTVSAVVIGVSLAFALRPYQLTYRQIKYFSFPGELLMRMLQMLVLPLIVSSLVTGMASLDNKATGRMGMRAAVYYMVTTIIAVFIGILMVTIIHPGKGSKEGLHREGRIETIPTADAFMDLIRNMFPPNLVEACFKQFKTQYSTRVVTRTMVRTENGSEPGASMPPPFSVENGTSFLENVTRALGTLQEMLSFEETVPVPGSANGINALGLVVFSVAFGLVIGGMKHKGRVLRDFFDSLNEAIMRLVGIIICSATLPITFRCLEEGLGVDRRITRFVLPVGATVNMDGTALYEALAAIFIAQVNNYELNLGQITTISITATAASVGAAGIPQAGLVTMVIVLTSVGLPTEDITLIIAVDWFLDRLRTMTNVLGDSIGAAVIEHLSQRELELQEAELTLPSLGKPYKSLMAQEKGASRGRGGNESAM

SEQ ID NO: 35811 - protein, 312 aa, Homo sapiens
  ENSP00000471781
MSSHGNSLFLRESGQRLGRVGWLQRLQESLQQRALRTRLRLQTMTLEHVLRFLRRNAFILLTVSAVVIGVSLAFALRPYQLTYRQIKYFSFPGELLMRMLQMLVLPLIVSSLVTGMASLDNKATGRMGMRAAVYYMVTTIIAVFIGILMVTIIHPGKGSKEGLHREGRIETIPTADAFMDLIRNMFPPNLVEACFKQFKTQYSTRVVTRTMVRTENGSEPGASMPPPFSVENGTSFLENVTRALGTLQEMLSFEETVPVPGSANGINALGLVVFSVAFGLVIGGMKHKGRVLRDFFDSLNEAIMRLVGIIIW

SEQ ID NO: 35812 - protein, 312 aa, Homo sapiens; identical to SEQ ID NO: 35811
  ENSP00000446175

SEQ ID NO: 35813 - protein, 160 aa, Homo sapiens
  ENSP00000471562
MSSHGNSLFLRESGQRLGRVGWLQRLQESLQQRALRTRLRLQTMTLEHVLRFLRRNAFILLTVSAVVIGVSLAFALRPYQLTYRQIKYFSFPGELLMRMLQMLVLPLIVSSLVTGMASLDNKATGRMGMRAAVYYMVTTIIAVFIGILMVTIIHPGKGSK

SEQ ID NO: 35814 - protein, 146 aa, Homo sapiens
  ENSP00000472837
MSIDHEQPWQQPVPAGERPAAGPGGLAAAAAGKPAAESTAHAPAPADHDPRARAALPAPKRLHSADGQRRGHWGQPGLCPAPISAHLPPDQVLLFSWRASDEDAADAGVTSHCLQPGHRYGIPGQQGHGADGDAGSCVLHGDHHHR

SEQ ID NO: 35815 - protein, 110 aa, Homo sapiens
  ENSP00000469551
MSSHGNSLFLRESGQRLGRVGWLQRLQESLQQRALRTRLRLQTMTLEHVLRFLRRNAFILLTVSAVVIGVSLAFALRPYQLTYRQIKYFSFPGELLMRMLQMLVLPLIVS

SEQ ID NO: 35816 - protein, 74 aa, Homo sapiens
  ENSP00000471129
MSSHGNSLFLRESGQRLGRVGWLQRLQESLQQRALRTRLRLQTMTLEHVLRFLRRNAFILLTVSAVVIGELCLL

SEQ ID NO: 35817 - protein, 35 aa, Homo sapiens
  ENSP00000472133
MSSHGNSLFLRESGQRLGRVGWLQRLQESLQQRAL

SEQ ID NO: 35818 - protein, 679 aa, Homo sapiens
  ENSP00000272542
MATLITSTTAATAASGPLVDYLWMLILGFIIAFVLAFSVGANDVANSFGTAVGSGVVTLKQACILASIFETVGSVLLGAKVSETIRKGLIDVEMYNSTQGLLMAGSVSAMFGSAVWQLVASFLKLPISGTHCIVGATIGFSLVAKGQEGVKWSELIKIVMSWFVSPLLSGIMSGILFFLVRAFILHKADPVPNGLRALPVFYACTVGINLFSIMYTGAPLLGFDKLPLWGTILISVGCAVFCALIVWFFVCPRMKRKIEREIKCSPSESPLMEKKNSLKEDHEETKLSVGDIENKHPVSEVGPATVPLQAVVEERTVSFKLGDLEEAPERERLPSVDLKEETSIDSTVNGAVQLPNGNLVQFSQAVSNQINSSGHYQYHTVHKDSGLYKELLHKLHLAKVGDCMGDSGDKPLRRNNSYTSYTMAICGMPLDSFRAKEGEQKGEEMEKLTWPNADSKKRIRMDSYTSYCNAVSDLHSASEIDMSVKAEMGLGDRKGSNGSLEEWYDQDKPEVSLLFQFLQILTACFGSFAHGGNDVSNAIGPLVALYLVYDTGDVSSKVATPIWLLLYGGVGICVGLWVWGRRVIQTMGKDLTPITPSSGFSIELASALTVVIASNIGLPISTTHCKVGSVVSVGWLRSKKAVDWRLFRNIFMAWFVTVPISGVISAAIMAIFRYVILRM

SEQ ID NO: 35819 - protein, 89 aa, Homo sapiens
  ENSP00000392050
  MOD_RES (1)..(1): Any amino acid
XELIKIVMSWFVSPLLSGIMSGILFFLVRAFILHKADPVPNGLRALPVFYACTVGINLFSIMYTGAPWLKSPRRWLACAHFRRLQASVR

SEQ ID NO: 35820 - protein, 213 aa, Homo sapiens
  ENSP00000390021
  MOD_RES (1)..(1): Any amino acid
XLFFLVRAFILHKADPVPNGLRALPVFYACTVGINLFSIMYTGAPLLGFDKLPLWGTILISVGCAVFCALIVWFFVCPRMKRKIERPATVPLQAVVEERTVSFKLGDLEEAPERERLPSVDLKEETSIDSTVNGAVQLPNGNLVQFSQAVSNQINSSGHYQYHTVHKDSGLYKELLHKLHLAKVGDCMGDSGDKPLRRNNSYTSYTMAICGMP

SEQ ID NO: 35821 - protein, 98 aa, Homo sapiens
  ENSP00000403763
  MOD_RES (1)..(1): Any amino acid
XFFLVRAFILHKADPVPNGLRALPVFYACTVGINLFSIMYTGAPWLKSPRRWLACAHFRRLQASCWALTNFLCGVPSSSRWDVQFSVPLSSGSLYVPG

SEQ ID NO: 35822 - protein, 115 aa, Homo sapiens
  ENSP00000413393
RAFILHKADPVPNGLRALPVFYACTVGINLFSIMYTGAPLLGFDKLPLWGTILISVGCAVFCALIVWFFVCPRMKRKIERCGGGENSLIQTWRFGGSSREREASQRGLERGNQHR

SEQ ID NO: 35823 - protein, 547 aa, Homo sapiens
  ENSP00000358515
MEVEEAFQAVGEMGIYQMYLCFLLAVLLQLYVATEAILIALVGATPSYHWDLAELLPNQSHGNQSAGEDQAFGDWLLTANGSEIHKHVHFSSSFTSIASEWFLIANRSYKVSAASSFFFSGVFVGVISFGQLSDRFGRKKVYLTGFALDILFAIANGFSPSYEFFAVTRFLVGMMNGGMSLVAFVLLNECVGTAYWALAGSIGGLFFAVGIAQYALLGYFIRSWRTLAILVNLQGTVVFLLSLFIPESPRWLYSQGRLSEAEEALYLIAKRNRKLKCTFSLTHPANRSCRETGSFLDLFRYRVLLGHTLILMFIWFVCSLVYYGLTLSAGDLGGSIYANLALSGLIEIPSYPLCIYLINQKWFGRKRTLSAFLCLGGLACLIVMFLPEKKDTGVFAVVNSHSLSLLGKLTISAAFNIVYIYTSELYPTVIRNVGLGTCSMFSRVGGIIAPFIPSLKYVQWSLPFIVFGATGLTSGLLSLLLPETLNSPLLETFSDLQVYSYRRLGEEALSLQALDPQQCVDKESSLGSESEEEEEFYDADEETQMIK

SEQ ID NO: 35824 - protein, 245 aa, Homo sapiens
  ENSP00000358514
MEVEEAFQAVGEMGIYQMYLCFLLAVLLQLYVATEAILIALVGATPSYHWDLAELLPNQSHGNQSAGEDQAFGDWLLTANGSEIHKHVHFSSSFTSIASEWFLIANRSYKVSAASSFFFSGVFVGVISFGQLSDRFGRKKVYLTGFALDILFAIANGFSPSYEFFAVTRFLVGMMNGGMSLVAFVLLNECVGTAYWALAGSIGGLFFAVGIAQYALLGYFIRSWRTLAILVNLQGTVVFLLSLVD

SEQ ID NO: 35825 - protein, 694 aa, Homo sapiens
  ENSP00000410245
MAIDRRREAAGGGPGRQPAPAEENGSLPPGDAAASAPLGGRAGPGGGAEIQPLPPLHPGGGPHPSCCSAAAAPSLLLLDYDGSVLPFLGGLGGGYQKTLVLLTWIPALFIGFSQFSDSFLLDQPNFWCRGAGKGTELAGVTTTGRGGDMGNWTSLPTTPFATAPWEAAGNRSNSSGADGGDTPPLPSPPDKGDNASNCDCRAWDYGIRAGLVQNVVSKWDLVCDNAWKVHIAKFSLLVGLIFGYLITGCIADWVGRRPVLLFSIIFILIFGLTVALSVNVTMFSTLRFFEGFCLAGIILTLYALRIELCPPGKRFMITMVASFVAMAGQFLMPGLAALCRDWQVLQALIICPFLLMLLYWSIFPESLRWLMATQQFESAKRLILHFTQKNRMNPEGDIKGVIPELEKELSRRPKKVCIVKVVGTRNLWKNIVVLCVNSLTGYGIHHCFARSMMGHEVKVPLLENFYADYYTTASIALVSCLAMCVVVRFLGRRGGLLLFMILTALASLLQLGLLNLIGKYSQHPDSELQLKLAVGMSDSVKDKFSIAFSIVGMFASHAVGSLSVFFCAEITPTVIRCGGLGLVLASAGFGMLTAPIIELHNQKGYFLHHIIFACCTLICIICILLLPESRDQNLPENISNGEHYTRQPLLPHKKGEQPLLLTNAELKDYSGLHDAAAAGDTLPEGATANGMKAM

SEQ ID NO: 35826 - protein, 686 aa, Homo sapiens
  ENSP00000385028
MAIDRRREAAGGGPGRQPAPAEENGSLPPGDAAASAPLGGRAGPGGGAEIQPLPPLHPGGGPHPSCCSAAAAPSLLLLDYDGSVLPFLGGLGGGYQKTLVLLTWIPALFIGFSQFSDSFLLDQPNFWCRGAGKGTELAGVTTTGRGGDMGNWTSLPTTPFATAPWEAAGNRSNSSGADGGDTPPLPSPPDKGDNASNCDCRAWDYGIRAGLVQNVVSKWDLVCDNAWKVHIAKFSLLVGLIFGYLITGCIADWVGRRPVLLFSIIFILIFGLTVALSVNVTMFSTLRFFEGFCLAGIILTLYALRIELCPPGKRFMITMVASFVAMAGQFLMPGLAALCRDWQVLQALIICPFLLMLLYWSIFPESLRWLMATQQFESAKRLILHFTQKNRMNPEGDIKGVIPELEKELSRRPKKVCIVKVVGTRNLWKNIVVLCVNSLTGYGIHHCFARSMMGHEVKVPLLENFYADYYTTASIALVSCLAMCVVVRFLGRRGGLLLFMILTALASLLQLGLLNLIGKYSQHPDSGMSDSVKDKFSIAFSIVGMFASHAVGSLSVFFCAEITPTVIRCGGLGLVLASAGFGMLTAPIIELHNQKGYFLHHIIFACCTLICIICILLLPESRDQNLPENISNGEHYTRQPLLPHKKGEQPLLLTNAELKDYSGLHDAAAAGDTLPEGATANGMKAM

SEQ ID NO: 35827 - protein, 92 aa, Homo sapiens
  ENSP00000417737
MFSTLRFFEGFCLAGIILTLYALRIELCPPGKRFMITMVASFVAMAGQFLMPGLAALCRDWQVLQALIICPFLLMLLYWSYYLWLLSGYSQS

SEQ ID NO: 35828 - protein, 405 aa, Homo sapiens
  ENSP00000369657
MFSTLRFFEGFCLAGIILTLYALRIELCPPGKRFMITMVASFVAMAGQFLMPGLAALCRDWQVLQALIICPFLLMLLYWSIFPESLRWLMATQQFESAKRLILHFTQKNRMNPEGDIKGVIPELEKELSRRPKKVCIVKVVGTRNLWKNIVVLCVNSLTGYGIHHCFARSMMGHEVKVPLLENFYADYYTTASIALVSCLAMCVVVRFLGRRGGLLLFMILTALASLLQLGLLNLIGKYSQHPDSGMSDSVKDKFSIAFSIVGMFASHAVGSLSVFFCAEITPTVIRCGGLGLVLASAGFGMLTAPIIELHNQKGYFLHHIIFACCTLICIICILLLPESRDQNLPENISNGEHYTRQPLLPHKKGEQPLLLTNAELKDYSGLHDAAAAGDTLPEGATANGMKAM

SEQ ID NO: 35829 - protein, 405 aa, Homo sapiens; identical to SEQ ID NO: 35828
  ENSP00000419463

SEQ ID NO: 35830 - protein, 440 aa, Homo sapiens
  ENSP00000418134
NSSGADGGDTPPLPSPPDKGDNASNCDCRAWDYGIRAGLVQNVVSKWDLVCDNAWKVHIAKFSLLVGLIFGYLITGCIADWVGRRPVLLFSIIFILIFGLTVALSVNVTMFSTLRFFEGFCLAGIILTLYALRIELCPPGKRFMITMVASFVAMAGQFLMPGLAALCRDWQVLQALIICPFLLMLLYWSIFPESLRWLMATQQFESAKRLILHFTQKNRMNPEGDIKGVIPELEKELSRRPKKVCIVKVVGTRNLWKNIVVLCVNSLTGYGIHHCFARSMMGHEVKVPLLENFYADYYTTASIALVSCLAMCVVVRFLGRRGGLLLFMILTALASLLQLGLLNLIGKYSQHPDSGMSDSVKDKFSIAFSIVGMFASHAVGSLSVFFCAEITPTVIRCVMGDTPGDAGFSEIKDESLAPGWCGINQRQLCLWLWTHQLRGS

SEQ ID NO: 35831 - protein, 386 aa, Homo sapiens
  ENSP00000418985
MPVGPQHPSFKRSSLDTFHGCCQQQETGALPWDTDTKRWRPELNWDLVCDNAWKVHIAKFSLLVGLIFGYLITGCIADWVGRRPVLLFSIIFILIFGLTVALSVNVTMFSTLRFFEGFCLAGIILTLYALRIELCPPGKRFMITMVASFVAMAGQFLMPGLAALCRDWQVLQALIICPFLLMLLYWSIFPESLRWLMATQQFESAKRLILHFTQKNRMNPEGDIKGVIPELEKELSRRPKKVCIVKVVGTRNLWKNIVVLCVNSLTGYGIHHCFARSMMGHEVKVPLLENFYADYYTTASIALVSCLAMCVVVRFLGRRGGLLLFMILTALASLLQLGLLNLIGKYSQHPDSGMSDSVKDKFSIAFSIVGMFASHAVGSLSVFFCA

SEQ ID NO: 35832 - protein, 361 aa, Homo sapiens
  ENSP00000369653
MAIDRRREAAGGGPGRQPAPAEENGSLPPGDAAASAPLGGRAGPGGGAEIQPLPPLHPGGGPHPSCCSAAAAPSLLLLDYDGSVLPFLGGLGGGYQKTLVLLTWIPALFIGFSQFSDSFLLDQPNFWCRGAGKGTELAGVTTTGRGGDMGNWTSLPTTPFATAPWEAAGNRSNSSGADGGDTPPLPSPPDKGDNASNCDCRAWDYGIRAGLVQNVVSKWDLVCDNAWKVHIAKFSLLVGLIFGYLITGCIADWVGRRPVLLFSIIFILIFGLTVALSVNVTMFSTLRFFEGFCLAGIILTLYALRIELCPPGKRFMITMVASFVAMAGQFLMPGLAALCRDWQVLQALIICPFLLMLLYWS

SEQ ID NO: 35833 - protein, 551 aa, Homo sapiens
  ENSP00000200652
MRDYDEVIAFLGEWGPFQRLIFFLLSASIIPNGFNGMSVVFLAGTPEHRCRVPDAANLSSAWRNNSVPLRLRDGREVPHSCSRYRLATIANFSALGLEPGRDVDLGQLEQESCLDGWEFSQDVYLSTVVTEWNLVCEDNWKVPLTTSLFFVGVLLGSFVSGQLSDRFGRKNVLFATMAVQTGFSFLQIFSISWEMFTVLFVIVGMGQISNYVVAFILGTEILGKSVRIIFSTLGVCTFFAVGYMLLPLFAYFIRDWRMLLLALTVPGVLCVPLWWFIPESPRWLISQRRFREAEDIIQKAAKMNNIAVPAVIFDSVEELNPLKQQKAFILDLFRTRNIAIMTIMSLLLWMLTSVGYFALSLDAPNLHGDAYLNCFLSALIEIPAYITAWLLLRTLPRRYIIAAVLFWGGGVLLFIQLVPVDYYFLSIGLVMLGKFGITSAFSMLYVFTAELYPTLVRNMAVGVTSTASRVGSIIAPYFVYLGAYNRMLPYIVMGSLTVLIGILTLFFPESLGMTLPETLEQMQKVKWFRSGKKTRDSMETEENPKVLITAF

SEQ ID NO: 35834 - protein, 261 aa, Homo sapiens
  ENSP00000445946
MAFNDLLQQVGGVGRFQQIQVTLVVLPLLLMASHNTLQNFTAAIPTHHCRPPADANLSKNGGLEVWLPRDRQGQPESCLRFTSPQWGLPFLNGTEANGTGATEPCTDGWIYDNSTFPSTIVTEGPTPAGPVLVHGGGAARSHGVRLPCRQARPPEGTHLELPADSCVRDLRSLRTQLPHLLRLPAPLGHGSGWHLPQLHDTECGVDAHSHTGLRGHLDWLCLQPGPVPPGWCGLRCAPLAPPAATGLCAFFCLLHLLLVLH

SEQ ID NO: 35835 - protein, 550 aa, Homo sapiens
  ENSP00000353597
MAFNDLLQQVGGVGRFQQIQVTLVVLPLLLMASHNTLQNFTAAIPTHHCRPPADANLSKNGGLEVWLPRDRQGQPESCLRFTSPQWGLPFLNGTEANGTGATEPCTDGWIYDNSTFPSTIVTEWDLVCSHRALRQLAQSLYMVGVLLGAMVFGYLADRLGRRKVLILNYLQTAVSGTCAAFAPNFPIYCAFRLLSGMALAGISLNCMTLNVEWMPIHTRACVGTLIGYVYSLGQFLLAGVAYAVPHWRHLQLLVSAPFFAFFIYSWFFIESARWHSSSGRLDLTLRALQRVARINGKREEGAKLSMEVLRASLQKELTMGKGQASAMELLRCPTLRHLFLCLSMLWFATSFAYYGLVMDLQGFGVSIYLIQVIFGAVDLPAKLVGFLVINSLGRRPAQMAALLLAGICILLNGVIPQDQSIVRTSLAVLGKGCLAASFNCIFLYTGELYPTMIRQTGMGMGSTMARVGSIVSPLVSMTAELYPSMPLFIYGAVPVAASAVTVLLPETLGQPLPDTVQDLESRKGKQTRQQQEHQKYMVPLQASAQEKNGL

SEQ ID NO: 35836 - protein, 563 aa, Homo sapiens
  ENSP00000367102
MAFNDLLQQVGGVGRFQQIQVTLVVLPLLLMASHNTLQNFTAAIPTHHCRPPADANLSKNGGLEVWLPRDRQGQPESCLRFTSPQWGLPFLNGTEANGTGATEPCTDGWIYDNSTFPSTIVTEWDLVCSHRALRQLAQSLYMVGVLLGAMVFGYLADRLGRRKVLILNYLQTAVSGTCAAFAPNFPIYCAFRLLSGMALAGISLNCMTLNVEWMPIHTRACVGTLIGYVYSLGQFLLAGVAYAVPHWRHLQLLVSAPFFAFFIYSWFFIESARWHSSSGRLDLTLRALQRVARINGKREEGAKLSMEVLRASLQKELTMGKGQASAMELLRCPTLRHLFLCLSMLWFATSFAYYGLVMDLQGFGVSIYLIQVIFGAVDLPAKLVGFLVINSLGRRPAQMAALLLAGICILLNGVIPQDQSIVRTSLAVLGKGCLAASFNCIFLYTGELYPTMIRQTGMGMGSTMARVGSIVSPLVSMTAELYPSMPLFIYGAVPVAASAVTVLLPETLGQPLPDTVQDLESRWAPTQKEAGIYPRKGKQTRQQQEHQKYMVPLQASAQEKNGL

SEQ ID NO: 35837 - protein, 506 aa, Homo sapiens
  ENSP00000396401
MAFNDLLQQVGGVGRFQQIQVTLVVLPLLLMASHNTLQNFTAAIPTHHCRPPADANLSKNGGLEVWLPRDRQGQPESCLRFTSPQWGLPFLNGTEANGTGATEPCTDGWIYDNSTFPSTIVTEWDLVCSHRALRQLAQSLYMVGVLLGAMVFGYLADRLGRRKVLILNYLQTAVSGTCAAFAPNFPIYCAFRLLSGMALAGISLNCMTLNVEWMPIHTRACVGTLIGYVYSLGQFLLAGVAYAVPHWRHLQLLVSAPFFAFFIYSWFFIESARWHSSSGRLDLTLRALQRVARINGKREEGAKLSMEVLRASLQKELTMGKGQASAMELLRCPTLRHLFLCLSMLWFATSFAYYGLVMDLQGFGVSIYLIQVIFGAVDLPAKLVGFLVINSLGRRPAQMAALLLAGICILLNGVIPQDQSIVRTSLAVLGKGCLAASFNCIFLYTGELYPTMIRAVTVLLPETLGQPLPDTVQDLESRKGKQTRQQQEHQKYMVPLQASAQEKNGL

SEQ ID NO: 35838 - protein, 519 aa, Homo sapiens
  ENSP00000404441
MAFNDLLQQVGGVGRFQQIQVTLVVLPLLLMASHNTLQNFTAAIPTHHCRPPADANLSKNGGLEVWLPRDRQGQPESCLRFTSPQWGLPFLNGTEANGTGATEPCTDGWIYDNSTFPSTIVTEWDLVCSHRALRQLAQSLYMVGVLLGAMVFGYLADRLGRRKVLILNYLQTAVSGTCAAFAPNFPIYCAFRLLSGMALAGISLNCMTLNVEWMPIHTRACVGTLIGYVYSLGQFLLAGVAYAVPHWRHLQLLVSAPFFAFFIYSWFFIESARWHSSSGRLDLTLRALQRVARINGKREEGAKLSMEVLRASLQKELTMGKGQASAMELLRCPTLRHLFLCLSMLWFATSFAYYGLVMDLQGFGVSIYLIQVIFGAVDLPAKLVGFLVINSLGRRPAQMAALLLAGICILLNGVIPQDQSIVRTSLAVLGKGCLAASFNCIFLYTGELYPTMIRAVTVLLPETLGQPLPDTVQDLESRWAPTQKEAGIYPRKGKQTRQQQEHQKYMVPLQASAQEKNGL

SEQ ID NO: 35839 - protein, 542 aa, Homo sapiens
  ENSP00000337335
MTFSEILDRVGSMGHFQFLHVAILGLPILNMANHNLLQIFTAATPVHHCRPPHNASTGPWVLPMGPNGKPERCLRFVHPPNASLPNDTQRAMEPCLDGWVYNSTKDSIVTEWDLVCNSNKLKEMAQSIFMAGILIGGLVLGDLSDRFGRRPILTCSYLLLAASGSGAAFSPTFPIYMVFRFLCGFGISGITLSTVILNVEWVPTRMRAIMSTALGYCYTFGQFILPGLAYAIPQWRWLQLTVSIPFFVFFLSSWWTPESIRWLVLSGKSSKALKILRRVAVFNGKKEEGERLSLEELKLNLQKEISLAKAKYTASDLFRIPMLRRMTFCLSLAWFATGFAYYSLAMGVEEFGVNLYILQIIFGGVDVPAKFITILSLSYLGRHTTQAAALLLAGGAILALTFVPLDLQTVRTVLAVFGKGCLSSSFSCLFLYTSELYPTVIRQTGMGVSNLWTRVGSMVSPLVKITGEVQPFIPNIIYGITALLGGSAALFLPETLNQPLPETIEDLENWSLRAKKPKQEPEVEKASQRIPLQPHGPGLGSS

SEQ ID NO: 35840 - protein, 451 aa, Homo sapiens
  ENSP00000441658
MEPCLDGWVYNSTKDSIVTEWDLVCNSNKLKEMAQSIFMAGILIGGLVLGDLSDRFGRRPILTCSYLLLAASGSGAAFSPTFPIYMVFRFLCGFGISGITLSTVILNVEWVPTRMRAIMSTALGYCYTFGQFILPGLAYAIPQWRWLQLTVSIPFFVFFLSSWWTPESIRWLVLSGKSSKALKILRRVAVFNGKKEEGERLSLEELKLNLQKEISLAKAKYTASDLFRIPMLRRMTFCLSLAWFATGFAYYSLAMGVEEFGVNLYILQIIFGGVDVPAKFITILSLSYLGRHTTQAAALLLAGGAILALTFVPLDLQTVRTVLAVFGKGCLSSSFSCLFLYTSELYPTVIRQTGMGVSNLWTRVGSMVSPLVKITGEVQPFIPNIIYGITALLGGSAALFLPETLNQPLPETIEDLENWSLRAKKPKQEPEVEKASQRIPLQPHGPGLGSS

SEQ ID NO: 35841 - protein, 419 aa, Homo sapiens
  ENSP00000443368
MAQSIFMAGILIGGLVLGDLSDRFGRRPILTCSYLLLAASGSGAAFSPTFPIYMVFRFLCGFGISGITLSTVILNVEWVPTRMRAIMSTALGYCYTFGQFILPGLAYAIPQWRWLQLTVSIPFFVFFLSSWWTPESIRWLVLSGKSSKALKILRRVAVFNGKKEEGERLSLEELKLNLQKEISLAKAKYTASDLFRIPMLRRMTFCLSLAWFATGFAYYSLAMGVEEFGVNLYILQIIFGGVDVPAKFITILSLSYLGRHTTQAAALLLAGGAILALTFVPLDLQTVRTVLAVFGKGCLSSSFSCLFLYTSELYPTVIRQTGMGVSNLWTRVGSMVSPLVKITGEVQPFIPNIIYGITALLGGSAALFLPETLNQPLPETIEDLENWSLRAKKPKQEPEVEKASQRIPLQPHGPGLGSS

SEQ ID NO: 35842 - protein, 533 aa, Homo sapiens
  ENSP00000311463
MTFSEILDRVGSMGHFQFLHVAILGLPILNMANHNLLQIFTAATPVHHCRPPHNASTGPWVLPMGPNGKPERCLRFVHPPNASLPNDTQRAMEPCLDGWVYNSTKDSIVTEWDLVCNSNKLKEMAQSIFMAGILIGGLVLGDLSDRFGRRPILTCSYLLLAASGSGAAFSPTFPIYMVFRFLCGFGISGITLSTVILNVEWVPTRMRAIMSTALGYCYTFGQFILPGLAYAIPQWRWLQLTVSIPFFVFFLSSWWTPESIRWLVLSGKSSKALKILRRVAVFNGKKEEGERLSLEELKLNLQKEISLAKAKYTASDLFRIPMLRRMTFCLSLAWFATGFAYYSLAMGVEEFGVNLYILQIIFGGVDVPAKFITILSLSYLGRHTTQAAALLLAGGAILALTFVPLDLQTVRTVLAVFGKGCLSSSFSCLFLYTSELYPTVIRQTGMGVSNLWTRVGSMVSPLVKITGEVQPFIPNIIYGITALLGGSAALFLPETLNQPLPETIEDLENWSVTASGPISAPPWGSRSGPRAFP

SEQ ID NO: 35843 - protein, 542 aa, Homo sapiens; identical to SEQ ID NO: 35839
  ENSP00000398548

SEQ ID NO: 35844 - protein, 644 aa, Homo sapiens
  ENSP00000333519
MRPSGDEDRARRRRRRRRRRDLLLSQLCFLASVALLLWSLSSLREQKELDLMDLVGEDRKWMMARKLMQVNDTLTSEDAGLRNSKNCTEPALHEFPNDIFTNEDRRQGAVVLHVLCAIYMFYALAIVCDDFFVPSLEKICERLHLSEDVAGATFMAAGSSAPELFTSVIGVFITKGDVGVGTIVGSAVFNILCIIGVCGLFAGQVVALSSWCLLRDSIYYTLSVIALIVFIYDEKVSWWESLVLVLMYLIYIVIMKYNACIHQCFERRTKGAGNMVNGLANNAEIDDSSNCDATVVLLKKANFHRKASVIMVDELLSAYPHQLSFSEAGLRIMITSHFPPKTRLSMASRMLINERQRLINSRAYTNGESEVAIKIPIKHTVENGTGPSSAPDRGVNGTRRDDVVAEAGNETENENEDNENDEEEEEDEDDDEGPYTPFDTPSGKLETVKWAFTWPLSFVLYFTVPNCNKPRWEKWFMVTFASSTLWIAAFSYMMVWMVTIIGYTLGIPDVIMGITFLAAGTSVPDCMASLIVARQGMGDMAVSNSIGSNVFDILIGLGLPWALQTLAVDYGSYIRLNSRGLIYSVGLLLASVFVTVFGVHLNKWQLDKKLGCGCLLLYGVFLCFSIMTEFNVFTFVNLPMCGDH

SEQ ID NO: 35845 - protein, 644 aa, Homo sapiens; identical to SEQ ID NO: 35844
  ENSP00000482967

SEQ ID NO: 35846 - protein, 558 aa, Homo sapiens
  ENSP00000376948
MAPVNGTQTAKNCTDPAIHEFPTDLFSNKERQHGAVLLHILGALYMFYALAIVCDDFFVPSLEKICERLHLSEDVAGATFMAAGSSTPELFASVIGVFITHGDVGVGTIVGSAVFNILCIIGVCGLFAGQVVRLTWWAVCRDSVYYTISVIVLIVFIYDEQIVWWEGLVLIILYVFYILIMKYNVKMQAFFTVKQKSIANGNPVNSELEAGNDFYDGSYDDPSVPLLGQVKEKPQYGKNPVVMVDEIMSSSPPKFTFPEAGLRIMITNKFGPRTRLRMASRIIINERQRLINSANGVSSKPLQNGRHENIENGNVPVENPEDPQQNQEQQPPPQPPPPEPEPVEADFLSPFSVPEARGDKVKWVFTWPLIFLLCVTIPNCSKPRWEKFFMVTFITATLWIAVFSYIMVWLVTIIGYTLGIPDVIMGITFLAAGTSVPDCMASLIVARQGLGDMAVSNTIGSNVFDILVGLGVPWGLQTMVVNYGSTVKINSRGLVYSVVLLLGSVALTVLGIHLNKWRLDRKLGVYVLVLYAIFLCFSIMIEFNVFTFVNLPMCREDD

SEQ ID NO: 35847 - protein, 603 aa, Homo sapiens
  ENSP00000433302
MALRGTLRPLKVRRRREMLPQQVGFVCAVLALVCCASGLFGSLGHKTASASKRVLPDTWRNRKLMAPVNGTQTAKNCTDPAIHEFPTDLFSNKERQHGAVLLHILGALYMFYALAIVCDDFFVPSLEKICERLHLSEDVAGATFMAAGSSTPELFASVIGVFITHGDVGVGTIVGSAVFNILCIIGVCGLFAGQVVRLTWWAVCRDSVYYTISVIVLIVFIYDEQIVWWEGLVLIILYVFYILIMKYNVKMQAFFTVKQKSIANGNPVNSELEAVKEKPQYGKNPVVMVDEIMSSSPPKFTFPEAGLRIMITNKFGPRTRLRMASRIIINERQRLINSANGVSSKPLQNGRHENIENGNVPVENPEDPQQNQEQQPPPQPPPPEPEPVEADFLSPFSVPEARGDKVKWVFTWPLIFLLCVTIPNCSKPRWEKFFMVTFITATLWIAVFSYIMVWLVTIIGYTLGIPDVIMGITFLAAGTSVPDCMASLIVARQGLGDMAVSNTIGSNVFDILVGLGVPWGLQTMVVNYGSTVKINSRGLVYSVVLLLGSVALTVLGIHLNKWRLDRKLGVYVLVLYAIFLCFSIMIEFNVFTFVNLPMCREDD

SEQ ID NO: 35848 - protein, 622 aa, Homo sapiens
  ENSP00000431840
MALRGTLRPLKVRRRREMLPQQVGFVCAVLALVCCASGLFGSLGHKTASASKRVLPDTWRNRKLMAPVNGTQTAKNCTDPAIHEFPTDLFSNKERQHGAVLLHILGALYMFYALAIVCDDFFVPSLEKICERLHLSEDVAGATFMAAGSSTPELFASVIGVFITHGDVGVGTIVGSAVFNILCIIGVCGLFAGQVVRLTWWAVCRDSVYYTISVIVLIVFIYDEQIVWWEGLVLIILYVFYILIMKYNVKMQAFFTVKQKSIANGNPVNSELEAGNDFYDGSYDDPSVPLLGQVKEKPQYGKNPVVMVDEIMSSSPPKFTFPEAGLRIMITNKFGPRTRLRMASRIIINERQRLINSANGVSSKPLQNGRHENIENGNVPVENPEDPQQNQEQQPPPQPPPPEPEPVEADFLSPFSVPEARGDKVKWVFTWPLIFLLCVTIPNCSKPRWEKFFMVTFITATLWIAVFSYIMVWLVTIIGYTLGIPDVIMGITFLAAGTSVPDCMASLIVARQGLGDMAVSNTIGSNVFDILVGLGVPWGLQTMVVNYGSTVKINSRGLVYSVVLLLGSVALTVLGIHLNKWRLDRKLGVYVLVLYAIFLCFSIMIEFNVFTFVNLPMCREDD

SEQ ID NO: 35849 - protein, 64 aa, Homo sapiens
  ENSP00000452099
MFYALAIVCDDFFVPSLEKICERLHLSEDVAGATFMAAGSSTPELFASVIGVFITHGDVGVGTI

SEQ ID NO: 35850 - protein, 464 aa, Homo sapiens
  ENSP00000432464
  MOD_RES (1)..(1): Any amino acid
XVCDDFFVPSLEKICERLHLSEDVAGATFMAAGSSTPELFASVIGVFITHGDVGVGTIVGSAVFNILCIIGVCGLFAGQVVRLTWWAVCRDSVYYTISVIVLIVFIYDEQIVWWEGLVLIILYVFYILIMKYNVKMQAFFTVKQKSIANGNPVNSELEAVKEKPQYGKNPVVMVDEIMSSSPPKFTFPEAGLRIMITNKFGPRTRLRMASRIIINERQRLINSANGVSSKPLQNGRHENIENGNVPVENPEDPQQNQEQQPPPQPPPPEPEPVEADFLSPFSVPEARGDKVKWVFTWPLIFLLCVTIPNCSKPRWEKFFMVTFITATLWIAVFSYIMVWLVTIIGYTLGIPDVIMGITFLAAGTSVPDCMASLIVARQGLGDMAVSNTIGSNVFDILVGLGVPWGLQTMVVNYGSTVKINSRGLVYSVVLLLGSVALTCSSEVPGIQPQEALIEGQGGRQWKER

SEQ ID NO: 35851 - protein, 315 aa, Homo sapiens
  ENSP00000329033
MTHQDLSITAKLINGGVAGLVGVTCVFPIDLAKTRLQNQHGKAMYKGMIDCLMKTARAEGFFGMYRGAAVNLTLVTPEKAIKLAANDFFRRLLMEDGMQRNLKMEMLAGCGAGMCQVVVTCPMEMLKIQLQDAGRLAVHHQGSASAPSTSRSYTTGSASTHRRPSATLIAWELLRTQGLAGLYRGLGATLLRDIPFSIIYFPLFANLNNLGFNELAGKASFAHSFVSGCVAGSIAAVAVTPLDVLKTRIQTLKKGLGEDMYSGITDCARKLWIQEGPSAFMKGAGCRALVIAPLFGIAQGVYFIGIGERILKCFD

SEQ ID NO: 35852 - protein, 315 aa, Homo sapiens; identical to SEQ ID NO: 35851
  ENSP00000382710

SEQ ID NO: 35853 - protein, 303 aa, Homo sapiens
  ENSP00000352167
MALDFLAGCAGGVAGVLVGHPFDTVKVRLQVQSVEKPQYRGTLHCFKSIIKQESVLGLYKGLGSPLMGLTFINALVFGVQGNTLRALGHDSPLNQFLAGAAAGAIQCVICCPMELAKTRLQLQDAGPARTYKGSLDCLAQIYGHEGLRGVNRGMVSTLLRETPSFGVYFLTYDALTRALGCEPGDRLLVPKLLLAGGTSGIVSWLSTYPVDVVKSRLQADGLRGAPRYRGILDCVHQSYRAEGWRVFTRGLASTLLRAFPVNAATFATVTVVLTYARGEEAGPEGEAVPAAPAGPALAQPSSL

SEQ ID NO: 35854 - protein, 237 aa, Homo sapiens
  ENSP00000450913
MGLTFINALVFGVQGNTLRALGHDSPLNQFLAGAAAGAIQCVICCPMELAKTRLQLQDAGPARTYKGSLDCLAQIYGHEGLRGVNRGMVSTLLRETPSFGVYFLTYDALTRALGCEPGDRLLVPKLLLAGGTSGIVSWLSTYPVDVVKSRLQADGLRGAPRYRGILDCVHQSYRAEGWRVFTRGLASTLLRAFPVNAATFATVTVVLTYARGEEAGPEGEAVPAAPAGPALAQPSSL

SEQ ID NO: 35855 - protein, 145 aa, Homo sapiens
  ENSP00000376640
MALDFLAGCAGGTASGPERGEASVPRDVALLQVHHQARERAGPVQGPGLAAHGAHLHQRAGVRGAGQHPPGPGPRLAPQPVPGRCGGGRHPVRHLLPHGAGQDAAAAAGRGPSAHLQGLAGLPRADLRARGSAWRQPGHGVHVAA

SEQ ID NO: 35856 - protein, 237 aa, Homo sapiens; identical to SEQ ID NO: 35854
  ENSP00000452446

SEQ ID NO: 35857 - protein, 237 aa, Homo sapiens; identical to SEQ ID NO: 35854
  ENSP00000452078

SEQ ID NO: 35858 - protein, 35 aa, Homo sapiens
  ENSP00000451573
MALDFLAGCAGGVAGVLVGHPFDTVKGLSPSIAKV

SEQ ID NO: 35859 - protein, 35 aa, Homo sapiens; identical to SEQ ID NO: 35858
  ENSP00000451952

SEQ ID NO: 35860 - protein, 129 aa, Homo sapiens
  ENSP00000452324
MGLTFINALVFGVQGNTLRALGHDSPLNQFLAGAAAGAIQCVICCPMELAKTRLQLQDAGPARTYKGSLDCLAQIYGHEGLRGVNRGMVSTLLRETPSFGVYFLTYDALTRALGCEPGDRLLVPKLLLA

SEQ ID NO: 35861 - protein, 138 aa, Homo sapiens
  ENSP00000451644
MALDFLAGCAGGTASGPERGEASVPRDVALLQVHHQARERAGPVQGPGLAAHGAHLHQRAGVRGAGQHPPGPGPRLAPQPVPGRCGGGRHPVRHLLPHGAGQDAAAAAGRGPSAHLQGLAGLPRADLRARGSAWRQPG

SEQ ID NO: 35862 - protein, 122 aa, Homo sapiens
  ENSP00000451808
MALDFLAGCAGGVAGVLVGHPFDTVKALGTERIQDLDLLYSAQNHSHRPEAHGLHTFLHEGSFLSCFLGHSNNQGAVVLTYDEGVTGHPWAWDGECGWGLAVGAPRLDVMLKFCVALTAFTF

SEQ ID NO: 35863 - protein, 361 aa, Homo sapiens
  ENSP00000383898
MFSSVAHLARANPFNTPHLQLVHDGLGDLRSSSPGPTGQPRRPRNLAAAAVEEYSCEFGSAKYYALCGFGGVLSCGLTHTAVVPLDLVKCRMQVDPQKYKGIFNGFSVTLKEDGVRGLAKGWAPTFLGYSMQGLCKFGFYEVFKVLYSNMLGEENTYLWRTSLYLAASASAEFFADIALAPMEAAKVRIQTQPGYANTLRDAAPKMYKEEGLKAFYKGVAPLWMRQIPYTMMKFACFERTVEALYKFVVPKPRSECSKPEQLVVTFVAGYIAGVFCAIVSHPADSVVSVLNKEKGSSASLVLKRLGFKGVWKGLFARIIMIGTLTALQWFIYDSVKVYFRLPRPPPPEMPESLKKKLGLTQ

SEQ ID NO: 35864 - protein, 361 aa, Homo sapiens; identical to SEQ ID NO: 35863
  ENSP00000188376

SEQ ID NO: 35865 - protein, 362 aa, Homo sapiens
  ENSP00000447310
MFSSVAHLARANPFNTPHLQLVHDGLGDLRSSSPGPTGQPRRPRNLAAAAVEEQYSCDYGSGRFFILCGLGGIISCGTTHTALVPLDLVKCRMQVDPQKYKGIFNGFSVTLKEDGVRGLAKGWAPTFLGYSMQGLCKFGFYEVFKVLYSNMLGEENTYLWRTSLYLAASASAEFFADIALAPMEAAKVRIQTQPGYANTLRDAAPKMYKEEGLKAFYKGVAPLWMRQIPYTMMKFACFERTVEALYKFVVPKPRSECSKPEQLVVTFVAGYIAGVFCAIVSHPADSVVSVLNKEKGSSASLVLKRLGFKGVWKGLFARIIMIGTLTALQWFIYDSVKVYFRLPRPPPPEMPESLKKKLGLTQ

SEQ ID NO: 35866 - protein, 153 aa, Homo sapiens
  ENSP00000447339
MFSSVAHLARANPFNTPHLQLVHDGLGDLRSSSPGPTGQPRRPRNLAAAAVEEQYSCDYGSGRFFILCGLGGIISCGTTHTALVPLDLVKCRMQVDPQKYKGIFNGFSVTLKEDGVRGLAKGWAPTFLGYSMQGLCKFGFYEVFKVLYSNMLG

SEQ ID NO: 35867 - protein, 361 aa, Homo sapiens; identical to SEQ ID NO: 35863
  ENSP00000448708

SEQ ID NO: 35868 - protein, 122 aa, Homo sapiens
  ENSP00000448969
MFSSVAHLARANPFNTPHLQLVHDGLGDLRSSSPGPTGQPRRPRNLAAAAVEGEIRPCPIQSCGLLVGRPAFEAWTRLGGQGRTSPARCTVGRRPVACPGVSAFSTIGGCQILGLPSRAWKR

SEQ ID NO: 35869 - protein, 154 aa, Homo sapiens
  ENSP00000449479
MFSSVAHLARANPFNTPHLQLVHDGLGDLRSSSPGPTGQPRRPRNLAAAAVEEQYSCDYGSGRFFILCGLGGIISCGTTHTALVPLDLVKCRMQVDPQKYKGIFNGFSVTLKEDGVRGLAKGWAPTFLGYSMQGLCKFGFYEVFKVLYSNMLGE

SEQ ID NO: 35870 - protein, 156 aa, Homo sapiens
  ENSP00000449793
MFSSVAHLARANPFNTPHLQLVHDGLGDLRSSSPGPTGQPRRPRNLAAAAVEEYSCEFGSAKYYALCGFGGVLSCGLTHTAVVPLDLVKCRMQVDPQKYKGIFNGFSVTLKEDGVRGLAKGWAPTFLGYSMQGLCKFGFYEVFKVLYSNMLGEVCN

SEQ ID NO: 35871 - protein, 361 aa, Homo sapiens; identical to SEQ ID NO: 35863
  ENSP00000447740

SEQ ID NO: 35872 - protein, 104 aa, Homo sapiens
  ENSP00000449009
MFSSVAHLARANPFNTPHLQLVHDGLGDLRSSSPGPTGQPRRPRNLAAAAVEEQYSCDYGSGRFFILCGLGGIISCGTTHTALVPLDLVKCRMQVCFACWTRAY

SEQ ID NO: 35873 - protein, 324 aa, Homo sapiens
  ENSP00000449166
MFSSVAHLARANPFNTPHLQLVHDGLGDLRSSSPGPTGQPRRPRNLAAAAVEEYSCEFGSAKYYALCGFGGVLSCGLTHTAVVPLDLVKCRMQVDPQKYKGIFNGFSVTLKEDGVRGLAKGWAPTFLGYSMQGLCKFGFYEVFKVLYSNMLGEENTYLWRTSLYLAASASAEFFADIALAPMEAAKVRIQTQPGYANTLRDAAPKMYKEEGLKAFYKGVAPLWMRQIPYTMMKFACFERTVEALYKFVVPKPRSECSKPEQLVVTFVAGYIGVWKGLFARIIMIGTLTALQWFIYDSVKVYFRLPRPPPPEMPESLKKKLGLTQ

SEQ ID NO: 35874 - protein, 362 aa, Homo sapiens; identical to SEQ ID NO: 35865
  ENSP00000228318

SEQ ID NO: 35875 - protein, 321 aa, Homo sapiens
  ENSP00000306328
MATGGQQKENTLLHLFAGGCGGTVGAIFTCPLEVIKTRLQSSRLALRTVYYPQVHLGTISGAGMVRPTSVTPGLFQVLKSILEKEGPKSLFRGLGPNLVGVAPSRAVYFACYSKAKEQFNGIFVPNSNIVHIFSAGSAAFITNSLMNPIWMVKTRMQLEQKVRGSKQMNTLQCARYVYQTEGIRGFYRGLTASYAGISETIICFAIYESLKKYLKEAPLASSANGTEKNSTSFFGLMAAAALSKGCASCIAYPHEVIRTRLREEGTKYKSFVQTARLVFREEGYLAFYRGLFAQLIRQIPNTAIVLSTYELIVYLLEDRTQ

SEQ ID NO: 35876 - protein, 298 aa, Homo sapiens
  ENSP00000370808
MTEQAISFAKDFLAGGIAAAISKTAVAPIERVKLLLQVQHASKQIAADKQYKGIVDCIVRIPKEQGVLSFWRGNLANVIRYFPTQALNFAFKDKYKQIFLGGVDKHTQFWRYFAGNLASGGAAGATSLCFVYPLDFARTRLAADVGKSGTEREFRGLGDCLVKITKSDGIRGLYQGFSVSVQGIIIYRAAYFGVYDTAKGMLPDPKNTHIVVSWMIAQTVTAVAGVVSYPFDTVRRRMMMQSGRKGADIMYTGTVDCWRKIFRDEGGKAFFKGAWSNVLRGMGGAFVLVLYDELKKVI

SEQ ID NO: 35877 - protein, 52 aa, Homo sapiens
  ENSP00000368375
MIEPFGNQYIVARPVYSTNAFEENHKKTGRHHKTFLDHLKVCCSILVASIPA

SEQ ID NO: 35878 - protein, 764 aa, Homo sapiens
  ENSP00000345873
MIEPFGNQYIVARPVYSTNAFEENHKKTGRHHKTFLDHLKVCCSCSPQKAKRIVLSLFPIASWLPAYRLKEWLLSDIVSGISTGIVAVLQGLAFALLVDIPPVYGLYASFFPAIIYLFFGTSRHISVGPFPILSMMVGLAVSGAVSKAVPDRNATTLGLPNNSNNSSLLDDERVRVAAAASVTVLSGIIQLAFGILRIGFVVIYLSESLISGFTTAAAVHVLVSQLKFIFQLTVPSHTDPVSIFKVLYSVFSQIEKTNIADLVTALIVLLVVSIVKEINQRFKDKLPVPIPIEFIMTVIAAGVSYGCDFKNRFKVAVVGDMNPGFQPPITPDVETFQNTVGDCFGIAMVAFAVAFSVASVYSLKYDYPLDGNQELIALGLGNIVCGVFRGFAGSTALSRSAVQESTGGKTQIAGLIGAIIVLIVVLAIGFLLAPLQKSVLAALALGNLKGMLMQFAEIGRLWRKDKYDCLIWIMTFIFTIVLGLGLGLAASVAFQLLTIVFRTQFPKCSTLANIGRTNIYKNKKDYYDMYEPEGVKIFRCPSPIYFANIGFFRRKLIDAVGFSPLRILRKRNKALRKIRKLQKQGLLQVTPKGFICTVDTIKDSDEELDNNQIEVLDQPINTTDLPFHIDWNDDLPLNIEVPKISLHSLILDFSAVSFLDVSSVRGLKSILQEFIRIKVDVYIVGTDDDFIEKLNRYEFFDGEVKSSIFFLTIHDAVLHILMKKDYSTSKFNPSQEKDGKIDFTINTNGGLRNRVYEVPVETKF

SEQ ID NO: 35879 - protein, 120 aa, Homo sapiens
  ENSP00000395955
MIEPFGNQYIVARPVYSTNAFEENHKKTGRHHKTFLDHLKVCCSCSPQKAKRIVLSLFPIASWLPAYRLKEWLLSDIVSGISTGIVAVLQGLAFALLVDIPPVYGLYASFFPAIIYLFFG

SEQ ID NO: 35880 - protein, 685 aa, Homo sapiens
  ENSP00000342396
MDHAEENEILAATQRYYVERPIFSHPVLQERLHTKDKVPDSIADKLKQAFTCTPKKIRNIIYMFLPITKWLPAYKFKEYVLGDLVSGISTGVLQLPQGLAFAMLAAVPPIFGLYSSFYPVIMYCFLGTSRHISIGPFAVISLMIGGVAVRLVPDDIVIPGGVNATNGTEARDALRVKVAMSVTLLSGIIQFCLGVCRFGFVAIYLTEPLVRGFTTAAAVHVFTSMLKYLFGVKTKRYSGIFSVVYSTVAVLQNVKNLNVCSLGVGLMVFGLLLGGKEFNERFKEKLPAPIPLEFFAVVMGTGISAGFNLKESYNVDVVGTLPLGLLPPANPDTSLFHLVYVDAIAIAIVGFSVTISMAKTLANKHGYQVDGNQELIALGLCNSIGSLFQTFSISCSLSRSLVQEGTGGKTQLAGCLASLMILLVILATGFLFESLPQAVLSAIVIVNLKGMFMQFSDLPFFWRTSKIELTIWLTTFVSSLFLGLDYGLITAVIIALLTVIYRTQSPSYKVLGKLPETDVYIDIDAYEEVKEIPGIKIFQINAPIYYANSDLYSNALKRKTGVNPAVIMGARRKAMRKYAKEVGNANMANATVVKADAEVDGEDATKPEEEDGEVKYPPIVIKSTFPEEMQRFMPPGDNVHTVILDFTQVNFIDSVGVKTLAGIVKEYGDVGIYVYLAGCSAFIQR

SEQ ID NO: 35881 - protein, 335 aa, Homo sapiens
  ENSP00000349210
MDHAEENEILAATQRYYVERPIFSHPVLQERLHTKDKVPDSIADKLKQAFTCTPKKIRNIIYMFLPITKWLPAYKFKEYVLGDLVSGISTGVLQLPQGLAFAMLAAVPPIFGLYSSFYPVIMYCFLGTSRHISIGPFAVISLMIGGVAVRLVPDDIVIPGGVNATNGTEARDALRVKVAMSVTLLSGIIQFCLGVCRFGFVAIYLTEPLVRGFTTAAAVHVFTSMLKYLFGVKTKRYSGIFSVVYSTVAVLQNVKNLNVCSLGVGLMVFGLLLGGKEFNERFKEKLPAPIPLEFFAVVMGTGISAGFNLKESYNVDVVGTLPLGFHTEMTRRWRP

SEQ ID NO: 35882 - protein, 516 aa, Homo sapiens
  ENSP00000377336
MDHAEENEILAATQRYYVERPIFSHPVLQERLHTKDKVPDSIADKLKQAFTCTPKKIRNIIYMFLPITKWLPAYKFKEYVLGDLVSGISTGVLQLPQGLAFAMLAAVPPIFGLYSSFYPVIMYCFLGTSRHISIGPFAVISLMIGGVAVRLVPDDIVIPGGVNATNGTEARDALRVKVAMSVTLLSGIIQFCLGVCRFGFVAIYLTEPLVRGFTTAAAVHVFTSMLKYLFGVKTKRYSGIFSVVYSTVAVLQNVKNLNVCSLGVGLMVFGLLLGGKEFNERFKEKLPAPIPLEFFAVVMGTGISAGFNLKESYNVDVVGTLPLGLLPPANPDTSLFHLVYVDAIAIAIVGFSVTISMAKTLANKHGYQVDGNQELIALGLCNSIGSLFQTFSISCSLSRSLVQEGTGGKTQLAGCLASLMILLVILATGFLFESLPQAVLSAIVIVNLKGMFMQFSDLPFFWRTSKIELTIWLTTFVSSLFLGLDYGLITAVIIALLTVIYRTQSFHTEMTRRWRP

SEQ ID NO: 35883 - protein, 248 aa, Homo sapiens
  ENSP00000396833
MDHAEENEILAATQRYYVERPIFSHPVLQERLHTKDKVPDSIADKLKQAFTCTPKKIRNIIYMFLPITKWLPAYKFKEYVLGDLVSGISTGVLQLPQGLAFAMLAAVPPIFGLYSSFYPVIMYCFLGTSRHISIGPFAVISLMIGGVAVRLVPDDIVIPGGVNATNGTEARDALRVKVAMSVTLLSGIIQFCLGVCRFGFVAIYLTEPLVRGFTTAAAVHVFTSMLKYLFGVKTKRYSGIFSVVYASG

SEQ ID NO: 35884 - protein, 447 aa, Homo sapiens
  ENSP00000416502
MDHAEENEILAATQRYYVERPIFSHPVLQERLHTKDKVPDSIADKLKQAFTCTPKKIRNIIYMFLPITKWLPAYKFKEYVLGDLVSGISTGVLQLPQGLAFAMLAAVPPIFGLYSSFYPVIMYCFLGTSRHISIGPFAVISLMIGGVAVRLVPDDIVIPGGVNATNGTEARDALRVKVAMSVTLLSGIIQFCLGVCRFGFVAIYLTEPLVRGFTTAAAVHVFTSMLKYLFGVKTKRYSGIFSVVYSTVAVLQNVKNLNVCSLGVGLMVFGLLLGGKEFNERFKEKLPAPIPLEFFAVVMGTGISAGFNLKESYNVDVVGTLPLGLLPPANPDTSLFHLVYVDAIAIAIVGFSVTISMAKTLANKHGYQVDGNQELIALGLCNSIGSLFQTFSISCSLSRSLVQEGTGGKTQTIWLTTFVSSLFLGLDYGLITAVIIALLTVIYRTQR

SEQ ID NO: 35885 - protein, 712 aa, Homo sapiens
  ENSP00000377331
MDHAEENEILAATQRYYVERPIFSHPVLQERLHTKDKVPDSIADKLKQAFTCTPKKIRNIIYMFLPITKWLPAYKFKEYVLGDLVSGISTGVLQLPQGLAFAMLAAVPPIFGLYSSFYPVIMYCFLGTSRHISIGPFAVISLMIGGVAVRLVPDDIVIPGGVNATNGTEARDALRVKVAMSVTLLSGIIQFCLGVCRFGFVAIYLTEPLVRGFTTAAAVHVFTSMLKYLFGVKTKRYSGIFSVVYSTVAVLQNVKNLNVCSLGVGLMVFGLLLGGKEFNERFKEKLPAPIPLEFFAVVMGTGISAGFNLKESYNVDVVGTLPLGLLPPANPDTSLFHLVYVDAIAIAIVGFSVTISMAKTLANKHGYQVDGNQELIALGLCNSIGSLFQTFSISCSLSRSLVQEGTGGKTQLAGCLASLMILLVILATGFLFESLPQTIWLTTFVSSLFLGLDYGLITAVIIALLTVIYRTQSPSYKVLGKLPETDVYIDIDAYEEVKEIPGIKIFQINAPIYYANSDLYSNALKRKTGVNPAVIMGARRKAMRKYAKEVGNANMANATVVKADAEVDGEDATKPEEEDGEVKYPPIVIKSTFPEEMQRFMPPGDNVHTVILDFTQVNFIDSVGVKTLAGIVKEYGDVGIYVYLAGCSAQVVNDLTRNRFFENPALWELLFHSIHDAVLGSQLREALAEQEASAPPSQEDLEPNATPATPEA

SEQ ID NO: 35886 - protein, 744 aa, Homo sapiens
  ENSP00000304783
MDHAEENEILAATQRYYVERPIFSHPVLQERLHTKDKVPDSIADKLKQAFTCTPKKIRNIIYMFLPITKWLPAYKFKEYVLGDLVSGISTGVLQLPQGLAFAMLAAVPPIFGLYSSFYPVIMYCFLGTSRHISIGPFAVISLMIGGVAVRLVPDDIVIPGGVNATNGTEARDALRVKVAMSVTLLSGIIQFCLGVCRFGFVAIYLTEPLVRGFTTAAAVHVFTSMLKYLFGVKTKRYSGIFSVVYSTVAVLQNVKNLNVCSLGVGLMVFGLLLGGKEFNERFKEKLPAPIPLEFFAVVMGTGISAGFNLKESYNVDVVGTLPLGLLPPANPDTSLFHLVYVDAIAIAIVGFSVTISMAKTLANKHGYQVDGNQELIALGLCNSIGSLFQTFSISCSLSRSLVQEGTGGKTQLAGCLASLMILLVILATGFLFESLPQAVLSAIVIVNLKGMFMQFSDLPFFWRTSKIELTIWLTTFVSSLFLGLDYGLITAVIIALLTVIYRTQSPSYKVLGKLPETDVYIDIDAYEEVKEIPGIKIFQINAPIYYANSDLYSNALKRKTGVNPAVIMGARRKAMRKYAKEVGNANMANATVVKADAEVDGEDATKPEEEDGEVKYPPIVIKSTFPEEMQRFMPPGDNVHTVILDFTQVNFIDSVGVKTLAGIVKEYGDVGIYVYLAGCSAQVVNDLTRNRFFENPALWELLFHSIHDAVLGSQLREALAEQEASAPPSQEDLEPNATPATPEA

SEQ ID NO: 35887 - protein, 473 aa, Homo sapiens
  ENSP00000389018
MDHAEENEILAATQRYYVERPIFSHPVLQERLHTKDKVPDSIADKLKQAFTCTPKKIRNIIYMFLPITKWLPAYKFKEYVLGDLVSGISTGVLQLPQGLAFAMLAAVPPIFGLYSSFYPVIMYCFLGTSRHISIGPFAVISLMIGGVAVRLVPDDIVIPGGVNATNGTEARDALRVKVAMSVTLLSGIIQFCLGVCRFGFVAIYLTEPLVRGFTTAAAVHVFTSMLKYLFGVKTKRYSGIFSVVYSTVAVLQNVKNLNVCSLGVGLMVFGLLLGGKEFNERFKEKLPAPIPLEFFAVVMGTGISAGFNLKESYNVDVVGTLPLGLLPPANPDTSLFHLVYVDAIAIAIVGFSVTISMAKTLANKHGYQVDGNQELIALGLCNSIGSLFQTFSISCSLSRSLVQEGTGGKTQLAGCLASLMILLVILATGFLFESLPQTIWLTTFVSSLFLGLDYGLITAVIIALLTVIYRTQR

SEQ ID NO: 35888 - protein, 211 aa, Homo sapiens
  ENSP00000395568
MDHAEENEILAATQRYYVERPIFSHPVLQERLHTKDKVPDSIADKLKQAFTCTPKKIRNIIYMFLPITKWLPAYKFKEYVLGDLVSGISTGVLQLPQGPFAVISLMIGGVAVRLVPDDIVIPGGVNATNGTEARDALRVKVAMSVTLLSGIIQFCLGVCRFGFVAIYLTEPLVRGFTTAAAVHVFTSMLKYLFGVKTKRYSGIFSVVYASG

SEQ ID NO: 35889 - protein, 707 aa, Homo sapiens
  ENSP00000377330
MDHAEENEILAATQRYYVERPIFSHPVLQERLHTKDKVPDSIADKLKQAFTCTPKKIRNIIYMFLPITKWLPAYKFKEYVLGDLVSGISTGVLQLPQGPFAVISLMIGGVAVRLVPDDIVIPGGVNATNGTEARDALRVKVAMSVTLLSGIIQFCLGVCRFGFVAIYLTEPLVRGFTTAAAVHVFTSMLKYLFGVKTKRYSGIFSVVYSTVAVLQNVKNLNVCSLGVGLMVFGLLLGGKEFNERFKEKLPAPIPLEFFAVVMGTGISAGFNLKESYNVDVVGTLPLGLLPPANPDTSLFHLVYVDAIAIAIVGFSVTISMAKTLANKHGYQVDGNQELIALGLCNSIGSLFQTFSISCSLSRSLVQEGTGGKTQLAGCLASLMILLVILATGFLFESLPQAVLSAIVIVNLKGMFMQFSDLPFFWRTSKIELTIWLTTFVSSLFLGLDYGLITAVIIALLTVIYRTQSPSYKVLGKLPETDVYIDIDAYEEVKEIPGIKIFQINAPIYYANSDLYSNALKRKTGVNPAVIMGARRKAMRKYAKEVGNANMANATVVKADAEVDGEDATKPEEEDGEVKYPPIVIKSTFPEEMQRFMPPGDNVHTVILDFTQVNFIDSVGVKTLAGIVKEYGDVGIYVYLAGCSAQVVNDLTRNRFFENPALWELLFHSIHDAVLGSQLREALAEQEASAPPSQEDLEPNATPATPEA

SEQ ID NO: 35890 - protein, 746 aa, Homo sapiens
  ENSP00000377328
MDHAEENEILAATQRYYVERPIFSHPVLQERLHTKDKVPDSIADKLKQAFTCTPKKIRNIIYMFLPITKWLPAYKFKEYVLGDLVSGISTGVLQLPQGLAFAMLAAVPPIFGLYSSFYPVIMYCFLGTSRHISIGPFAVISLMIGGVAVRLVPDDIVIPGGVNATNGTEARDALRVKVAMSVTLLSGIIQFCLGVCRFGFVAIYLTEPLVRGFTTAAAVHVFTSMLKYLFGVKTKRYSGIFSVVYSTVAVLQNVKNLNVCSLGVGLMVFGLLLGGKEFNERFKEKLPAPIPLEFFAVVMGTGISAGFNLKESYNVDVVGTLPLGLLPPANPDTSLFHLVYVDAIAIAIVGFSVTISMAKTLANKHGYQVDGNQELIALGLCNSIGSLFQTFSISCSLSRSLVQEGTGGKTQLAGCLASLMILLVILATGFLFESLPQAVLSAIVIVNLKGMFMQFSDLPFFWRTSKIELTIWLTTFVSSLFLGLDYGLITAVIIALLTVIYRTQSPSYKVLGKLPETDVYIDIDAYEEVKEIPGIKIFQINAPIYYANSDLYSNALKRKTGVNPAVIMGARRKAMRKYAKEVGNANMANATVVKATQDAEVDGEDATKPEEEDGEVKYPPIVIKSTFPEEMQRFMPPGDNVHTVILDFTQVNFIDSVGVKTLAGIVKEYGDVGIYVYLAGCSAQVVNDLTRNRFFENPALWELLFHSIHDAVLGSQLREALAEQEASAPPSQEDLEPNATPATPEA

SEQ ID NO: 35891 - protein, 714 aa, Homo sapiens
  ENSP00000377324
MDHAEENEILAATQRYYVERPIFSHPVLQERLHTKDKVPDSIADKLKQAFTCTPKKIRNIIYMFLPITKWLPAYKFKEYVLGDLVSGISTGVLQLPQGLAFAMLAAVPPIFGLYSSFYPVIMYCFLGTSRHISIGPFAVISLMIGGVAVRLVPDDIVIPGGVNATNGTEARDALRVKVAMSVTLLSGIIQFCLGVCRFGFVAIYLTEPLVRGFTTAAAVHVFTSMLKYLFGVKTKRYSGIFSVVYSTVAVLQNVKNLNVCSLGVGLMVFGLLLGGKEFNERFKEKLPAPIPLEFFAVVMGTGISAGFNLKESYNVDVVGTLPLGLLPPANPDTSLFHLVYVDAIAIAIVGFSVTISMAKTLANKHGYQVDGNQELIALGLCNSIGSLFQTFSISCSLSRSLVQEGTGGKTQLAGCLASLMILLVILATGFLFESLPQTIWLTTFVSSLFLGLDYGLITAVIIALLTVIYRTQSPSYKVLGKLPETDVYIDIDAYEEVKEIPGIKIFQINAPIYYANSDLYSNALKRKTGVNPAVIMGARRKAMRKYAKEVGNANMANATVVKATQDAEVDGEDATKPEEEDGEVKYPPIVIKSTFPEEMQRFMPPGDNVHTVILDFTQVNFIDSVGVKTLAGIVKEYGDVGIYVYLAGCSAQVVNDLTRNRFFENPALWELLFHSIHDAVLGSQLREALAEQEASAPPSQEDLEPNATPATPEA

SEQ ID NO: 35892 - protein, 712 aa, Homo sapiens; identical to SEQ ID NO: 35885
  ENSP00000389733

SEQ ID NO: 35893 - protein, 746 aa, Homo sapiens; identical to SEQ ID NO: 35890
  ENSP00000346325

SEQ ID NO: 35894 - protein, 970 aa, Homo sapiens
  ENSP00000417638
MAQLERSAISGFSSKSRRNSFAYDVKREVYNEETFQQEHKRKASSSGNMNINITTFRHHVQCRCSWHRFLRCVLTIFPFLEWMCMYRLKDWLLGDLLAGISVGLVQVPQGLTLSLLARQLIPPLNIAYAAFCSSVIYVIFGSCHQMSIGSFFLVSALLINVLKVSPFNNGQLVMGSFVKNEFSAPSYLMGYNKSLSVVATTTFLTGIIQLIMGVLGLGFIATYLPESAMSAYLAAVALHIMLSQLTFIFGIMISFHAGPISFFYDIINYCVALPKANSTSILVFLTVVVALRINKCIRISFNQYPIEFPMELFLIIGFTVIANKISMATETSQTLIDMIPYSFLLPVTPDFSLLPKIILQAFSLSLVSSFLLIFLGKKIASLHNYSVNSNQDLIAIGLCNVVSSFFRSCVFTGAIARTIIQDKSGGRQQFASLVGAGVMLLLMVKMGHFFYTLPNAVLAGIILSNVIPYLETISNLPSLWRQDQYDCALWMMTFSSSIFLGLDIGLIISVVSAFFITTVRSHRAKILLLGQIPNTNIYRSINDYREIITIPGVKIFQCCSSITFVNVYYLKHKLLKEVDMVKVPLKEEEIFSLFNSSDTNLQGGKICRCFCNCDDLEPLPRILYTERFENKLDPEASSINLIHCSHFESMNTSQTASEDQVPYTVSSVSQKNQGQQYEEVEEVWLPNNSSRNSSPGLPDVAESQGRRSLIPYSDASLLPSVHTIILDFSMVHYVDSRGLVVLRQICNAFQNANILILIAGCHSSIVRAFERNDFFDAGITKTQLFLSVHDAVLFALSRKVIGSSELSIDESETVIRETYSETDKNDNSRYKMSSSFLGSQKNVSPGFIKIQQPVEEESELDLELESEQEAGLGLDLDLDRELEPEMEPKAETETKTQTEMEPQPETEPEMEPNPKSRPRAHTFPQQRYWPMYHPSMASTQSQTQTRTWSVERRRHPMDSYSPEGNSNEDV

SEQ ID NO: 35895 - protein, 865 aa, Homo sapiens
  ENSP00000378100
MAQLERSAISGFSSKSRRNSFAYDVKREVYNEETFQQEHKRKASSSGNMNINITTFRHHVQCRCSWHRFLRCVLTIFPFLEWMCMYRLKDWLLGDLLAGISVGLVQVPQGLTLSLLARQLIPPLNIAYAAFCSSVIYVIFGSCHQMSIGSFFLVSALLINVLKVSPFNNGQLVMGSFVKNEFSAPSYLMGYNKSLSVVATTTFLTGIIQIIGFTVIANKISMATETSQTLIDMIPYSFLLPVTPDFSLLPKIILQAFSLSLVSSFLLIFLGKKIASLHNYSVNSNQDLIAIGLCNVVSSFFRSCVFTGAIARTIIQDKSGGRQQFASLVGAGVMLLLMVKMGHFFYTLPNAVLAGIILSNVIPYLETISNLPSLWRQDQYDCALWMMTFSSSIFLGLDIGLIISVVSAFFITTVRSHRAKILLLGQIPNTNIYRSINDYREIITIPGVKIFQCCSSITFVNVYYLKHKLLKEVDMVKVPLKEEEIFSLFNSSDTNLQGGKICRCFCNCDDLEPLPRILYTERFENKLDPEASSINLIHCSHFESMNTSQTASEDQVPYTVSSVSQKNQGQQYEEVEEVWLPNNSSRNSSPGLPDVAESQGRRSLIPYSDASLLPSVHTIILDFSMVHYVDSRGLVVLRQICNAFQNANILILIAGCHSSIVRAFERNDFFDAGITKTQLFLSVHDAVLFALSRKVIGSSELSIDESETVIRETYSETDKNDNSRYKMSSSFLGSQKNVSPGFIKIQQPVEEESELDLELESEQEAGLGLDLDLDRELEPEMEPKAETETKTQTEMEPQPETEPEMEPNPKSRPRAHTFPQQRYWPMYHPSMASTQSQTQTRTWSVERRRHPMDSYSPEGNSNEDV

SEQ ID NO: 35896 - protein, 970 aa, Homo sapiens; identical to SEQ ID NO: 35894
  ENSP00000347778

SEQ ID NO: 35897 - protein, 320 aa, Homo sapiens
  ENSP00000418107
  MOD_RES (1)..(1): Any amino acid
XFYTLPNAVLAGIILSNVIPYLETISNLPSLWRQDQYDCALWMMTFSSSIFLGLDIGLIISVVSAFFITTVRSHRAKILLLGQIPNTNIYRSINDYREIITIPGVKIFQCCSSITFVNVYYLKHKLLKEVDMVKVPLKEEEIFSLFNSSDTNLQGGKICRCFCNCDDLEPLPRILYTERFENKLDPEASSINLIHCSHFESMNTSQTASEDQVPYTVSSVSQKNQGQQYEEVEEVWLPNNSSRNSSPGLPDVAESQGRRSLIPYSDASLLPSVHTIILDFSMVHYVDSRGLVVLRQVSTEEALAGALIPLLPSQPHPDPD

SEQ ID NO: 35898 - protein, 184 aa, Homo sapiens
  ENSP00000419700
  MOD_RES (1)..(1): Any amino acid
XVYRFTKYQGDPTTQPARNARGLGHNGSGTAAGIRVRSAASQARAVWDPSARTPAPAKEPGEPLLGDAWAPGAAGPRAGAASVTGRYPGMAQLERSAISGFSSKSRRNSFAYDVKREVYNEETFQQEHKRKASSSGNMNINITTFRHHVQCRMDVYVSIKGLASGRLTCWYKCWPCASSPRPDT

SEQ ID NO: 35899 - protein, 190 aa, Homo sapiens
  ENSP00000420488
MFRTRGLAPNRPSIKNSKTSEREGALVYRFTKYQGDPTTQPARNARGLGHNGSGTAAGIRVRSAASQARAVWDPSARTPAPAKEPGMAQLERSAISGFSSKSRRNSFAYDVKREVYNEETFQQEHKRKASSSGNMNINITTFRHHVQCRCSWHRFLRCVLTIFPFLEWMCMYRLKDWLLGDLLAGISVGL

SEQ ID NO: 35900 - protein, 162 aa, Homo sapiens
  ENSP00000421759
MKDSVPQGVISLKEKLSTSPDEPVPRSHHVVSLLKSTCLYIFTSGTTGLPKAAVISQLQVLRGSAVLWAFGCTAHDIVYITLPLYHSSAAILGISGCVELGATCVLKKKFSASQFWSDCKKYDVTVFQYIGELCRYLCKQSKREGEKDHKVRLAIGNGIRSD

SEQ ID NO: 35901 - protein, 619 aa, Homo sapiens
  ENSP00000262462
MLLSWLTVLGAGMVVLHFLQKLLFPYFWDDFWFVLKVVLIIIRLKKYEKRGELVTVLDKFLSHAKRQPRKPFIIYEGDIYTYQDVDKRSSRVAHVFLNHSSLKKGDTVALLMSNEPDFVHVWFGLAKLGCVVAFLNTNIRSNSLLNCIRACGPRALVVGADLLGTVEEILPSLSENISVWGMKDSVPQGVISLKEKLSTSPDEPVPRSHHVVSLLKSTCLYIFTSGTTGLPKAAVISQLQVLRGSAVLWAFGCTAHDIVYITLPLYHSSAAILGISGCVELGATCVLKKKFSASQFWSDCKKYDVTVFQYIGELCRYLCKQSKREGEKDHKVRLAIGNGIRSDVWREFLDRFGNIKVCELYAATESSISFMNYTGRIGAIGRTNLFYKLLSTFDLIKYDFQKDEPMRNEQGWCIHVKKGEPGLLISRVNAKNPFFGYAGPYKHTKDKLLCDVFKKGDVYLNTGDLIVQDQDNFLYFWDRTGDTFRWKGENVATTEVADVIGMLDFIQEANVYGVAISGYEGRAGMASIILKPNTSLDLEKVYEQVVTFLPAYACPRFLRIQEKMEATGTFKLLKHQLVEDGFNPLKISEPLYFMDNLKKSYVLLTRELYDQIMLGEIKL

SEQ ID NO: 35902 - protein, 619 aa, Homo sapiens; identical to SEQ ID NO: 35901
  ENSP00000378684

SEQ ID NO: 35903 - protein, 619 aa, Homo sapiens; identical to SEQ ID NO: 35901
  ENSP00000421024

SEQ ID NO: 35904 - protein, 541 aa, Homo sapiens
  ENSP00000352216
MGHSPPVLPLCASVSLLGGLTFGYELAVISGALLPLQLDFGLSCLEQEFLVGSLLLGALLASLVGGFLIDCYGRKQAILGSNLVLLAGSLTLGLAGSLAWLVLGRAVVGFAISLSSMACCIYVSELVGPRQRGVLVSLYEAGITVGILLSYALNYALAGTPWGWRHMFGWATAPAVLQSLSLLFLPAGTDETATHKDLIPLQGGEAPKLGPGRPRYSFLDLFRARDNMRGRTTVGLGLVLFQQLTGQPNVLCYASTIFSSVGFHGGSSAVLASVGLGAVKVAATLTAMGLVDRAGRRALLLAGCALMALSVSGIGLVSFAVPMDSGPSCLAVPNATGQTGLPGDSGLLQDSSLPPIPRTNEDQREPILSTAKKTKPHPRSGDPSAPPRLALSSALPGPPLPARGHALLRWTALLCLMVFVSAFSFGFGPVTWLVLSEIYPVEIRGRAFAFCNSFNWAANLFISLSFLDLIGTIGLSWTFLLYGLTAVLGLGFIYLFVPETKGQSLAEIDQQFQKRRFTLSFGHRQNSTGIPYSRIEISAAS

SEQ ID NO: 35905 - protein, 13 aa, Homo sapiens
  ENSP00000478679
MAPTRAQALSRAP

SEQ ID NO: 35906 - protein, 648 aa, Homo sapiens
  ENSP00000280871
MSRKASENVEYTLRSLSSLMGERRRKQPEPDAASAAGECSLLAAAESSTSLQSAGAGGGGVGDLERAARRQFQQDETPAFVYVVAVFSALGGFLFGYDTGVVSGAMLLLKRQLSLDALWQELLVSSTVGAAAVSALAGGALNGVFGRRAAILLASALFTAGSAVLAAANNKETLLAGRLVVGLGIGIASMTVPVYIAEVSPPNLRGRLVTINTLFITGGQFFASVVDGAFSYLQKDGWRYMLGLAAVPAVIQFFGFLFLPESPRWLIQKGQTQKARRILSQMRGNQTIDEEYDSIKNNIEEEEKEVGSAGPVICRMLSYPPTRRALIVGCGLQMFQQLSGINTIMYYSATILQMSGVEDDRLAIWLASVTAFTNFIFTLVGVWLVEKVGRRKLTFGSLAGTTVALIILALGFVLSAQVSPRITFKPIAPSGQNATCTRYSYCNECMLDPDCGFCYKMNKSTVIDSSCVPVNKASTNEAAWGRCENETKFKTEDIFWAYNFCPTPYSWTALLGLILYLVFFAPGMGPMPWTVNSEIYPLWARSTGNACSSGINWIFNVLVSLTFLHTAEYLTYYGAFFLYAGFAAVGLLFIYGCLPETKGKKLEEIESLFDNRLCTCGTSDSDEGRYIEYIRVKGSNYHLSDNDASDVE

SEQ ID NO: 35907 - protein, 357 aa, Homo sapiens
  ENSP00000370239
MSRKASENVEYTLRSLSSLMGERRRKQPEPDAASAAGECSLLAAAESSTSLQSAGAGGGGVGDLERAARRQFQQDETPAFVYVVAVFSALGGFLFGYDTGVVSGAMLLLKRQLSLDALWQELLVSSTVGAAAVSALAGGALNGVFGRRAAILLASALFTAGSAVLAAANNKETLLAGRLVVGLGIGIASMTVPVYIAEVSPPNLRGRLVTINTLFITGGQFFASVVDGAFSYLQKDGWRYMLGLAAVPAVIQFFGFLFLPESPRWLIQKGQTQKARRILSQMRGNQTIDEEYDSIKNNIEEEEKEVGSAGPVICRMLSYPPTRRALIVGCGLQMFQQLSGINTIMYVFLSGFLLKRL

SEQ ID NO: 35908 - protein, 496 aa, Homo sapiens
  ENSP00000075120
MGTQKVTPALIFAITVATIGSFQFGYNTGVINAPEKIIKEFINKTLTDKGNAPPSEVLLTSLWSLSVAIFSVGGMIGSFSVGLFVNRFGRRNSMLIVNLLAVTGGCFMGLCKVAKSVEMLILGRLVIGLFCGLCTGFVPMYIGEISPTALRGAFGTLNQLGIVVGILVAQIFGLEFILGSEELWPLLLGFTILPAILQSAALPFCPESPRFLLINRKEEENAKQILQRLWGTQDVSQDIQEMKDESARMSQEKQVTVLELFRVSSYRQPIIISIVLQLSQQLSGINAVFYYSTGIFKDAGVQEPIYATIGAGVVNTIFTVVSLFLVERAGRRTLHMIGLGGMAFCSTLMTVSLLLKDNYNGMSFVCIGAILVFVAFFEIGPGPIPWFIVAELFSQGPRPAAMAVAGCSNWTSNFLVGLLFPSAAHYLGAYVFIIFTGFLITFLAFTFFKVPETRGRTFEDITRAFEGQAHGADRSGKDGVMEMNSIEPAKETTTNV

SEQ ID NO: 35909 - protein, 141 aa, Homo sapiens
  ENSP00000440750
MGTQKIIKEFINKTLTDKGNAPPSEVLLTSLWSLSVAIFSVGGMIGSFSVGLFVNRFGRRNSMLIVNLLAVTGGCFMGLCKVAKSVEMLILGRLVIGLFCGLCTGFVPMYIGEISPTALRGAFGTLNQLGIVVGILVAQIF

SEQ ID NO: 35910 - protein, 48 aa, Homo sapiens
  ENSP00000441496
MGTQKVTPALIFAITVATIGSFQFGYNTGVINAPEKSVLPPTLLFCRS

SEQ ID NO: 35911 - protein, 509 aa, Homo sapiens
  ENSP00000320935
MPSGFQQIGSEDGEPPQQRVTGTLVLAVFSAVLGSLQFGYNIGVINAPQKVIEQSYNETWLGRQGPEGPSSIPPGTLTTLWALSVAIFSVGGMISSFLIGIISQWLGRKRAMLVNNVLAVLGGSLMGLANAAASYEMLILGRFLIGAYSGLTSGLVPMYVGEIAPTHLRGALGTLNQLAIVIGILIAQVLGLESLLGTASLWPLLLGLTVLPALLQLVLLPFCPESPRYLYIIQNLEGPARKSLKRLTGWADVSGVLAELKDEKRKLERERPLSLLQLLGSRTHRQPLIIAVVLQLSQQLSGINAVFYYSTSIFETAGVGQPAYATIGAGVVNTVFTLVSVLLVERAGRRTLHLLGLAGMCGCAILMTVALLLLERVPAMSYVSIVAIFGFVAFFEIGPGPIPWFIVAELFSQGPRPAAMAVAGFSNWTSNFIIGMGFQYVAEAMGPYVFLLFAVLLLGFFIFTFLRVPETRGRTFDQISAAFHRTPSLLEQEVKPSTELEYLGPDEND

SEQ ID NO: 35912 - protein, 415 aa, Homo sapiens
  ENSP00000461086
MPSGFQQIGSEDGEPPQQRVTGTLVLAVFSAVLGSLQFGYNIGVINAPQKVIEQSYNETWLGRQGPEGPSSIPPGTLTTLWALSVAIFSVGGMISSFLIGIISQWLGRKRAMLVNNVLAVLGGSLMGLANAAASYEMLILGRFLIGAYSGLTSGLVPMYVGEIAPTHLRGALGTLNQLAIVIGILIAQVLGLESLLGTASLWPLLLGLTVLPALLQLVLLPFCPESPRYLYIIQNLEGPARKSLKRLTGWADVSGVLAELKDEKRKLERERPLSLLQLLGSRTHRQPLIIAVVLQLSQQLSGINAVFYYSTSIFETAGVGQPAYATIGAGVVNTVFTLVSVTAHLWNGPSHWLHLPGCPGGVVGGAGGAPDAPSPGPGGHVWLCHPDDCGSAPAGASSSHELRLHCGHLWLRGIF

SEQ ID NO: 35913 - protein, 461 aa, Homo sapiens
  ENSP00000459864
MPSGFQQIGSEDGEPPQQRVTGTLVLAVFSAVLGSLQFGYNIGVINAPQKVIEQSYNETWLGRQGPEGPSSIPPGTLTTLWALSVAIFSVGGMISSFLIGIISQWLGRKRAMLVNNVLAVLGGSLMGLANAAASYEMLILGRFLIGAYSGLTSGLVPMYVGEIAPTHLRGALGTLNQLAIVIGILIAQVLGLESLLGTASLWPLLLGLTVLPALLQLVLLPFCPESPRYLYIIQNLEGPARKSLKRLTGWADVSGVLAELKDEKRKLERERPLSLLQLLGSRTHRQPLIIAVVLQLSQQLSGINAVFYYSTSIFETAGVGQPAYATIGAGVVNTVFTLVSVLLVERAGRRTLHLLGLAGMCGCAILMTVALLLLERVPAMSYVSIVAIFGFVAFFEIGPGPIPWFIVAELFSQGPRPAAMAVAGFSNWTSNFIIGMGFQYVAVGPPAPASHTVGQRWASHS

SEQ ID NO: 35914 - protein, 219 aa, Homo sapiens
  ENSP00000459056
MPSGFQQIGSEDGEPPQQRVTGTLVLAVFSAVLGSLQFGYNIGVINAPQKVIEQSYNETWLGRQGPEGPSSIPPGTLTTLWALSVAIFSVGGMISSFLIGIISQWLGRKRAMLVNNVLAVLGGSLMGLANAAASYEMLILGRFLIGAYSGAGLGVPPGHCQPVATAPGPHSATCPPAAGPAALLSREPPLPLHHPESRGACQKESEAPDRLGRCFWSAG

SEQ ID NO: 35915 - protein, 451 aa, Homo sapiens
  ENSP00000396887
MDGEPPQQRVTGTLVLAVFSAVLGSLQFGYNIGVINAPQKVIEQSYNETWLGRQGPEGPSSIPPGTLTTLWALSVAIFSVGGMISSFLIGIISQWLGRKRAMLVNNVLAVLGGSLMGLANAAASYEMLILGRFLIGAYSGLTSGLVPMYVGEIAPTHLRGALGTLNQLAIVIGILIAQVLGLESLLGTASLWPLLLGLTVLPALLQLVLLPFCPESPRYLYIIQNLEGPARKSLKRLTGWADVSGVLAELKDEKRKLERERPLSLLQLLGSRTHRQPLIIAVVLQLSQQLSGINAVFYYSTSIFETAGVGQPAYATIGAGVVNTVFTLVSVLLVERAGRRTLHLLGLAGMCGCAILMTVALLLLERVPAMSYVSIVAIFGFVAFFEIGPGPIPWFIVAELFSQGPRPAAMAVAGFSNWTSNFIIGMGFQYVAVGPPAPASHTVGQRWASHS

SEQ ID NO: 35916 - protein, 388 aa, Homo sapiens
  ENSP00000233535
MEPSPAAGGLETTRLVSPRDRGGAGGSLRLKSLFTEPSEPLPEESKPVEMPFHHCHRDPLPPPGLTPERLHARRQLYAACAVCFVFMAGEVVGGYLAHSLAIMTDAAHLLADVGSMMGSLFSLWLSTRPATRTMTFGWHRSETLGALASVVSLWMVTGILLYLAFVRLLHSDYHIEGGAMLLTASIAVCANLLMAFVLHQAGPPHSHGSRGAEYAPLEEGPEEPLPLGNTSVRAAFVHVLGDLLQSFGVLAASILIYFKPQYKAADPISTFLFSICALGSTAPTLRDVLRILMEGTPRNVGFEPVRDTLLSVPGVRATHELHLWALTLTYHVASAHLAIDSTADPEAVLAEASSRLYSRFGFSSCTLQVEQYQPEMAQCLRCQEPPQA

SEQ ID NO: 35917 - protein, 302 aa, Homo sapiens
  ENSP00000388219
  MOD_RES (1)..(1): Any amino acid
XTRLVSPRDRGGAGGSLRLKSLFTEPSEPLPEESKPVEMPFHHCHRDPLPPPGLTPERLHARRQLYAACAVCFVFMAGEVVGGYLAHSLAIMTDAAHLLADVGSMMGSLFSLWLSTRPATRTMTFGWHRSEWPLCCTRLGPPTATGLGEQSMHRWRRGLKSPCPWGTPASGRHLCTCWGTSCRALGYWLPPSSSTSSLNTRQPTPSAPSSSPSVPLDPPLPPSETFFESSWKVPPAMWGSNLCGIRCCRCQESGQPMSCTCGPLRSLTMLPLHTWPSTPPLTLKPSWLKPHPGSTPGLDSPA

SEQ ID NO: 35918 - protein, 240 aa, Homo sapiens
  ENSP00000414320
MPFHHCHRDPLPPPGLTPERLHARRQLYAACAVCFVFMAGEVVGGYLAHSLAIMTDAAHLLADVGSMMGSLFSLWLSTRPATRTMTFGWHRSETLGALASVVSLWMVTGILLYLAFVRLLHSDYHIEGGAMLLTASIAVCANLLMAFVLHQAGPPHSHGSRGAEYAPLEEGPEEPLPLGNTSVRAAFVHVLGDLLQSFGVLAASILIYFKPQYKAADPISTFLFSICALGSTAPTLRDVL

SEQ ID NO: 35919 - protein, 230 aa, Homo sapiens
  ENSP00000393545
MAQLTPGNTMGLLTVADESLFTEPSEPLPEESKPVEMPFHHCHRDPLPPPGLTPERLHARRQLYAACAVCFVFMAGEVVGGYLAHSLAIMTDAAHLLADVGSMMGSLFSLWLSTRPATRTMTFGWHRSETLGALASVVSLWMVTGILLYLAFVRLLHSDYHIEGGAMLLTASIAVCANLLMAFVLHQAGPPHSHGSRGAEYAPLEEGPEEPLPLGNTSVRAAFVHVLGDL

SEQ ID NO: 35920 - protein, 170 aa, Homo sapiens
  ENSP00000403959
MHRVVVVGRSLFTEPSEPLPEESKPVEMPFHHCHRDPLPPPGLTPERLHARRQLYAACAVCFVFMAGEVVGGYLAHSLAIMTDAAHLLADVGSMMGSLFSLWLSTRPATRTMTFGWHRSETLGALASVVSLWMVTGILLYLAFVRLLHSDYHIEGGAMLLTASIAVCANL

SEQ ID NO: 35921 - protein, 110 aa, Homo sapiens
  ENSP00000403912
MPFHHCHRDPLPPPGLTPERLHARRQLYAACAVCFVFMAGEVVGGYLAHSLAIMTDAAHLLADVGSMMGSLFSLWLSTRPATRTMTFGWHRSETLGALASVVSLWMVTGI

SEQ ID NO: 35922 - protein, 98 aa, Homo sapiens
  ENSP00000392673
MPFHHCHRDPLPPPGLTPERLHARRQLYAACAVCFVFMAGEVVGGYLAHSLAIMTDAAHLLADVGSMMGSLFSLWLSTRPATRTMTFGWHRSETLGAL

SEQ ID NO: 35923 - protein, 143 aa, Homo sapiens
  ENSP00000259392
MAMHFIFSDTAVLLFDFWSVHSPAGMALSVLVLLLLAVLYEGIKVGKAKLLNQVLVNLPTSISQQTIAETDGDSAGSDSFPVGRTHHRWYLCHFGQSLIHVIQVVIGYFIMLAVMSYNTWIFLGVVLGSAVGYYLAYPLLSTA

SEQ ID NO: 35924 - protein, 73 aa, Homo sapiens
  ENSP00000363337
MAMHFIFSDTAVLLFDFWSVHSPAGQETKAQRQEERLVQGHTAWPFRCWCSCFWLYCMKASRLAKPSCSTRYW

SEQ ID NO: 35925 - protein, 525 aa, Homo sapiens
  ENSP00000217420
MATLLRSKLSNVATSVSNKSQAKMSGMFARMGFQAATDEEAVGFAHCDDLDFEHRQGLQMDILKAEGEPCGDEGAEAPVEGDIHYQRGSGAPLPPSGSKDQVGGGGEFGGHDKPKITAWEAGWNVTNAIQGMFVLGLPYAILHGGYLGLFLIIFAAVVCCYTGKILIACLYEENEDGEVVRVRDSYVAIANACCAPRFPTLGGRVVNVAQIIELVMTCILYVVVSGNLMYNSFPGLPVSQKSWSIIATAVLLPCAFLKNLKAVSKFSLLCTLAHFVINILVIAYCLSRARDWAWEKVKFYIDVKKFPISIGIIVFSYTSQIFLPSLEGNMQQPSEFHCMMNWTHIAACVLKGLFALVAYLTWADETKEVITDNLPGSIRAVVNIFLVAKALLSYPLPFFAAVEVLEKSLFQEGSRAFFPACYSGDGRLKSWGLTLRCALVVFTLLMAIYVPHFALLMGLTGSLTGAGLCFLLPSLFHLRLLWRKLLWHQVFFDVAIFVIGGICSVSGFVHSLEGLIEAYRTNAED

SEQ ID NO: 35926 - protein, 355 aa, Homo sapiens
  ENSP00000235345
MAEVHRRQHARVKGEAPAKSSTLRDEEELGMASAETLTVFLKLLAAGFYGVSSFLIVVVNKSVLTNYRFPSSLCVGLGQMVATVAVLWVGKALRVVKFPDLDRNVPRKTFPLPLLYFGNQITGLFSTKKLNLPMFTVLRRFSILFTMFAEGVLLKKTFSWGIKMTVFAMIIGAFVAASSDLAFDLEGYAFILINDVLTAANGAYVKQKLDSKELGKYGLLYYNALFMILPTLAIAYFTGDAQKAVEFEGWADTLFLLQFTLSCVMGFILMYATVLCTQYNSALTTTIVGCIKNILITYIGMVFGGDYIFTWTNFIGLNISIAGSLVYSYITFTEEQLSKQSEANNKLDIKGKGAV

SEQ ID NO: 35927 - protein, 408 aa, Homo sapiens
  ENSP00000353557
MIPPEQPQQQLQPPSPAPPNHVVTTIENLPAEGSGGGGSLSASSRAGVRQRIRKVLNREMLISVALGQVLSLLICGIGLTSKYLSEDFHANTPVFQSFLNYILLFLVYTTTLAVRQGEENLLAILRRRWWKYMILGLIDLEANYLVVKAYQYTTLTSIQLLDCFVIPVVILLSWFFLLIRYKAVHFIGIVVCILGMGCMVGADVLVGRHQGAGENKLVGDLLVLGGATLYGISNVWEEYIIRTLSRVEFLGMIGLFGAFFSGIQLAIMEHKELLKVPWDWQIGLLYVGFSACMFGLYSFMPVVIKKTSATSVNLSLLTADLYSLFCGLFLFHYKFSGLYLLSFFTILIGLVLYSSTSTYIAQDPRVYKQFRNPSGPVVDLPTTAQVEPSVTYTSLGQETEEEPHVRVA

SEQ ID NO: 35928 - protein, 349 aa, Homo sapiens
  ENSP00000484738
MLISVALGQVLSLLICGIGLTSKYLSEDFHANTPVFQSFLNYILLFLVYTTTLAVRQGEENLLAILRRRWWKYMILGLIDLEANYLVVKAYQYTTLTSIQLLDCFVIPVVILLSWFFLLIRYKAVHFIGIVVCILGMGCMVGADVLVGRHQGAGENKLVGDLLVLGGATLYGISNVWEEYIIRTLSRVEFLGMIGLFGAFFSGIQLAIMEHKELLKVPWDWQIGLLYVGFSACMFGLYSFMPVVIKKTSATSVNLSLLTADLYSLFCGLFLFHYKFSGLYLLSFFTILIGLVLYSSTSTYIAQDPRVYKQFRNPSGPVVDLPTTAQVEPSVTYTSLGQETEEEPHVRVA

SEQ ID NO: 35929 - protein, 485 aa, Homo sapiens
  ENSP00000452086
MDVKAAPNGVATIEDRILRITGYYGYYPGYSSQKSTSRSSVTRCKPGANCPSSHSGISRQLSPLSVTEDSSAPILELQNQGSSGVCGHRVERQNRSADDGTQTHSENSSQENRIKARCLSCTSMVLKGIWGLLIILSVSSSWVGTTQIVKITYKNFYCPFFMTWFSTNWNIMFFPVYYSGHLATAQEKQSPMKKFRECSRIFGEDGLTLKLFLKRTAPFSILWTLTNYLYLLALKKLTATDVSALFCCNKAFVFLLSWIVLKDRFMGVRIVAAIMAITGIVMMAYADNFHADSIIGVAFAVGSASTSALYKVLFKMFLGSANFGEAAHFVSTLGFFNLIFISFTPVILYFTKVEHWSSFAALPWGCLCGMAGLWLAFNILVNVGVVLTYPILISIGTVLSVPGNAAVDLLKQEVIFNVVRLAATIIICIGFLLMLLPEEWDEITLRFINSLKEKKSEEHVDDVTDPSIHLRGRGRANGTVSIPLA

SEQ ID NO: 35930 - protein, 362 aa, Homo sapiens
  ENSP00000451990
MVLKGIWGLLIILSVSSSWVGTTQIVKITYKNFYCPFFMTWFSTNWNIMFFPVYYSGHLATAQEKQSPMKKFRECSRIFGEDGLTLKLFLKRTAPFSILWTLTNYLYLLALKKLTATDVSALFCCNKAFVFLLSWIVLKDRFMGVRIVAAIMAITGIVMMAYADNFHADSIIGVAFAVGSASTSALYKVLFKMFLGSANFGEAAHFVSTLGFFNLIFISFTPVILYFTKVEHWSSFAALPWGCLCGMAGLWLAFNILVNVGVVLTYPILISIGTVLSVPGNAAVDLLKQEVIFNVVRLAATIIICIGFLLMLLPEEWDEITLRFINSLKEKKSEEHVDDVTDPSIHLRGRGRANGTVSIPLA

SEQ ID NO: 35931 - protein, 151 aa, Homo sapiens
  ENSP00000450836
MVLKGIWGLLIILSVSSSWVGTTQIVKITYKNFYCPFFMTWFSTNWNIMFFPVYYSGHLATAQEKQSPMKKFRECSRIFGEDGLTLKLFLKRTAPFSILWTLTNYLYLLALKKLTATDVSALFCCNKAFVFLLSWIVLKDRFMGVRIAGKP

SEQ ID NO: 35932 - protein, 46 aa, Homo sapiens
  ENSP00000452196
  MOD_RES (1)..(1): Any amino acid
XYLLALKKLTATDVSALFCCNKAFVFLLSWIVLKDRFMGVRIAGKP

SEQ ID NO: 35933 - protein, 521 aa, Homo sapiens
  ENSP00000342518
MDELLLDLFHKLTSGRQLAAGNGLCGISHKEQEVWKPGHNILVKMRKEDKSLVWLIHSTLARYTQVTNFLGTSRSSVTRCKPGANCPSSHSGISRQLSPLSVTEDSSAPILELQNQGSSGVCGHRVERQNRSADDGTQTHSENSSQENRIKARCLSCTSMVLKGIWGLLIILSVSSSWVGTTQIVKITYKNFYCPFFMTWFSTNWNIMFFPVYYSGHLATAQEKQSPMKKFRECSRIFGEDGLTLKLFLKRTAPFSILWTLTNYLYLLALKKLTATDVSALFCCNKAFVFLLSWIVLKDRFMGVRIVAAIMAITGIVMMAYADNFHADSIIGVAFAVGSASTSALYKVLFKMFLGSANFGEAAHFVSTLGFFNLIFISFTPVILYFTKVEHWSSFAALPWGCLCGMAGLWLAFNILVNVGVVLTYPILISIGTVLSVPGNAAVDLLKQEVIFNVVRLAATIIICIGFLLMLLPEEWDEITLRFINSLKEKKSEEHVDDVTDPSIHLRGRGRANGTVSIPLA

SEQ ID NO: 35934 - protein, 487 aa, Homo sapiens
  ENSP00000381634
MMHFKSGLELTELQNMTVPEDDNISNDSNDFTEVENGQINSKFISDRESRRSLTNSHLEKKKCDEYIPGTTSLGMSVFNLSNAIMGSGILGLAFALANTGILLFLVLLTSVTLLSIYSINLLLICSKETGCMVYEKLGEQVFGTTGKFVIFGATSLQNTGAMLSYLFIVKNELPSAIKFLMGKEETFSAWYVDGRVLVVIVTFGIILPLCLLKNLGYLGYTSGFSLSCMVFFLIVVIYKKFQIPCIVPELNSTISANSTNADTCTPKYVTFNSKTVYALPTIAFAFVCHPSVLPIYSELKDRSQKKMQMVSNISFFAMFVMYFLTAIFGYLTFYDNVQSDLLHKYQSKDDILILTVRLAVIVAVILTVPVLFFTVRSSLFELAKKTKFNLCRHTVVTCILLVVINLLVIFIPSMKDIFGVVGVTSANMLIFILPSSLYLKITDQDGDKGTQRIWAALFLGLGVLFSLVSIPLVIYDWACSSSSDEGH

SEQ ID NO: 35935 - protein, 487 aa, Homo sapiens; identical to SEQ ID NO: 35934
  ENSP00000449607

SEQ ID NO: 35936 - protein, 487 aa, Homo sapiens; identical to SEQ ID NO: 35934
  ENSP00000398142

SEQ ID NO: 35937 - protein, 487 aa, Homo sapiens; identical to SEQ ID NO: 35934
  ENSP00000447853

SEQ ID NO: 35938 - protein, 503 aa, Homo sapiens
  ENSP00000449756
MMHFKSGLELTELQNMTVPEDDNISNDSNDFTEVENGQINSKFISDRESRRSLTNSHLEKKKCDEYIPGTTSLGMSVFNLSNAIMGSGILGLAFALANTGILLFLVLLTSVTLLSIYSINLLLICSKETGCMVYEKLGEQVFGTTGKFVIFGATSLQNTGAMLSYLFIVKNELPSAIKFLMGKEETFSAWYVDGRVLVVIVTFGIILPLCLLKNLGYLGYTSGFSLSCMVFFLIVVIYKKFQIPCIVPELNSTISANSTNADTCTPKYVTFNSKTVYALPTIAFAFVCHPSVLPIYSELKDRSQKKMQMVSNISFFAMFVMYFLTAIFGYLTFYDNVQSDLLHKYQSKDDILILTVRLAVIVAVILTVPVLFFTVRSSLFELAKKTKFNLCRHTVVTCILLVVINLLVIFIPSMKDIFGVVGVTSANMLIFILPSSLYLKITDQDGDKGTQRIWLFLFLQFPVQPCWLSECIILLPAALSLNMLKRKELIILCSLDSGFSNLY

SEQ ID NO: 35939 - protein, 78 aa, Homo sapiens
  ENSP00000449744
MMHFKSGLELTELQNMTVPEDDNISNDSNDFTEVENGQINSKFISDRESRRSLTNSHLEKKKCDEYIPGTTSLGMSVF

SEQ ID NO: 35940 - protein, 503 aa, Homo sapiens; identical to SEQ ID NO: 35938
  ENSP00000478907

SEQ ID NO: 35941 - protein, 1119 aa, Homo sapiens
  ENSP00000363891
MTAAAASNWGLITNIVNSIVGVSVLTMPFCFKQCGIVLGALLLVFCSWMTHQSCMFLVKSASLSKRRTYAGLAFHAYGKAGKMLVETSMIGLMLGTCIAFYVVIGDLGSNFFARLFGFQVGGTFRMFLLFAVSLCIVLPLSLQRNMMASIQSFSAMALLFYTVFMFVIVLSSLKHGLFSGQWLRRVSYVRWEGVFRCIPIFGMSFACQSQVLPTYDSLDEPSVKTMSSIFASSLNVVTTFYVMVGFFGYVSFTEATAGNVLMHFPSNLVTEMLRVGFMMSVAVGFPMMILPCRQALSTLLCEQQQKDGTFAAGGYMPPLRFKALTLSVVFGTMVGGILIPNVETILGLTGATMGSLICFICPALIYKKIHKNALSSQVVLWVGLGVLVVSTVTTLSVSEEVPEDLAEEAPGGRLGEAEGLMKVEAARLSAQDPVVAVAEDGREKPKLPKEREELEQAQIKGPVDVPGREDGKEAPEEAQLDRPGQGIAVPVGEAHRHEPPVPHDKVVVDEGQDREVPEENKPPSRHAGGKAPGVQGQMAPPLPDSEREKQEPEQGEVGKRPGQAQALEEAGDLPEDPQKVPEADGQPAVQPAKEDLGPGDRGLHPRPQAVLSEQQNGLAVGGGEKAKGGPPPGNAAGDTGQPAEDSDHGGKPPLPAEKPAPGPGLPPEPREQRDVERAGGNQAASQLEEAGRAEMLDHAVLLQVIKEQQVQQKRLLDQQEKLLAVIEEQHKEIHQQRQEDEEDKPRQVEVHQEPGAAVPRGQEAPEGKARETVENLPPLPLDPVLRAPGGRPAPSQDLNQRSLEHSEGPVGRDPAGPPDGGPDTEPRAAQAKLRDGQKDAAPRAAGTVKELPKGPEQVPVPDPAREAGGPEERLAEEFPGQSQDVTGGSQDRKKPGKEVAATGTSILKEANWLVAGPGAETGDPRMKPKQVSRDLGLAADLPGGAEGAAAQPQAVLRQPELRVISDGEQGGQQGHRLDHGGHLEMRKARGGDHVPVSHEQPRGGEDAAVQEPRQRPEPELGLKRAVPGGQRPDNAKPNRDLKLQAGSDLRRRRRDLGPHAEGQLAPRDGVIIGLNPLPDVQVNDLRGALDAQLRQAAGGALQVVHSRQLRQAPGPPEES

SEQ ID NO: 35942 - protein, 298 aa, Homo sapiens
  ENSP00000437601
GEKAKGGPPPGNAAGDTGQPAEDSDHGGKPPLPAEKPAPGPGLPPEPREQRDVERAGGNQAASQLEAEIKKIVAEAGRAEMLDHAVLLQVIKEQQVQQKRLLDQQEKLLAVIEEQHKEIHQQRQEDEEDKPRQVEVHQEPGAAVPRGQEAPEGKARETVENLPPLPLDPVLRAPGGRPAPSQDLNQRSLEHSEGPVGRDPAGPPDGGPDTEPRAAQAKLRDGQKDAAPRAAGTVKELPKGPEQVPVPDPAREAGGPEERLAEEFPGQSQDVTGGSQDRKKPGKEVAATGTSILKEANW

SEQ ID NO: 35943 - protein, 258 aa, Homo sapiens
  ENSP00000458273
  MOD_RES (1)..(1): Any amino acid
XEKAKGGPPPGNAAGDTGQPAEDSDHGGKPPLPAEKPAPGPGLPPEPREQRDVERAGGNQAASQLEAGRAEMLDHAVLLQVIKEQQVQQKRLLDQQEKLLAVIEEQHKEIHQQRQEDEEDKPRQVEVHQEPGAAVPRGQEAPEGKARETVENLPPLPLDPVLRAPGGRPAPSQDLNQRSLEHSEGPVGRDPAGPPDGGPDTEPRAAQAKLRDGQKDAAPRAAGTVKELPKGPEQVPVPDPAREAGGPEERLAEEFPGQ

SEQ ID NO: 35944 - protein, 780 aa, Homo sapiens
  ENSP00000288439
MTAAAASNWGLITNIVNSIVGVSVLTMPFCFKQCGIVLGALLLVFCSWMTHQSCMFLVKSASLSKRRTYAGLAFHAYGKAGKMLVETSMIGLMLGTCIAFYVVIGDLGSNFFARLFGFQVGGTFRMFLLFAVSLCIVLPLSLQRNMMASIQSFSAMALLFYTVFMFVIVLSSLKHGLFSGQWLRRVSYVRWEGVFRCIPIFGMSFACQSQVLPTYDSLDEPSVKTMSSIFASSLNVVTTFYVMVGFFGYVSFTEATAGNVLMHFPSNLVTEMLRVGFMMSVAVGFPMMILPCRQALSTLLCEQQQKDGTFAAGGYMPPLRFKALTLSVVFGTMVGGILIPNVETILGLTGATMGSLICFICPALIYKKIHKNALSSQVVLWVGLGVLVVSTVTTLSVSEEVPEDLAEEAPGGRLGEAEGLMKVEAARLSAQDPVVAVAEDGREKPKLPKEREELEQAQIKGPVDVPGREDGKEAPEEAQLDRPGQGIAVPVGEAHRHEPPVPHDKVVVDEGQDREVPEENKPPSRHAGGKAPGVQGQMAPPLPDSEREKQEPEQGEVGKRPGQAQALEEAGDLPEDPQKVPEADGQPAVQPAKEDLGPGDRGLHPRPQAVLSEQQNGLAVGGGEKAKGGPPPGNAAGDTGQPAEDSDHGGKPPLPAEKPAPGPGLPPEPREQRDVERAGGNQAASQLEGKASALQPPASGPGSGSPLPQPWGDAQVILGSPARPPFSFQPPAEQTPRRAFCSLPISSLLSGNLLSALLPFKHLRHRHMACDYRFISLAPL

SEQ ID NO: 35945 - protein, 70 aa, Homo sapiens
  ENSP00000444523
  MOD_RES (1)..(1): Any amino acid
XQRNMMASIQSFSAMALLFYTVFMFVIVLSSLKHGLFSGQWLRRVSYVRWEGVFRCIPIFGMSFACQSAL

SEQ ID NO: 35946 - protein, 119 aa, Homo sapiens
  ENSP00000439115
MTHQSCMFLVKSASLSKRRTYAGLAFHAYGKAGKMLVETSMIGLMLGTCIAFYVVIGDLGSNFFARLFGFQVGGTFRMFLLFAVSLCIVLPLSLQRNMMASIQSFSAMALLFYTVFMFV

SEQ ID NO: 35947 - protein, 472 aa, Homo sapiens
  ENSP00000471683
MELQDPKMNGALPSDAVGYRQEREGFLPSRGPAPGSKPVQFMDFEGKTSFGMSVFNLSNAIMGSGILGLAYAMAHTGVIFFLALLLCIALLSSYSIHLLLTCAGIAGIRAYEQLGQRAFGPAGKVVVATVICLHNVGAMSSYLFIIKSELPLVIGTFLYMDPEGDWFLKGNLLIIIVSVLIILPLALMKHLGYLGYTSGLSLTCMLFFLVSVIYKKFQLGCAIGHNETAMESEALVGLPSQGLNSSCEAQMFTVDSQMSYTVPIMAFAFVCHPEVLPIYTELCRPSKRRMQAVANVSIGAMFCMYGLTATFGYLTFYSSVKAEMLHMYSQKDPLILCVRLAVLLAVTLTVPVVLFPIRRALQQLLFPGKAFSWPRHVAIALILLVLVNVLVICVPTIRDIFGVIGSTSAPSLIFILPSIFYLRIVPSEVEPFLSWPKIQALCFGVLGVLFMAVSLGFMFANWATGQSRMSGH

SEQ ID NO: 35948 - protein, 421 aa, Homo sapiens
  ENSP00000478807
MSVFNLSNAIMGSGILGLAYAMAHTGVIFFLALLLCIALLSSYSIHLLLTCAGIAGIRAYEQLGQRAFGPAGKVVVATVICLHNVGAMSSYLFIIKSELPLVIGTFLYMDPEGDWFLKGNLLIIIVSVLIILPLALMKHLGYLGYTSGLSLTCMLFFLVSVIYKKFQLGCAIGHNETAMESEALVGLPSQGLNSSCEAQMFTVDSQMSYTVPIMAFAFVCHPEVLPIYTELCRPSKRRMQAVANVSIGAMFCMYGLTATFGYLTFYSSVKAEMLHMYSQKDPLILCVRLAVLLAVTLTVPVVLFPIRRALQQLLFPGKAFSWPRHVAIALILLVLVNVLVICVPTIRDIFGVIGSTSAPSLIFILPSIFYLRIVPSEVEPFLSWPKIQALCFGVLGVLFMAVSLGFMFANWATGQSRMSGH

SEQ ID NO: 35949 - protein, 29 aa, Homo sapiens
  ENSP00000482638
  MOD_RES (1)..(1): Any amino acid
XALLLCIALLSSYSIHLLLTCAGIAGTGS

SEQ ID NO: 35950 - protein, 279 aa, Homo sapiens
  ENSP00000402988
MELQDPKMNGALPSDAVGYRQEREGFLPSRGPAPGSKPVQFMDFEGKTSFGMSVFNLSNAIMGSGILGLAYAMAHTGVIFFLALLLCIALLSSYSIHLLLTCAGIAGIRAYEQLGQRAFGPAGKVVVATVICLHNVGAMSSYLFIIKSELPLVIGTFLYMDPEGDWFLKGNLLIIIVSVLIILPLALMKHLGYLGYTSGLSLTCMLFFLVSVIYKKFQLGCAIGHNETAMESEALVGLPSQGLNSSCEAQMFTVDSQMSYTVPIMAFAFVCHPEVLPIY

SEQ ID NO: 35951 - protein, 272 aa, Homo sapiens
  ENSP00000407258
MELQDPKMNGALPSDAVGYRQEREGFLPSRGPAPGSKPVQFMDFEGKTSFGMSVFNLSNAIMGSGILGLAYAMAHTGVIFFLALLLCIALLSSYSIHLLLTCAGIAGIRAYEQLGQRAFGPAGKVVVATVICLHNVGAMSSYLFIIKSELPLVIGTFLYMDPEGDWFLKGNLLIIIVSVLIILPLALMKHLGYLGYTSGLSLTCMLFFLVSVIYKKFQLGCAIGHNETAMESEALVGLPSQGLNSSCEAQMFTVDSQMSYTVPIMAFAFVCH

SEQ ID NO: 35952 - protein, 218 aa, Homo sapiens
  ENSP00000403976
MELQDPKMNGALPSDAVGYRQEREGFLPSRGPAPGSKPVQFMDFEGKTSFGMSVFNLSNAIMGSGILGLAYAMAHTGVIFFLALLLCIALLSSYSIHLLLTCAGIAGIRAYEQLGQRAFGPAGKVVVATVICLHNVGAMSSYLFIIKSELPLVIGTFLYMDPEGDWFLKGNLLIIIVSVLIILPLALMKHLGYLGYTSGLSLTCMLFFLVSVIYKKFQ

SEQ ID NO: 35953 - protein, 191 aa, Homo sapiens
  ENSP00000389644
MELQDPKMNGALPSDAVGYRQEREGFLPSRGPAPGSKPVQFMDFEGKTSFGMSVFNLSNAIMGSGILGLAYAMAHTGVIFFLALLLCIALLSSYSIHLLLTCAGIAGIRAYEQLGQRAFGPAGKVVVATVICLHNVGAMSSYLFIIKSELPLVIGTFLYMDPEGDWFLKGNLLIIIVSVLIILPLALMKHL

SEQ ID NO: 35954 - protein, 163 aa, Homo sapiens
  ENSP00000483716
MELQDPKMNGALPSDAVGYRQEREGFLPSRGPAPGSKPVQFMDFEGKTSFGMSVFNLSNAIMGSGILGLAYAMAHTGVIFFLALLLCIALLSSYSIHLLLTCAGIAGIRAYEQLGQRAFGPAGKVVVATVICLHNVGAMSSYLFIIKSELPLVIGTFLYMDPE

SEQ ID NO: 35955 - protein, 163 aa, Homo sapiens; identical to SEQ ID NO: 35954
  ENSP00000416948

SEQ ID NO: 35956 - protein, 472 aa, Homo sapiens; identical to SEQ ID NO: 35947
  ENSP00000481291

SEQ ID NO: 35957 - protein, 403 aa, Homo sapiens
  ENSP00000484236
MLGPCPVTCSSSNLSSPWLSAPSCTWTPRGDWFLKGNLLIIIVSVLIILPLALMKHLGYLGYTSGLSLTCMLFFLVSVIYKKFQLGCAIGHNETAMESEALVGLPSQGLNSSCEAQMFTVDSQMSYTVPIMAFAFVCHPEVLPIYTELCRPSKRRMQAVANVSIGAMFCMYGLTATFGYLTFYSSVKAEMLHMYSQKDPLILCVRLAVLLAVTLTVPVVLFPIRRALQQLLFPGKAFSWPRHVAIALILLVLVNVLVICVPTIRDIFGVIGSTSAPSLIFILPSIFYLRIVPSEVEPFLSWPKIQALCFGVLGVLFMAVSLGFMFANWATGRAACLDTDQALLAQVPVRMHMEGSGPLPRVPPAQHVEVAGSHERGCQRRGTAEAADWPTSLLPRDAKLGSWP

SEQ ID NO: 35958 - protein, 462 aa, Homo sapiens
  ENSP00000454646
MAQVSINNDYSEWDLSTDAGERARLLQSPCVDTAPKSEWEASPGGLDRGTTSTLGAIFIVVNACLGAGLLNFPAAFSTAGGVAAGIALQMGMLVFIISGLVILAYCSQASNERTYQEVVWAVCGKLTGVLCEVAIAVYTFGTCIAFLIIIGDQQDKIIAVMAKEPEGASGPWYTDRKFTISLTAFLFILPLSIPREIGFQKYASFLSVVGTWYVTAIVIIKYIWPDKEMTPGNILTRPASWMAVFNAMPTICFGFQCHVSSVPVFNSMQQPEVKTWGGVVTAAMVIALAVYMGTGICGFLTFGAAVDPDVLLSYPSEDMAVAVARAFIILSVLTSYPILHFCGRAVVEGLWLRYQGVPVEEDVGRERRRRVLQTLVWFLLTLLLALFIPDIGKVISVIGGLAACFIFVFPGLCLIQAKLSEMEEVKPASWWVLVSYGVLLVTLGAFIFGQTTANAIFVDLLA

SEQ ID NO: 35959 - protein, 462 aa, Homo sapiens; identical to SEQ ID NO: 35958
  ENSP00000219320

SEQ ID NO: 35960 - protein, 354 aa, Homo sapiens
  ENSP00000454325
MAQVSINNDYSEWDLSTDAGERARLLQSPCVDTAPKSEWEASPGGLDRGTTSTLGAIFIVVNACLGAGLLNFPAAFSTAGGVAAGIALQMGMLVFIISGLVILAYCSQASNERTYQEVVWAVCGKLTGVLCEVAIAVYTFGTCIAFLIIIGDQQDKIIAVMAKEPEGASGPWYTDRKFTISLTAFLFILPLSIPREIGFQKYASFLSVVGTWYVTAIVIIKYIWPDKEMTPGNILTRPASWMAVFNAMPTICFGFQCHVSSVPVFNSMQQPEVKTWGGVVTAAMVIALAVYMGTAGGCWSATESSWSPWEPSSSARPQPTPSLWISWHNHCLPGNTRPLPLVAGTHLLELWGHS

SEQ ID NO: 35961 - protein, 260 aa, Homo sapiens
  ENSP00000455119
MAQVSINNDYSEWDLSTDAGERARLLQSPCVDTAPKSEWEASPGGLDRGTTSTLGAIFIVVNACLGAGLLNFPAAFSTAGGVAAGIALQMGMLVFIISGLVILAYCSQASNERTYQEVVWAVCGKLTGVLCEVAIAVYTFGTCIAFLIIIGDQQDKIIAVMAKEPEGASGPWYTDRKFTISLTAFLFILPLSIPREIGFQKYASFLSVVGTWYVTAIVIIKYIWPDKEMTPGNILTRPASWMAVFNAMPTICFGFQHAAA

SEQ ID NO: 35962 - protein, 373 aa, Homo sapiens
  ENSP00000455362
MGMLVFIISGLVILAYCSQASNERTYQEVVWAVCGKLTGVLCEVAIAVYTFGTCIAFLIIIGDQQDKIIAVMAKEPEGASGPWYTDRKFTISLTAFLFILPLSIPREIGFQKYASFLSVVGTWYVTAIVIIKYIWPDKEMTPGNILTRPASWMAVFNAMPTICFGFQCHVSSVPVFNSMQQPEVKTWGGVVTAAMVIALAVYMGTGICGFLTFGAAVDPDVLLSYPSEDMAVAVARAFIILSVLTSYPILHFCGRAVVEGLWLRYQGVPVEEDVGRERRRRVLQTLVWFLLTLLLALFIPDIGKVISVIGGLAACFIFVFPGLCLIQAKLSEMEEVKPASWWVLVSYGVLLVTLGAFIFGQTTANAIFVDLLA

SEQ ID NO: 35963 - protein, 170 aa, Homo sapiens
  ENSP00000457988
  MOD_RES (1)..(1): Any amino acid
XIAVYTFGTCIAFLIIIGDQQDKIIAVMAKEPEGASGPWYTDRKFTISLTAFLFILPLSIPREIGFQKYASFLSVVGTWYVTAIVIIKYIWPDKEMTPGNILTRPASWMAVFNAMPTICFGFQCHVSSVPVFNSMQQPEVKTWGGVVTAAMVIALAVYMGTAETRSHYVA

SEQ ID NO: 35964 - protein, 65 aa, Homo sapiens
  ENSP00000456464
MTPGNILTRPASWMAVFNAMPTICFGFQCHVSSVPVFNSMQQPEVKTWGGVVTAAMVIALAVYMG

SEQ ID NO: 35965 - protein, 140 aa, Homo sapiens
  ENSP00000455490
MAQVSINNDYSEWDLSTDAGERARLLQSPCVDTAPKSEWEASPGGLDRGTTSTLGAIFIVVNACLGAGLLNFPAAFSTAGGVAAGIALQMGMLVFIISGLVILAYCSQASNERTYQEVVWAVCGKLTGVLCEVAIAVYTF

SEQ ID NO: 35966 - protein, 94 aa, Homo sapiens
  ENSP00000454734
MAQVSINNDYSEWDLSTDAGERARLLQSPCVDTAPKSEWEASPGGLDRGTTSTLGAIFIVVNACLGAGLLNFPAAFSTAGGVAAGIALQMGMLV

SEQ ID NO: 35967 - protein, 135 aa, Homo sapiens
  ENSP00000457462
MAQVSINNDYSEWDLSTDAGERARLLQSPCVDTAPKSEWEASPGGLDRGTTSTLGAIFIVVNACLGAGLLNFPAAFSTAGGVAAGIALQMVSALAGRAEVQFSWALCLKREASGQGWPVSDTRTALPSLTHGRHD

SEQ ID NO: 35968 - protein, 654 aa, Homo sapiens
  ENSP00000366591
MCFRTKLSVSWVPLFLLLSRVFSTETDKPSAQDSRSRGSSGQPADLLQVLSAGDHPPHNHSRSLIKTLLEKTGCPRRRNGMQGDCNLCFEPDALLLIAGGNFEDQLREEVVQRVSLLLLYYIIHQEEICSSKLNMSNKEYKFYLHSLLSLRQDEDSSFLSQNETEDILAFTRQYFDTSQSQCMETKTLQKKSGIVSSEGANESTLPQLAAMIITLSLQGVCLGQGNLPSPDYFTEYIFSSLNRTNTLRLSELDQLLNTLWTRSTCIKNEKIHQFQRKQNNIITHDQDYSNFSSSMEKESEDGPVSWDQTCFSARQLVEIFLQKGLSLISKEDFKQMSPGIIQQLLSCSCHLPKDQQAKLPPTTLEKYGYSTVAVTLLTLGSMLGTALVLFHSCEENYRLILQLFVGLAVGTLSGDALLHLIPQVLGLHKQEAPEFGHFHESKGHIWKLMGLIGGIHGFFLIEKCFILLVSPNDKKSPEDSQAAEMPIGSMTASNRKCKAISLLAIMILVGDSLHNFADGLAIGAAFSSSSESGVTTTIAILCHEIPHEMGDFAVLLSSGLSMKTAILMNFISSLTAFMGLYIGLSVSADPCVQDWIFTVTAGMFLYLSLVEMLPEMTHVQTQRPWMMFLLQNFGLILGWLSLLLLAIYEQNIKI

SEQ ID NO: 35969 - protein, 690 aa, Homo sapiens
  ENSP00000366588
MCFRTKLSVSWVPLFLLLSRVFSTETDKPSAQDSRSRGSSGQPADLLQVLSAGDHPPHNHSRSLIKTLLEKTGCPRRRNGMQGDCNLCFEPDALLLIAGGNFEDQLREEVVQRVSLLLLYYIIHQEEICSSKLNMSNKEYKFYLHSLLSLRQDEDSSFLSQNETEDILAFTRQYFDTSQSQCMETKTLQKKSGIVSSEGANESTLPQLAAMIITLSLQGVCLGQGNLPSPDYFTEYIFSSLNRTNTLRLSELDQLLNTLWTRSTCIKNEKIHQFQRKQNNIITHDQDYSNFSSSMEKESEDGPVSWDQTCFSARQLVEIFLQKGLSLISKEDFKQMSPGIIQQLLSCSCHLPKDQQAKLPPTTLEKYGYSTVAVTLLTLGSMLGTALVLFHSCEENYRLILQLFVGLAVGTLSGDALLHLIPQVLGLHKQEAPEFGHFHESKGHIWKLMGLIGGIHGFFLIEKCFILLVSPNDKGLSLVNGHVGHSHHLALNSELSDQAGRGKSASTIQLKSPEDSQAAEMPIGSMTASNRKCKAISLLAIMILVGDSLHNFADGLAIGAAFSSSSESGVTTTIAILCHEIPHEMGDFAVLLSSGLSMKTAILMNFISSLTAFMGLYIGLSVSADPCVQDWIFTVTAGMFLYLSLVEMLPEMTHVQTQRPWMMFLLQNFGLILGWLSLLLLAIYEQNIKI

SEQ ID NO: 35970 - protein, 557 aa, Homo sapiens
  ENSP00000440445
MSNKEYKFYLHSLLSLRQDEDSSFLSQNETEDILAFTRQYFDTSQSQCMETKTLQKKSGIVSSEGANESTLPQLAAMIITLSLQGVCLGQGNLPSPDYFTEYIFSSLNRTNTLRLSELDQLLNTLWTRSTCIKNEKIHQFQRKQNNIITHDQDYSNFSSSMEKESEDGPVSWDQTCFSARQLVEIFLQKGLSLISKEDFKQMSPGIIQQLLSCSCHLPKDQQAKLPPTTLEKYGYSTVAVTLLTLGSMLGTALVLFHSCEENYRLILQLFVGLAVGTLSGDALLHLIPQVLGLHKQEAPEFGHFHESKGHIWKLMGLIGGIHGFFLIEKCFILLVSPNDKQGLSLVNGHVGHSHHLALNSELSDQAGRGKSASTIQLKSPEDSQAAEMPIGSMTASNRKCKAISLLAIMILVGDSLHNFADGLAIGAAFSSSSESGVTTTIAILCHEIPHEMGDFAVLLSSGLSMKTAILMNFISSLTAFMGLYIGLSVSADPCVQDWIFTVTAGMFLYLSLVEMLPEMTHVQTQRPWMMFLLQNFGLILGWLSLLLLAIYEQNIKI

SEQ ID NO: 35971 - protein, 691 aa, Homo sapiens
  ENSP00000366586
MCFRTKLSVSWVPLFLLLSRVFSTETDKPSAQDSRSRGSSGQPADLLQVLSAGDHPPHNHSRSLIKTLLEKTGCPRRRNGMQGDCNLCFEPDALLLIAGGNFEDQLREEVVQRVSLLLLYYIIHQEEICSSKLNMSNKEYKFYLHSLLSLRQDEDSSFLSQNETEDILAFTRQYFDTSQSQCMETKTLQKKSGIVSSEGANESTLPQLAAMIITLSLQGVCLGQGNLPSPDYFTEYIFSSLNRTNTLRLSELDQLLNTLWTRSTCIKNEKIHQFQRKQNNIITHDQDYSNFSSSMEKESEDGPVSWDQTCFSARQLVEIFLQKGLSLISKEDFKQMSPGIIQQLLSCSCHLPKDQQAKLPPTTLEKYGYSTVAVTLLTLGSMLGTALVLFHSCEENYRLILQLFVGLAVGTLSGDALLHLIPQVLGLHKQEAPEFGHFHESKGHIWKLMGLIGGIHGFFLIEKCFILLVSPNDKQGLSLVNGHVGHSHHLALNSELSDQAGRGKSASTIQLKSPEDSQAAEMPIGSMTASNRKCKAISLLAIMILVGDSLHNFADGLAIGAAFSSSSESGVTTTIAILCHEIPHEMGDFAVLLSSGLSMKTAILMNFISSLTAFMGLYIGLSVSADPCVQDWIFTVTAGMFLYLSLVEMLPEMTHVQTQRPWMMFLLQNFGLILGWLSLLLLAIYEQNIKI

SEQ ID NO: 35972 - protein, 513 aa, Homo sapiens
  ENSP00000356105
MSSKPEPKDVHQLNGTGPSASPCSSDGPGREPLAGTSEFLGPDGAGVEVVIESRANAKGVREEDALLENGSQSNESDDVSTDRGPAPPSPLKETSFSIGLQVLFPFLLAGFGTVAAGMVLDIVQHWEVFQKVTEVFILVPALLGLKGNLEMTLASRLSTAANIGHMDTPKELWRMITGNMALIQVQATVVGFLASIAAVVFGWIPDGHFSIPHAFLLCASSVATAFIASLVLGMIMIGVIIGSRKIGINPDNVATPIAASLGDLITLALLSGISWGLYLELNHWRYIYPLVCAFFVALLPVWVVLARRSPATREVLYSGWEPVIIAMAISSVGGLILDKTVSDPNFAGMAVFTPVINGVGGNLVAVQASRISTFLHMNGMPGENSEQAPRRCPSPCTTFFSPDVNSRSARVLFLLVVPGHLVFLYTISCMQGGHTTLTLIFIIFYMTAALLQVLILLYIADWMVHWMWGRGLDPDNFSIPYLTALGDLLGTGLLALSFHVLWLIGDRDTDVGD

SEQ ID NO: 35973 - protein, 569 aa, Homo sapiens
  ENSP00000488355
MAPTLATAHRRRWWMACTAVLENLLFSAVLLGWGSLLIMLKSEGFYSYLCTEPENVTNGTVGGTAEPGHEEVSWMNGWLSCQAQDEMLNLAFTVGSFLLSAITLPLGIVMDKYGPRKLRLLGSACFAVSCLLIAYGASKPNALSVLIFIALALNGFGGMCMTFTSLTLPNMFGDLRSTFIALMIGSYASSAVTFPGIKLIYDAGVSFIVVLVVWAGCSGLVFLNCFFNWPLEPFPGPEDMDYSVKIKFSWLGFDHKITGKQFYKQVTTVGRRLSVGSSMRSAKEQVALQEGHKLCLSTVDLEVKCQPDAAVAPSFMHSVFSPILLLSLVTMCVTQLRLIFYMGAMNNILKFLVSGDQKTVGLYTSIFGVLQLLCLLTAPVIGYIMDWRLKECEDASEEPEEKDANQGEKKKKKRDRQIQKITNAMRAFAFTNLLLVGFGVTCLIPNLPLQILSFILHTIVRGFIHSAVGGLYAAVYPSTQFGSLTGLQSLISALFALLQQPLFLAMMGPLQGDPLWVNVGLLLLSLLGFCLPLYLICYRRQLERQLQQRQEDDKLFLKINGSSNQEAFV

SEQ ID NO: 35974 - protein, 573 aa, Homo sapiens
  ENSP00000483848
MAPTLATAHRRRWWMACTAVLENLLFSAVLLGWGSLLIMLKSEGFYSYLCTEPENVTNGTVGGTAEPGHEEVSWMNGWLSCQAQDEMLNLAFTVGSFLLSAITLPLGIVMDKYGPRKLRLLGSACFAVSCLLIAYGASKPNALSVLIFIALALNGFGGMCMTFTSLTLPNMFGDLRSTFIALMIGSYASSAVTFPGIKLIYDAGVSFIVVLVVWAGCSGLVFLNCFFNWPLEPFPGPEDMDYSVKIKFSWLGFDHKITGKQFYKQVTTVGRRLSVGSSMRSAKEQVALQEGHKLCLSTVDLEVKCQPDAAVAPSFMHSVFSPILLLSLVTMCVTQLRLIFYMGAMNNILKFLVSGDQKTVMATVGLYTSIFGVLQLLCLLTAPVIGYIMDWRLKECEDASEEPEEKDANQGEKKKKKRDRQIQKITNAMRAFAFTNLLLVGFGVTCLIPNLPLQILSFILHTIVRGFIHSAVGGLYAAVYPSTQFGSLTGLQSLISALFALLQQPLFLAMMGPLQGDPLWVNVGLLLLSLLGFCLPLYLICYRRQLERQLQQRQEDDKLFLKINGSSNQEAFV

SEQ ID NO: 35975 - protein, 432 aa, Homo sapiens
  ENSP00000371582
MTYGSPQANASPSDAVALDHGEVSRRQQQELPNMFGDLRSTFIALMIGSYASSAVTFPGIKLIYDAGVSFIVVLVVWAGCSGLVFLNCFFNWPLEPFPGPEDMDYSVKIKFSWLGFDHKITGKQFYKQVTTVGRRLSVGSSMRSAKEQVALQEGHKLCLSTVDLEVKCQPDAAVAPSFMHSVFSPILLLSLVTMCVTQLRLIFYMGAMNNILKFLVSGDQKTVGLYTSIFGVLQLLCLLTAPVIGYIMDWRLKECEDASEEPEEKDANQGEKKKKKRDRQIQKITNAMRAFAFTNLLLVGFGVTCLIPNLPLQILSFILHTIVRGFIHSAVGGLYAAVYPSTQFGSLTGLQSLISALFALLQQPLFLAMMGPLQGDPLWVNVGLLLLSLLGFCLPLYLICYRRQLERQLQQRQEDDKLFLKINGSSNQEAFV

SEQ ID NO: 35976 - protein, 62 aa, Homo sapiens
  ENSP00000488706
MAPTLATAHRRRWWMACTAVLENLLFSAVLLGWGSLLIMLKSEGFYSYLCTEPAPASRFPAC

SEQ ID NO: 35977 - protein, 56 aa, Homo sapiens
  ENSP00000487944
MTYGSPQANASPSDAVALDHGEVSRRQQQESCGSCQRTLPSLAMPRSSLTRRFSLL

SEQ ID NO: 35978 - protein, 109 aa, Homo sapiens
  ENSP00000487841
MAPTLATAHRRRWWMACTAVLENLLFSAVLLGWGSLLIMLKSEGFYSYLCTEPENVTNGTVGGTAEPGHEECHHPAPGYRHGQVWPEEAQAAGQRLLRGFLLADCVRSK

SEQ ID NO: 35979 - protein, 573 aa, Homo sapiens; identical to SEQ ID NO: 35974
  ENSP00000484291

SEQ ID NO: 35980 - protein, 569 aa, Homo sapiens; identical to SEQ ID NO: 35973
  ENSP00000301335

SEQ ID NO: 35981 - protein, 573 aa, Homo sapiens; identical to SEQ ID NO: 35974
  ENSP00000461382

SEQ ID NO: 35982 - protein, 432 aa, Homo sapiens; identical to SEQ ID NO: 35975
  ENSP00000408284

SEQ ID NO: 35983 - protein, 62 aa, Homo sapiens; identical to SEQ ID NO: 35976
  ENSP00000461298

SEQ ID NO: 35984 - protein, 56 aa, Homo sapiens; identical to SEQ ID NO: 35977
  ENSP00000460388

SEQ ID NO: 35985 - protein, 109 aa, Homo sapiens; identical to SEQ ID NO: 35978
  ENSP00000461553

SEQ ID NO: 35986 - protein, 491 aa, Homo sapiens
  ENSP00000378555
MAGQGLPLHVATLLTGLLECLGFAGVLFGWPSLVFVFKNEDYFKDLCGPDAGPIGNATGQADCKAQDERFSLIFTLGSFMNNFMTFPTGYIFDRFKTTVARLIAIFFYTTATLIIAFTSAGSAVLLFLAMPMLTIGGILFLITNLQIGNLFGQHRSTIITLYNGAFDSSSAVFLIIKLLYEKGISLRASFIFISVCSTWHVARTFLLMPRGHIPYPLPPNYSYGLCPGNGTTKEEKETAEHENRELQSKEFLSAKEETPGAGQKQELRSFWSYAFSRRFAWHLVWLSVIQLWHYLFIGTLNSLLTNMAGGDMARVSTYTNAFAFTQFGVLCAPWNGLLMDRLKQKYQKEARKTGSSTLAVALCSTVPSLALTSLLCLGFALCASVPILPLQYLTFILQVISRSFLYGSNAAFLTLAFPSEHFGKLFGLVMALSAVVSLLQFPIFTLIKGSLQNDPFYVNVMFMLAILLTFFHPFLVYRECRTWKESPSAIA

SEQ ID NO: 35987 - protein, 491 aa, Homo sapiens; identical to SEQ ID NO: 35986
  ENSP00000378556

SEQ ID NO: 35988 - protein, 491 aa, Homo sapiens; identical to SEQ ID NO: 35986
  ENSP00000337561

SEQ ID NO: 35989 - protein, 491 aa, Homo sapiens; identical to SEQ ID NO: 35986
  ENSP00000436254

SEQ ID NO: 35990 - protein, 137 aa, Homo sapiens
  ENSP00000433078
  MOD_RES (1)..(1): Any amino acid
XTTKEEKETAEHENRELQSKEFLSAKEETPGAGQKQELRSFWSYAFSRRFAWHLVWLSVIQLWHYLFIGTLNSLLTNMAGGDMARVSTYTNAFAFTQFGVLCAPWNGLLMDRLKQKYQKEARKTVSLQSTLASSLGW

SEQ ID NO: 35991 - protein, 504 aa, Homo sapiens
  ENSP00000434515
MAGQGLPLHVATLLTGLLECLGFAGVLFGWPSLVFVFKNEDYFKDLCGPDAGPIGNATGQAGRLGCMGDLFSTPDCKAQDERFSLIFTLGSFMNNFMTFPTGYIFDRFKTTVARLIAIFFYTTATLIIAFTSAGSAVLLFLAMPMLTIGGILFLITNLQIGNLFGQHRSTIITLYNGAFDSSSAVFLIIKLLYEKGISLRASFIFISVCSTWHVARTFLLMPRGHIPYPLPPNYSYGLCPGNGTTKEEKETAEHENRELQSKEFLSAKEETPGAGQKQELRSFWSYAFSRRFAWHLVWLSVIQLWHYLFIGTLNSLLTNMAGGDMARVSTYTNAFAFTQFGVLCAPWNGLLMDRLKQKYQKEARKTGSSTLAVALCSTVPSLALTSLLCLGFALCASVPILPLQYLTFILQVISRSFLYGSNAAFLTLAFPSEHFGKLFGLVMALSAVVSLLQFPIFTLIKGSLQNDPFYVNVMFMLAILLTFFHPFLVYRECRTWKESPSAIA

SEQ ID NO: 35992 - protein, 331 aa, Homo sapiens
  ENSP00000435893
MAGQGLPLHVATLLTGLLECLGFAGVLFGWPSLVFVFKNEDYFKDLCGPDAGPIGNATGQADCKAQDERFSLIFTLGSFMNNFMTFPTGYIFDRFKTTVARLIAIFFYTTATLIIAFTSAGSAVLLFLAMPMLTIGGILFLITNLQIGNLFGQHRSTIITLYNGAFDSSSAVFLIIKLLYEKGISLRASFIFISVCSTWHVARTFLLMPRGHIPYPLPPNYSYGLCPGNGTTKEEKETAEHENRELQSKEFLSAKEETPGAGQKQELRSFWSYAFSRRFAWHLVWLSVIQLWHYLFIGTLNSLLTNMAGGDMARVSTYTNAFAFTQFGVLC

SEQ ID NO: 35993 - protein, 126 aa, Homo sapiens
  ENSP00000434293
MGDLFSTPDCKAQDERFSLIFTLGSFMNNFMTFPTGYIFDRFKTTVARLIAIFFYTTATLIIAFTSAGSAVLLFLAMPMLTIGGILFLITNLQIGNLFGQHRSTIITLYNGAFDSSSAVFLIIKLL

SEQ ID NO: 35994 - protein, 169 aa, Homo sapiens
  ENSP00000436055
MAGQGLPLHVATLLTGLLECLGFAGVLFGWPSLVFVFKNEDYFKDLCGPDAGPIGNATGQADCKAQDERFSLIFTLGSFMNNFMTFPTGYIFDRFKTTVARLIAIFFYTTATLIIAFTSAGSAVLLFLAMPMLTIGGILFLITNLQIGNLFGQHRSTIITLYNGAFDSS

SEQ ID NO: 35995 - protein, 148 aa, Homo sapiens
  ENSP00000434913
MAGQGLPLHVATLLTGLLECLGFAGVLFGWPSLVFVFKNEDYFKDLCGPDAGPIGNATGQADCKAQDERFSLIFTLGSFMNNFMTFPTGYIFDRFKTTVARLIAIFFYTTATLIIAFTSAGSAVLLFLAMPMLTIGGILFLITNLQIG

SEQ ID NO: 35996 - protein, 133 aa, Homo sapiens
  ENSP00000435273
MAGQGLPLHVATLLTGLLECLGFAGVLFGWPSLVFVFKNEDYFKDLCGPDAGPIGNATGQAGRLGCMGDLFSTPDCKAQDERFSLIFTLGSFMNNFMTFPTGYIFDRFKTTVARLIAIFFYTTATLIIAFTSA

SEQ ID NO: 35997 - protein, 119 aa, Homo sapiens
  ENSP00000433974
MAGQGLPLHVATLLTGLLECLGFAGVLFGWPSLVFVFKNEDYFKDLCGPDAGPIGNATGQADCKAQDERFSLIFTLGSFMNNFMTFPTGYIFDRFKTTVARLIAIFFYTTATLIIAFTS

SEQ ID NO: 35998 - protein, 109 aa, Homo sapiens
  ENSP00000431762
MAGQGLPLHVATLLTGLLECLGFAGVLFGWPSLVFVFKNEDYFKDLCGPDAGPIGNATGQADCKAQDERFSLIFTLGSFMNNFMTFPTGYIFDRFKTTVARLIAIFFYT

SEQ ID NO: 35999 - protein, 107 aa, Homo sapiens
  ENSP00000435156
MAGQGLPLHVATLLTGLLECLGFAGVLFGWPSLVFVFKNEDYFKDLCGPDAGPIGNATGQADCKAQDERFSLIFTLGSFMNNFMTFPTGYIFDRFKTTVARLIAIFF

SEQ ID NO: 36000 - protein, 101 aa, Homo sapiens
  ENSP00000434569
MAGQGLPLHVATLLTGLLECLGFAGVLFGWPSLVFVFKNEDYFKDLCGPDAGPIGNATGQADCKAQDERFSLIFTLGSFMNNFMTFPTGYIFDRFKTTVAR

SEQ ID NO: 36001 - protein, 97 aa, Homo sapiens
  ENSP00000435109
MAGQGLPLHVATLLTGLLECLGFAGVLFGWPSLVFVFKNEDYFKDLCGPDAGPIGNATGQADCKAQDERFSLIFTLGSFMNNFMTFPTGYIFDRFKT

SEQ ID NO: 36002 - protein, 78 aa, Homo sapiens
  ENSP00000435490
MAGQGLPLHVATLLTGLLECLGFAGVLFGWPSLVFVFKNEDYFKDLCGPDAGPIGNATGQADCKAQDERFSLIFTLGS

SEQ ID NO: 36003 - protein, 82 aa, Homo sapiens
  ENSP00000431367
MAGQGLPLHVATLLTGLLECLGFAGVLFGWPSLVFVFKNEDYFKDLCGPDAGPIGNATGQAGRLGCMGDLFSTPDCKAQDER

SEQ ID NO: 36004 - protein, 63 aa, Homo sapiens
  ENSP00000434710
MAGQGLPLHVATLLTGLLECLGFAGVLFGWPSLVFVFKNEDYFKDLCGPDAGPIGNATGQAGR

SEQ ID NO: 36005 - protein, 44 aa, Homo sapiens
  ENSP00000431765
MAGQGLPLHVATLLTGLLECLGFAGVLFGWPSLVFVFKNEDYFK

SEQ ID NO: 36006 - protein, 22 aa, Homo sapiens
  ENSP00000433393
MAGQGLPLHVATLLTGLLECLG

SEQ ID NO: 36007 - protein, 1 aa, Homo sapiens
  ENSP00000434371
M

SEQ ID NO: 36008 - protein, 717 aa, Homo sapiens
  ENSP00000359896
MNDTEKPADTPSEEEDFGDPRTYDPDFKGPVANRSCTDVLCCMIFLLCIIGYIVLGLVAWVHGDPRRAAYPTDSQGHFCGQKGTPNENKTILFYFNLLRCTSPSVLLNLQCPTTQICVSKCPEKFLTYVEMQLLYTKDKSYWEDYRQFCKTTAKPVKSLTQLLLDDDCPTAIFPSKPFLQRCFPDFSTKNGTLTIGSKMMFQDGNGGTRSVVELGIAANGINKLLDAKSLGLKVFEDYARTWYWILIGLTIAMVLSWIFLILLRFIAGCLFWVFMIGVIGIIGYGIWHCYQQYTNLQERPSSVLTIYDIGIQTNISMYFELQQTWFTFMIILCIIEVIVILMLIFLRNRIRVAIILLKEGSKAIGYVPSTLVYPALTFILLSICICYWVVTAVFLATSGVPVYKVIAPGGHCIHENQTCDPEIFNTTEIAKACPGALCNFAFYGGKSLYHQYIPTFHVYNLFVFLWLINFVIALGQCALAGAFATYYWAMKKPDDIPRYPLFTAFGRAIRYHTGSLAFGSLIIALIQMFKIVLEYLDHRLKRTQNTLSKFLQCCLRCCFWCLENAIKFLNRNAYIMIAIYGRNFCRSAKDAFNLLMRNVLKVAVTDEVTYFVLFLGKLLVAGSIGVLAFLFFTQRLPVIAQGPASLNYYWVPLLTVIFGSYLIAHGFFSVYAMCVETIFICFLEDLERNDGSTARPYYVSQPLLKIFQEENPQTRKQ

SEQ ID NO: 36009 - protein, 719 aa, Homo sapiens
  ENSP00000359892
MNDTEKPADTPSEEEDFGDPRTYDPDFKGPVANRSCTDVLCCMIFLLCIIGYIVLGLVAWVHGDPRRAAYPTDSQGHFCGQKGTPNENKTILFYFNLLRCTSPSVLLNLQCPTTQICVSKCPEKFLTYVEMQLLYTKDKSYWEDYRQFCKTTAKPVKSLTQLLLDDDCPTAIFPSKPFLQRCFPDFSTKNGTLTIGSKMMFQDGNGGTRSVVELGIAANGINKLLDAKSLGLKVFEDYARTWYWILIGLTIAMVLSWIFLILLRFIAGCLFWVFMIGVIGIIGYGIWHCYQQYTNLQERPSSVLTIYDIGIQTNISMYFELQQTWFTFMIILCIIEVIVILMLIFLRNRIRVAIILLKEGSKAIGYVPSTLVYPALTFILLSICICYWVVTAVFLATSGVPVYKVIAPGGHCIHENQTCDPEIFNTTEIAKACPGALCNFAFYGGKSLYHQYIPTFHVYNLFVFLWLINFVIALGQCALAGAFATYYWAMKKPDDIPRYPLFTAFGRAIRYHTGSLAFGSLIIALIQMFKIVLEYLDHRLKRTQNTLSKFLQCCLRCCFWCLENAIKFLNRNAYIMIAIYGRNFCRSAKDAFNLLMRNVLKVAVTDEVTYFVLFLGKLLVAGSIGVLAFLFFTQRLPVIAQGPASLNYYWVPLLTVIFGSYLIAHGFFSVYAMCVETIFICFCEDLERNDGSTEKPYFVTPNLHGILIKKQLVPQKQKE

SEQ ID NO: 36010 - protein, 782 aa, Homo sapiens
  ENSP00000418096
MLQQPGPRPGRQQPSGDRDACRLHPQGRPPALPTMIPAASSTPPGDALFPSVAPQDFWRSQVTGYSGSVTRHLSHRANNFKRHPKRRKCIRPSPPPPPNTPCPLELVDFGDLHPQRSFRELLFNGCILFGIEFSYAMETAYVTPVLLQMGLPDQLYSLVWFISPILGFLLQPLLGAWSDRCTSRFGRRRPFILVLAIGALLGLSLLLNGRDIGIALADVTGNHKWGLLLTVCGVVLMDFSADSADNPSHAYMMDVCSPADQDRGLNIHALLAGLGGGFGYVVGGIHWDKTGFGRALGGQLRVIYLFTAVTLSVTTVLTLVSIPERPLRPPSEKRAAMKSPSLPLPPSPPVLPEEGPGDSLPSHTATNFSSPISPPSPLTPKYGSFISRDSSLTGISEFASSFGTANIDSVLIDCFTGGHDSYLAIPGSVPRPPISVSFPRAPDGFYRQDRGLLEGREGALTSGCDGDILRVGSLDTSKPRSSGILKRPQTLAIPDAAGGGGPETSRRRNVTFSQQVANILLNGVKYESELTGSSERAEQPLSVGRLCSTICNMPKALRTLCVNHFLGWLSFEGMLLFYTDFMGEVVFQGDPKAPHTSEAYQKYNSGVTMGCWGMCIYAFSAAFYSAILEKLEEFLSVRTLYFIAYLAFGLGTGLATLSRNLYVVLSLCITYGILFSTLCTLPYSLLCDYYQSKKFAGSSADGTRRGMGVDISLLSCQYFLAQILVSLVLGPLTSAVGSANGVMYFSSLVSFLGCLYSSLFVIYEIPPSDAADEEHRPLLLNV

SEQ ID NO: 36011 - protein, 748 aa, Homo sapiens
  ENSP00000289877
MIPAASSTPPGDALFPSVAPQDFWRSQVTGYSGSVTRHLSHRANNFKRHPKRRKCIRPSPPPPPNTPCPLELVDFGDLHPQRSFRELLFNGCILFGIEFSYAMETAYVTPVLLQMGLPDQLYSLVWFISPILGFLLQPLLGAWSDRCTSRFGRRRPFILVLAIGALLGLSLLLNGRDIGIALADVTGNHKWGLLLTVCGVVLMDFSADSADNPSHAYMMDVCSPADQDRGLNIHALLAGLGGGFGYVVGGIHWDKTGFGRALGGQLRVIYLFTAVTLSVTTVLTLVSIPERPLRPPSEKRAAMKSPSLPLPPSPPVLPEEGPGDSLPSHTATNFSSPISPPSPLTPKYGSFISRDSSLTGISEFASSFGTANIDSVLIDCFTGGHDSYLAIPGSVPRPPISVSFPRAPDGFYRQDRGLLEGREGALTSGCDGDILRVGSLDTSKPRSSGILKRPQTLAIPDAAGGGGPETSRRRNVTFSQQVANILLNGVKYESELTGSSERAEQPLSVGRLCSTICNMPKALRTLCVNHFLGWLSFEGMLLFYTDFMGEVVFQGDPKAPHTSEAYQKYNSGVTMGCWGMCIYAFSAAFYSAILEKLEEFLSVRTLYFIAYLAFGLGTGLATLSRNLYVVLSLCITYGILFSTLCTLPYSLLCDYYQSKKFAGSSADGTRRGMGVDISLLSCQYFLAQILVSLVLGPLTSAVGSANGVMYFSSLVSFLGCLYSSLFVIYEIPPSDAADEEHRPLLLNV

SEQ ID NO: 36012 - protein, 553 aa, Homo sapiens
  ENSP00000356113
MVQRLWVSRLLRHRKAQLLLVNLLTFGLEVCLAAGITYVPPLLLEVGVEEKFMTMVLGIGPVLGLVCVPLLGSASDHWRGRYGRRRPFIWALSLGILLSLFLIPRAGWLAGLLCPDPRPLELALLILGVGLLDFCGQVCFTPLEALLSDLFRDPDHCRQAYSVYAFMISLGGCLGYLLPAIDWDTSALAPYLGTQEECLFGLLTLIFLTCVAATLLVAEEAALGPTEPAEGLSAPSLSPHCCPCRARLAFRNLGALLPRLHQLCCRMPRTLRRLFVAELCSWMALMTFTLFYTDFVGEGLYQGVPRAEPGTEARRHYDEGVRMGSLGLFLQCAISLVFSLVMDRLVQRFGTRAVYLASVAAFPVAAGATCLSHSVAVVTASAALTGFTFSALQILPYTLASLYHREKQVFLPKYRGDTGGASSEDSLMTSFLPGPKPGAPFPNGHVGAGGSGLLPPPPALCGASACDVSVRVVVGEPTEARVVPGRGICLDLAILDSAFLLSQVAPSLFMGSIVQLSQSVTAYMVSAAGLGLVAIYFATQVVFDKSDLAKYSA

SEQ ID NO: 36013 - protein, 1079 aa, Homo sapiens
  ENSP00000264485
MEDEAVLDRGASFLKHVCDEEEVEGHHTIYIGVHVPKSYRRRRRHKRKTGHKEKKEKERISENYSDKSDIENADESSSSILKPLISPAAERIRFILGEEDDSPAPPQLFTELDELLAVDGQEMEWKETARWIKFEEKVEQGGERWSKPHVATLSLHSLFELRTCMEKGSIMLDREASSLPQLVEMIVDHQIETGLLKPELKDKVTYTLLRKHRHQTKKSNLRSLADIGKTVSSASRMFTNPDNGSPAMTHRNLTSSSLNDISDKPEKDQLKNKFMKKLPRDAEASNVLVGEVDFLDTPFIAFVRLQQAVMLGALTEVPVPTRFLFILLGPKGKAKSYHEIGRAIATLMSDEVFHDIAYKAKDRHDLIAGIDEFLDEVIVLPPGEWDPAIRIEPPKSLPSSDKRKNMYSGGENVQMNGDTPHDGGHGGGGHGDCEELQRTGRFCGGLIKDIKRKAPFFASDFYDALNIQALSAILFIYLATVTNAITFGGLLGDATDNMQGVLESFLGTAVSGAIFCLFAGQPLTILSSTGPVLVFERLLFNFSKDNNFDYLEFRLWIGLWSAFLCLILVATDASFLVQYFTRFTEEGFSSLISFIFIYDAFKKMIKLADYYPINSNFKVGYNTLFSCTCVPPDPANISISNDTTLAPEYLPTMSSTDMYHNTTFDWAFLSKKECSKYGGNLVGNNCNFVPDITLMSFILFLGTYTSSMALKKFKTSPYFPTTARKLISDFAIILSILIFCVIDALVGVDTPKLIVPSEFKPTSPNRGWFVPPFGENPWWVCLAAAIPALLVTILIFMDQQITAVIVNRKEHKLKKGAGYHLDLFWVAILMVICSLMALPWYVAATVISIAHIDSLKMETETSAPGEQPKFLGVREQRVTGTLVFILTGLSVFMAPILKFIPMPVLYGVFLYMGVASLNGVQFMDRLKLLLMPLKHQPDFIYLRHVPLRRVHLFTFLQVLCLALLWILKSTVAAIIFPVMILALVAVRKGMDYLFSQHDLSFLDDVIPEKDKKKKEDEKKKKKKKGSLDSDNDDSDCPYSEKVPSIKIPMDIMEQQPFLSDSKPSDRERSPTFLERHTSC

SEQ ID NO: 36014 - protein, 995 aa, Homo sapiens
  ENSP00000307349
MEDEAVLDRGASFLKHVCDEEEVEGHHTIYIGVHVPKSYRRRRRHKRKTGHKEKKEKERISENYSDKSDIENADESSSSILKPLISPAAERIRFILGEEDDSPAPPQLFTELDELLAVDGQEMEWKETARWIKFEEKVEQGGERWSKPHVATLSLHSLFELRTCMEKGSIMLDREASSLPQLVEMIVDHQIETGLLKPELKDKVTYTLLRKHRHQTKKSNLRSLADIGKTVSSASRMFTNPDNGSPAMTHRNLTSSSLNDISDKPEKDQLKNKFMKKLPRDAEASNVLVGEVDFLDTPFIAFVRLQQAVMLGALTEVPVPTRFLFILLGPKGKAKSYHEIGRAIATLMSDEVFHDIAYKAKDRHDLIAGIDEFLDEVIVLPPGEWDPAIRIEPPKSLPSSDKRKNMYSGGENVQMNGDTPHDGGHGGGGHGDCEELQRTGRFCGGLIKDIKRKAPFFASDFYDALNIQALSAILFIYLATVTNAITFGGLLGDATDNMQGVLESFLGTAVSGAIFCLFAGQPLTILSSTGPVLVFERLLFNFSKDNNFDYLEFRLWIGLWSAFLCLILVATDASFLVQYFTRFTEEGFSSLISFIFIYDAFKKMIKLADYYPINSNFKVGYNTLFSCTCVPPDPANISISNDTTLAPEYLPTMSSTDMYHNTTFDWAFLSKKECSKYGGNLVGNNCNFVPDITLMSFILFLGTYTSSMALKKFKTSPYFPTTARKLISDFAIILSILIFCVIDALVGVDTPKLIVPSEFKPTSPNRGWFVPPFGENPWWVCLAAAIPALLVTILIFMDQQITAVIVNRKEHKLKFIPMPVLYGVFLYMGVASLNGVQFMDRLKLLLMPLKHQPDFIYLRHVPLRRVHLFTFLQVLCLALLWILKSTVAAIIFPVMILALVAVRKGMDYLFSQHDLSFLDDVIPEKDKKKKEDEKKKKKKKGSLDSDNDDSDCPYSEKVPSIKIPMDIMEQQPFLSDSKPSDRERSPTFLERHTSC

SEQ ID NO: 36015 - protein, 171 aa, Homo sapiens
  ENSP00000491107
MNNSLQVNLPRSWAAPSGSLQEKSEHSFFLFYYYRMEDEAVLDRGASFLKHVCDEEEVEGHHTIYIGVHVPKSYRRRRRHKRKTGHKEKKEKERISENYSDKSDIENADESSSSILKPLISPAAERIRFILGEEDDSPAPPQLFTELDELLAVDGQEMEWKETARWIKFEE

SEQ ID NO: 36016 - protein, 130 aa, Homo sapiens
  ENSP00000492496
MQWVFKELSTEAGFPQTIITSTPDTPNFLSWMEDEAVLDRGASFLKHVCDEEEVEGHHTIYIGVHVPKSYRRRRRHKRKTGHKEKKEKERISENYSDKSDIENADESSSSILKPLISPAAERIRFILGEE

SEQ ID NO: 36017 - protein, 646 aa, Homo sapiens
  ENSP00000422400
MSTENVEGKPSNLGERGRARSSTFLRVVQPMFNHSIFTSAVSPAAERIRFILGEEDDSPAPPQLFTELDELLAVDGQEMEWKETARWIKFEEKVEQGGERWSKPHVATLSLHSLFELRTCMEKGSIMLDREASSLPQLVEMIVDHQIETGLLKPELKDKVTYTLLRKHRHQTKKSNLRSLADIGKTVSSASRMFTNPDNGSPAMTHRNLTSSSLNDISDKPEKDQLKNKFMKKLPRDAEASNVLVGEVDFLDTPFIAFVRLQQAVMLGALTEVPVPTRFLFILLGPKGKAKSYHEIGRAIATLMSDEVFHDIAYKAKDRHDLIAGIDEFLDEVIVLPPGEWDPAIRIEPPKSLPSSDKRKNMYSGGENVQMNGDTPHDGGHGGGGHGDCEELQRTGRFCGGLIKDIKRKAPFFASDFYDALNIQALSAILFIYLATVTNAITFGGLLGDATDNMQGVLESFLGTAVSGAIFCLFAGQPLTILSSTGPVLVFERLLFNFSKDNNFDYLEFRLWIGLWSAFLCLILVATDASFLVQYFTRFTEEGFSSLISFIFIYDAFKKMIKLADYYPINSNFKVGYNTLFSCTCVPPDPGEGITLCVYARFVFGGRCRLHACKFSTCCHGPQELVLFFSLKNSATEFDVSLPEVF

SEQ ID NO: 36018 - protein, 1035 aa, Homo sapiens
  ENSP00000344272
MSTENVEGKPSNLGERGRARSSTFLRVVQPMFNHSIFTSAVSPAAERIRFILGEEDDSPAPPQLFTELDELLAVDGQEMEWKETARWIKFEEKVEQGGERWSKPHVATLSLHSLFELRTCMEKGSIMLDREASSLPQLVEMIVDHQIETGLLKPELKDKVTYTLLRKHRHQTKKSNLRSLADIGKTVSSASRMFTNPDNGSPAMTHRNLTSSSLNDISDKPEKDQLKNKFMKKLPRDAEASNVLVGEVDFLDTPFIAFVRLQQAVMLGALTEVPVPTRFLFILLGPKGKAKSYHEIGRAIATLMSDEVFHDIAYKAKDRHDLIAGIDEFLDEVIVLPPGEWDPAIRIEPPKSLPSSDKRKNMYSGGENVQMNGDTPHDGGHGGGGHGDCEELQRTGRFCGGLIKDIKRKAPFFASDFYDALNIQALSAILFIYLATVTNAITFGGLLGDATDNMQGVLESFLGTAVSGAIFCLFAGQPLTILSSTGPVLVFERLLFNFSKDNNFDYLEFRLWIGLWSAFLCLILVATDASFLVQYFTRFTEEGFSSLISFIFIYDAFKKMIKLADYYPINSNFKVGYNTLFSCTCVPPDPANISISNDTTLAPEYLPTMSSTDMYHNTTFDWAFLSKKECSKYGGNLVGNNCNFVPDITLMSFILFLGTYTSSMALKKFKTSPYFPTTARKLISDFAIILSILIFCVIDALVGVDTPKLIVPSEFKPTSPNRGWFVPPFGENPWWVCLAAAIPALLVTILIFMDQQITAVIVNRKEHKLKKGAGYHLDLFWVAILMVICSLMALPWYVAATVISIAHIDSLKMETETSAPGEQPKFLGVREQRVTGTLVFILTGLSVFMAPILKFIPMPVLYGVFLYMGVASLNGVQFMDRLKLLLMPLKHQPDFIYLRHVPLRRVHLFTFLQVLCLALLWILKSTVAAIIFPVMILALVAVRKGMDYLFSQHDLSFLDDVIPEKDKKKKEDEKKKKKKKGSLDSDNDDSDCPYSEKVPSIKIPMDIMEQQPFLSDSKPSDRERSPTFLERHTSC

SEQ ID NO: 36019 - protein, 1094 aa, Homo sapiens
  ENSP00000393557
MEDEAVLDRGASFLKHVCDEEEVEGHHTIYIGVHVPKSYRRRRRHKRKTGHKEKKEKERISENYSDKSDIENADESSSSILKPLISPAAERIRFILGEEDDSPAPPQLFTELDELLAVDGQEMEWKETARWIKFEEKVEQGGERWSKPHVATLSLHSLFELRTCMEKGSIMLDREASSLPQLVEMIVDHQIETGLLKPELKDKVTYTLLRKHRHQTKKSNLRSLADIGKTVSSASRMFTNPDNGSPAMTHRNLTSSSLNDISDKPEKDQLKNKFMKKLPRDAEASNVLVGEVDFLDTPFIAFVRLQQAVMLGALTEVPVPTRFLFILLGPKGKAKSYHEIGRAIATLMSDEVFHDIAYKAKDRHDLIAGIDEFLDEVIVLPPGEWDPAIRIEPPKSLPSSDKRKNMYSGGENVQMNGDTPHDGGHGGGGHGDCEELQRTGRFCGGLIKDIKRKAPFFASDFYDALNIQALSAILFIYLATVTNAITFGGLLGDATDNMQGVLESFLGTAVSGAIFCLFAGQPLTILSSTGPVLVFERLLFNFSKDNNFDYLEFRLWIGLWSAFLCLILVATDASFLVQYFTRFTEEGFSSLISFIFIYDAFKKMIKLADYYPINSNFKVGYNTLFSCTCVPPDPANISISNDTTLAPEYLPTMSSTDMYHNTTFDWAFLSKKECSKYGGNLVGNNCNFVPDITLMSFILFLGTYTSSMALKKFKTSPYFPTTARKLISDFAIILSILIFCVIDALVGVDTPKLIVPSEFKPTSPNRGWFVPPFGENPWWVCLAAAIPALLVTILIFMDQQITAVIVNRKEHKLKKGAGYHLDLFWVAILMVICSLMALPWYVAATVISIAHIDSLKMETETSAPGEQPKFLGVREQRVTGTLVFILTGLSVFMAPILKFIPMPVLYGVFLYMGVASLNGVQFMDRLKLLLMPLKHQPDFIYLRHVPLRRVHLFTFLQVLCLALLWILKSTVAAIIFPVMILALVAVRKGMDYLFSQHDLSFLDDVIPEKDKKKKEDEKKKKKKKGSLDSDNDDEKDHQHSLNATHHADKIPFLQSLGMPSPPRTPVKVVPQIRIELEPEDNDYFWRSKGTETTL

SEQ ID NO: 36020 - protein, 801 aa, Homo sapiens
  ENSP00000411031
VMEVVEAEKIVLLTSARFLFLLLGPAGKAPQYHEIGRSIATLMTDEIFHDVAYKAKDRNDLLSGIDEFLDQVTVLPPGEWDPSIRIEPPKSVPSQEKRKIPVFHNGSTPTLGETPKEAAHHAGPELQRTGRLFGGLILDIKRKAPFFLSDFKDALSLQCLASILFLYCACMSPVITFGGLLGEATEGRISAIESLFGASLTGIAYSLFAGQPLTILGSTGPVLVFEKILYKFCRDYQLSYLSLRTSIGLWTSFLCIVLVATDASSLVCYITRFTEEAFAALICIIFIYEALEKLFDLGETYAFNMHNNLDKLTSYSCVCTEPPNPSNETLAQWKKDNITAHNISWRNLTVSECKKLRGVFLGSACGHHGPYIPDVLFWCVILFFTTFFLSSFLKQFKTKRYFPTKVRSTISDFAVFLTIVIMVTIDYLVGVPSPKLHVPEKFEPTHPERGWIISPLGDNPWWTLLIAAIPALLCTILIFMDQQITAVIINRKEHKLKKGAGYHLDLLMVGVMLGVCSVMGLPWFVAATVLSISHVNSLKVESECSAPGEQPKFLGIREQRVTGLMIFILMGLSVFMTSVLKFIPMPVLYGVFLYMGVSSLKGIQLFDRIKLFGMPAKHQPDLIYLRYVPLWKVHIFTVIQLTCLVLLWVIKVSAAAVVFPMMVLALVFVRKLMDLCFTKRELSWLDDLMPESKKKKEDDKKKKEKEEAERMLQDDDDTVHLPFEGGSLLQIPVKALKYSVDPSIVNISDEMAKTAQWKALSMNTENAKVTRSNMSPDKPVSVKISFEDEPRKKYVDAETSL

SEQ ID NO: 36021 - protein, 1214 aa, Homo sapiens
  ENSP00000295736
MERFRLEKKLPGPDEEAVVDLGKTSSTVNTKFEKEELESHRAVYIGVHVPFSKESRRRHRHRGHKHHHRRRKDKESDKEDGRESPSYDTPSQRVQFILGTEDDDEEHIPHDLFTEMDELCYRDGEEYEWKETARWLKFEEDVEDGGDRWSKPYVATLSLHSLFELRSCILNGTVMLDMRASTLDEIADMVLDNMIASGQLDESIRENVREALLKRHHHQNEKRFTSRIPLVRSFADIGKKHSDPHLLERNGEGLSASRHSLRTGLSASNLSLRGESPLSLLLGHLLPSSRAGTPAGSRCTTPVPTPQNSPPSSPSISRLTSRSSQESQRQAPELLVSPASDDIPTVVIHPPEEDLEAALKGEEQKNEENVDLTPGILASPQSAPGNLDNSKSGEIKGNGSGGSRENSTVDFSKVDMNFMRKIPTGAEASNVLVGEVDFLERPIIAFVRLAPAVLLTGLTEVPVPTRFLFLLLGPAGKAPQYHEIGRSIATLMTDEIFHDVAYKAKDRNDLLSGIDEFLDQVTVLPPGEWDPSIRIEPPKSVPSQEKRKIPVFHNGSTPTLGETPKEAAHHAGPELQRTGRLFGGLILDIKRKAPFFLSDFKDALSLQCLASILFLYCACMSPVITFGGLLGEATEGRISAIESLFGASLTGIAYSLFAGQPLTILGSTGPVLVFEKILYKFCRDYQLSYLSLRTSIGLWTSFLCIVLVATDASSLVCYITRFTEEAFAALICIIFIYEALEKLFDLGETYAFNMHNNLDKLTSYSCVCTEPPNPSNETLAQWKKDNITAHNISWRNLTVSECKKLRGVFLGSACGHHGPYIPDVLFWCVILFFTTFFLSSFLKQFKTKRYFPTKVRSTISDFAVFLTIVIMVTIDYLVGVPSPKLHVPEKFEPTHPERGWIISPLGDNPWWTLLIAAIPALLCTILIFMDQQITAVIINRKEHKLKKGAGYHLDLLMVGVMLGVCSVMGLPWFVAATVLSISHVNSLKVESECSAPGEQPKFLGIREQRVTGLMIFILMGLSVFMTSVLKFIPMPVLYGVFLYMGVSSLKGIQLFDRIKLFGMPAKHQPDLIYLRYVPLWKVHIFTVIQLTCLVLLWVIKVSAAAVVFPMMVLALVFVRKLMDLCFTKRELSWLDDLMPESKKKKEDDKKKKEKEEAERMLQDDDDTVHLPFEGGSLLQIPVKALKYSPDKPVSVKISFEDEPRKKYVDAETSL

SEQ ID NO: 36022 - protein, 1090 aa, Homo sapiens
  ENSP00000416368
MERFRLEKKLPGPDEEAVVDLGKTSSTVNTKFEKEELESHRAVYIGVHVPFSKESRRRHRHRGHKHHHRRRKDKESDKEDGRESPSYDTPSQRVQFILGTEDDDEEHIPHDLFTEMDELCYRDGEEYEWKETARWLKFEEDVEDGGDRWSKPYVATLSLHSLFELRSCILNGTVMLDMRASTLDEIADMVLDNMIASGQLDESIRENVREALLKRHHHQNEKRFTSRIPLVRSFADIGKKHSDPHLLERNGILASPQSAPGNLDNSKSGEIKGNGSGGSRENSTVDFSKVDMNFMRKIPTGAEASNVLVGEVDFLERPIIAFVRLAPAVLLTGLTEVPVPTRFLFLLLGPAGKAPQYHEIGRSIATLMTDEIFHDVAYKAKDRNDLLSGIDEFLDQVTVLPPGEWDPSIRIEPPKSVPSQEKRKIPVFHNGSTPTLGETPKEAAHHAGPELQRTGRLFGGLILDIKRKAPFFLSDFKDALSLQCLASILFLYCACMSPVITFGGLLGEATEGRISAIESLFGASLTGIAYSLFAGQPLTILGSTGPVLVFEKILYKFCRDYQLSYLSLRTSIGLWTSFLCIVLVATDASSLVCYITRFTEEAFAALICIIFIYEALEKLFDLGETYAFNMHNNLDKLTSYSCVCTEPPNPSNETLAQWKKDNITAHNISWRNLTVSECKKLRGVFLGSACGHHGPYIPDVLFWCVILFFTTFFLSSFLKQFKTKRYFPTKVRSTISDFAVFLTIVIMVTIDYLVGVPSPKLHVPEKFEPTHPERGWIISPLGDNPWWTLLIAAIPALLCTILIFMDQQITAVIINRKEHKLKKGAGYHLDLLMVGVMLGVCSVMGLPWFVAATVLSISHVNSLKVESECSAPGEQPKFLGIREQRVTGLMIFILMGLSVFMTSVLKFIPMPVLYGVFLYMGVSSLKGIQLFDRIKLFGMPAKHQPDLIYLRYVPLWKVHIFTVIQLTCLVLLWVIKVSAAAVVFPMMVLALVFVRKLMDLCFTKRELSWLDDLMPESKKKKEDDKKKKEKEEAERMLQDDDDTVHLPFEGGSLLQIPVKALKYSPDKPVSVKISFEDEPRKKYVDAETSL

SEQ ID NO: 36023 - protein, 1259 aa, Homo sapiens
  ENSP00000390394
MEADGAGEQMRPLLTRVTSRGPDEEAVVDLGKTSSTVNTKFEKEELESHRAVYIGVHVPFSKESRRRHRHRGHKHHHRRRKDKESDKEDGRESPSYDTPSQRVQFILGTEDDDEEHIPHDLFTEMDELCYRDGEEYEWKETARWLKFEEDVEDGGDRWSKPYVATLSLHSLFELRSCILNGTVMLDMRASTLDEIADMVLDNMIASGQLDESIRENVREALLKRHHHQNEKRFTSRIPLVRSFADIGKKHSDPHLLERNGEGLSASRHSLRTGLSASNLSLRGESPLSLLLGHLLPSSRAGTPAGSRCTTPVPTPQNSPPSSPSISRLTSRSSQESQRQAPELLVSPASDDIPTVVIHPPEEDLEAALKGEEQKNEENVDLTPGILASPQSAPGNLDNSKSGEIKGNGSGGSRENSTVDFSKVDMNFMRKIPTGAEASNVLVGEVDFLERPIIAFVRLAPAVLLTGLTEVPVPTRFLFLLLGPAGKAPQYHEIGRSIATLMTDEIFHDVAYKAKDRNDLLSGIDEFLDQVTVLPPGEWDPSIRIEPPKSVPSQEKRKIPVFHNGSTPTLGETPKEAAHHAGPELQRTGRLFGGLILDIKRKAPFFLSDFKDALSLQCLASILFLYCACMSPVITFGGLLGEATEGRISAIESLFGASLTGIAYSLFAGQPLTILGSTGPVLVFEKILYKFCRDYQLSYLSLRTSIGLWTSFLCIVLVATDASSLVCYITRFTEEAFAALICIIFIYEALEKLFDLGETYAFNMHNNLDKLTSYSCVCTEPPNPSNETLAQWKKDNITAHNISWRNLTVSECKKLRGVFLGSACGHHGPYIPDVLFWCVILFFTTFFLSSFLKQFKTKRYFPTKVRSTISDFAVFLTIVIMVTIDYLVGVPSPKLHVPEKFEPTHPERGWIISPLGDNPWWTLLIAAIPALLCTILIFMDQQITAVIINRKEHKLKKGAGYHLDLLMVGVMLGVCSVMGLPWFVAATVLSISHVNSLKVESECSAPGEQPKFLGIREQRVTGLMIFILMGLSVFMTSVLKFIPMPVLYGVFLYMGVSSLKGIQLFDRIKLFGMPAKHQPDLIYLRYVPLWKVHIFTVIQLTCLVLLWVIKVSAAAVVFPMMVLALVFVRKLMDLCFTKRELSWLDDLMPESKKKKEDDKKKKEKEEAERMLQDDDDTVHLPFEGGSLLQIPVKALKYSVDPSIVNISDEMAKTAQWKALSMNTENAKVTRSNMSPDKPVSVKISFEDEPRKKYVDAETSL

SEQ ID NO: 36024 - protein, 1246 aa, Homo sapiens
  ENSP00000414797
MEADGAGEQMRPLLTRVTSRGPDEEAVVDLGKTSSTVNTKFEKEELESHRAVYIGVHVPFSKESRRRHRHRGHKHHHRRRKDKESDKEDGRESPSYDTPSQRVQFILGTEDDDEEHIPHDLFTEMDELCYRDGEEYEWKETARWLKFEEDVEDGGDRWSKPYVATLSLHSLFELRSCILNGTVMLDMRASTLDEIADMVLDNMIASGQLDESIRENVREALLKRHHHQNEKRFTSRIPLVRSFADIGEGLSASRHSLRTGLSASNLSLRGESPLSLLLGHLLPSSRAGTPAGSRCTTPVPTPQNSPPSSPSISRLTSRSSQESQRQAPELLVSPASDDIPTVVIHPPEEDLEAALKGEEQKNEENVDLTPGILASPQSAPGNLDNSKSGEIKGNGSGGSRENSTVDFSKVDMNFMRKIPTGAEASNVLVGEVDFLERPIIAFVRLAPAVLLTGLTEVPVPTRFLFLLLGPAGKAPQYHEIGRSIATLMTDEIFHDVAYKAKDRNDLLSGIDEFLDQVTVLPPGEWDPSIRIEPPKSVPSQEKRKIPVFHNGSTPTLGETPKEAAHHAGPELQRTGRLFGGLILDIKRKAPFFLSDFKDALSLQCLASILFLYCACMSPVITFGGLLGEATEGRISAIESLFGASLTGIAYSLFAGQPLTILGSTGPVLVFEKILYKFCRDYQLSYLSLRTSIGLWTSFLCIVLVATDASSLVCYITRFTEEAFAALICIIFIYEALEKLFDLGETYAFNMHNNLDKLTSYSCVCTEPPNPSNETLAQWKKDNITAHNISWRNLTVSECKKLRGVFLGSACGHHGPYIPDVLFWCVILFFTTFFLSSFLKQFKTKRYFPTKVRSTISDFAVFLTIVIMVTIDYLVGVPSPKLHVPEKFEPTHPERGWIISPLGDNPWWTLLIAAIPALLCTILIFMDQQITAVIINRKEHKLKKGAGYHLDLLMVGVMLGVCSVMGLPWFVAATVLSISHVNSLKVESECSAPGEQPKFLGIREQRVTGLMIFILMGLSVFMTSVLKFIPMPVLYGVFLYMGVSSLKGIQLFDRIKLFGMPAKHQPDLIYLRYVPLWKVHIFTVIQLTCLVLLWVIKVSAAAVVFPMMVLALVFVRKLMDLCFTKRELSWLDDLMPESKKKKEDDKKKKEKEEAERMLQDDDDTVHLPFEGGSLLQIPVKALKYSVDPSIVNISDEMAKTAQWKALSMNTENAKVTRSNMSPDKPVSVKISFEDEPRKKYVDAETSL

SEQ ID NO: 36025 - protein, 463 aa, Homo sapiens
  ENSP00000408323
MEADGAGEQMRPLLTRGPDEEAVVDLGKTSSTVNTKFEKEELESHRAVYIGVHVPFSKESRRRHRHRGHKHHHRRRKDKESDKEDGRESPSYDTPSQRVQFILGTEDDDEEHIPHDLFTEMDELCYRDGEEYEWKETARWLKFEEDVEDGGDRWSKPYVATLSLHSLFELRSCILNGTVMLDMRASTLDEIADMVLDNMIASGQLDESIRENVREALLKRHHHQNEKRFTSRIPLVRSFADIGKKHSDPHLLERNGILASPQSAPGNLDNSKSGEIKGNGSGGSRENSTVDFSKVDMNFMRKIPTGAEASNVLVGEVDFLERPIIAFVRLAPAVLLTGLTEVPVPTRFLFLLLGPAGKAPQYHEIGRSIATLMTDEIFHDVAYKAKDRNDLLSGIDEFLDQVTVLPPGEWDPSIRIEPPKSVPSQEKRKIPVFHNGSTPTLGETPKEAAHHAGPELQRTGRVQ

SEQ ID NO: 36026 - protein, 574 aa, Homo sapiens
  ENSP00000407304
MEADGAGEQMRPLLTRGPDEEAVVDLGKTSSTVNTKFEKEELESHRAVYIGVHVPFSKESRRRHRHRGHKHHHRRRKDKESDKEDGRESPSYDTPSQRVQFILGTEDDDEEHIPHDLFTEMDELCYRDGEEYEWKETARWLKFEEDVEDGGDRWSKPYVATLSLHSLFELRSCILNGTVMLDMRASTLDEIADMVLDNMIASGQLDESIRENVREALLKRHHHQNEKRFTSRIPLVRSFADIGEGLSASRHSLRTGLSASNLSLRGESPLSLLLGHLLPSSRAGTPAGSRCTTPVPTPQNSPPSSPSISRLTSRSSQESQRQAPELLVSPASDDIPTVVIHPPEEDLEAALKGEEQKNEENVDLTPGILASPQSAPGNLDNSKSGEIKGNGSGGSRENSTVDFSKVDMNFMRKIPTGAEASNVLVGEVDFLERPIIAFVRLAPAVLLTGLTEVPVPTRFLFLLLGPAGKAPQYHEIGRSIATLMTDEIFHDVAYKAKDRNDLLSGIDEFLDQVTVLPPGEWDPSIRIEPPKSVPSQEKRKIPVFHNGSTPTLGETPKEAAHHAGPELQRTGRVQ

SEQ ID NO: 36027 - protein, 1095 aa, Homo sapiens
  ENSP00000394252
MEADGAGEQMRPLLTRGPDEEAVVDLGKTSSTVNTKFEKEELESHRAVYIGVHVPFSKESRRRHRHRGHKHHHRRRKDKESDKEDGRESPSYDTPSQRVQFILGTEDDDEEHIPHDLFTEMDELCYRDGEEYEWKETARWLKFEEDVEDGGDRWSKPYVATLSLHSLFELRSCILNGTVMLDMRASTLDEIADMVLDNMIASGQLDESIRENVREALLKRHHHQNEKRFTSRIPLVRSFADIGKKHSDPHLLERNGILASPQSAPGNLDNSKSGEIKGNGSGGSRENSTVDFSKVDMNFMRKIPTGAEASNVLVGEVDFLERPIIAFVRLAPAVLLTGLTEVPVPTRFLFLLLGPAGKAPQYHEIGRSIATLMTDEIFHDVAYKAKDRNDLLSGIDEFLDQVTVLPPGEWDPSIRIEPPKSVPSQEKRKIPVFHNGSTPTLGETPKEAAHHAGPELQRTGRLFGGLILDIKRKAPFFLSDFKDALSLQCLASILFLYCACMSPVITFGGLLGEATEGRISAIESLFGASLTGIAYSLFAGQPLTILGSTGPVLVFEKILYKFCRDYQLSYLSLRTSIGLWTSFLCIVLVATDASSLVCYITRFTEEAFAALICIIFIYEALEKLFDLGETYAFNMHNNLDKLTSYSCVCTEPPNPSNETLAQWKKDNITAHNISWRNLTVSECKKLRGVFLGSACGHHGPYIPDVLFWCVILFFTTFFLSSFLKQFKTKRYFPTKVRSTISDFAVFLTIVIMVTIDYLVGVPSPKLHVPEKFEPTHPERGWIISPLGDNPWWTLLIAAIPALLCTILIFMDQQITAVIINRKEHKLKKGAGYHLDLLMVGVMLGVCSVMGLPWFVAATVLSISHVNSLKVESECSAPGEQPKFLGIREQRVTGLMIFILMGLSVFMTSVLKFIPMPVLYGVFLYMGVSSLKGIQLFDRIKLFGMPAKHQPDLIYLRYVPLWKVHIFTVIQLTCLVLLWVIKVSAAAVVFPMMVLALVFVRKLMDLCFTKRELSWLDDLMPESKKKKEDDKKKKEKEEAERMLQDDDDTVHLPFEGGSLLQIPVKALKYSPDKPVSVKISFEDEPRKKYVDAETSL

SEQ ID NO: 36028 - protein, 1206 aa, Homo sapiens
  ENSP00000406605
MEADGAGEQMRPLLTRGPDEEAVVDLGKTSSTVNTKFEKEELESHRAVYIGVHVPFSKESRRRHRHRGHKHHHRRRKDKESDKEDGRESPSYDTPSQRVQFILGTEDDDEEHIPHDLFTEMDELCYRDGEEYEWKETARWLKFEEDVEDGGDRWSKPYVATLSLHSLFELRSCILNGTVMLDMRASTLDEIADMVLDNMIASGQLDESIRENVREALLKRHHHQNEKRFTSRIPLVRSFADIGEGLSASRHSLRTGLSASNLSLRGESPLSLLLGHLLPSSRAGTPAGSRCTTPVPTPQNSPPSSPSISRLTSRSSQESQRQAPELLVSPASDDIPTVVIHPPEEDLEAALKGEEQKNEENVDLTPGILASPQSAPGNLDNSKSGEIKGNGSGGSRENSTVDFSKVDMNFMRKIPTGAEASNVLVGEVDFLERPIIAFVRLAPAVLLTGLTEVPVPTRFLFLLLGPAGKAPQYHEIGRSIATLMTDEIFHDVAYKAKDRNDLLSGIDEFLDQVTVLPPGEWDPSIRIEPPKSVPSQEKRKIPVFHNGSTPTLGETPKEAAHHAGPELQRTGRLFGGLILDIKRKAPFFLSDFKDALSLQCLASILFLYCACMSPVITFGGLLGEATEGRISAIESLFGASLTGIAYSLFAGQPLTILGSTGPVLVFEKILYKFCRDYQLSYLSLRTSIGLWTSFLCIVLVATDASSLVCYITRFTEEAFAALICIIFIYEALEKLFDLGETYAFNMHNNLDKLTSYSCVCTEPPNPSNETLAQWKKDNITAHNISWRNLTVSECKKLRGVFLGSACGHHGPYIPDVLFWCVILFFTTFFLSSFLKQFKTKRYFPTKVRSTISDFAVFLTIVIMVTIDYLVGVPSPKLHVPEKFEPTHPERGWIISPLGDNPWWTLLIAAIPALLCTILIFMDQQITAVIINRKEHKLKKGAGYHLDLLMVGVMLGVCSVMGLPWFVAATVLSISHVNSLKVESECSAPGEQPKFLGIREQRVTGLMIFILMGLSVFMTSVLKFIPMPVLYGVFLYMGVSSLKGIQLFDRIKLFGMPAKHQPDLIYLRYVPLWKVHIFTVIQLTCLVLLWVIKVSAAAVVFPMMVLALVFVRKLMDLCFTKRELSWLDDLMPESKKKKEDDKKKKEKEEAERMLQDDDDTVHLPFEGGSLLQIPVKALKYSPDKPVSVKISFEDEPRKKYVDAETSL

SEQ ID NO: 36029 - protein, 1131 aa, Homo sapiens
  ENSP00000407382
MEADGAGEQMRPLLTRGPDEEAVVDLGKTSSTVNTKFEKEELESHRAVYIGVHVPFSKESRRRHRHRGHKHHHRRRKDKESDKEDGRESPSYDTPSQRVQFILGTEDDDEEHIPHDLFTEMDELCYRDGEEYEWKETARWLKFEEDVEDGGDRWSKPYVATLSLHSLFELRSCILNGTVMLDMRASTLDEIADMVLDNMIASGQLDESIRENVREALLKRHHHQNEKRFTSRIPLVRSFADIGKKHSDPHLLERNGILASPQSAPGNLDNSKSGEIKGNGSGGSRENSTVDFSKVDMNFMRKIPTGAEASNVLVGEVDFLERPIIAFVRLAPAVLLTGLTEVPVPTRFLFLLLGPAGKAPQYHEIGRSIATLMTDEIFHDVAYKAKDRNDLLSGIDEFLDQVTVLPPGEWDPSIRIEPPKSVPSQEKRKIPVFHNGSTPTLGETPKEAAHHAGPELQRTGRLFGGLILDIKRKAPFFLSDFKDALSLQCLASILFLYCACMSPVITFGGLLGEATEGRISAIESLFGASLTGIAYSLFAGQPLTILGSTGPVLVFEKILYKFCRDYQLSYLSLRTSIGLWTSFLCIVLVATDASSLVCYITRFTEEAFAALICIIFIYEALEKLFDLGETYAFNMHNNLDKLTSYSCVCTEPPNPSNETLAQWKKDNITAHNISWRNLTVSECKKLRGVFLGSACGHHGPYIPDVLFWCVILFFTTFFLSSFLKQFKTKRYFPTKVRSTISDFAVFLTIVIMVTIDYLVGVPSPKLHVPEKFEPTHPERGWIISPLGDNPWWTLLIAAIPALLCTILIFMDQQITAVIINRKEHKLKKGAGYHLDLLMVGVMLGVCSVMGLPWFVAATVLSISHVNSLKVESECSAPGEQPKFLGIREQRVTGLMIFILMGLSVFMTSVLKFIPMPVLYGVFLYMGVSSLKGIQLFDRIKLFGMPAKHQPDLIYLRYVPLWKVHIFTVIQLTCLVLLWVIKVSAAAVVFPMMVLALVFVRKLMDLCFTKRELSWLDDLMPESKKKKEDDKKKKEKEEAERMLQDDDDTVHLPFEGGSLLQIPVKALKYSVDPSIVNISDEMAKTAQWKALSMNTENAKVTRSNMSPDKPVSVKISFEDEPRKKYVDAETSL

SEQ ID NO: 36030 - protein, 1210 aa, Homo sapiens
  ENSP00000406804
MEADGAGEQMRPLLTRVTSRGPDEEAVVDLGKTSSTVNTKFEKEELESHRAVYIGVHVPFSKESRRRHRHRGHKHHHRRRKDKESDKEDGRESPSYDTPSQRVQFILGTEDDDEEHIPHDLFTEMDELCYRDGEEYEWKETARWLKFEEDVEDGGDRWSKPYVATLSLHSLFELRSCILNGTVMLDMRASTLDEIADMVLDNMIASGQLDESIRENVREALLKRHHHQNEKRFTSRIPLVRSFADIGEGLSASRHSLRTGLSASNLSLRGESPLSLLLGHLLPSSRAGTPAGSRCTTPVPTPQNSPPSSPSISRLTSRSSQESQRQAPELLVSPASDDIPTVVIHPPEEDLEAALKGEEQKNEENVDLTPGILASPQSAPGNLDNSKSGEIKGNGSGGSRENSTVDFSKVDMNFMRKIPTGAEASNVLVGEVDFLERPIIAFVRLAPAVLLTGLTEVPVPTRFLFLLLGPAGKAPQYHEIGRSIATLMTDEIFHDVAYKAKDRNDLLSGIDEFLDQVTVLPPGEWDPSIRIEPPKSVPSQEKRKIPVFHNGSTPTLGETPKEAAHHAGPELQRTGRLFGGLILDIKRKAPFFLSDFKDALSLQCLASILFLYCACMSPVITFGGLLGEATEGRISAIESLFGASLTGIAYSLFAGQPLTILGSTGPVLVFEKILYKFCRDYQLSYLSLRTSIGLWTSFLCIVLVATDASSLVCYITRFTEEAFAALICIIFIYEALEKLFDLGETYAFNMHNNLDKLTSYSCVCTEPPNPSNETLAQWKKDNITAHNISWRNLTVSECKKLRGVFLGSACGHHGPYIPDVLFWCVILFFTTFFLSSFLKQFKTKRYFPTKVRSTISDFAVFLTIVIMVTIDYLVGVPSPKLHVPEKFEPTHPERGWIISPLGDNPWWTLLIAAIPALLCTILIFMDQQITAVIINRKEHKLKKGAGYHLDLLMVGVMLGVCSVMGLPWFVAATVLSISHVNSLKVESECSAPGEQPKFLGIREQRVTGLMIFILMGLSVFMTSVLKFIPMPVLYGVFLYMGVSSLKGIQLFDRIKLFGMPAKHQPDLIYLRYVPLWKVHIFTVIQLTCLVLLWVIKVSAAAVVFPMMVLALVFVRKLMDLCFTKRELSWLDDLMPESKKKKEDDKKKKEKEEAERMLQDDDDTVHLPFEGGSLLQIPVKALKYSPDKPVSVKISFEDEPRKKYVDAETSL

SEQ ID NO: 36031 - protein, 463 aa, Homo sapiens; identical to SEQ ID NO: 36025
  ENSP00000409418

SEQ ID NO: 36032 - protein, 1051 aa, Homo sapiens
  ENSP00000388703
MERFRLEKKLPGPDEEAVVDLGKTSSTVNTKFEKEELESHRAVYIGVHVPFSKESRRRHRHRGHKHHHRRRKDKESDKEDGRESPSYDTPSQRVQFILGTEDDDEEHIPHDLFTEMDELCYRDGEEYEWKETARWLKFEEDVEDGGDRWSKPYVATLSLHSLFELRSCILNGTVMLDMRASTLDEIADMVLDNMIASGQLDESIRENVREALLKRHHHQNEKRFTSRIPLVRSFADIGKKHSDPHLLERNGILASPQSAPGNLDNSKSGEIKGNGSGGSRENSTVDFSKESASWHCSCGTLGVGLKRPAVDMNFMRKIPTGAEASNVLVGEVDFLERPIIAFVRLAPAVLLTGLTEVPVPTRFLFLLLGPAGKAPQYHEIGRSIATLMTDEIFHDVAYKAKDRNDLLSGIDEFLDQVTVLPPGEWDPSIRIEPPKSVPSQEKRKIPVFHNGSTPTLGETPKEAAHHAGPELQRTGRLFGGLILDIKRKAPFFLSDFKDALSLQCLASILFLYCACMSPVITFGGLLGEATEGRISAIESLFGASLTGIAYSLFAGQPLTILGSTGPVLVFEKILYKFCRDYQLSYLSLRTSIGLWTSFLCIVLVATDASSLVCYITRFTEEAFAALICIIFIYEALEKLFDLGETYAFNMHNNLDKLTSYSCVCTEPPNPSNETLAQWKKDNITAHNISWRNLTVSECKKLRGVFLGSACGHHGPYIPDVLFWCVILFFTTFFLSSFLKQFKTKRYFPTKVRSTISDFAVFLTIVIMVTIDYLVGVPSPKLHVPEKFEPTHPERGWIISPLGDNPWWTLLIAAIPALLCTILIFMDQQITAVIINRKEHKLKKGAGYHLDLLMVGVMLGVCSVMGLPWFVAATVLSISHVNSLKVESECSAPGEQPKFLGIREQRVTGLMIFILMGLSVFMTSVLKFIPMPVLYGVFLYMGVSSLKGIQLFDRIKLFGMPAKHQPDLIYLRYVPLWKVHIFTVIQLTCLVLLWVIKVSAAAVVFPMMVLALVFVRKLMDLCFTKRELSWLDDLMPESKKKKEDDKKKKEKE

SEQ ID NO: 36033 - protein, 1201 aa, Homo sapiens [sequence omitted]

SEQ ID NO: 36034 - protein, 675 aa, Homo sapiens
  ENSP00000289932
MESGTSSPQPPQLDPLDAFPQKGLEPGDIAVLVLYFLFVLAVGLWSTVKTKRDTVKGYFLAGGDMVWWPVGASLFASNVGSGHFIGLAGSGAATGISVSAYELNGLFSVLMLAWIFLPIYIAGQVTTMPEYLRKRFGGIRIPIILAVLYLFIYIFTKISVDMYAGAIFIQQSLHLDLYLAIVGLLAITAVYTVAGGLAAVIYTDALQTLIMLIGALTLMGYSFAAVGGMEGLKEKYFLALASNRSENSSCGLPREDAFHIFRDPLTSDLPWPGVLFGMSIPSLWYWCTDQVIVQRTLAAKNLSHAKGGALMAAYLKVLPLFIMVFPGMVSRILFPDQVACADPEICQKICSNPSGCSDIAYPKLVLELLPTGLRGLMMAVMVAALMSSLTSIFNSASTIFTMDLWNHLRPRASEKELMIVGRVFVLLLVLVSILWIPVVQASQGGQLFIYIQSISSYLQPPVAVVFIMGCFWKRTNEKGAFWGLISGLLLGLVRLVLDFIYVQPRCDQPDERPVLVKSIHYLYFSMILSTVTLITVSTVSWFTEPPSKEMVSHLTWFTRHDPVVQKEQAPPAAPLSLTLSQNGMPEASSSSSVQFEMVQENTSKTHSCDMTPKQSKVVKAILWLCGIQEKGKEELPARAEAIIVSLEENPLVKTLLDVNLIFCVSCAIFIWGYFA

SEQ ID NO: 36035 - protein, 62 aa, Homo sapiens
  ENSP00000458806
MESGTSSPQPPQLDPLDAFPQKGLEPGDIAVLVLYFLFVLAVGLWVGSPSVAQGTRTQWWQS

SEQ ID NO: 36036 - protein, 611 aa, Homo sapiens
  ENSP00000457179
MVWWPVGASLFASNVGSGHFIGLAGSGAATGISVSAYELNGLFSVLMLAWIFLPIYIAGQVTTMPEYLRKRFGGIRIPIILAVLYLFIYIFTKISVDMYAGAIFIQQSLHLDLYLAIVGLLAITAVYTVAGGLAAVIYTDALQTLIMLIGALTLMGYSFAAVGGMEGLKEKYFLALASNRSENSSCGLPREDAFHIFRDPLTSDLPWPGVLFGMSIPSLWYWCTDQVIVQRTLAAKNLSHAKGGALMAAYLKVLPLFIMVFPGMVSRILFPDQVACADPEICQKICSNPSGCSDIAYPKLVLELLPTGLRGLMMAVMVAALMSSLTSIFNSASTIFTMDLWNHLRPRASEKELMIVGRVFVLLLVLVSILWIPVVQASQGGQLFIYIQSISSYLQPPVAVVFIMGCFWKRTNEKGAFWGLISGLLLGLVRLVLDFIYVQPRCDQPDERPVLVKSIHYLYFSMILSTVTLITVSTVSWFTEPPSKEMVSHLTWFTRHDPVVQKEQAPPAAPLSLTLSQNGMPEASSSSSVQFEMVQENTSKTHSCDMTPKQSKVVKAILWLCGIQEKGKEELPARAEAIIVSLEENPLVKTLLDVNLIFCVSCAIFIWGYFA

SEQ ID NO: 36037 - protein, 91 aa, Homo sapiens
  ENSP00000454732
MESGTSSPQPPQLDPLDAFPQKGLEPGDIAVLVLYFLFVLAVGLWSTVKTKRDTVKGYFLAGGDMVWWPVGASLFASNVGSGHFIGLAGSG

SEQ ID NO: 36038 - protein, 605 aa, Homo sapiens
  ENSP00000456234
MESGTSSPQPPQLDPLDAFPQKGLEPGDIAVLVLYFLFVLAVGLWSTVKTKRDTVKGYFLAGGDMVWWPGLFSVLMLAWIFLPIYIAGQVDMYAGAIFIQQSLHLDLYLAIVGLLAITAVYTVAGGLAAVIYTDALQTLIMLIGALTLMGYSFAAVGGMEGLKEKYFLALASNRSENSSCGLPREDAFHIFRDPLTSDLPWPGVLFGMSIPSLWYWCTDQVIVQRTLAAKNLSHAKGGALMAAYLKVLPLFIMVFPGMVSRILFPDQVACADPEICQKICSNPSGCSDIAYPKLVLELLPTGLRGLMMAVMVAALMSSLTSIFNSASTIFTMDLWNHLRPRASEKELMIVGRVFVLLLVLVSILWIPVVQASQGGQLFIYIQSISSYLQPPVAVVFIMGCFWKRTNEKGAFWGLISGLLLGLVRLVLDFIYVQPRCDQPDERPVLVKSIHYLYFSMILSTVTLITVSTVSWFTEPPSKEMVSHLTWFTRHDPVVQKEQAPPAAPLSLTLSQNGMPEASSSSSVQFEMVQENTSKTHSCDMTPKQSKVVKAILWLCGIQEKGKEELPARAEAIIVSLEENPLVKTLLDVNLIFCVSCAIFIWGYFA

SEQ ID NO: 36039 - protein, 640 aa, Homo sapiens
  ENSP00000454401
MESGTSSPQPPQLDPLDAFPQKGLEPGDIAVLVLYFLFVLAVGLWSTVKTKRDTVKGYFLAGGDMVWWPVGASLFASNVGSGHFIGLAGSGAATGISVSAYELNGLFSVLMLAWIFLPIYIAGQVDMYAGAIFIQQSLHLDLYLAIVGLLAITAVYTVAGGLAAVIYTDALQTLIMLIGALTLMGYSFAAVGGMEGLKEKYFLALASNRSENSSCGLPREDAFHIFRDPLTSDLPWPGVLFGMSIPSLWYWCTDQVIVQRTLAAKNLSHAKGGALMAAYLKVLPLFIMVFPGMVSRILFPDQVACADPEICQKICSNPSGCSDIAYPKLVLELLPTGLRGLMMAVMVAALMSSLTSIFNSASTIFTMDLWNHLRPRASEKELMIVGRVFVLLLVLVSILWIPVVQASQGGQLFIYIQSISSYLQPPVAVVFIMGCFWKRTNEKGAFWGLISGLLLGLVRLVLDFIYVQPRCDQPDERPVLVKSIHYLYFSMILSTVTLITVSTVSWFTEPPSKEMVSHLTWFTRHDPVVQKEQAPPAAPLSLTLSQNGMPEASSSSSVQFEMVQENTSKTHSCDMTPKQSKVVKAILWLCGIQEKGKEELPARAEAIIVSLEENPLVKTLLDVNLIFCVSCAIFIWGYFA

SEQ ID NO: 36040 - protein, 519 aa, Homo sapiens
  ENSP00000456376
MVWWPVGASLFASNVGSGHFIGLAGSGAATGISVSAYELNGLFSVLMLAWIFLPIYIAGQVTTMPEYLRKRFGGIRIPIILAVLYLFIYIFTKISVDMYAGAIFIQQSLHLDLYLAIVGLLAITAVYTVAGGLAAVIYTDALQTLIMLIGALTLMGYSDCPADSGCQEPVPCQRRCSDGCIPEGAAPLHNGVPWDGQPHPLPRSSGLCRSRDLPEDLQQPLRLFGHRVSQTRAGTPAHSASTIFTMDLWNHLRPRASEKELMIVGRVFVLLLVLVSILWIPVVQASQGGQLFIYIQSISSYLQPPVAVVFIMGCFWKRTNEKGAFWGLISGLLLGLVRLVLDFIYVQPRCDQPDERPVLVKSIHYLYFSMILSTVTLITVSTVSWFTEPPSKEMVSHLTWFTRHDPVVQKEQAPPAAPLSLTLSQNGMPEASSSSSVQFEMVQENTSKTHSCDMTPKQSKVVKAILWLCGIQEKGKEELPARAEAIIVSLEENPLVKTLLDVNLIFCVSCAIFIWGYFA

SEQ ID NO: 36041 - protein, 605 aa, Homo sapiens; identical to SEQ ID NO: 36038
  ENSP00000441384

SEQ ID NO: 36042 - protein, 519 aa, Homo sapiens; identical to SEQ ID NO: 36040
  ENSP00000389606

SEQ ID NO: 36043 - protein, 640 aa, Homo sapiens; identical to SEQ ID NO: 36039
  ENSP00000416782

SEQ ID NO: 36044 - protein, 659 aa, Homo sapiens
  ENSP00000266086
MASTVSPSTIAETPEPPPLSDHIRNAADISVIVIYFLVVMAVGLWAMLKTNRGTIGGFFLAGRDMAWWPMGASLFASNIGSNHYVGLAGTGAASGVATVTFEWTSSVMLLILGWIFVPIYIKSGVMTMPEYLKKRFGGERLQVYLSILSLFICVVLLISADIFAGAIFIKLALGLDLYLAIFILLAMTAVYTTTGGLASVIYTDTLQTIIMLIGSFILMGFAFNEVGGYESFTEKYVNATPSVVEGDNLTISASCYTPRADSFHIFRDAVTGDIPWPGIIFGMPITALWYWCTNQVIVQRCLCGKDMSHVKAACIMCAYLKLLPMFLMVMPGMISRILYTDMVACVVPSECVKHCGVDVGCTNYAYPTMVLELMPQGLRGLMLSVMLASLMSSLTSIFNSASTLFTIDLYTKMRKQASEKELLIAGRIFVLLLTVVSIVWVPLVQVSQNGQLIHYTESISSYLGPPIAAVFVLAIFCKRVNEQGAFWGLMVGLAMGLIRMITEFAYGTGSCLAPSNCPKIICGVHYLYFSIVLFFGSMLVTLGISLLTKPIPDVHLYRLCWVLRNSTEERIDIDAEEKSQEETDDGVEEDYPEKSRGCLKKAYDLFCGLQKGPKLTKEEEEALSKKLTDTSERPSWRTIVNINAILLLAVVVFIHGYYA

SEQ ID NO: 36045 - protein, 580 aa, Homo sapiens
  ENSP00000387346
MAFHVEGLIAIIVFYLLILLVGIWAAWRTKNSGSAEERSEAIIVGGRDIGLLVGGFTMTATWVGGGYINGTAEAVYVPGYGLAWAQAPIGYSLSLILGGLFFAKPMRSKGYVTMLDPFQQIYGKRMGGLLFIPALMGEMFWAAAIFSALGATISVIIDVDMHISVIISALIATLYTLVGGLYSVAYTDVVQLFCIFVGLWISVPFALSHPAVADIGFTAVHAKYQKPWLGTVDSSEVYSWLDSFLLLMLGGIPWQAYFQRVLSSSSATYAQVLSFLAAFGCLVMAIPAILIGAIGASTDWNQTAYGLPDPKTTEEADMILPIVLQYLCPVYISFFGLGAVSAAVMSSADSSILSASSMFARNIYQLSFRQNASDKEIVWVMRITVFVFGASATAMALLTKTVYGLWYLSSDLVYIVIFPQLLCVLFVKGTNTYGAVAGYVSGLFLRITGGEPYLYLQPLIFYPGYYPDDNGIYNQKFPFKTLAMVTSFLTNICISYLAKYLFESGTLPPKLDVFDAVVARHSEENMDKTILVKNENIKLDELALVKPRQSMTLSSTFTNKEAFLDVDSSPEGSGTEDNLQ

SEQ ID NO: 36046 - protein, 580 aa, Homo sapiens; identical to SEQ ID NO: 36045
  ENSP00000264047

SEQ ID NO: 36047 - protein, 610 aa, Homo sapiens
  ENSP00000445340
MDTPRGIGTFVVWDYVVFAGMLVISAAIGIYYAFAGGGQQTSKDFLMGGRRMTAVPVALSLTASFMSAVTVLGTPSEVYRFGAIFSIFAFTYFFVVVISAEVFLPVFYKLGITSTYEYLELRFNKCVRLCGTVLFIVQTILYTGIVIYAPALALNQVTGFDLWGAVVATGVVCTFYCTLGGLKAVIWTDVFQVGIMVAGFASVIIQAVVMQGGISTILNDAYDGGRLNFWNFNPNPLQRHTFWTIIIGGTFTWTSIYGVNQSQVQRYISCKSRFQAKLSLYINLVGLWAILTCSVFCGLALYSRYHDCDPWTAKKVSAPDQLMPYLVLDILQDYPGLPGLFVACAYSGTLSTVSSSINALAAVTVEDLIKPYFRSLSERSLSWISQGMSVVYGALCIGMAALASLMGALLQAALSVFGMVGGPLMGLFALGILVPFANSIGALVGLMAGFAISLWVGIGAQIYPPLPERTLPLHLDIQGCNSTYNETNLMTTTEMPFTTSVFQIYNVQRTPLMDNWYSLSYLYFSTVGTLVTLLVGILVSLSTGGRKQNLDPRYILTKEDFLSNFDIFKKKKHVLSYKSHPVEDGGTDNPAFNHIELNSDQSGKSNGTRL

SEQ ID NO: 36048 - protein, 610 aa, Homo sapiens; identical to SEQ ID NO: 36047
  ENSP00000461697

SEQ ID NO: 36049 - protein, 614 aa, Homo sapiens
  ENSP00000352702
MDGKVAVQECGPPAVSWVPEEGEKLDQEDEDQVKDRGQWTNKMEFVLSVAGEIIGLGNVWRFPYLCYKNGGGAFFIPYFIFFFVCGIPVFFLEVALGQYTSQGSVTAWRKICPLFQGIGLASVVIESYLNVYYIIILAWALFYLFSSFTSELPWTTCNNFWNTEHCTDFLNHSGAGTVTPFENFTSPVMEFWERRVLGITSGIHDLGSLRWELALCLLLAWVICYFCIWKGVKSTGKVVYFTATFPYLMLVILLIRGVTLPGAYQGIIYYLKPDLFRLKDPQVWMDAGTQIFFSFAICQGCLTALGSYNKYHNNCYKDCIALCFLNSATSFVAGFVVFSILGFMSQEQGVPISEVAESGPGLAFIAFPKAVTMMPLSQLWSCLFFIMLIFLGLDSQFVCVECLVTASIDMFPRQLRKSGRRELLILTIAVMCYLIGLFLVTEGGMYIFQLFDYYASSGICLLFLSLFEVVCISWVYGADRFYDNIEDMIGYRPWPLVKISWLFLTPGLCLATFLFSLSKYTPLKYNNVYVYPPWGYSIGWFLALSSMVCVPLFVVITLLKTRGPFRKRLRQLITPDSSLPQPKQHPCLDGSAGRNFGPSPTREGLIAGEKETHL

SEQ ID NO: 36050 - protein, 614 aa, Homo sapiens; identical to SEQ ID NO: 36049
  ENSP00000399136

SEQ ID NO: 36051 - protein, 614 aa, Homo sapiens; identical to SEQ ID NO: 36049
  ENSP00000444268

SEQ ID NO: 36052 - protein, 146 aa, Homo sapiens
  ENSP00000439351
MDGKVAVQECGPPAVSWVPEEGEKLDQEDEDQVKDRGQWTNKMEFVLSVAGEIIGLGNVWRFPYLCYKNGGGAFFIPYFIFFFVCGIPVFFLEVALGQYTSQGSVTAWRKICPLFQGIGLASVVIESYLNVYYIIILAWALFYLFS

SEQ ID NO: 36053 - protein, 81 aa, Homo sapiens
  ENSP00000446082
MDGKVAVQECGPPAVSWVPEEGEKLDQEDEDQEPSSSPTSSSSLSAASRCSSWRWRWANTPAKGVSQPGGRSAPSSRALVW

SEQ ID NO: 36054 - protein, 614 aa, Homo sapiens; identical to SEQ ID NO: 36049
  ENSP00000380464

SEQ ID NO: 36055 - protein, 602 aa, Homo sapiens
  ENSP00000339260
MDSRVSGTTSNGETKPVYPVMEKKEEDGTLERGHWNNKMEFVLSVAGEIIGLGNVWRFPYLCYKNGGGAFFIPYLVFLFTCGIPVFLLETALGQYTSQGGVTAWRKICPIFEGIGYASQMIVILLNVYYIIVLAWALFYLFSSFTIDLPWGGCYHEWNTEHCMEFQKTNGSLNGTSENATSPVIEFWERRVLKISDGIQHLGALRWELALCLLLAWVICYFCIWKGVKSTGKVVYFTATFPYLMLVVLLIRGVTLPGAAQGIQFYLYPNLTRLWDPQVWMDAGTQIFFSFAICLGCLTALGSYNKYHNNCYRDCIALCFLNSGTSFVAGFAIFSILGFMSQEQGVPISEVAESGPGLAFIAYPRAVVMLPFSPLWACCFFFMVVLLGLDSQFVCVESLVTALVDMYPHVFRKKNRREVLILGVSVVSFLVGLIMLTEGGMYVFQLFDYYAASGMCLLFVAIFESLCVAWVYGAKRFYDNIEDMIGYRPWPLIKYCWLFLTPAVCTATFLFSLIKYTPLTYNKKYTYPWWGDALGWLLALSSMVCIPAWSLYRLGTLKGPFRERIRQLMCPAEDLPQRNPAGPSAPATPRTSLLRLTELESHC

SEQ ID NO: 36056 - protein, 150 aa, Homo sapiens
  ENSP00000444606
MDSRVSGTTSNGETKPVYPVMEKKEEDGTLERGHWNNKMEFVLSVAGEIIGLGNVWRFPYLCYKNGGEHCMEFQKTNGSLNGTSENATSPVIEFWERRVLKISDGIQHLGALRWELALCLLLAWVICYFCIWKGVKSTGKVVYFTATFPY

SEQ ID NO: 36057 - protein, 123 aa, Homo sapiens
  ENSP00000437386
MDSRVSGTTSNGETKPVYPVMEKKEEDGTLERGHWNNKMEFVLSVAGEIIGLGNVWRFPYLCYKNGGGAFFIPYLVFLFTCGIPVFLLETALGQYTSQGGVTAWRKICPIFEVSPQALAMPPR

SEQ ID NO: 36058 - protein, 69 aa, Homo sapiens
  ENSP00000443466
MIVILLNVYYIIVLAWALFYLFSSFTIDLPWGGCYHEWNTGGDFAQDAYIEMLACLEAADLKSTFPVAI

SEQ ID NO: 36059 - protein, 97 aa, Homo sapiens
  ENSP00000389316
MDSRVSGTTSNGETKPVYPVMEKKEEDGTLERGHWNNKMEFVLSVAGEIIGLGNVWRFPYLCYKNGGGEMRALVPPHPLLEGGYFHLLHLRPLWGVP

SEQ ID NO: 36060 - protein, 510 aa, Homo sapiens
  ENSP00000407104
MDSRVSGTTSNGETKPVYPVMEKKEEDGTLERGHWNNKMEFVLSVAGEIIGLGNVWRFPYLCYKNGGEHCMEFQKTNGSLNGTSENATSPVIEFWERRVLKISDGIQHLGALRWELALCLLLAWVICYFCIWKGVKSTGKVVYFTATFPYLMLVVLLIRGVTLPGAAQGIQFYLYPNLTRLWDPQVWMDAGTQIFFSFAICLGCLTALGSYNKYHNNCYRDCIALCFLNSGTSFVAGFAIFSILGFMSQEQGVPISEVAESGPGLAFIAYPRAVVMLPFSPLWACCFFFMVVLLGLDSQFVCVESLVTALVDMYPHVFRKKNRREVLILGVSVVSFLVGLIMLTEGGMYVFQLFDYYAASGMCLLFVAIFESLCVAWVYGAKRFYDNIEDMIGYRPWPLIKYCWLFLTPAVCTATFLFSLIKYTPLTYNKKYTYPWWGDALGWLLALSSMVCIPAWSLYRLGTLKGPFRERIRQLMCPAEDLPQRNPAGPSAPATPRTSLLRLTELESHC

SEQ ID NO: 36061 - protein, 636 aa, Homo sapiens
  ENSP00000230671
MKKLQGAHLRKPVTPDLLMTPSDQGDVDLDVDFAAHRGNWTGKLDFLLSCIGYCVGLGNVWRFPYRAYTNGGGAFLVPYFLMLAICGIPLFFLELSLGQFSSLGPLAVWKISPLFKGAGAAMLLIVGLVAIYYNMIIAYVLFYLFASLTSDLPWEHCGNWWNTELCLEHRVSKDGNGALPLNLTCTVSPSEEYWSRYVLHIQGSQGIGSPGEIRWNLCLCLLLAWVIVFLCILKGVKSSGKVVYFTATFPYLILLMLLVRGVTLPGAWKGIQFYLTPQFHHLLSSKVWIEAALQIFYSLGVGFGGLLTFASYNTFHQNIYRDTFIVTLGNAITSILAGFAIFSVLGYMSQELGVPVDQVAKAGPGLAFVVYPQAMTMLPLSPFWSFLFFFMLLTLGLDSQFAFLETIVTAVTDEFPYYLRPKKAVFSGLICVAMYLMGLILTTDGGMYWLVLLDDYSASFGLMVVVITTCLAVTRVYGIQRFCRDIHMMLGFKPGLYFRACWLFLSPATLLALMVYSIVKYQPSEYGSYRFPPWAELLGILMGLLSCLMIPAGMLVAVLREEGSLWERLQQASRPAMDWGPSLEENRTGMYVATLAGSQSPKPLMVHMRKYGGITSFENTAIEVDREIAEEEESMM

SEQ ID NO: 36062 - protein, 666 aa, Homo sapiens
  ENSP00000428200
MKKLQGAHLRKPVTPDLLMTPSDQGDVDLDVDFAAHRGNWTGKLDFLLSCIGYCVGLGNVWRFPYRAYTNGGGAFLVPYFLMLAICGIPLFFLELSLGQFSSLGPLAVWKISPLFKGAGAAMLLIVGLVAIYYNMIIAYVLFYLFASLTSDLPWEHCGNWWNTELCLEHRVSKDGNGALPLNLTCTVSPSEEYWSRYVLHIQGSQGIGSPGEIRWNLCLCLLLAWVIVFLCILKGVKSSGKVVYFTATFPYLILLMLLVRGVTLPGAWKGIQFYLTPQFHHLLSSKVWIEAALQIFYSLGVGFGGLLTFASYNTFHQNIYRDTFIVTLGNAITSILAGFAIFSVLGYMSQELGVPVDQVAKAGPGLAFVVYPQAMTMLPLSPFWSFLFFFMLLTLGLDSQFAFLETIVTAVTDEFPYYLRPKKAVFSGLICVAMYLMGLILTTDGGMYWLVLLDDYSASFGLMVVVITTCLAVTRVYGIQRFCRDIHMMLGFKPGLYFRACWLFLSPATLLALMVYSIVKYQPSEYGSYRFPPWAELLGILMGLLSCLMIPAGMLVAVLREEGSLWERLQQASRPAMDWGPSLEENRTGMYVATLAGSQSPKPLMVHMRKGTSARGLLYARMTVSATYIRSTDKMLSCLQGAHSSAETCLGDFKPEICGEEVTVVG

SEQ ID NO: 36063 - protein, 629 aa, Homo sapiens
  ENSP00000370128
MGCKVLLNIGQQMLRRKVVDCSREETRLSRCLNTFDLVALGVGSTLGAGVYVLAGAVARENAGPAIVISFLIAALASVLAGLCYGEFGARVPKTGSAYLYSYVTVGELWAFITGWNLILSYIIGTSSVARAWSATFDELIGRPIGEFSRTHMTLNAPGVLAENPDIFAVIIILILTGLLTLGVKESAMVNKIFTCINVLVLGFIMVSGFVKGSVKNWQLTEEDFGNTSGRLCLNNDTKEGKPGVGGFMPFGFSGVLSGAATCFYAFVGFDCIATTGEEVKNPQKAIPVGIVASLLICFIAYFGVSAALTLMMPYFCLDNNSPLPDAFKHVGWEGAKYAVAVGSLCALSASLLGSMFPMPRVIYAMAEDGLLFKFLANVNDRTKTPIIATLASGAVAAVMAFLFDLKDLVDLMSIGTLLAYSLVAACVLVLRYQPEQPNLVYQMASTSDELDPADQNELASTNDSQLGFLPEAEMFSLKTILSPKNMEPSKISGLIVNISTSLIAVLIITFCIVTVLGREALTKGALWAVFLLAGSALLCAVVTGVIWRQPESKTKLSFKVPFLPVLPILSIFVNVYLMMQLDQGTWVRFAVWMLIGFIIYFGYGLWHSEEASLDADQARTPDGNLDQCK

SEQ ID NO: 36064 - protein, 121 aa, Homo sapiens
  ENSP00000390092
MGCKVLLNIGQQMLRRKVVDCSREETRLSRCLNTFDLVALGVGSTLGAGVYVLAGAVARENAGPAIVISFLIAALASVLAGLCYGEFGARVPKTGSAYLYSYVTVGELWAFITGWNLILSY

SEQ ID NO: 36065 - protein, 523 aa, Homo sapiens
  ENSP00000253188
MAGHTQQPSGRGNPRPAPSPSPVPGTVPGASERVALKKEIGLLSACTIIIGNIIGSGIFISPKGVLEHSGSVGLALFVWVLGGGVTALGSLCYAELGVAIPKSGGDYAYVTEIFGGLAGFLLLWSAVLIMYPTSLAVISMTFSNYVLQPVFPNCIPPTTASRVLSMACLMLLTWVNSSSVRWATRIQDMFTGGKLLALSLIIGVGLLQIFQGHFEELRPSNAFAFWMTPSVGHLALAFLQGSFAFSGWNFLNYVTEEMVDARKNLPRAIFISIPLVTFVYTFTNIAYFTAMSPQELLSSNAVAVTFGEKLLGYFSWVMPVSVALSTFGGINGYLFTYSRLCFSGAREGHLPSLLAMIHVRHCTPIPALLVCCGATAVIMLVGDTYTLINYVSFINYLCYGVTILGLLLLRWRRPALHRPIKVNLLIPVAYLVFWAFLLVFSFISEPMVCGVGVIIILTGVPIFFLGVFWRSKPKCVHRLTESMTHWGQELCFVVYPQDAPEEEENGPCPPSLLPATDKPSKPQ

SEQ ID NO: 36066 - protein, 389 aa, Homo sapiens
  ENSP00000465421
MAGHTQQPSGRGNPRPAPSPSPVPGTVPGASERVALKKEIGLLSACTIIIGNIIGSGIFISPKGVLEHSGSVGLALFVWVLGGGVTALGSLCYAELGVAIPKSGGDYAYVTEIFGGLAGFLLLWSAVLIMYPTSLAVISMTFSNYVLQPVFPNCIPPTTASRVLSMACLMLLTWVNSSSVRWATRIQDMFTGGKLLALSLIIGVGLLQIFQGHFEELRPSNAFAFWMTPSVGHLALAFLQGSFAFSGWNFLNYVTEEMVDARKNLPRAIFISIPLVTFVYTFTNIAYFTAMSPQELLSSNAVAVTFGEKLLGYFSWVMPVSVALSTFGGINGYLFTYSSAGPQPSSCSWATRTRSSTMCPSSTTSATASPSWACCCCAGGGLHSTGPSR

SEQ ID NO: 36067 - protein, 71 aa, Homo sapiens
  ENSP00000466876
MAGHTQQPSGRGNPRPAPSPSPVPGTVPGASERVALKKEIGLLSACTIIIAFCCSGAPSSSCTPPALLSSP

SEQ ID NO: 36068 - protein, 71 aa, Homo sapiens; identical to SEQ ID NO: 36067
  ENSP00000466410

SEQ ID NO: 36069 - protein, 75 aa, Homo sapiens
  ENSP00000424046
AILIIIVPGVMQLIKGQTQNFKDAFSGRDSSITRLPLAFYYGMYAYAGWFYLNFVTEEVENPEKPFLSGYWEISH

SEQ ID NO: 36070 - protein, 501 aa, Homo sapiens
  ENSP00000280612
MVRKPVVSTISKGGYLQGNVNGRLPSLGNKEPPGQEKVQLKRKVTLLRGVSIIIGTIIGAGIFISPKGVLQNTGSVGMSLTIWTVCGVLSLFGALSYAELGTTIKKSGGHYTYILEVFGPLPAFVRVWVELLIIRPAATAVISLAFGRYILEPFFIQCEIPELAIKLITAVGITVVMVLNSMSVSWSARIQIFLTFCKLTAILIIIVPGVMQLIKGQTQNFKDAFSGRDSSITRLPLAFYYGMYAYAGWFYLNFVTEEVENPEKTIPLAICISMAIVTIGYVLTNVAYFTTINAEELLLSNAVAVTFSERLLGNFSLAVPIFVALSCFGSMNGGVFAVSRLFYVASREGHLPEILSMIHVRKHTPLPAVIVLHPLTMIMLFSGDLDSLLNFLSFARWLFIGLAVAGLIYLRYKCPDMHRPFKVPLFIPALFSFTCLFMVALSLYSDPFSTGIGFVITLTGVPAYYLFIIWDKKPRWFRIMSEKITRTLQIILEVVPEEDKL

SEQ ID NO: 36071 - protein, 771 aa, Homo sapiens
  ENSP00000231706
MSGFFTSLDPRRVQWGAAWYAMHSRILRTKPVESMLEGTGTTTAHGTKLAQVLTTVDLISLGVGSCVGTGMYVVSGLVAKEMAGPGVIVSFIIAAVASILSGVCYAEFGVRVPKTTGSAYTYSYVTVGEFVAFFIGWNLILEYLIGTAAGASALSSMFDSLANHTISRWMADSVGTLNGLGKGEESYPDLLALLIAVIVTIIVALGVKNSIGFNNVLNVLNLAVWVFIMIAGLFFINGKYWAEGQFLPHGWSGVLQGAATCFYAFIGFDIIATTGEEAKNPNTSIPYAITASLVICLTAYVSVSVILTLMVPYYTIDTESPLMEMFVAHGFYAAKFVVAIGSVAGLTVSLLGSLFPMPRVIYAMAGDGLLFRFLAHVSSYTETPVVACIVSGFLAALLALLVSLRDLIEMMSIGTLLAYTLVSVCVLLLRYQPESDIDGFVKFLSEEHTKKKEGILADCEKEACSPVSEGDEFSGPATNTCGAKNLPSLGDNEMLIGKSDKSTYNVNHPNYGTVDMTTGIEADESENIYLIKLKKLIGPHYYTMRIRLGLPGKMDRPTAATGHTVTICVLLLFILMFIFCSFIIFGSDYISEQSWWAILLVVLMVLLISTLVFVILQQPENPKKLPYMAPCLPFVPAFAMLVNIYLMLKLSTITWIRFAVWCFVGLLIYFGYGIWNSTLEISAREEALHQSTYQRYDVDDPFSVEEGFSYATEGESQEDWGGPTEDKGFYYQQMSDAKANGRTSSKAKSKSKHKQNSEALIANDELDYSPE

SEQ ID NO: 36072 - protein, 619 aa, Homo sapiens
  ENSP00000363417
MPWQAFRRFGQKLVRRRTLESGMAETRLARCLSTLDLVALGVGSTLGAGVYVLAGEVAKDKAGPSIVICFLVAALSSVLAGLCYAEFGARVPRSGSAYLYSYVTVGELWAFTTGWNLILSYVIGTASVARAWSSAFDNLIGNHISKTLQGSIALHVPHVLAEYPDFFALGLVLLLTGLLALGASESALVTKVFTGVNLLVLGFVMISGFVKGDVHNWKLTEEDYELAMAELNDTYSLGPLGSGGFVPFGFEGILRGAATCFYAFVGFDCIATTGEEAQNPQRSIPMGIVISLSVCFLAYFAVSSALTLMMPYYQLQPESPLPEAFLYIGWAPARYVVAVGSLCALSTSLLGSMFPMPRVIYAMAEDGLLFRVLARIHTGTRTPIIATVVSGIIAAFMAFLFKLTDLVDLMSIGTLLAYSLVSICVLILRYQPDQETKTGEEVELQEEAITTESEKLTLWGLFFPLNSIPTPLSGQIVYVCSSLLAVLLTALCLVLAQWSVPLLSGDLLWTAVVVLLLLLIIGIIVVIWRQPQSSTPLHFKVPALPLLPLMSIFVNIYLMMQMTAGTWARFGVWMLIGFAIYFGYGIQHSLEEIKSNQPSRKSRAKTVDLDPGTLYVHSV

SEQ ID NO: 36073 - protein, 619 aa, Homo sapiens; identical to SEQ ID NO: 36072
  ENSP00000298085

SEQ ID NO: 36074 - protein, 241 aa, Homo sapiens
  ENSP00000454323
MINPYRNLPLAIIISLPIVTLVYVLTNLAYFTTLSTEQMLSSEAVAVDFGNYHLGVMSWIIPVFVGLSCFGSVNGSLFTSSRLFFVGSREGHLPSILSMIHPQLLTPVPSLVFTCVMTLLYAFSKDIFSVINFFSFFNWLCVALAIIGMIWLRHRKPELERPIKVNLALPVFFILACLFLIAVSFWKTPVECGIGFTIILSGLPVYFFGVWWKNKPKWLLQGIFSTTVLCQKLMQVVPQET

SEQ ID NO: 36075 - protein, 507 aa, Homo sapiens
  ENSP00000261622
MAGAGPKRRALAAPAAEEKEEAREKMLAAKSADGSAPAGEGEGVTLQRNITLLNGVAIIVGTIIGSGIFVTPTGVLKEAGSPGLALVVWAACGVFSIVGALCYAELGTTISKSGGDYAYMLEVYGSLPAFLKLWIELLIIRPSSQYIVALVFATYLLKPLFPTCPVPEEAAKLVACLCVLLLTAVNCYSVKAATRVQDAFAAAKLLALALIILLGFVQIGKGDVSNLDPNFSFEGTKLDVGNIVLALYSGLFAYGGWNYLNFVTEEMINPYRNLPLAIIISLPIVTLVYVLTNLAYFTTLSTEQMLSSEAVAVDFGNYHLGVMSWIIPVFVGLSCFGSVNGSLFTSSRLFFVGSREGHLPSILSMIHPQLLTPVPSLVFTCVMTLLYAFSKDIFSVINFFSFFNWLCVALAIIGMIWLRHRKPELERPIKVNLALPVFFILACLFLIAVSFWKTPVECGIGFTIILSGLPVYFFGVWWKNKPKWLLQGIFSTTVLCQKLMQVVPQET

SEQ ID NO: 36076 - protein, 937 aa, Homo sapiens
  ENSP00000383886
MYNMRRLSLSPTFSMGFHLLVTVSLLFSHVDHVIAETEMEGEGNETGECTGSYYCKKGVILPIWEPQDPSFGDKIARATVYFVAMVYMFLGVSIIADRFMSSIEVITSQEKEITIKKPNGETTKTTVRIWNETVSNLTLMALGSSAPEILLSVIEVCGHNFTAGDLGPSTIVGSAAFNMFIIIALCVYVVPDGETRKIKHLRVFFVTAAWSIFAYTWLYIILSVISPGVVEVWEGLLTFFFFPICVVFAWVADRRLLFYKYVYKRYRAGKQRGMIIEHEGDRPSSKTEIEMDGKVVNSHVENFLDGALVLEVDERDQDDEEARREMARILKELKQKHPDKEIEQLIELANYQVLSQQQKSRAFYRIQATRLMTGAGNILKRHAADQARKAVSMHEVNTEVTENDPVSKIFFEQGTYQCLENCGTVALTIIRRGGDLTNTVFVDFRTEDGTANAGSDYEFTEGTVVFKPGDTQKEIRVGIIDDDIFEEDENFLVHLSNVKVSSEASEDGILEANHVSTLACLGSPSTATVTIFDDDHAGIFTFEEPVTHVSESIGIMEVKVLRTSGARGNVIVPYKTIEGTARGGGEDFEDTCGELEFQNDEIVKIITIRIFDREEYEKECSFSLVLEEPKWIRRGMKGGFTITDEYDDKQPLTSKEEEERRIAEMGRPILGEHTKLEVIIEESYEFKSTVDKLIKKTNLALVVGTNSWREQFIEAITVSAGEDDDDDECGEEKLPSCFDYVMHFLTVFWKVLFAFVPPTEYWNGWACFIVSILMIGLLTAFIGDLASHFGCTIGLKDSVTAVVFVALGTSVPDTFASKVAATQDQYADASIGNVTGSNAVNVFLGIGVAWSIAAIYHAANGEQFKVSPGTLAFSVTLFTIFAFINVGVLLYRRRPEIGGELGGPRTAKLLTSCLFVLLWLLYIFFSSLEAYCHIKGF

SEQ ID NO: 36077 - protein, 664 aa, Homo sapiens
  ENSP00000386116
MRRLSLSPTFSMGFHLLVTVSLLFSHVDHVIAETEMEGEGNETGECTGSYYCKKGVILPIWEPQDPSFGDKIARATVYFVAMVYMFLGVSIIADRFMSSIEVITSQEKEITIKKPNGETTKTTVRIWNETVSNLTLMALGSSAPEILLSVIEVCGHNFTAGDLGPSTIVGSAAFNMFIIIALCVYVVPDGETRKIKHLRVFFVTAAWSIFAYTWLYIILSVISPGVVEVWEGLLTFFFFPICVVFAWVADRRLLFYKYVYKRYRAGKQRGMIIEHEGDRPSSKTEIEMDGKVVNSHVENFLDGALVLEVDERDQDDEEARREMARILKELKQKHPDKEIEQLIELANYQVLSQQQKSRAFYRIQATRLMTGAGNILKRHAADQARKAVSMHEVNTEVTENDPVSKIFFEQGTYQCLENCGTVALTIIRRGGDLTNTVFVDFRTEDGTANAGSDYEFTEGTVVFKPGDTQKEIRVGIIDDDIFEEDENFLVHLSNVKVSSEASEDGILEANHVSTLACLGSPSTATVTIFDDDHAGIFTFEEPVTHVSESIGIMEVKVLRTSGARGNVIVPYKTIEGTARGGGEDFEDTCGELEFQNDEIVKTISVKVIDDEEYEKNKTFFLEIGEPRLVEMSEKKGRSLPLEYLTVRNMRKSAVSPLCLRNQNG

SEQ ID NO: 36078 - protein, 973 aa, Homo sapiens
  ENSP00000384763
MYNMRRLSLSPTFSMGFHLLVTVSLLFSHVDHVIAETEMEGEGNETGECTGSYYCKKGVILPIWEPQDPSFGDKIARATVYFVAMVYMFLGVSIIADRFMSSIEVITSQEKEITIKKPNGETTKTTVRIWNETVSNLTLMALGSSAPEILLSVIEVCGHNFTAGDLGPSTIVGSAAFNMFIIIALCVYVVPDGETRKIKHLRVFFVTAAWSIFAYTWLYIILSVISPGVVEVWEGLLTFFFFPICVVFAWVADRRLLFYKYVYKRYRAGKQRGMIIEHEGDRPSSKTEIEMDGKVVNSHVENFLDGALVLEVDERDQDDEEARREMARILKELKQKHPDKEIEQLIELANYQVLSQQQKSRAFYRIQATRLMTGAGNILKRHAADQARKAVSMHEVNTEVTENDPVSKIFFEQGTYQCLENCGTVALTIIRRGGDLTNTVFVDFRTEDGTANAGSDYEFTEGTVVFKPGDTQKEIRVGIIDDDIFEEDENFLVHLSNVKVSSEASEDGILEANHVSTLACLGSPSTATVTIFDDDHAGIFTFEEPVTHVSESIGIMEVKVLRTSGARGNVIVPYKTIEGTARGGGEDFEDTCGELEFQNDEIVKTISVKVIDDEEYEKNKTFFLEIGEPRLVEMSEKKALLLNELGGFTITGKYLFGQPVFRKVHAREHPILSTVITIADEYDDKQPLTSKEEEERRIAEMGRPILGEHTKLEVIIEESYEFKSTVDKLIKKTNLALVVGTNSWREQFIEAITVSAGEDDDDDECGEEKLPSCFDYVMHFLTVFWKVLFAFVPPTEYWNGWACFIVSILMIGLLTAFIGDLASHFGCTIGLKDSVTAVVFVALGTSVPDTFASKVAATQDQYADASIGNVTGSNAVNVFLGIGVAWSIAAIYHAANGEQFKVSPGTLAFSVTLFTIFAFINVGVLLYRRRPEIGGELGGPRTAKLLTSCLFVLLWLLYIFFSSLEAYCHIKGF

SEQ ID NO: 36079 - protein, 968 aa, Homo sapiens
  ENSP00000385678
MYNMRRLSLSPTFSMGFHLLVTVSLLFSHVDHVIAETEMEGEGNETGECTGSYYCKKGVILPIWEPQDPSFGDKIARATVYFVAMVYMFLGVSIIADRFMSSIEVITSQEKEITIKKPNGETTKTTVRIWNETVSNLTLMALGSSAPEILLSVIEVCGHNFTAGDLGPSTIVGSAAFNMFIIIALCVYVVPDGETRKIKHLRVFFVTAAWSIFAYTWLYIILSVISPGVVEVWEGLLTFFFFPICVVFAWVADRRLLFYKYVYKRYRAGKQRGMIIEHEGDRPSSKTEIEMDGKVVNSHVENFLDGALVLEVDERDQDDEEARREMARILKELKQKHPDKEIEQLIELANYQVLSQQQKSRAFYRIQATRLMTGAGNILKRHAADQARKAVSMHEVNTEVTENDPVSKIFFEQGTYQCLENCGTVALTIIRRGGDLTNTVFVDFRTEDGTANAGSDYEFTEGTVVFKPGDTQKEIRVGIIDDDIFEEDENFLVHLSNVKVSSEASEDGILEANHVSTLACLGSPSTATVTIFDDDHAGIFTFEEPVTHVSESIGIMEVKVLRTSGARGNVIVPYKTIEGTARGGGEDFEDTCGELEFQNDEIVKTISVKVIDDEEYEKNKTFFLEIGEPRLVEMSEKKALLLNELGGFTITGQPVFRKVHAREHPILSTVITIADEYDDKQPLTSKEEEERRIAEMGRPILGEHTKLEVIIEESYEFKSTVDKLIKKTNLALVVGTNSWREQFIEAITVSAGEDDDDDECGEEKLPSCFDYVMHFLTVFWKVLFAFVPPTEYWNGWACFIVSILMIGLLTAFIGDLASHFGCTIGLKDSVTAVVFVALGTSVPDTFASKVAATQDQYADASIGNVTGSNAVNVFLGIGVAWSIAAIYHAANGEQFKVSPGTLAFSVTLFTIFAFINVGVLLYRRRPEIGGELGGPRTAKLLTSCLFVLLWLLYIFFSSLEAYCHIKGF

SEQ ID NO: 36080 - protein, 937 aa, Homo sapiens; identical to SEQ ID NO: 36076
  ENSP00000385188

SEQ ID NO: 36081 - protein, 937 aa, Homo sapiens; identical to SEQ ID NO: 36076
  ENSP00000385535

SEQ ID NO: 36082 - protein, 965 aa, Homo sapiens
  ENSP00000384908
MYNMRRLSLSPTFSMGFHLLVTVSLLFSHVDHVIAETEMEGEGNETGECTGSYYCKKGVILPIWEPQDPSFGDKIARATVYFVAMVYMFLGVSIIADRFMSSIEVITSQEKEITIKKPNGETTKTTVRIWNETVSNLTLMALGSSAPEILLSVIEVCGHNFTAGDLGPSTIVGSAAFNMFIIIALCVYVVPDGETRKIKHLRVFFVTAAWSIFAYTWLYIILSVISPGVVEVWEGLLTFFFFPICVVFAWVADRRLLFYKYVYKRYRAGKQRGMIIEHEGDRPSSKTEIEMDGKVVNSHVENFLDGALVLEVDERDQDDEEARREMARILKELKQKHPDKEIEQLIELANYQVLSQQQKSRAFYRIQATRLMTGAGNILKRHAADQARKAVSMHEVNTEVTENDPVSKIFFEQGTYQCLENCGTVALTIIRRGGDLTNTVFVDFRTEDGTANAGSDYEFTEGTVVFKPGDTQKEIRVGIIDDDIFEEDENFLVHLSNVKVSSEASEDGILEANHVSTLACLGSPSTATVTIFDDDHAGIFTFEEPVTHVSESIGIMEVKVLRTSGARGNVIVPYKTIEGTARGGGEDFEDTCGELEFQNDEIVKIITIRIFDREEYEKECSFSLVLEEPKWIRRGMKGGFTITGKYLFGQPVFRKVHAREHPILSTVITIADEYDDKQPLTSKEEEERRIAEMGRPILGEHTKLEVIIEESYEFKSTVDKLIKKTNLALVVGTNSWREQFIEAITVSAGEDDDDDECGEEKLPSCFDYVMHFLTVFWKVLFAFVPPTEYWNGWACFIVSILMIGLLTAFIGDLASHFGCTIGLKDSVTAVVFVALGTSVPDTFASKVAATQDQYADASIGNVTGSNAVNVFLGIGVAWSIAAIYHAANGEQFKVSPGTLAFSVTLFTIFAFINVGVLLYRRRPEIGGELGGPRTAKLLTSCLFVLLWLLYIFFSSLEAYCHIKGF

SEQ ID NO: 36083 - protein, 87 aa, Homo sapiens
  ENSP00000389330
MYNMRRLSLSPTFSMGFHLLVTVSLLFSHVDHVIAETEMEGEGNETGECTGSYYCKKGVILPIWEPQDPSFGDKIARATVYFVAMVY

SEQ ID NO: 36084 - protein, 87 aa, Homo sapiens; identical to SEQ ID NO: 36083
  ENSP00000398575

SEQ ID NO: 36085 - protein, 73 aa, Homo sapiens
  ENSP00000412560
MYNMRRLSLSPTFSMGFHLLVTVSLLFSHVDHVIAETEMEGEGNETGECTGSYYCKKGVILPIWEPQDPSFGD

SEQ ID NO: 36086 - protein, 973 aa, Homo sapiens; identical to SEQ ID NO: 36078
  ENSP00000332931

SEQ ID NO: 36087 - protein, 937 aa, Homo sapiens; identical to SEQ ID NO: 36076
  ENSP00000385811

SEQ ID NO: 36088 - protein, 921 aa, Homo sapiens
  ENSP00000236877
MAPLALVGVTLLLAAPPCSGAATPTPSLPPPPANDSDTSTGGCQGSYRCQPGVLLPVWEPDDPSLGDKAARAVVYFVAMVYMFLGVSIIADRFMAAIEVITSKEKEITITKANGETSVGTVRIWNETVSNLTLMALGSSAPEILLSVIEVCGHNFQAGELGPGTIVGSAAFNMFVVIAVCIYVIPAGESRKIKHLRVFFVTASWSIFAYVWLYLILAVFSPGVVQVWEALLTLVFFPVCVVFAWMADKRLLFYKYVYKRYRTDPRSGIIIGAEGDPPKSIELDGTFVGAEAPGELGGLGPGPAEARELDASRREVIQILKDLKQKHPDKDLEQLVGIANYYALLHQQKSRAFYRIQATRLMTGAGNVLRRHAADASRRAAPAEGAGEDEDDGASRIFFEPSLYHCLENCGSVLLSVTCQGGEGNSTFYVDYRTEDGSAKAGSDYEYSEGTLVFKPGETQKELRIGIIDDDIFEEDEHFFVRLLNLRVGDAQGMFEPDGGGRPKGRLVAPLLATVTILDDDHAGIFSFQDRLLHVSECMGTVDVRVVRSSGARGTVRLPYRTVDGTARGGGVHYEDACGELEFGDDETMKTLQVKIVDDEEYEKKDNFFIELGQPQWLKRGISALLLNQGDGDRKLTAEEEEARRIAEMGKPVLGENCRLEVIIEESYDFKNTVDKLIKKTNLALVIGTHSWREQFLEAITVSAGDEEEEEDGSREERLPSCFDYVMHFLTVFWKVLFACVPPTEYCHGWACFGVSILVIGLLTALIGDLASHFGCTVGLKDSVNAVVFVALGTSIPDTFASKVAALQDQCADASIGNVTGSNAVNVFLGLGVAWSVAAVYWAVQGRPFEVRTGTLAFSVTLFTVFAFVGIAVLLYRRRPHIGGELGGPRGPKLATTALFLGLWLLYILFASLEAYCHIRGF

SEQ ID NO: 36089 - protein, 677 aa, Homo sapiens
  ENSP00000437536
MADKRLLFYKYVYKRYRTDPRSGIIIGAEGDPPKSIELDGTFVGAEAPGELGGLGPGPAEARELDASRREVIQILKDLKQKHPDKDLEQLVGIANYYALLHQQKSRAFYRIQATRLMTGAGNVLRRHAADASRRAAPAEGAGEDEDDGASRIFFEPSLYHCLENCGSVLLSVTCQGGEGNSTFYVDYRTEDGSAKAGSDYEYSEGTLVFKPGETQKELRIGIIDDDIFEEDEHFFVRLLNLRVGDAQGMFEPDGGGRPKGRLVAPLLATVTILDDDHAGIFSFQDRLLHVSECMGTVDVRVVRSSGARGTVRLPYRTVDGTARGGGVHYEDACGELEFGDDETMKTLQVKIVDDEEYEKKDNFFIELGQPQWLKRGISALLLNQGDGDRKLTAEEEEARRIAEMGKPVLGENCRLEVIIEESYDFKNTVDKLIKKTNLALVIGTHSWREQFLEAITVSAGDEEEEEDGSREERLPSCFDYVMHFLTVFWKVLFACVPPTEYCHGWACFGVSILVIGLLTALIGDLASHFGCTVGLKDSVNAVVFVALGTSIPDTFASKVAALQDQCADASIGNVTGSNAVNVFLGLGVAWSVAAVYWAVQGRPFEVRTGTLAFSVTLFTVFAFVGIAVLLYRRRPHIGGELGGPRGPKLATTALFLGLWLLYILFASLEAYCHIRGF

SEQ ID NO: 36090 - protein, 159 aa, Homo sapiens
  ENSP00000472233
MAAIEVITSKEKEITITKANGETSVGTVRIWNETVSNLTLMALGSSAPEILLSVIEVCGHNFQAGELGPGTIVGSAAFNMFVVIAVCIYVIPAGESRKIKHLRVFFVTASWSIFAYVWLYLILAVFSPGVVQVWEALLTLVFFPVCVVFAWMADKRLLF

SEQ ID NO: 36091 - protein, 145 aa, Homo sapiens
  ENSP00000472208
MVYMFLGVSIIADRFMAAIEVITSKEKEITITKANGETSVGTVRIWNETVSNLTLMALGSSAPEILLSVIEVCGHNFQAGELGPGTIVGSAAFNMFVVIAVCIYVIPAGESRKIKHLRVFFVTASWSIFAYVWLYLILAVFSPGV

SEQ ID NO: 36092 - protein, 921 aa, Homo sapiens
  ENSP00000349392
MAWLRLQPLTSAFLHFGLVTFVLFLNGLRAEAGGSGDVPSTGQNNESCSGSSDCKEGVILPIWYPENPSLGDKIARVIVYFVALIYMFLGVSIIADRFMASIEVITSQEREVTIKKPNGETSTTTIRVWNETVSNLTLMALGSSAPEILLSLIEVCGHGFIAGDLGPSTIVGSAAFNMFIIIGICVYVIPDGETRKIKHLRVFFITAAWSIFAYIWLYMILAVFSPGVVQVWEGLLTLFFFPVCVLLAWVADKRLLFYKYMHKKYRTDKHRGIIIETEGDHPKGIEMDGKMMNSHFLDGNLVPLEGKEVDESRREMIRILKDLKQKHPEKDLDQLVEMANYYALSHQQKSRAFYRIQATRMMTGAGNILKKHAAEQAKKASSMSEVHTDEPEDFISKVFFDPCSYQCLENCGAVLLTVVRKGGDMSKTMYVDYKTEDGSANAGADYEFTEGTVVLKPGETQKEFSVGIIDDDIFEEDEHFFVRLSNVRIEEEQPEEGMPPAIFNSLPLPRAVLASPCVATVTILDDDHAGIFTFECDTIHVSESIGVMEVKVLRTSGARGTVIVPFRTVEGTAKGGGEDFEDTYGELEFKNDETVKTIRVKIVDEEEYERQENFFIALGEPKWMERGISDVTDRKLTMEEEEAKRIAEMGKPVLGEHPKLEVIIEESYEFKTTVDKLIKKTNLALVVGTHSWRDQFMEAITVSAAGDEDEDESGEERLPSCFDYVMHFLTVFWKVLFACVPPTEYCHGWACFAVSILIIGMLTAIIGDLASHFGCTIGLKDSVTAVVFVAFGTSVPDTFASKAAALQDVYADASIGNVTGSNAVNVFLGIGLAWSVAAIYWALQGQEFHVSAGTLAFSVTLFTIFAFVCISVLLYRRRPHLGGELGGPRGCKLATTWLFVSLWLLYILFATLEAYCYIKGF

SEQ ID NO: 36093 - protein, 620 aa, Homo sapiens
  ENSP00000436332
MAWLRLQPLTSAFLHFGLVTFVLFLNGLRAEAGGSGDVPSTGQNNESCSGSSDCKEGVILPIWYPENPSLGDKIARVIVYFVALIYMFLGVSIIADRFMASIEVITSQEREVTIKKPNGETSTTTIRVWNETVSNLTLMALGSSAPEILLSLIEVCGHGFIAGDLGPSTIVGSAAFNMFIIIGICVYVIPDGETRKIKHLRVFFITAAWSIFAYIWLYMILAVFSPGVVQVWEGLLTLFFFPVCVLLAWVADKRLLFYKYMHKKYRTDKHRGIIIETEGDHPKGIEMDGKMMNSHFLDGNLVPLEGKEVDESRREMIRILKDLKQKHPEKDLDQLVEMANYYALSHQQKSRAFYRIQATRMMTGAGNILKKHAAEQAKKASSMSEVHTDEPEDFISKVFFDPCSYQCLENCGAVLLTVVRKGGDMSKTMYVDYKTEDGSANAGADYEFTEGTVVLKPGETQKEFSVGIIDDDIFEEDEHFFVRLSNVRIEEEQPEEGMPPAIFNSLPLPRAVLASPCVATVTILDDDHAGIFTFECDTIHVSESIGVMEVKVLRTSGARGTVIVPFRTVEGTAKGGGEDFEDTYGELEFKNDETVCDRQEADYGRRGGQEDSRDGKASIG

SEQ ID NO: 36094 - protein, 927 aa, Homo sapiens
  ENSP00000370669
MAWLRLQPLTSAFLHFGLVTFVLFLNGLRAEAGGSGDVPSTGQNNESCSGSSDCKEGVILPIWYPENPSLGDKIARVIVYFVALIYMFLGVSIIADRFMASIEVITSQEREVTIKKPNGETSTTTIRVWNETVSNLTLMALGSSAPEILLSLIEVCGHGFIAGDLGPSTIVGSAAFNMFIIIGICVYVIPDGETRKIKHLRVFFITAAWSIFAYIWLYMILAVFSPGVVQVWEGLLTLFFFPVCVLLAWVADKRLLFYKYMHKKYRTDKHRGIIIETEGDHPKGIEMDGKMMNSHFLDGNLVPLEGKEVDESRREMIRILKDLKQKHPEKDLDQLVEMANYYALSHQQKSRAFYRIQATRMMTGAGNILKKHAAEQAKKASSMSEVHTDEPEDFISKVFFDPCSYQCLENCGAVLLTVVRKGGDMSKTMYVDYKTEDGSANAGADYEFTEGTVVLKPGETQKEFSVGIIDDDIFEEDEHFFVRLSNVRIEEEQPEEGMPPAIFNSLPLPRAVLASPCVATVTILDDDHAGIFTFECDTIHVSESIGVMEVKVLRTSGARGTVIVPFRTVEGTAKGGGEDFEDTYGELEFKNDETVKTIRVKIVDEEEYERQENFFIALGEPKWMERGISALLLSPDVTDRKLTMEEEEAKRIAEMGKPVLGEHPKLEVIIEESYEFKTTVDKLIKKTNLALVVGTHSWRDQFMEAITVSAAGDEDEDESGEERLPSCFDYVMHFLTVFWKVLFACVPPTEYCHGWACFAVSILIIGMLTAIIGDLASHFGCTIGLKDSVTAVVFVAFGTSVPDTFASKAAALQDVYADASIGNVTGSNAVNVFLGIGLAWSVAAIYWALQGQEFHVSAGTLAFSVTLFTIFAFVCISVLLYRRRPHLGGELGGPRGCKLATTWLFVSLWLLYILFATLEAYCYIKGF

SEQ ID NO: 36095 - protein, 298 aa, Homo sapiens
  ENSP00000216568
MERGISDVTDRKLTMEEEEAKRIAEMGKPVLGEHPKLEVIIEESYEFKTTVDKLIKKTNLALVVGTHSWRDQFMEAITVSAAGDEDEDESGEERLPSCFDYVMHFLTVFWKVLFACVPPTEYCHGWACFAVSILIIGMLTAIIGDLASHFGCTIGLKDSVTAVVFVAFGTSVPDTFASKAAALQDVYADASIGNVTGSNAVNVFLGIGLAWSVAAIYWALQGQEFHVSAGTLAFSVTLFTIFAFVCISVLLYRRRPHLGGELGGPRGCKLATTWLFVSLWLLYILFATLEAYCYIKGF

SEQ ID NO: 36096 - protein, 284 aa, Homo sapiens
  ENSP00000377863
MEEEEAKRIAEMGKPVLGEHPKLEVIIEESYEFKTTVDKLIKKTNLALVVGTHSWRDQFMEAITVSAAGDEDEDESGEERLPSCFDYVMHFLTVFWKVLFACVPPTEYCHGWACFAVSILIIGMLTAIIGDLASHFGCTIGLKDSVTAVVFVAFGTSVPDTFASKAAALQDVYADASIGNVTGSNAVNVFLGIGLAWSVAAIYWALQGQEFHVSAGTLAFSVTLFTIFAFVCISVLLYRRRPHLGGELGGPRGCKLATTWLFVSLWLLYILFATLEAYCYIKGF

SEQ ID NO: 36097 - protein, 924 aa, Homo sapiens
  ENSP00000436688
MAWLRLQPLTSAFLHFGLVTFVLFLNGLRAEAGGSGDVPSTGQNNESCSGSSDCKEGVILPIWYPENPSLGDKIARVIVYFVALIYMFLGVSIIADRFMASIEVITSQEREVTIKKPNGETSTTTIRVWNETVSNLTLMALGSSAPEILLSLIEVCGHGFIAGDLGPSTIVGSAAFNMFIIIGICVYVIPDGETRKIKHLRVFFITAAWSIFAYIWLYMILAVFSPGVVQVWEGLLTLFFFPVCVLLAWVADKRLLFYKYMHKKYRTDKHRGIIIETEGDHPKGIEMDGKMMNSHFLDGNLVPLEGKEVDESRREMIRILKDLKQKHPEKDLDQLVEMANYYALSHQQKSRAFYRIQATRMMTGAGNILKKHAAEQAKKASSMSEVHTDEPEDFISKVFFDPCSYQCLENCGAVLLTVVRKGGDMSKTMYVDYKTEDGSANAGADYEFTEGTVVLKPGETQKEFSVGIIDDDIFEEDEHFFVRLSNVRIEEEQPEEGMPPAIFNSLPLPRAVLASPCVATVTILDDDHAGIFTFECDTIHVSESIGVMEVKVLRTSGARGTVIVPFRTVEGTAKGGGEDFEDTYGELEFKNDETVKTIRVKIVDEEEYERQENFFIALGEPKWMERGISALLLSPDRKLTMEEEEAKRIAEMGKPVLGEHPKLEVIIEESYEFKTTVDKLIKKTNLALVVGTHSWRDQFMEAITVSAAGDEDEDESGEERLPSCFDYVMHFLTVFWKVLFACVPPTEYCHGWACFAVSILIIGMLTAIIGDLASHFGCTIGLKDSVTAVVFVAFGTSVPDTFASKAAALQDVYADASIGNVTGSNAVNVFLGIGLAWSVAAIYWALQGQEFHVSAGTLAFSVTLFTIFAFVCISVLLYRRRPHLGGELGGPRGCKLATTWLFVSLWLLYILFATLEAYCYIKGF

SEQ ID NO: 36098 - protein, 925 aa, Homo sapiens
  ENSP00000433531
MAWLRLQPLTSAFLHFGLVTFVLFLNGLRAEAGGSGDVPSTGQNNESCSGSSDCKEGVILPIWYPENPSLGDKIARVIVYFVALIYMFLGVSIIADRFMASIEVITSQEREVTIKKPNGETSTTTIRVWNETVSNLTLMALGSSAPEILLSLIEVCGHGFIAGDLGPSTIVGSAAFNMFIIIGICVYVIPDGETRKIKHLRVFFITAAWSIFAYIWLYMILAVFSPGVVQVWEGLLTLFFFPVCVLLAWVADKRLLFYKYMHKKYRTDKHRGIIIETEGDHPKGIEMDGKMMNSHFLDGNLVPLEGKEVDESRREMIRILKDLKQKHPEKDLDQLVEMANYYALSHQQKSRAFYRIQATRMMTGAGNILKKHAAEQAKKASSMSEVHTDEPEDFISKVFFDPCSYQCLENCGAVLLTVVRKGGDMSKTMYVDYKTEDGSANAGADYEFTEGTVVLKPGETQKEFSVGIIDDDIFEEDEHFFVRLSNVRIEEEQPEEGMPPAIFNSLPLPRAVLASPCVATVTILDDDHAGIFTFECDTIHVSESIGVMEVKVLRTSGARGTVIVPFRTVEGTAKGGGEDFEDTYGELEFKNDETVKTIHIKVIDDEAYEKNKNYFIEMMGPRMVDMSFQKALLLSPDRKLTMEEEEAKRIAEMGKPVLGEHPKLEVIIEESYEFKTTVDKLIKKTNLALVVGTHSWRDQFMEAITVSAAGDEDEDESGEERLPSCFDYVMHFLTVFWKVLFACVPPTEYCHGWACFAVSILIIGMLTAIIGDLASHFGCTIGLKDSVTAVVFVAFGTSVPDTFASKAAALQDVYADASIGNVTGSNAVNVFLGIGLAWSVAAIYWALQGQEFHVSAGTLAFSVTLFTIFAFVCISVLLYRRRPHLGGELGGPRGCKLATTWLFVSLWLLYILFATLEAYCYIKGF

SEQ ID NO: 36099 - protein, 210 aa, Homo sapiens
  ENSP00000437103
MEEEEAKRIAEMGKPVLGEHPKLEVIIEESYEFKTTVDKLIKKTNLALVVGTHSWRDQFMEAITVSAAGDEDEDESGEERLPSCFDYVMHFLTVFWKVLFACVPPTEYCHGWACFAVSILIIGMLTAIIGDLASHFGCTIGLKDSVTAVVFVAFGTSVPGESERCLNLQRGFYLVQMTPGLHLIIFHTISDLNLTEPLPLKCTKVNQRDE

SEQ ID NO: 36100 - protein, 925 aa, Homo sapiens; identical to SEQ ID NO: 36098
  ENSP00000350560

SEQ ID NO: 36101 - protein, 584 aa, Homo sapiens
  ENSP00000447091
MAGRRLNLRWALSVLCVLLMAETVSGTRGSSTGAHISPQFPASGVNQTPVVDCRKVCGLNVSDRCDFIRTNPDCHSDGGYLDYLEGIFCHFPPSLLPLAVTLYVSWLLYLFLILGVTAAKFFCPNLSAISTTLKLSHNVAGVTFLAFGNGAPDIFSALVAFSDPHTAGLALGALFGAGVLVTTVVAGGITILHPFMAASRPFFRDIVFYMVAVFLTFLMLFRGRVTLAWALGYLGLYVFYVVTVILCTWIYQRQRRGSLFCPMPVTPEILSDSEEDRVSSNTNSYDYGDEYRPLFFYQETTAQILVRALNPLDYMKWRRKSAYWKALKVFKLPVEFLLLLTVPVVDPDKDDQNWKRPLNCLHLVISPLVVVLTLQSGTYGVYEIGGLVPVWVVVVIAGTALASVTFFATSDSQPPRLHWLFAFLGFLTSALWINAAATEVVNILRSLGVVFRLSNTVLGLTLLAWGNSIGDAFSDFTLARQGYPRMAFSACFGGIIFNILVGVGLGCLLQISRSHTEVKLEPDGLLVWVLAGALGLSLVFSLVSVPLQCFQLSRVYGFCLLLFYLNFLVVALLTEFGVIHLKSM

SEQ ID NO: 36102 - protein, 404 aa, Homo sapiens
  ENSP00000448758
  MOD_RES (1)..(1): Any amino acid
XTLKLSHNVAGVTFLAFGNGAPDIFSALVAFSDPHTAGLALGALFGAGVLVTTVVAGGITILHPFMAASRPFFRDIVFYMVAVFLTFLMLFRGRVTLAWALGYLGLYVFYVVTVILCTWIYQRQRRGSLFCPMPVTPEILSDSEEDRVSSNTNSYDYGDEYRPLFFYQETTAQILVRALNPLDYMKWRRKSAYWKALKVFKLPVEFLLLLTVPVVDPDKDDQNWKRPLNCLHLVISPLVVVLTLQSGTYGVYEIGGLVPVWVVVVIAGTALASVTFFATSDSQPPRLHWLFAFLGFLTSALWINAAATEVVNILRSLGVVFRLSNTVLGLTLLAWGNSIGDAFSDFTLARQGYPRMAFSACFGGIIFNILVGVGLGCLLQISRSHTEVKTRRMQVAGKTKRHGA

SEQ ID NO: 36103 - protein, 99 aa, Homo sapiens
  ENSP00000447585
MAFSACFGGIIFNILVGVGLGCLLQISRSHTEVKLEPDGLLVWVLAGALGLSLVFSLVSVPLQCFQLSRVYGFCLLLFYLNFLVVALLTEFGVIHLKSM

SEQ ID NO: 36104 - protein, 143 aa, Homo sapiens
  ENSP00000449519
MTVGENEGVDDQGGWGKRLTTAGPSCSCADAFSDFTLARQGYPRMAFSACFGGIIFNILVGVGLGCLLQISRSHTEVKLEPDGLLVWVLAGALGLSLVFSLVSVPLQCFQLSRVYGFCLLLFYLNFLVVALLTEFGVIHLKSM

SEQ ID NO: 36105 - protein, 528 aa, Homo sapiens
  ENSP00000450081
MAGRRLNLRWALSVLCVLLMAETVSGTRGSSTGAHISPQFPASGVNQTPVVDCRKVCGLNVSDRCDFIRTNPDCHSDGGYLDYLEGIFCHFPPSLLPLAVTLYVSWLLYLFLILGVTAAKFFCPNLSAISTTLKLSHNVAGVTFLAFGNGAPDIFSALVAFSDPHTAGLALGALFGYLGLYVFYVVTVILCTWIYQRQRRGSLFCPMPVTPEILSDSEEDRVSSNTNSYDYGDEYRPLFFYQETTAQILVRALNPLDYMKWRRKSAYWKALKVFKLPVEFLLLLTVPVVDPDKDDQNWKRPLNCLHLVISPLVVVLTLQSGTYGVYEIGGLVPVWVVVVIAGTALASVTFFATSDSQPPRLHWLFAFLGFLTSALWINAAATEVVNILRSLGVVFRLSNTVLGLTLLAWGNSIGDAFSDFTLARQGYPRMAFSACFGGIIFNILVGVGLGCLLQISRSHTEVKLEPDGLLVWVLAGALGLSLVFSLVSVPLQCFQLSRVYGFCLLLFYLNFLVVALLTEFGVIHLKSM

SEQ ID NO: 36106 - protein, 231 aa, Homo sapiens
  ENSP00000448703
MAGRRLNLRWALSVLCVLLMAETVSGTRGSSTGAHISPQFPASGVNQTPVVDCRKVCGLNVSDRCDFIRTNPDCHSDGGYLDYLEGIFCHFPPSLLPLAVTLYVSWLLYLFLILGVTAAKFFCPNLSAISTTLKLSHNVAGVTFLAFGNGAPDIFSALVAFSDPHTAGLALGALFGAGVLVTTVVAGGITILHPFMAASRPFFRDIVFYMVAVFLTFLMLFRGRVTLAWAL

SEQ ID NO: 36107 - protein, 53 aa, Homo sapiens
  ENSP00000448749
MAGRRLNLRWALSVLCVLLMAETVSGTRGSSTGAHISPQFPASVPQGVWPECL

SEQ ID NO: 36108 - protein, 53 aa, Homo sapiens; identical to SEQ ID NO: 36107
  ENSP00000447502

SEQ ID NO: 36109 - protein, 131 aa, Homo sapiens
  ENSP00000449448
MAGRRLNLRWALSVLCVLLMAETVSGTRGSSTGAHISPQFPASGVNQTPVVDCRKVCGLNVSDRCDFIRTNPDCHSDGGYLDYLEGIFCHFPPSLLPLAVTLYVSWLLYLFLILGVTAAKFFCPNLSAIST

SEQ ID NO: 36110 - protein, 103 aa, Homo sapiens
  ENSP00000447972
MAGRRLNLRWALSVLCVLLMAETVSGTRGSSTGAHISPQFPASGVNQTPVVDCRKVCGLNVSDRCDFIRTNPDCHSDGGYLDYLEGIFCHFPPSLLPLAVTLY

SEQ ID NO: 36111 - protein, 584 aa, Homo sapiens; identical to SEQ ID NO: 36101
  ENSP00000202831

SEQ ID NO: 36112 - protein, 834 aa, Homo sapiens
  ENSP00000264938
MWGLGARGPDRGLLLALALGGLARAGGVEVEPGGAHGESGGFQVVTFEWAHVQDPYVIALWILVASLAKIGFHLSHKVTSVVPESALLIVLGLVLGGIVWAADHIASFTLTPTVFFFYLLPPIVLDAGYFMPNRLFFGNLGTILLYAVVGTVWNAATTGLSLYGVFLSGLMGDLQIGLLDFLLFGSLMAAVDPVAVLAVFEEVHVNEVLFIIVFGESLLNDAVTVVLYNVFESFVALGGDNVTGVDCVKGIVSFFVVSLGGTLVGVVFAFLLSLVTRFTKHVRIIEPGFVFIISYLSYLTSEMLSLSAILAITFCGICCQKYVKANISEQSATTVRYTMKMLASSAETIIFMFLGISAVNPFIWTWNTAFVLLTLVFISVYRAIGVVLQTWLLNRYRMVQLEPIDQVVLSYGGLRGAVAFALVVLLDGDKVKEKNLFVSTTIIVVFFTVIFQGLTIKPLVQWLKVKRSEHREPRLNEKLHGRAFDHILSAIEDISGQIGHNYLRDKWSHFDRKFLSRVLMRRSAQKSRDRILNVFHELNLKDAISYVAEGERRGSLAFIRSPSTDNVVNVDFTPRSSTVEASVSYLLRENVSAVCLDMQSLEQRRRSIRDAEDMVTHHTLQQYLYKPRQEYKHLYSRHELTPTEDEKQDREIFHRTMRKRLESFKSTKLGLNQNKKAAKLYKRERAQKRRNSSIPNGKLPMESPAQNFTIKEKDLELSDTEEPPNYDEEMSGGIEFLASVTKDTASDSPAGIDNPVFSPDEALDRSLLARLPPWLSPGETVVPSQRARTQIPYSPGTFCRLMPFRLSSKSVDSFLQADGPEERPPAALPESTHM

SEQ ID NO: 36113 - protein, 825 aa, Homo sapiens
  ENSP00000422983
MWGLGARGPDRGLLLALALGGLARAGGVEVEPGGAHGESGGFQVVTFEWAHVQDPYVIALWILVASLAKIGFHLSHKVTSVVPESALLIVLGLVLGGIVWAADHIASFTLTPTVFFFYLLPPIVLDAGYFMPNRLFFGNLGTILLYAVVGTVWNAATTGLSLYGVFLSGLMGDLQIGLLDFLLFGSLMAAVDPVAVLAVFEEVHVNEVLFIIVFGESLLNDAVTVVLYNVFESFVALGGDNVTGVDCVKGIVSFFVVSLGGTLVGVVFAFLLSLVTRFTKHVRIIEPGFVFIISYLSYLTSEMLSLSAILAITFCGICCQKYVKANISEQSATTVRYTMKMLASSAETIIFMFLGISAVNPFIWTWNTAFVLLTLVFISVYRAIGVVLQTWLLNRYRMVQLEPIDQVVLSYGGLRGAVAFALVVLLDGDKVKEKNLFVSTTIIVVFFTVIFQWLKVKRSEHREPRLNEKLHGRAFDHILSAIEDISGQIGHNYLRDKWSHFDRKFLSRVLMRRSAQKSRDRILNVFHELNLKDAISYVAEGERRGSLAFIRSPSTDNVVNVDFTPRSSTVEASVSYLLRENVSAVCLDMQSLEQRRRSIRDAEDMVTHHTLQQYLYKPRQEYKHLYSRHELTPTEDEKQDREIFHRTMRKRLESFKSTKLGLNQNKKAAKLYKRERAQKRRNSSIPNGKLPMESPAQNFTIKEKDLELSDTEEPPNYDEEMSGGIEFLASVTKDTASDSPAGIDNPVFSPDEALDRSLLARLPPWLSPGETVVPSQRARTQIPYSPGTFCRLMPFRLSSKSVDSFLQADGPEERPPAALPESTHM

SEQ ID NO: 36114 - protein, 70 aa, Homo sapiens
  ENSP00000486364
MWGLGARGPDRGLLLALALGGLARAGGVEVEPGGAHGESGGFQVVTFEWAHVQDPYVIALWILVASLAKI

SEQ ID NO: 36115 - protein, 70 aa, Homo sapiens; identical to SEQ ID NO: 36114
  ENSP00000486297

SEQ ID NO: 36116 - protein, 645 aa, Homo sapiens
  ENSP00000320246
MERQSRVMSEKDEYQFQHQGAVELLVFNFLLILTILTIWLFKNHRFRFLHETGGAMVYGLIMGLILRYATAPTDIESGTVYDCVKLTFSPSTLLVNITDQVYEYKYKREISQHNINPHQGNAILEKMTFDPEIFFNVLLPPIIFHAGYSLKKRHFFQNLGSILTYAFLGTAISCIVIGLIMYGFVKAMIHAGQLKNGDFHFTDCLFFGSLMSATDPVTVLAIFHELHVDPDLYTLLFGESVLNDAVAIVLTYSISIYSPKENPNAFDAAAFFQSVGNFLGIFAGSFAMGSAYAIITALLTKFTKLCEFPMLETGLFFLLSWSAFLSAEAAGLTGIVAVLFCGVTQAHYTYNNLSSDSKIRTKQLFEFMNFLAENVIFCYMGLALFTFQNHIFNALFILGAFLAIFVARACNIYPLSFLLNLGRKQKIPWNFQHMMMFSGLRGAIAFALAIRNTESQPKQMMFTTTLLLVFFTVWVFGGGTTPMLTWLQIRVGVDLDENLKEDPSSQHQEANNLDKNMTKAESARLFRMWYSFDHKYLKPILTHSGPPLTTTLPEWCGPISRLLTSPQAYGEQLKEDDVECIVNQDELAINYQEQASSPCSPPARLGLDQKASPQTPGKENIYEGDLGLGGYELKLEQTLGQSQLN

SEQ ID NO: 36117 - protein, 61 aa, Homo sapiens
  ENSP00000419090
MERQSRVMSEKDEYQFQHQGAVELLVFNFLLILTILTIWLFKNHRFRFLHETGGAMVYDDI

SEQ ID NO: 36118 - protein, 147 aa, Homo sapiens
  ENSP00000418627
MERQSRVMSEKDEYQFQHQGAVELLVFNFLLILTILTIWLFKNHRFRFLHETGGAMVYGLIMGLILRYATAPTDIESGTVYDCVKLTFSPSTLLVNITDQVYEYKYKREISQHNINPHQGNAILEKRHFFQNLGSILTYAFLGTAIS

SEQ ID NO: 36119 - protein, 87 aa, Homo sapiens
  ENSP00000432889
MGTENTPGGKASPDPQDVRPSVFHNIKLFVLCHSLLQLAQLMISGYLKSSISTVEKRFGLSSQTSGLLASFNEVGNTALIVFVSYFG

SEQ ID NO: 36120 - protein, 709 aa, Homo sapiens
  ENSP00000289575
MGPRIGPAGEVPQVPDKETKATMGTENTPGGKASPDPQDVRPSVFHNIKLFVLCHSLLQLAQLMISGYLKSSISTVEKRFGLSSQTSGLLASFNEVGNTALIVFVSYFGSRVHRPRMIGYGAILVALAGLLMTLPHFISEPYRYDNTSPEDMPQDFKASLCLPTTSAPASAPSNGNCSSYTETQHLSVVGIMFVAQTLLGVGGVPIQPFGISYIDDFAHNSNSPLYLGILFAVTMMGPGLAFGLGSLMLRLYVDINQMPEGGISLTIKDPRWVGAWWLGFLIAAGAVALAAIPYFFFPKEMPKEKRELQFRRKVLAVTDSPARKGKDSPSKQSPGESTKKQDGLVQIAPNLTVIQFIKVFPRVLLQTLRHPIFLLVVLSQVCLSSMAAGMATFLPKFLERQFSITASYANLLIGCLSFPSVIVGIVVGGVLVKRLHLGPVGCGALCLLGMLLCLFFSLPLFFIGCSSHQIAGITHQTSAHPGLELSPSCMEACSCPLDGFNPVCDPSTRVEYITPCHAGCSSWVVQDALDNSQVFYTNCSCVVEGNPVLAGSCDSTCSHLVVPFLLLVSLGSALACLTHTPSFMLILRGVKKEDKTLAVGIQFMFLRILAWMPSPVIHGSAIDTTCVHWALSCGRRAVCRYYNNDLLRNRFIGLQFFFKTGSVICFALVLAVLRQQDKEARTKESRSSPAVEQQLLVSGPGKKPEDSRV

SEQ ID NO: 36121 - protein, 593 aa, Homo sapiens
  ENSP00000434112
MIGYGAILVALAGLLMTLPHFISEPYRYDNTSPEDMPQDFKASLCLPTTSAPASAPSNGNCSSYTETQHLSVVGIMFVAQTLLGVGGVPIQPFGISYIDDFAHNSNSPLYLGILFAVTMMGPGLAFGLGSLMLRLYVDINQMPEGGISLTIKDPRWVGAWWLGFLIAAGAVALAAIPYFFFPKEMPKEKRELQFRRKVLAVTDSPARKGKDSPSKQSPGESTKKQDGLVQIAPNLTVIQFIKVFPRVLLQTLRHPIFLLVVLSQVCLSSMAAGMATFLPKFLERQFSITASYANLLIGCLSFPSVIVGIVVGGVLVKRLHLGPVGCGALCLLGMLLCLFFSLPLFFIGCSSHQIAGITHQTSAHPGLELSPSCMEACSCPLDGFNPVCDPSTRVEYITPCHAGCSSWVVQDALDNSQVFYTNCSCVVEGNPVLAGSCDSTCSHLVVPFLLLVSLGSALACLTHTPSFMLILRGVKKEDKTLAVGIQFMFLRILAWMPSPVIHGSAIDTTCVHWALSCGRRAVCRYYNNDLLRNRFIGLQFFFKTGSVICFALVLAVLRQQDKEARTKESRSSPAVEQQLLVSGPGKKPEDSRV

SEQ ID NO: 36122 - protein, 565 aa, Homo sapiens
  ENSP00000436324
MGPRIEDMPQDFKASLCLPTTSAPASAPSNGNCSSYTETQHLSVVGIMFVAQTLLGVGGVPIQPFGISYIDDFAHNSNSPLYLGILFAVTMMGPGLAFGLGSLMLRLYVDINQMPEGGISLTIKDPRWVGAWWLGFLIAAGAVALAAIPYFFFPKEMPKEKRELQFRRKVLAVTDSPARKGKDSPSKQSPGESTKKQDGLVQIAPNLTVIQFIKVFPRVLLQTLRHPIFLLVVLSQVCLSSMAAGMATFLPKFLERQFSITASYANLLIGCLSFPSVIVGIVVGGVLVKRLHLGPVGCGALCLLGMLLCLFFSLPLFFIGCSSHQIAGITHQTSAHPGLELSPSCMEACSCPLDGFNPVCDPSTRVEYITPCHAGCSSWVVQDALDNSQVFYTNCSCVVEGNPVLAGSCDSTCSHLVVPFLLLVSLGSALACLTHTPSFMLILRGVKKEDKTLAVGIQFMFLRILAWMPSPVIHGSAIDTTCVHWALSCGRRAVCRYYNNDLLRNRFIGLQFFFKTGSVICFALVLAVLRQQDKEARTKESRSSPAVEQQLLVSGPGKKPEDSRV

SEQ ID NO: 36123 - protein, 482 aa, Homo sapiens
  ENSP00000389653
MIGYGAILVALAGLLMTLPHFISEPYRYDNTSPGGISLTIKDPRWVGAWWLGFLIAAGAVALAAIPYFFFPKEMPKEKRELQFRRKVLAVTDSPARKGKDSPSKQSPGESTKKQDGLVQIAPNLTVIQFIKVFPRVLLQTLRHPIFLLVVLSQVCLSSMAAGMATFLPKFLERQFSITASYANLLIGCLSFPSVIVGIVVGGVLVKRLHLGPVGCGALCLLGMLLCLFFSLPLFFIGCSSHQIAGITHQTSAHPGLELSPSCMEACSCPLDGFNPVCDPSTRVEYITPCHAGCSSWVVQDALDNSQVFYTNCSCVVEGNPVLAGSCDSTCSHLVVPFLLLVSLGSALACLTHTPSFMLILRGVKKEDKTLAVGIQFMFLRILAWMPSPVIHGSAIDTTCVHWALSCGRRAVCRYYNNDLLRNRFIGLQFFFKTGSVICFALVLAVLRQQDKEARTKESRSSPAVEQQLLVSGPGKKPEDSRV

SEQ ID NO: 36124 - protein, 43 aa, Homo sapiens
  ENSP00000435384
MGTENTPGGKASPDPQDVRPSVFHNIKLFVLCHSLLQLAQLMI

SEQ ID NO: 36125 - protein, 43 aa, Homo sapiens; identical to SEQ ID NO: 36124
  ENSP00000431192

SEQ ID NO: 36126 - protein, 150 aa, Homo sapiens
  ENSP00000436513
MGTENTPGGKASPDPQDVRPSVFHNIKLFVLCHSLLQLAQLMISGYLKSSISTVEKRFGLSSQTSGLLASFNEVGNTALIVFVSYFGSRVHRPRMIGYGAILVALAGLLMTLPHFISEPYRYDNTSPEDMPQDFKASLCLPTTSAPASAP

SEQ ID NO: 36127 - protein, 43 aa, Homo sapiens; identical to SEQ ID NO: 36124
  ENSP00000431324

SEQ ID NO: 36128 - protein, 127 aa, Homo sapiens
  ENSP00000433872
MGTENTPGGKASPDPQDVRPSVFHNIKLFVLCHSLLQLAQLMISGYLKSSISTVEKRFGLSSQTSGLLASFNEVGNTALIVFVSYFGSRVHRPRMIGYGAILVALAGLLMTLPHFISEPYRYDNTSP

SEQ ID NO: 36129 - protein, 687 aa, Homo sapiens
  ENSP00000388912
MGTENTPGGKASPDPQDVRPSVFHNIKLFVLCHSLLQLAQLMISGYLKSSISTVEKRFGLSSQTSGLLASFNEVGNTALIVFVSYFGSRVHRPRMIGYGAILVALAGLLMTLPHFISEPYRYDNTSPEDMPQDFKASLCLPTTSAPASAPSNGNCSSYTETQHLSVVGIMFVAQTLLGVGGVPIQPFGISYIDDFAHNSNSPLYLGILFAVTMMGPGLAFGLGSLMLRLYVDINQMPEGGISLTIKDPRWVGAWWLGFLIAAGAVALAAIPYFFFPKEMPKEKRELQFRRKVLAVTDSPARKGKDSPSKQSPGESTKKQDGLVQIAPNLTVIQFIKVFPRVLLQTLRHPIFLLVVLSQVCLSSMAAGMATFLPKFLERQFSITASYANLLIGCLSFPSVIVGIVVGGVLVKRLHLGPVGCGALCLLGMLLCLFFSLPLFFIGCSSHQIAGITHQTSAHPGLELSPSCMEACSCPLDGFNPVCDPSTRVEYITPCHAGCSSWVVQDALDNSQVFYTNCSCVVEGNPVLAGSCDSTCSHLVVPFLLLVSLGSALACLTHTPSFMLILRGVKKEDKTLAVGIQFMFLRILAWMPSPVIHGSAIDTTCVHWALSCGRRAVCRYYNNDLLRNRFIGLQFFFKTGSVICFALVLAVLRQQDKEARTKESRSSPAVEQQLLVSGPGKKPEDSRV

SEQ ID NO: 36130 - protein, 147 aa, Homo sapiens
  ENSP00000434742
VALAGLLMTLPHFISEPYRYDNTSPEDMPQDFKASLCLPTTSAPASAPSNGNCSSYTETQHLSVVGIMFVAQTLLGVGGVPIQPFGISYIDDFAHNSNSPLYLGILFAVTMMGPGLAFGLGSLMLRLYVDINQMPEGEPQEHMFARP

SEQ ID NO: 36131 - protein, 620 aa, Homo sapiens
  ENSP00000434245
MPLHQLGDKPLTFPSPNSAMENGLDHTPPSRRASPGTPLSPGSLRSAAHSPLDTSKQPLCQLWAEKHGARGTHEVRYVSAGQSVACGWWAFAPPCLQVLNTPKGILFFLCAAAFLQGMTVNGFINTVITSLERRYDLHSYQSGLIASSYDIAACLCLTFVSYFGGSGHKPRWLGWGVLLMGTGSLVFALPHFTAGRYEVELDAGVRTCPANPGAVCADSTSGLSRYQLVFMLGQFLHGVGATPLYTLGVTYLDENVKSSCSPVYIAIFYTAAILGPAAGYLIGGALLNIYTEMGRRTELTTESPLWVGAWWVGFLGSGAAAFFTAVPILGYPRQLPGSQRYAVMRAAEMHQLKDSSRGEASNPDFGKTIRDLPLSIWLLLKNPTFILLCLAGATEATLITGMSTFSPKFLESQFSLSASEAATLFGYLVVPAGGGGTFLGGFFVNKLRLRGSAVIKFCLFCTVVSLLGILVFSLHCPSVPMAGVTASYGGSLLPEGHLNLTAPCNAACSCQPEHYSPVCGSDGLMYFSLCHAGCPAATETNVDGQKVSGAAAYRPCPPLDPGKGPPCLPLVIGAIVGLPRCTETVAVSLRIFPLVLAMPLQGNALQLVRESPSFWFSYSL

SEQ ID NO: 36132 - protein, 722 aa, Homo sapiens
  ENSP00000359538
MPLHQLGDKPLTFPSPNSAMENGLDHTPPSRRASPGTPLSPGSLRSAAHSPLDTSKQPLCQLWAEKHGARGTHEVRYVSAGQSVACGWWAFAPPCLQVLNTPKGILFFLCAAAFLQGMTVNGFINTVITSLERRYDLHSYQSGLIASSYDIAACLCLTFVSYFGGSGHKPRWLGWGVLLMGTGSLVFALPHFTAGRYEVELDAGVRTCPANPGAVCADSTSGLSRYQLVFMLGQFLHGVGATPLYTLGVTYLDENVKSSCSPVYIAIFYTAAILGPAAGYLIGGALLNIYTEMGRRTELTTESPLWVGAWWVGFLGSGAAAFFTAVPILGYPRQLPGSQRYAVMRAAEMHQLKDSSRGEASNPDFGKTIRDLPLSIWLLLKNPTFILLCLAGATEATLITGMSTFSPKFLESQFSLSASEAATLFGYLVVPAGGGGTFLGGFFVNKLRLRGSAVIKFCLFCTVVSLLGILVFSLHCPSVPMAGVTASYGGSLLPEGHLNLTAPCNAACSCQPEHYSPVCGSDGLMYFSLCHAGCPAATETNVDGQKVYRDCSCIPQNLSSGFGHATAGKCTSTCQRKPLLLVFIFVVIFFTFLSSIPALTATLRCVRDPQRSFALGIQWIVVRILGGIPGPIAFGWVIDKACLLWQDQCGQQGSCLVYQNSAMSRYILIMGLLYKVLGVLFFAIACFLYKPLSESSDGLETCLPSQSSAPDSATDSQLQSSV

SEQ ID NO: 36133 - protein, 151 aa, Homo sapiens
  ENSP00000414855
TTALCAARTASCTSHCATQGALQPRRRMWTARRCVRDPQRSFALGIQWIVVRILGGIPGPIAFGWVIDKACLLWQDQCGQQGSCLVYQNSAMSRYILIMGLLYKVLGVLFFAIACFLYKPLSESSDGLETCLPSQSSAPDSATDSQLQSSV

SEQ ID NO: 36134 - protein, 722 aa, Homo sapiens; identical to SEQ ID NO: 36132
  ENSP00000217159

SEQ ID NO: 36135 - protein, 724 aa, Homo sapiens
  ENSP00000309741
MKSAKGIENLAFVPSSPDILRRLSASPSQIEVSALSSDPQRENSQPQELQKPQEPQKSPEPSLPSAPPNVSEEKLRSLSLSEFEEGSYGWRNFHPQCLQRCNTPGGFLLHYCLLAVTQGIVVNGLVNISISTVEKRYEMKSSLTGLISSSYDISFCLLSLFVSFFGERGHKPRWLAFAAFMIGLGALVFSLPQFFSGEYKLGSLFEDTCVTTRNSTSCTSSTSSLSNYLYVFILGQLLLGAGGTPLYTLGTAFLDDSVPTHKSSLYIGTGYAMSILGPAIGYVLGGQLLTIYIDVAMGESTDVTEDDPRWLGAWWIGFLLSWIFAWSLIIPFSCFPKHLPGTAEIQAGKTSQAHQSNSNADVKFGKSIKDFPAALKNLMKNAVFMCLVLSTSSEALITTGFATFLPKFIENQFGLTSSFAATLGGAVLIPGAALGQILGGFLVSKFRMTCKNTMKFALFTSGVALTLSFVFMYAKCENEPFAGVSESYNGTGELGNLIAPCNANCNCSRSYYYPVCGDGVQYFSPCFAGCSNPVAHRKPKVYYNCSCIERKTEITSTAETFGFEAKAGKCETHCAKLPIFLCIFFIVIIFTFMAGTPITVSILRCVNHRQRSLALGIQFMVLRLLGTIPGPIIFGFTIDSTCILWDINDCGIKGACWIYDNIKMAHMLVAISVTCKVITMFFNGFAIFLYKPPPSATDVSFHKENAVVTNVLAEQDLNKIVKEG

SEQ ID NO: 36136 - protein, 80 aa, Homo sapiens
  ENSP00000468602
MEANQCPLVVEPSYPDLVINVGEVTLGEENRKKLQKIQRDQEKERVMRAACALLNSGGGVIRMAKKVEHPVEMGLDLEQS

SEQ ID NO: 36137 - protein, 90 aa, Homo sapiens
  ENSP00000395140
MEANQCPLVVEPSYPDLVINVGEVTLGEENRKKLQKIQRDQEKERVMRAACALLNSGGGVIRMAKKVEHPVEMGLDLEQSLRELIQSSDL

SEQ ID NO: 36138 - protein, 90 aa, Homo sapiens; identical to SEQ ID NO: 36137
  ENSP00000397454

SEQ ID NO: 36139 - protein, 100 aa, Homo sapiens
  ENSP00000468095
MEANQCPLVVEPSYPDLVINVGEVTLGEENRKKLQKIQRDQEKERVMRAACALLNSGGGVIRMAKKVEHPVEMGLDLEQSLRELIQSSDLQAFFETKQQG

SEQ ID NO: 36140 - protein, 111 aa, Homo sapiens
  ENSP00000393615
MEANQCPLVVEPSYPDLVINVGEVTLGEENRKKLQKIQRDQEKERVMRAACALLNSGGGVIRMAKKVEHPVEMGLDLEQSLRELIQSSDLQAFFETKQQGRCFYIFVKSWS

SEQ ID NO: 36141 - protein, 123 aa, Homo sapiens
  ENSP00000464806
MEANQCPLVVEPSYPDLVINVGEVTLGEENRKKLQKIQRDQEKERVMRAACALLNSGGGVIRMAKKVEHPVEMGLDLEQSLRELIQSSDLQAFFETKQQGRCFYIFVKSWSSGPFPEDRSVKP

SEQ ID NO: 36142 - protein, 901 aa, Homo sapiens
  ENSP00000378067
MEANQCPLVVEPSYPDLVINVGEVTLGEENRKKLQKIQRDQEKERVMRAACALLNSGGGVIRMAKKVEHPVEMGLDLEQSLRELIQSSDLQAFFETKQQGRCFYIFVKSWSSGPFPEDRSVKPRLCSLSSSLYRRSETSVRSMDSREAFCFLKTKRKPKILEEGPFHKIHKGVYQELPNSDPADPNSDPADLIFQKDYLEYGEILPFPESQLVEFKQFSTKHFQEYVKRTIPEYVPAFANTGGGYLFIGVDDKSREVLGCAKENVDPDSLRRKIEQAIYKLPCVHFCQPQRPITFTLKIVNVLKRGELYGYACMIRVNPFCCAVFSEAPNSWIVEDKYVCSLTTEKWVGMMTDTDPDLLQLSEDFECQLSLSSGPPLSRPVYSKKGLEHKKELQQLLFSVPPGYLRYTPESLWRDLISEHRGLEELINKQMQPFFRGILIFSRSWAVDLNLQEKPGVICDALLIAQNSTPILYTILREQDAEGQDYCTRTAFTLKQKLVNMGGYTGKVCVRAKVLCLSPESSAEALEAAVSPMDYPASYSLAGTQHMEALLQSLVIVLLGFRSLLSDQLGCEVLNLLTAQQYEIFSRSLRKNRELFVHGLPGSGKTIMAMKIMEKIRNVFHCEAHRILYVCENQPLRNFISDRNICRAETRKTFLRENFEHIQHIVIDEAQNFRTEDGDWYGKAKSITRRAKGGPGILWIFLDYFQTSHLDCSGLPPLSDQYPREELTRIVRNADPIAKYLQKEMQVIRSNPSFNIPTGCLEVFPEAEWSQGVQGTLRIKKYLTVEQIMTCVADTCRRFFDRGYSPKDVAVLVSTAKEVEHYKYELLKAMRKKRVVQLSDACDMLGDHIVLDSVRRFSGLERSIVFGIHPRTADPAILPNVLICLASRAKQHLYIFPWGGH

SEQ ID NO: 36143 - protein, 50 aa, Homo sapiens
  ENSP00000465198
  MOD_RES (1)..(1): Any amino acid
XICRAETRKTFLRENFEHIQHIVIDEAQNFRTEDGDWYGKAKSITRRAKE

SEQ ID NO: 36144 - protein, 901 aa, Homo sapiens; identical to SEQ ID NO: 36142
  ENSP00000312402

SEQ ID NO: 36145 - protein, 48 aa, Homo sapiens
  ENSP00000465777
MEANQCPLVVEPSYPDLVINVGEVTLGEENRKKLQKIQRDQEKERVMR

SEQ ID NO: 36146 - protein, 1521 aa, Homo sapiens
  ENSP00000427548
MRGVGWQMLSLSLGLVLAILNKVAPQACPAQCSCSGSTVDCHGLALRSVPRNIPRNTERLDLNGNNITRITKTDFAGLRHLRVLQLMENKISTIERGAFQDLKELERLRLNRNHLQLFPELLFLGTAKLYRLDLSENQIQAIPRKAFRGAVDIKNLQLDYNQISCIEDGAFRALRDLEVLTLNNNNITRLSVASFNHMPKLRTFRLHSNNLYCDCHLAWLSDWLRQRPRVGLYTQCMGPSHLRGHNVAEVQKREFVCSGHQSFMAPSCSVLHCPAACTCSNNIVDCRGKGLTEIPTNLPETITEIRLEQNTIKVIPPGAFSPYKKLRRIDLSNNQISELAPDAFQGLRSLNSLVLYGNKITELPKSLFEGLFSLQLLLLNANKINCLRVDAFQDLHNLNLLSLYDNKLQTIAKGTFSPLRAIQTMHLAQNPFICDCHLKWLADYLHTNPIETSGARCTSPRRLANKRIGQIKSKKFRCSGTEDYRSKLSGDCFADLACPEKCRCEGTTVDCSNQKLNKIPEHIPQYTAELRLNNNEFTVLEATGIFKKLPQLRKINFSNNKITDIEEGAFEGASGVNEILLTSNRLENVQHKMFKGLESLKTLMLRSNRITCVGNDSFIGLSSVRLLSLYDNQITTVAPGAFDTLHSLSTLNLLANPFNCNCYLAWLGEWLRKKRIVTGNPRCQKPYFLKEIPIQDVAIQDFTCDDGNDDNSCSPLSRCPTECTCLDTVVRCSNKGLKVLPKGIPRDVTELYLDGNQFTLVPKELSNYKHLTLIDLSNNRISTLSNQSFSNMTQLLTLILSYNRLRCIPPRTFDGLKSLRLLSLHGNDISVVPEGAFNDLSALSHLAIGANPLYCDCNMQWLSDWVKSEYKEPGIARCAGPGEMADKLLLTTPSKKFTCQGPVDVNILAKCNPCLSNPCKNDGTCNSDPVDFYRCTCPYGFKGQDCDVPIHACISNPCKHGGTCHLKEGEEDGFWCICADGFEGENCEVNVDDCEDNDCENNSTCVDGINNYTCLCPPEYTGELCEEKLDFCAQDLNPCQHDSKCILTPKGFKCDCTPGYVGEHCDIDFDDCQDNKCKNGAHCTDAVNGYTCICPEGYSGLFCEFSPPMVLPRTSPCDNFDCQNGAQCIVRINEPICQCLPGYQGEKCEKLVSVNFINKESYLQIPSAKVRPQTNITLQIATDEDSGILLYKGDKDHIAVELYRGRVRASYDTGSHPASAIYSVETINDGNFHIVELLALDQSLSLSVDGGNPKIITNLSKQSTLNFDSPLYVGGMPGKSNVASLRQAPGQNGTSFHGCIRNLYINSELQDFQKVPMQTGILPGCEPCHKKVCAHGTCQPSSQAGFTCECQEGWMGPLCDQRTNDPCLGNKCVHGTCLPINAFSYSCKCLEGHGGVLCDEEEDLFNPCQAIKCKHGKCRLSGLGQPYCECSSGYTGDSCDREISCRGERIRDYYQKQQGYAACQTTKKVSRLECRGGCAGGQCCGPLRSKRRKYSFECTDGSSFVDEVEKVVKCGCTRCVS

SEQ ID NO: 36147 - protein, 1529 aa, Homo sapiens
  ENSP00000422591
MRGVGWQMLSLSLGLVLAILNKVAPQACPAQCSCSGSTVDCHGLALRSVPRNIPRNTERLDLNGNNITRITKTDFAGLRHLRVLQLMENKISTIERGAFQDLKELERLRLNRNHLQLFPELLFLGTAKLYRLDLSENQIQAIPRKAFRGAVDIKNLQLDYNQISCIEDGAFRALRDLEVLTLNNNNITRLSVASFNHMPKLRTFRLHSNNLYCDCHLAWLSDWLRQRPRVGLYTQCMGPSHLRGHNVAEVQKREFVCSGHQSFMAPSCSVLHCPAACTCSNNIVDCRGKGLTEIPTNLPETITEIRLEQNTIKVIPPGAFSPYKKLRRIDLSNNQISELAPDAFQGLRSLNSLVLYGNKITELPKSLFEGLFSLQLLLLNANKINCLRVDAFQDLHNLNLLSLYDNKLQTIAKGTFSPLRAIQTMHLAQNPFICDCHLKWLADYLHTNPIETSGARCTSPRRLANKRIGQIKSKKFRCSAKEQYFIPGTEDYRSKLSGDCFADLACPEKCRCEGTTVDCSNQKLNKIPEHIPQYTAELRLNNNEFTVLEATGIFKKLPQLRKINFSNNKITDIEEGAFEGASGVNEILLTSNRLENVQHKMFKGLESLKTLMLRSNRITCVGNDSFIGLSSVRLLSLYDNQITTVAPGAFDTLHSLSTLNLLANPFNCNCYLAWLGEWLRKKRIVTGNPRCQKPYFLKEIPIQDVAIQDFTCDDGNDDNSCSPLSRCPTECTCLDTVVRCSNKGLKVLPKGIPRDVTELYLDGNQFTLVPKELSNYKHLTLIDLSNNRISTLSNQSFSNMTQLLTLILSYNRLRCIPPRTFDGLKSLRLLSLHGNDISVVPEGAFNDLSALSHLAIGANPLYCDCNMQWLSDWVKSEYKEPGIARCAGPGEMADKLLLTTPSKKFTCQGPVDVNILAKCNPCLSNPCKNDGTCNSDPVDFYRCTCPYGFKGQDCDVPIHACISNPCKHGGTCHLKEGEEDGFWCICADGFEGENCEVNVDDCEDNDCENNSTCVDGINNYTCLCPPEYTGELCEEKLDFCAQDLNPCQHDSKCILTPKGFKCDCTPGYVGEHCDIDFDDCQDNKCKNGAHCTDAVNGYTCICPEGYSGLFCEFSPPMVLPRTSPCDNFDCQNGAQCIVRINEPICQCLPGYQGEKCEKLVSVNFINKESYLQIPSAKVRPQTNITLQIATDEDSGILLYKGDKDHIAVELYRGRVRASYDTGSHPASAIYSVETINDGNFHIVELLALDQSLSLSVDGGNPKIITNLSKQSTLNFDSPLYVGGMPGKSNVASLRQAPGQNGTSFHGCIRNLYINSELQDFQKVPMQTGILPGCEPCHKKVCAHGTCQPSSQAGFTCECQEGWMGPLCDQRTNDPCLGNKCVHGTCLPINAFSYSCKCLEGHGGVLCDEEEDLFNPCQAIKCKHGKCRLSGLGQPYCECSSGYTGDSCDREISCRGERIRDYYQKQQGYAACQTTKKVSRLECRGGCAGGQCCGPLRSKRRKYSFECTDGSSFVDEVEKVVKCGCTRCVS

SEQ ID NO: 36148 - protein, 1542 aa, Homo sapiens
  ENSP00000273739
MRGVGWQMLSLSLGLVLAILNKVAPQACPAQCSCSGSTVDCHGLALRSVPRNIPRNTERLDLNGNNITRITKTDFAGLRHLRVLQLMENKISTIERGAFQDLKELERLRLNRNHLQLFPELLFLGTAKLYRLDLSENQIQAIPRKAFRGAVDIKNLQLDYNQISCIEDGAFRALRDLEVLTLNNNNITRLSVASFNHMPKLRTFRLHSNNLYCDCHLAWLSDWLRQRPRVGLYTQCMGPSHLRGHNVAEVQKREFVCSDEEEGHQSFMAPSCSVLHCPAACTCSNNIVDCRGKGLTEIPTNLPETITEIRLEQNTIKVIPPGAFSPYKKLRRIDLSNNQISELAPDAFQGLRSLNSLVLYGNKITELPKSLFEGLFSLQLLLLNANKINCLRVDAFQDLHNLNLLSLYDNKLQTIAKGTFSPLRAIQTMHLAQNPFICDCHLKWLADYLHTNPIETSGARCTSPRRLANKRIGQIKSKKFRCSAKEQYFIPGTEDYRSKLSGDCFADLACPEKCRCEGTTVDCSNQKLNKIPEHIPQYTAELRLNNNEFTVLEATGIFKKLPQLRKINFSNNKITDIEEGAFEGASGVNEILLTSNRLENVQHKMFKGLESLKTLMLRSNRITCVGNDSFIGLSSVRLLSLYDNQITTVAPGAFDTLHSLSTLNLLANPFNCNCYLAWLGEWLRKKRIVTGNPRCQKPYFLKEIPIQDVAIQDFTCDDGNDDNSCSPLSRCPTECTCLDTVVRCSNKGLKVLPKGIPRDVTELYLDGNQFTLVPKELSNYKHLTLIDLSNNRISTLSNQSFSNMTQLLTLILSYNRLRCIPPRTFDGLKSLRLLSLHGNDISVVPEGAFNDLSALSHLAIGANPLYCDCNMQWLSDWVKSEYKEPGIARCAGPGEMADKLLLTTPSKKFTCQGPVDVNILAKCNPCLSNPCKNDGTCNSDPVDFYRCTCPYGFKGQDCDVPIHACISNPCKHGGTCHLKEGEEDGFWCICADGFEGENCEVNVDDCEDNDCENNSTCVDGINNYTCLCPPEYTAANLNEVEKGELCEEKLDFCAQDLNPCQHDSKCILTPKGFKCDCTPGYVGEHCDIDFDDCQDNKCKNGAHCTDAVNGYTCICPEGYSGLFCEFSPPMVLPRTSPCDNFDCQNGAQCIVRINEPICQCLPGYQGEKCEKLVSVNFINKESYLQIPSAKVRPQTNITLQIATDEDSGILLYKGDKDHIAVELYRGRVRASYDTGSHPASAIYSVETINDGNFHIVELLALDQSLSLSVDGGNPKIITNLSKQSTLNFDSPLYVGGMPGKSNVASLRQAPGQNGTSFHGCIRNLYINSELQDFQKVPMQTGILPGCEPCHKKVCAHGTCQPSSQAGFTCECQEGWMGPLCDQRTNDPCLGNKCVHGTCLPINAFSYSCKCLEGHGGVLCDEEEDLFNPCQAIKCKHGKCRLSGLGQPYCECSSGYTGDSCDREISCRGERIRDYYQKQQGYAACQTTKKVSRLECRGGCAGGQCCGPLRSKRRKYSFECTDGSSFVDEVEKVVKCGCTRCVS

SEQ ID NO: 36149 - protein, 1525 aa, Homo sapiens
  ENSP00000422261
MRGVGWQMLSLSLGLVLAILNKVAPQACPAQCSCSGSTVDCHGLALRSVPRNIPRNTERLDLNGNNITRITKTDFAGLRHLRVLQLMENKISTIERGAFQDLKELERLRLNRNHLQLFPELLFLGTAKLYRLDLSENQIQAIPRKAFRGAVDIKNLQLDYNQISCIEDGAFRALRDLEVLTLNNNNITRLSVASFNHMPKLRTFRLHSNNLYCDCHLAWLSDWLRQRPRVGLYTQCMGPSHLRGHNVAEVQKREFVCSDEEEGHQSFMAPSCSVLHCPAACTCSNNIVDCRGKGLTEIPTNLPETITEIRLEQNTIKVIPPGAFSPYKKLRRIDLSNNQISELAPDAFQGLRSLNSLVLYGNKITELPKSLFEGLFSLQLLLLNANKINCLRVDAFQDLHNLNLLSLYDNKLQTIAKGTFSPLRAIQTMHLAQNPFICDCHLKWLADYLHTNPIETSGARCTSPRRLANKRIGQIKSKKFRCSGTEDYRSKLSGDCFADLACPEKCRCEGTTVDCSNQKLNKIPEHIPQYTAELRLNNNEFTVLEATGIFKKLPQLRKINFSNNKITDIEEGAFEGASGVNEILLTSNRLENVQHKMFKGLESLKTLMLRSNRITCVGNDSFIGLSSVRLLSLYDNQITTVAPGAFDTLHSLSTLNLLANPFNCNCYLAWLGEWLRKKRIVTGNPRCQKPYFLKEIPIQDVAIQDFTCDDGNDDNSCSPLSRCPTECTCLDTVVRCSNKGLKVLPKGIPRDVTELYLDGNQFTLVPKELSNYKHLTLIDLSNNRISTLSNQSFSNMTQLLTLILSYNRLRCIPPRTFDGLKSLRLLSLHGNDISVVPEGAFNDLSALSHLAIGANPLYCDCNMQWLSDWVKSEYKEPGIARCAGPGEMADKLLLTTPSKKFTCQGPVDVNILAKCNPCLSNPCKNDGTCNSDPVDFYRCTCPYGFKGQDCDVPIHACISNPCKHGGTCHLKEGEEDGFWCICADGFEGENCEVNVDDCEDNDCENNSTCVDGINNYTCLCPPEYTGELCEEKLDFCAQDLNPCQHDSKCILTPKGFKCDCTPGYVGEHCDIDFDDCQDNKCKNGAHCTDAVNGYTCICPEGYSGLFCEFSPPMVLPRTSPCDNFDCQNGAQCIVRINEPICQCLPGYQGEKCEKLVSVNFINKESYLQIPSAKVRPQTNITLQIATDEDSGILLYKGDKDHIAVELYRGRVRASYDTGSHPASAIYSVETINDGNFHIVELLALDQSLSLSVDGGNPKIITNLSKQSTLNFDSPLYVGGMPGKSNVASLRQAPGQNGTSFHGCIRNLYINSELQDFQKVPMQTGILPGCEPCHKKVCAHGTCQPSSQAGFTCECQEGWMGPLCDQRTNDPCLGNKCVHGTCLPINAFSYSCKCLEGHGGVLCDEEEDLFNPCQAIKCKHGKCRLSGLGQPYCECSSGYTGDSCDREISCRGERIRDYYQKQQGYAACQTTKKVSRLECRGGCAGGQCCGPLRSKRRKYSFECTDGSSFVDEVEKVVKCGCTRCVS

SEQ ID NO: 36150 - protein, 146 aa, Homo sapiens
  ENSP00000426356
MEAVLFVNAEAAAPRQSGRPRDLNGNNITRITKTDFAGLRHLRVLQLMENKISTIERGAFQDLKELERLRLNRNHLQLFPELLFLGTAKLYRLDLSENQIQAIPRKAFRGAVDIKNLQLDYNQISCIEDGAFRALRDLEVLTLNNN

SEQ ID NO: 36151 - protein, 212 aa, Homo sapiens
  ENSP00000421975
MTQLLTLILSYNRLRCIPPRTFDGLKSLRLLSLHGNDISVVPEGAFNDLSALSHLAIGANPLYCDCNMQWLSDWVKSEYKEPGIARCAGPGEMADKLLLTTPSKKFTCQGLPGPCGFLIPGPVDVNILAKCNPCLSNPCKNDGTCNSDPVDFYRCTCPYGFKGQDCDVPIHACISNPCKHGGTCHLKEGEEDGFWCICADGFEGENCEVNVD

SEQ ID NO: 36152 - protein, 196 aa, Homo sapiens
  ENSP00000425609
  MOD_RES (1)..(1): Any amino acid
XSDWVKSEYKEPGIARCAGPGEMADKLLLTTPSKKFTCQGPVDVNILAKCNPCLSNPCKNDGTCNSDPVDFYRCTCPYGFKGQDCDVPIHACISNPCKHGGTCHLKEGEEDGFWCICADGFEGENCEVNVDDCEDNDCENNSTCVDGINNYTCLCPPEYTGTNNRKYFAFHQYICLKASLELCYICLVNLFLFDKW

SEQ ID NO: 36153 - protein, 82 aa, Homo sapiens
  ENSP00000423179
  MOD_RES (1)..(1): Any amino acid
XSYDTGSHPASAIYSVETINDGNFHIVELLALDQSLSLSVDGGNPKIITNLSKQSTLNFDSPLYVGGMPGKSNVASLRQGAL

SEQ ID NO: 36154 - protein, 1439 aa, Homo sapiens
  ENSP00000482129
MENKISTIERGAFQDLKELERLRLNRNHLQLFPELLFLGTAKLYRLDLSENQIQAIPRKAFRGAVDIKNLQLDYNQISCIEDGAFRALRDLEVLTLNNNNITRLSVASFNHMPKLRTFRLHSNNLYCDCHLAWLSDWLRQRPRVGLYTQCMGPSHLRGHNVAEVQKREFVCSARHGGHQSFMAPSCSVLHCPAACTCSNNIVDCRGKGLTEIPTNLPETITEIRLEQNTIKVIPPGAFSPYKKLRRIDLSNNQISELAPDAFQGLRSLNSLVLYGNKITELPKSLFEGLFSLQLLLLNANKINCLRVDAFQDLHNLNLLSLYDNKLQTIAKGTFSPLRAIQTMHLAQNPFICDCHLKWLADYLHTNPIETSGARCTSPRRLANKRIGQIKSKKFRCSGTEDYRSKLSGDCFADLACPEKCRCEGTTVDCSNQKLNKIPEHIPQYTAELRLNNNEFTVLEATGIFKKLPQLRKINFSNNKITDIEEGAFEGASGVNEILLTSNRLENVQHKMFKGLESLKTLMLRSNRITCVGNDSFIGLSSVRLLSLYDNQITTVAPGAFDTLHSLSTLNLLANPFNCNCYLAWLGEWLRKKRIVTGNPRCQKPYFLKEIPIQDVAIQDFTCDDGNDDNSCSPLSRCPTECTCLDTVVRCSNKGLKVLPKGIPRDVTELYLDGNQFTLVPKELSNYKHLTLIDLSNNRISTLSNQSFSNMTQLLTLILSYNRLRCIPPRTFDGLKSLRLLSLHGNDISVVPEGAFNDLSALSHLAIGANPLYCDCNMQWLSDWVKSEYKEPGIARCAGPGEMADKLLLTTPSKKFTCQGPVDVNILAKCNPCLSNPCKNDGTCNSDPVDFYRCTCPYGFKGQDCDVPIHACISNPCKHGGTCHLKEGEEDGFWCICADGFEGENCEVNVDDCEDNDCENNSTCVDGINNYTCLCPPEYTGELCEEKLDFCAQDLNPCQHDSKCILTPKGFKCDCTPGYVGEHCDIDFDDCQDNKCKNGAHCTDAVNGYTCICPEGYSGLFCEFSPPMVLPRTSPCDNFDCQNGAQCIVRINEPICQCLPGYQGEKCEKLVSVNFINKESYLQIPSAKVRPQTNITLQIATDEDSGILLYKGDKDHIAVELYRGRVRASYDTGSHPASAIYSVETINDGNFHIVELLALDQSLSLSVDGGNPKIITNLSKQSTLNFDSPLYVGGMPGKSNVASLRQAPGQNGTSFHGCIRNLYINSELQDFQKVPMQTGILPGCEPCHKKVCAHGTCQPSSQAGFTCECQEGWMGPLCDQRTNDPCLGNKCVHGTCLPINAFSYSCKCLEGHGGVLCDEEEDLFNPCQAIKCKHGKCRLSGLGQPYCECSSGYTGDSCDREISCRGERIRDYYQKQQGYAACQTTKKVSRLECRGGCAGGQCCGPLRSKRRKYSFECTDGSSFVDEVEKVVKCGCTRCVS

SEQ ID NO: 36155 - protein, 1523 aa, Homo sapiens
  ENSP00000430333
MAPGWAGVGAAVRARLALALALASVLSGPPAVACPTKCTCSAASVDCHGLGLRAVPRGIPRNAERLDLDRNNITRITKMDFAGLKNLRVLHLEDNQVSVIERGAFQDLKQLERLRLNKNKLQVLPELLFQSTPKLTRLDLSENQIQGIPRKAFRGITDVKNLQLDNNHISCIEDGAFRALRDLEILTLNNNNISRILVTSFNHMPKIRTLRLHSNHLYCDCHLAWLSDWLRQRRTVGQFTLCMAPVHLRGFNVADVQKKEYVCPAPHSEPPSCNANSISCPSPCTCSNNIVDCRGKGLMEIPANLPEGIVEIRLEQNSIKAIPAGAFTQYKKLKRIDISKNQISDIAPDAFQGLKSLTSLVLYGNKITEIVKGLFDGLVSLQLLLLNANKINCLRVNTFQDLQNLNLLSLYDNKLQTISKGLFAPLQSIQTLHLAQNPFVCDCHLKWLADYLQDNPIETSGARCSSPRRLANKRISQIKSKKFRCSGSEDYRSRFSSECFMDLVCPEKCRCEGTIVDCSNQKLVRIPSHLPEYVTDLRLNDNEVSVLEATGIFKKLPNLRKINLSNNKIKEVREGAFDGAASVQELMLTGNQLETVHGRVFRGLSGLKTLMLRSNLIGCVSNDTFAGLSSVRLLSLYDNRITTITPGAFTTLVSLSTINLLSNPFNCNCHLAWLGKWLRKRRIVSGNPRCQKPFFLKEIPIQDVAIQDFTCDGNEESSCQLSPRCPEQCTCMETVVRCSNKGLRALPRGMPKDVTELYLEGNHLTAVPRELSALRHLTLIDLSNNSISMLTNYTFSNMSHLSTLILSYNRLRCIPVHAFNGLRSLRVLTLHGNDISSVPEGSFNDLTSLSHLALGTNPLHCDCSLRWLSEWVKAGYKEPGIARCSSPEPMADRLLLTTPTHRFQCKGPVDINIVAKCNACLSSPCKNNGTCTQDPVELYRCACPYSYKGKDCTVPINTCIQNPCQHGGTCHLSDSHKDGFSCSCPLGFEGQRCEINPDDCEDNDCENNATCVDGINNYVCICPPNYTGELCDEVIDHCVPELNLCQHEAKCIPLDKGFSCECVPGYSGKLCETDNDDCVAHKCRHGAQCVDTINGYTCTCPQGFSGPFCEHPPPMVLLQTSPCDQYECQNGAQCIVVQQEPTCRCPPGFAGPRCEKLITVNFVGKDSYVELASAKVRPQANISLQVATDKDNGILLYKGDNDPLALELYQGHVRLVYDSLSSPPTTVYSVETVNDGQFHSVELVTLNQTLNLVVDKGTPKSLGKLQKQPAVGINSPLYLGGIPTSTGLSALRQGTDRPLGGFHGCIHEVRINNELQDFKALPPQSLGVSPGCKSCTVCKHGLCRSVEKDSVVCECRPGWTGPLCDQEARDPCLGHRCHHGKCVATGTSYMCKCAEGYGGDLCDNKNDSANACSAFKCHHGQCHISDQGEPYCLCQPGFSGEHCQQENPCLGQVVREVIRRQKGYASCATASKVPIMECRGGCGPQCCQPTRSKRRKYVFQCTDGSSFVEEVERHLECGCLACS

SEQ ID NO: 36156 - protein, 1530 aa, Homo sapiens
  ENSP00000332164
MAPGWAGVGAAVRARLALALALASVLSGPPAVACPTKCTCSAASVDCHGLGLRAVPRGIPRNAERLDLDRNNITRITKMDFAGLKNLRVLHLEDNQVSVIERGAFQDLKQLERLRLNKNKLQVLPELLFQSTPKLTRLDLSENQIQGIPRKAFRGITDVKNLQLDNNHISCIEDGAFRALRDLEILTLNNNNISRILVTSFNHMPKIRTLRLHSNHLYCDCHLAWLSDWLRQRRTVGQFTLCMAPVHLRGFNVADVQKKEYVCPAPHSEPPSCNANSISCPSPCTCSNNIVDCRGKGLMEIPANLPEGIVEIRLEQNSIKAIPAGAFTQYKKLKRIDISKNQISDIAPDAFQGLKSLTSLVLYGNKITEIVKGLFDGLVSLQLLLLNANKINCLRVNTFQDLQNLNLLSLYDNKLQTISKGLFAPLQSIQTLHLAQNPFVCDCHLKWLADYLQDNPIETSGARCSSPRRLANKRISQIKSKKFRCSGSEDYRSRFSSECFMDLVCPEKCRCEGTIVDCSNQKLVRIPSHLPEYVTDLRLNDNEVSVLEATGIFKKLPNLRKINLSNNKIKEVREGAFDGAASVQELMLTGNQLETVHGRVFRGLSGLKTLMLRSNLIGCVSNDTFAGLSSVRLLSLYDNRITTITPGAFTTLVSLSTINLLSNPFNCNCHLAWLGKWLRKRRIVSGNPRCQKPFFLKEIPIQDVAIQDFTCDGNEESSCQLSPRCPEQCTCMETVVRCSNKGLRALPRGMPKDVTELYLEGNHLTAVPRELSALRHLTLIDLSNNSISMLTNYTFSNMSHLSTLILSYNRLRCIPVHAFNGLRSLRVLTLHGNDISSVPEGSFNDLTSLSHLALGTNPLHCDCSLRWLSEWVKAGYKEPGIARCSSPEPMADRLLLTTPTHRFQCKVLWFCCPGPVDINIVAKCNACLSSPCKNNGTCTQDPVELYRCACPYSYKGKDCTVPINTCIQNPCQHGGTCHLSDSHKDGFSCSCPLGFEGQRCEINPDDCEDNDCENNATCVDGINNYVCICPPNYTGELCDEVIDHCVPELNLCQHEAKCIPLDKGFSCECVPGYSGKLCETDNDDCVAHKCRHGAQCVDTINGYTCTCPQGFSGPFCEHPPPMVLLQTSPCDQYECQNGAQCIVVQQEPTCRCPPGFAGPRCEKLITVNFVGKDSYVELASAKVRPQANISLQVATDKDNGILLYKGDNDPLALELYQGHVRLVYDSLSSPPTTVYSVETVNDGQFHSVELVTLNQTLNLVVDKGTPKSLGKLQKQPAVGINSPLYLGGIPTSTGLSALRQGTDRPLGGFHGCIHEVRINNELQDFKALPPQSLGVSPGCKSCTVCKHGLCRSVEKDSVVCECRPGWTGPLCDQEARDPCLGHRCHHGKCVATGTSYMCKCAEGYGGDLCDNKNDSANACSAFKCHHGQCHISDQGEPYCLCQPGFSGEHCQQENPCLGQVVREVIRRQKGYASCATASKVPIMECRGGCGPQCCQPTRSKRRKYVFQCTDGSSFVEEVERHLECGCLACS

SEQ ID NO: 36157 - protein, 1393 aa, Homo sapiens
  ENSP00000384890
RDLSENQIQGIPRKAFRGITDVKNLQLDNNHISCIEDGAFRALRDLEILTLNNNNISRILVTSFNHMPKIRTLRLHSNHLYCDCHLAWLSDWLRQRRTVGQFTLCMAPVHLRGFNVADVQKKEYVCPAPHSEPPSCNANSISCPSPCTCSNNIVDCRGKGLMEIPANLPEGIVEIRLEQNSIKAIPAGAFTQYKKLKRIDISKNQISDIAPDAFQGLKSLTSLVLYGNKITEIVKGLFDGLVSLQLLLLNANKINCLRVNTFQDLQNLNLLSLYDNKLQTISKGLFAPLQSIQTLHLAQNPFVCDCHLKWLADYLQDNPIETSGARCSSPRRLANKRISQIKSKKFRCSGSEDYRSRFSSECFMDLVCPEKCRCEGTIVDCSNQKLVRIPSHLPEYVTDLRLNDNEVSVLEATGIFKKLPNLRKINLSNNKIKEVREGAFDGAASVQELMLTGNQLETVHGRVFRGLSGLKTLMLRSNLIGCVSNDTFAGLSSVRLLSLYDNRITTITPGAFTTLVSLSTINLLSNPFNCNCHLAWLGKWLRKRRIVSGNPRCQKPFFLKEIPIQDVAIQDFTCDGNEESSCQLSPRCPEQCTCMETVVRCSNKGLRALPRGMPKDVTELYLEGNHLTAVPRELSALRHLTLIDLSNNSISMLTNYTFSNMSHLSTLILSYNRLRCIPVHAFNGLRSLRVLTLHGNDISSVPEGSFNDLTSLSHLALGTNPLHCDCSLRWLSEWVKAGYKEPGIARCSSPEPMADRLLLTTPTHRFQCKVLWFCCPGPVDINIVAKCNACLSSPCKNNGTCTQDPVELYRCACPYSYKGKDCTVPINTCIQNPCQHGGTCHLSDSHKDGFSCSCPLGFEGQRCEINPDDCEDNDCENNATCVDGINNYVCICPPNYTGELCDEVIDHCVPELNLCQHEAKCIPLDKGFSCECVPGYSGKLCETDNDDCVAHKCRHGAQCVDTINGYTCTCPQGFSGPFCEHPPPMVLLQTSPCDQYECQNGAQCIVVQQEPTCRCPPGFAGPRCEKLITVNFVGKDSYVELASAKVRPQANISLQVATDKDNGILLYKGDNDPLALELYQGHVRLVYDSLSSPPTTVYSVETVNDGQFHSVELVTLNQTLNLVVDKGTPKSLGKLQKQPAVGINSPLYLGGIPTSTGLSALRQGTDRPLGGFHGCIHEVRINNELQDFKALPPQSLGVSPGCKSCTVCKHGLCRSVEKDSVVCECRPGWTGPLCDQEARDPCLGHRCHHGKCVATGTSYMCKCAEGYGGDLCDNKNDSANACSAFKCHHGQCHISDQGEPYCLCQPGFSGEHCQQENPCLGQVVREVIRRQKGYASCATASKVPIMECRGGCGPQCCQPTRSKRRKYVFQCTDGSSFVEEVERHLECGCLACS

SEQ ID NO: 36158 - protein, 696 aa, Homo sapiens
  ENSP00000366288
MLLWILLLETSLCFAAGNVTGDVCKEKICSCNEIEGDLHVDCEKKGFTSLQRFTAPTSQFYHLFLHGNSLTRLFPNEFANFYNAVSLHMENNGLHEIVPGAFLGLQLVKRLHINNNKIKSFRKQTFLGLDDLEYLQADFNLLRDIDPGAFQDLNKLEVLILNDNLISTLPANVFQYVPITHLDLRGNRLKTLPYEEVLEQIPGIAEILLEDNPWDCTCDLLSLKEWLENIPKNALIGRVVCEAPTRLQGKDLNETTEQDLCPLKNRVDSSLPAPPAQEETFAPGPLPTPFKTNGQEDHATPGSAPNGGTKIPGNWQIKIRPTAAIATGSSRNKPLANSLPCPGGCSCDHIPGSGLKMNCNNRNVSSLADLKPKLSNVQELFLRDNKIHSIRKSHFVDYKNLILLDLGNNNIATVENNTFKNLLDLRWLYMDSNYLDTLSREKFAGLQNLEYLNVEYNAIQLILPGTFNAMPKLRILILNNNLLRSLPVDVFAGVSLSKLSLHNNYFMYLPVAGVLDQLTSIIQIDLHGNPWECSCTIVPFKQWAERLGSEVLMSDLKCETPVNFFRKDFMLLSNDEICPQLYARISPTLTSHSKNSTGLAETGTHSNSYLDTSRVSISVLVPGLLLVFVTSAFTVVGMLVFILRNRKRSKRRDANSSASEINSLQTVCDSSYWHNGPYNADGAHRVYDCGSHSLSD

SEQ ID NO: 36159 - protein, 841 aa, Homo sapiens
  ENSP00000383143
MKLWIHLFYSSLLACISLHSQTPVLSSRGSCDSLCNCEEKDGTMLINCEAKGIKMVSEISVPPSRPFQLSLLNNGLTMLHTNDFSGLTNAISIHLGFNNIADIEIGAFNGLGLLKQLHINHNSLEILKEDTFHGLENLEFLQADNNFITVIEPSAFSKLNRLKVLILNDNAIESLPPNIFRFVPLTHLDLRGNQLQTLPYVGFLEHIGRILDLQLEDNKWACNCDLLQLKTWLENMPPQSIIGDVVCNSPPFFKGSILSRLKKESICPTPPVYEEHEDPSGSLHLAATSSINDSRMSTKTTSILKLPTKAPGLIPYITKPSTQLPGPYCPIPCNCKVLSPSGLLIHCQERNIESLSDLRPPPQNPRKLILAGNIIHSLMKSDLVEYFTLEMLHLGNNRIEVLEEGSFMNLTRLQKLYLNGNHLTKLSKGMFLGLHNLEYLYLEYNAIKEILPGTFNPMPKLKVLYLNNNLLQVLPPHIFSGVPLTKVNLKTNQFTHLPVSNILDDLDLLTQIDLEDNPWDCSCDLVGLQQWIQKLSKNTVTDDILCTSPGHLDKKELKALNSEILCPGLVNNPSMPTQTSYLMVTTPATTTNTADTILRSLTDAVPLSVLILGLLIMFITIVFCAAGIVVLVLHRRRRYKKKQVDEQMRDNSPVHLQYSMYGHKTTHHTTERPSASLYEQHMVSPMVHVYRSPSFGPKHLEEEEERNEKEGSDAKHLQRSLLEQENHSPLTGSNMKYKTTNQSTEFLSFQDASSLYRNILEKERELQQLGITEYLRKNIAQLQPDMEAHYPGAHEELKLMETLMYSRPRKVLVEQTKNEYFELKANLHAEPDYLEVLEQQT

SEQ ID NO: 36160 - protein, 92 aa, Homo sapiens
  ENSP00000453082
MELCEFAFNMKKDEVCVNPYHYQRVETPVLPPVLVPRHTEIPAEFPPLDDYSHSIPENTNFPAGIEPQSNIPETPPPGYLSEDGETSDHQMN

SEQ ID NO: 36161 - protein, 425 aa, Homo sapiens
  ENSP00000332973
MSSILPFTPPIVKRLLGWKKGEQNGQEEKWCEKAVKSLVKKLKKTGQLDELEKAITTQNVNTKCITIPRSLDGRLQVSHRKGLPHVIYCRLWRWPDLHSHHELRAMELCEFAFNMKKDEVCVNPYHYQRVETPVLPPVLVPRHTEIPAEFPPLDDYSHSIPENTNFPAGIEPQSNIPETPPPGYLSEDGETSDHQMNHSMDAGSPNLSPNPMSPAHNNLDLQPVTYCEPAFWCSISYYELNQRVGETFHASQPSMTVDGFTDPSNSERFCLGLLSNVNRNAAVELTRRHIGRGVRLYYIGGEVFAECLSDSAIFVQSPNCNQRYGWHPATVCKIPPGCNLKIFNNQEFAALLAQSVNQGFEAVYQLTRMCTIRMSFVKGWGAEYRRQTVTSTPCWIELHLNGPLQWLDKVLTQMGSPSIRCSSVS

SEQ ID NO: 36162 - protein, 96 aa, Homo sapiens
  ENSP00000453788
MGGWTPFLRGPVWRRVRQPMEMGQCSEMLHKCGLLPQTVDRAYVLSEDQLCPWMAGCRCPIGRGSLMSSTAACGDGQTCTATTSYGPWSCVSSPSI

SEQ ID NO: 36163 - protein, 114 aa, Homo sapiens
  ENSP00000455095
MELCEFAFNMKKDEVCVNPYHYQRVETPVLPPVLVPRHTEIPAEFPPLDDYSHSIPENTNFPAGIEPQSNIPETPPPGYLSEDGETSDHQMNHSMDAGSPNLSPNPMSPAHNNL

SEQ ID NO: 36164 - protein, 320 aa, Homo sapiens
  ENSP00000437757
MELCEFAFNMKKDEVCVNPYHYQRVETPVLPPVLVPRHTEIPAEFPPLDDYSHSIPENTNFPAGIEPQSNIPETPPPGYLSEDGETSDHQMNHSMDAGSPNLSPNPMSPAHNNLDLQPVTYCEPAFWCSISYYELNQRVGETFHASQPSMTVDGFTDPSNSERFCLGLLSNVNRNAAVELTRRHIGRGVRLYYIGGEVFAECLSDSAIFVQSPNCNQRYGWHPATVCKIPPGCNLKIFNNQEFAALLAQSVNQGFEAVYQLTRMCTIRMSFVKGWGAEYRRQTVTSTPCWIELHLNGPLQWLDKVLTQMGSPSIRCSSVS

SEQ ID NO: 36165 - protein, 213 aa, Homo sapiens
  ENSP00000458060
MELCEFAFNMKKDEVCVNPYHYQRVETPVLPPVLVPRHTEIPAEFPPLDDYSHSIPENTNFPAGIEPQSNIPETPPPGYLSEDGETSDHQMNHSMDAGSPNLSPNPMSPAHNNLDLQPVTYCEPAFWCSISYYELNQRVGETFHASQPSMTVDGFTDPSNSERFCLGLLSNVNRNAAVELTRRHIGCNLKIFNNQEFAALLAQSVNQGFEAVY

SEQ ID NO: 36166 - protein, 381 aa, Homo sapiens
  ENSP00000401133
MSCLHPRQTWKGAALVHRKAWWMGRSLDGRLQVSHRKGLPHVIYCRLWRWPDLHSHHELRAMELCEFAFNMKKDEVCVNPYHYQRVETPVLPPVLVPRHTEIPAEFPPLDDYSHSIPENTNFPAGIEPQSNIPETPPPGYLSEDGETSDHQMNHSMDAGSPNLSPNPMSPAHNNLDLQPVTYCEPAFWCSISYYELNQRVGETFHASQPSMTVDGFTDPSNSERFCLGLLSNVNRNAAVELTRRHIGRGVRLYYIGGEVFAECLSDSAIFVQSPNCNQRYGWHPATVCKIPPGCNLKIFNNQEFAALLAQSVNQGFEAVYQLTRMCTIRMSFVKGWGAEYRRQTVTSTPCWIELHLNGPLQWLDKVLTQMGSPSIRCSSVS

SEQ ID NO: 36167 - protein, 63 aa, Homo sapiens
  ENSP00000453684
MELCEFAFNMKKDEVCVNPYHYQRVETPVLPPVLVPRHTEIPAEFPPLDDYSHSIPENTNFPA

SEQ ID NO: 36168 - protein, 230 aa, Homo sapiens
  ENSP00000445348
MNHSMDAGSPNLSPNPMSPAHNNLDLQPVTYCEPAFWCSISYYELNQRVGETFHASQPSMTVDGFTDPSNSERFCLGLLSNVNRNAAVELTRRHIGRGVRLYYIGGEVFAECLSDSAIFVQSPNCNQRYGWHPATVCKIPPGCNLKIFNNQEFAALLAQSVNQGFEAVYQLTRMCTIRMSFVKGWGAEYRRQTVTSTPCWIELHLNGPLQWLDKVLTQMGSPSIRCSSVS

SEQ ID NO: 36169 - protein, 84 aa, Homo sapiens
  ENSP00000454165
MNHSMDAGSPNLSPNPMSPAHNNLDLQPVTYCEPAFWCSISYYELNQRVGETFHASQPSMTVDGFTDPSNSERFCLGLLSNVNR

SEQ ID NO: 36170 - protein, 112 aa, Homo sapiens
  ENSP00000452767
MNHSMDAGSPNLSPNPMSPAHNNLDLQPVTYCEPAFWCSISYYELNQRVGETFHASQPSMTVDGFTDPSNSERFCLGLLSNVNRNAAVELTRRHIGRGVRLYYIGGEVFAEC

SEQ ID NO: 36171 - protein, 156 aa, Homo sapiens
  ENSP00000455540
  MOD_RES (1)..(1): Any amino acid
XLSDSAIFVQSPNCNQRYGWHPATVCKIPPGKAPLSTPSPYFWKPSLQTSPCSGSRSLWASLPSPLAGCNLKIFNNQEFAALLAQSVNQGFEAVYQLTRMCTIRMSFVKGWGAEYRRQTVTSTPCWIELHLNGPLQWLDKVLTQMGSPSIRCSSVS

SEQ ID NO: 36172 - protein, 426 aa, Homo sapiens
  ENSP00000262158
MFRTKRSALVRRLWRSRAPGGEDEEEGAGGGGGGGELRGEGATDSRAHGAGGGGPGRAGCCLGKAVRGAKGHHHPHPPAAGAGAAGGAEADLKALTHSVLKKLKERQLELLLQAVESRGGTRTACLLLPGRLDCRLGPGAPAGAQPAQPPSSYSLPLLLCKVFRWPDLRHSSEVKRLCCCESYGKINPELVCCNPHHLSRLCELESPPPPYSRYPMDFLKPTADCPDAVPSSAETGGTNYLAPGGLSDSQLLLEPGDRSHWCVVAYWEEKTRVGRLYCVQEPSLDIFYDLPQGNGFCLGQLNSDNKSQLVQKVRSKIGCGIQLTREVDGVWVYNRSSYPIFIKSATLDNPDSRTLLVHKVFPGFSIKAFDYEKAYSLQRPNDHEFMQQPWTGFTVQISFVKGWGQCYTRQFISSCPCWLEVIFNSR

SEQ ID NO: 36173 - protein, 211 aa, Homo sapiens
  ENSP00000466902
MDFLKPTADCPDAVPSSAETGGTNYLAPGGLSDSQLLLEPGDRSHWCVVAYWEEKTRVGRLYCVQEPSLDIFYDLPQGNGFCLGQLNSDNKSQLVQKVRSKIGCGIQLTREVDGVWVYNRSSYPIFIKSATLDNPDSRTLLVHKVFPGFSIKAFDYEKAYSLQRPNDHEFMQQPWTGFTVQISFVKGWGQCYTRQFISSCPCWLEVIFNSR

SEQ ID NO: 36174 - protein, 425 aa, Homo sapiens
  ENSP00000467621
MFRTKRSALVRRLWRSRAPGGEDEEEGAGGGGGGGELRGEGATDSRAHGAGGGGPGRAGCCLGKAVRGAKGHHHPHPPAAGAGAAGGAEADLKALTHSVLKKLKERQLELLLQAVESRGGTRTACLLLPGRLDCRLGPGAPAGAQPAQPPSSYSLPLLLCKVFRWPDLRHSSEVKRLCCCESYGKINPELVCCNPHHLSRLCELESPPPPYSRYPMDFLKPTDCPDAVPSSAETGGTNYLAPGGLSDSQLLLEPGDRSHWCVVAYWEEKTRVGRLYCVQEPSLDIFYDLPQGNGFCLGQLNSDNKSQLVQKVRSKIGCGIQLTREVDGVWVYNRSSYPIFIKSATLDNPDSRTLLVHKVFPGFSIKAFDYEKAYSLQRPNDHEFMQQPWTGFTVQISFVKGWGQCYTRQFISSCPCWLEVIFNSR

SEQ ID NO: 36175 - protein, 158 aa, Homo sapiens
  ENSP00000465590
MDFLKPTADCPDAVPSSAETGGTNYLAPGGLSDSQLLLEPGDRSHWCVVAYWEEKTRVGRLYCVQEPSLDIFYDLPQGNGFCLGQLNSDNKSQLVQKVRSKIGCGIQLTREVDGVWVYNRSSYPIFIKSATLDNPDSRTLLVHKVFPGFSIKAFDYEK

SEQ ID NO: 36176 - protein, 118 aa, Homo sapiens
  ENSP00000471126
MQSLRPEQTRGLLEPERTKTLLPRESRAWEKPPHPACTKDWEAVEVGASSHDSDEKDLSSQETGLSQEWSSVEEDDESEGSQGFVEWSKAPQQTTIVLVVCVLFLFLVLTGMPMMFHI

SEQ ID NO: 36177 - protein, 103 aa, Homo sapiens
  ENSP00000472019
MQSLRPEQTRGLLEPERTKTLLPRESRAWEKPPHPACTKDWEAVEVGASSHDSDEKGLCGVVKSSTTNNHSLGSVRAFFVPGFNGDAYDVSHLTIMVAVVLKV

SEQ ID NO: 36178 - protein, 435 aa, Homo sapiens
  ENSP00000355110
MLPARCARLLTPHLLLVLVQLSPARGHRTTGPRFLISDRDPQCNLHCSRTQPKPICASDGRSYESMCEYQRAKCRDPTLGVVHRGRCKDAGQSKCRLERAQALEQAKKPQEAVFVPECGEDGSFTQVQCHTYTGYCWCVTPDGKPISGSSVQNKTPVCSGSVTDKPLSQGNSGRKDDGSKPTPTMETQPVFDGDEITAPTLWIKHLVIKDSKLNNTNIRNSEKVYSCDQERQSALEEAQQNPREGIVIPECAPGGLYKPVQCHQSTGYCWCVLVDTGRPLPGTSTRYVMPSCESDARAKTTEADDPFKDRELPGCPEGKKMEFITSLLDALTTDMVQAINSAAPTGGGRFSEPDPSHTLEERVVHWYFSQLDSNSSNDINKREMKPFKRYVKKKAKPKKCARRFTDYCDLNKDKVISLPELKGCLGVSKEVGRLV

SEQ ID NO: 36179 - protein, 434 aa, Homo sapiens
  ENSP00000370680
MLPARCARLLTPHLLLVLVQLSPARGHRTTGPRFLISDRDPQCNLHCSRTQPKPICASDGRSYESMCEYQRAKCRDPTLGVVHRGRCKDAGQSKCRLERAQALEQAKKPQEAVFVPECGEDGSFTQVQCHTYTGYCWCVTPDGKPISGSSVQNKTPVCSGSVTDKPLSQGNSGRKDDGSKPTPTMETQPVFDGDEITAPTLWIKHLVIKDSKLNNTNIRNSEKVYSCDQERQSALEEAQQNPREGIVIPECAPGGLYKPVQCHQSTGYCWCVLVDTGRPLPGTSTRYVMPSCESDARAKTTEADDPFKDRELPGCPEGKKMEFITSLLDALTTDMVQAINSAAPTGGGRFSEPDPSHTLEERVVHWYFSQLDSNSSNDINKREMKPFKRYVKKKAKPKKCARRFTDYCDLNKDKVISLPELKGCLGVSKEGRLV

SEQ ID NO: 36180 - protein, 88 aa, Homo sapiens
  ENSP00000368808
MNMSKQPVSNVRAIQANINIPMGAFRPGAGQPPRRKECTPEVEEGVPPTSDEEKKPIPGAKKLPGPAVNLSEIQNIKSELKYVPKAEQ

SEQ ID NO: 36181 - protein, 268 aa, Homo sapiens
  ENSP00000020945
MPRSFLVKKHFNASKKPNYSELDTHTVIISPYLYESYSMPVIPQPEILSSGAYSPITVWTTAAPFHAQLPNGLSPLSGYSSSLGRVSPPPPSDTSSKDHSGSESPISDEEERLQSKLSDPHAIEAEKFQCNLCNKTYSTFSGLAKHKQLHCDAQSRKSFSCKYCDKEYVSLGALKMHIRTHTLPCVCKICGKAFSRPWLLQGHIRTHTGEKPFSCPHCNRAFADRSNLRAHLQTHSDVKKYQCKNCSKTFSRMSLLHKHEESGCCVAH

SEQ ID NO: 36182 - protein, 89 aa, Homo sapiens
  ENSP00000380034
MPRSFLVKKHFNASKKPNYSELDTHTVIISPYLYESYSMPVIPQPEILSSGAYSPITVWTTAAPFHAQLPNGLSPLSGYSSSLGRVSPP

SEQ ID NO: 36183 - protein, 368 aa, Homo sapiens
  ENSP00000216294
MGTPPGLQTDCEALLSRFQETDSVRFEDFTELWRNMKFGTIFCGRMRNLEKNMFTKEALALAWRYFLPPYTFQIRVGALYLLYGLYNTQLCQPKQKIRVALKDWDEVLKFQQDLVNAQHFDAAYIFRKLRLDRAFHFTAMPKLLSYRMKKKIHRAEVTEEFKDPSDRVMKLITSDVLEEMLNVHDHYQNMKHVISVDKSKPDKALSLIKDDFFDNIKNIVLEHQQWHKDRKNPSLKSKTNDGEEKMEGNSQETERCERAESLAKIKSKAFSVVIQASKSRRHRQVKLDSSDSDSASGQGQVKATRKKEKKERLKPAGRKMSLRNKGNVQNIHKEDKPLSLSMPVITEEEENESLSGTEFTASKKRRKH

SEQ ID NO: 36184 - protein, 135 aa, Homo sapiens
  ENSP00000427090
MEAPEYLDLDEIDFSDDISYSVTSLKTIPELCRRCDTQNEDRSVSSSSWNCGISTLITNTQKPTGIADVYSKFRPVKRVSPLKHQPETLENNESDDQKNQKVVEYQKGGESDLGPQPQELGPGDGVGGPPGKSSE

SEQ ID NO: 36185 - protein, 66 aa, Homo sapiens
  ENSP00000426526
MEAPEYLDLDEIDFSDDISYSVTSLKTIPELCRRCDTQNEDRSEWSVGVRTLDGERNRSHCRTELF

SEQ ID NO: 36186 - protein, 160 aa, Homo sapiens
  ENSP00000426551
MEAPEYLDLDEIDFSDDISDNRSQGNRLQKLGLEDTDREDAMGFGSHRAKLTVVAALGACHCPENEYSVTSLKTIPELCRRCDTQNEDRSVSSSSWNCGISTLITNTQKPTGIADVYSKFRPVKRVSPLKHQPETLENNESDDQKNQKVVEYQKGGESDL

SEQ ID NO: 36187 - protein, 98 aa, Homo sapiens
  ENSP00000422610
MEAPEYLDLDEIDFSDDISYSVTSLKTIPELCRRCDTQNEDRSVSSSSWNCGISTLITNTQKPTGIADVYSKFRPVKRVSPLKHQPETLENNESDDQK

SEQ ID NO: 36188 - protein, 858 aa, Homo sapiens
  ENSP00000422106
MEAPEYLDLDEIDFSDDISYSVTSLKTIPELCRRCDTQNEDRSVSSSSWNCGISTLITNTQKPTGIADVYSKFRPVKRVSPLKHQPETLENNESDDQKNQKVVEYQKGGESDLGPQPQELGPGDGVGGPPGKSSEPSTSLGELEHYDLDMDEILDVPYIKSSQQLASFTKVTSEKRILGLCTTINGLSGKACSTGSSESSSSNMAPFCVLSPVKSPHLRKASAVIHDQHKLSTEETEISPPLVKCGSAYEPENQSKDFLNKTFSDPHGRKVEKTTPDCQLRAFHLQSSAAESKPEEQVSGLNRTSSQGPEERSEYLKKVKSILNIVKEGQISLLNGQLECVRWMVSETEAIAELSCSKDFPSLIHYAGCYGQEKILLWLLQFMQEQGISLDEVDQDGNSAVHVASQHGYLGCIQTLVEYGANVTMQNHAGEKPSQSAERQGHTLCSRYLVVVETCMSLASQVVKLTKQLKEQTVERVTLQNQLQQFLEAQKSEGKSLPSSPSSPSSPASRKSQWKSPDADDDSVAKSKPGVQEGIQVLGSLSASSRARPKAKDEDSDKILRQLLGKEISENVCTQEKLSLEFQDAQASSRNSKKIPLEKRELKLARLRQLMQRSLSESDTDSNNSEDPKTTPVRKADRPRPQPIVESVESMDSAESLHLMIKKHTLASGGRRFPFSIKASKSLDGHSPSPTSESSEPDLESQYPGSGSIPPNQPSGDPQQPSPDSTAAQKVATSPKSALKSPSSKRRTSQNLKLRVTFEEPVVQMEQPSLELNGEKDKDKGRTLQRTSTSNESGDQLKRPFGAFRSIMETLSGNQNNNNNYQAANQLKTSTLPLTSLGRKTDAKGNPASSASKGKNKA

SEQ ID NO: 36189 - protein, 919 aa, Homo sapiens
  ENSP00000261368
MEAPEYLDLDEIDFSDDISYSVTSLKTIPELCRRCDTQNEDRSVSSSSWNCGISTLITNTQKPTGIADVYSKFRPVKRVSPLKHQPETLENNESDDQKNQKVVEYQKGGESDLGPQPQELGPGDGVGGPPGKSSEPSTSLGELEHYDLDMDEILDVPYIKSSQQLASFTKVTSEKRILGLCTTINGLSGKACSTGSSESSSSNMAPFCVLSPVKSPHLRKASAVIHDQHKLSTEETEISPPLVKCGSAYEPENQSKDFLNKTFSDPHGRKVEKTTPDCQLRAFHLQSSAAESKPEEQVSGLNRTSSQGPEERSEYLKKVKSILNIVKEGQISLLPHLAADNLDKIHDENGNNLLHIAASQGHAECLQHLTSLMGEDCLNERNTEKLTPAGLAIKNGQLECVRWMVSETEAIAELSCSKDFPSLIHYAGCYGQEKILLWLLQFMQEQGISLDEVDQDGNSAVHVASQHGYLGCIQTLVEYGANVTMQNHAGEKPSQSAERQGHTLCSRYLVVVETCMSLASQVVKLTKQLKEQTVERVTLQNQLQQFLEAQKSEGKSLPSSPSSPSSPASRKSQWKSPDADDDSVAKSKPGVQEGIQVLGSLSASSRARPKAKDEDSDKILRQLLGKEISENVCTQEKLSLEFQDAQASSRNSKKIPLEKRELKLARLRQLMQRSLSESDTDSNNSEDPKTTPVRKADRPRPQPIVESVESMDSAESLHLMIKKHTLASGGRRFPFSIKASKSLDGHSPSPTSESSEPDLESQYPGSGSIPPNQPSGDPQQPSPDSTAAQKVATSPKSALKSPSSKRRTSQNLKLRVTFEEPVVQMEQPSLELNGEKDKDKGRTLQRTSTSNESGDQLKRPFGAFRSIMETLSGNQNNNNNYQAANQLKTSTLPLTSLGRKTDAKGNPASSASKGKNKAA

SEQ ID NO: 36190 - protein, 66 aa, Homo sapiens; identical to SEQ ID NO: 36185
  ENSP00000426280

SEQ ID NO: 36191 - protein, 67 aa, Homo sapiens
  ENSP00000425063
MEAPEYLDLDEIDFSDDISDNRSQGNRLQKLGLEDTDREDAMGFGSHRAKLTVVAALGACHCPENEY

SEQ ID NO: 36192 - protein, 1016 aa, Homo sapiens
  ENSP00000261367
MEAPEYLDLDEIDFSDDISDNRSQGNRLQKLGLEDTDREDAMGFGSHRAKLTVVAALGACHCPENEYSVTSLKTIPELCRRCDTQNEDRSVSSSSWNCGISTLITNTQKPTGIADVYSKFRPVKRVSPLKHQPETLENNESDDQKNQKVVEYQKGGESDLGPQPQELGPGDGVGGPPGKSSEPSTSLGELEHYDLDMDEILDVPYIKSSQQLASFTKVTSEKRILGLCTTINGLSGKACSTGSSESSSSNMAPFCVLSPVKSPHLRKASAVIHDQHKLSTEETEISPPLVKCGSAYEPENQSKDFLNKTFSDPHGRKVEKTTPDCQLRAFHLQSSAAESKPEEQVSGLNRTSSQGPEERSEYLKKVKSILNIVKEGQISLLPHLAADNLDKIHDENGNNLLHIAASQGHAECLQHLTSLMGEDCLNERNTEKLTPAGLAIKNGQLECVRWMVSETEAIAELSCSKDFPSLIHYAGCYGQEKILLWLLQFMQEQGISLDEVDQDGNSAVHVASQHGYLGCIQTLVEYGANVTMQNHAGEKPSQSAERQGHTLCSRYLVVVETCMSLASQVVKLTKQLKEQTVERVTLQNQLQQFLEAQKSEGKSLPSSPSSPSSPASRKSQWKSPDADDDSVAKSKPGVQEGIQVLGSLSASSRARPKAKDEDSDKILRQLLGKEISENVCTQEKLSLEFQDAQASSRNSKKIPLEKRELKLARLRQLMQRSLSESDTDSNNSEDPKTTPVRKADRPRPQPIVESVESMDSAESLHLMIKKHTLASGGRRFPFSIKASKSLDGHSPSPTSESSEPDLESQYPGSGSIPPNQPSGDPQQPSPDSTAAQKVATSPKSALKSPSSKRRTSQNLKLRVTFEEPVVQMEQPSLELNGEKDKDKGRTLQRTSTSNESGDQLKRPFGAFRSIMETLSGNQNNNNNYQAANQLKTSTLPLTSLGRKTDAKGNPASSASKGKNKAEMYSSCINLSSNMLIEEHLCNDTRHNDINRKMKKSYSIKHIAEPESKELFL

SEQ ID NO: 36193 - protein, 62 aa, Homo sapiens
  ENSP00000427078
MEAPEYLDLDEIDFSDDISYSVTSLKTIPELCRRCDTQNEDRSGKDSSVASSVYARTGHLVG

SEQ ID NO: 36194 - protein, 66 aa, Homo sapiens; identical to SEQ ID NO: 36185
  ENSP00000424338

SEQ ID NO: 36195 - protein, 14 aa, Homo sapiens
  ENSP00000427587
MEAPEYLDLDEIDF

SEQ ID NO: 36196 - protein, 113 aa, Homo sapiens
  ENSP00000423360
MEAPEYLDLDEIDFSDDISDNRSQGNRLQKLGLEDTDREDAMGFGSHRAKLTVVAALGACHCPENEYSVTSLKTIPELCRRCDTQNEDRSEWSVGVRTLDGERNRSHCRTELF

SEQ ID NO: 36197 - protein, 588 aa, Homo sapiens
  ENSP00000378852
MEAPEYLDLDEIDFSDDISDNRSQGNRLQKLGLEDTDREDAMGFGSHRAKLTVVAALGACHCPENEYSVTSLKTIPELCRRCDTQNEDRSVSSSSWNCGISTLITNTQKPTGIADVYSKFRPVKRVSPLKHQPETLENNESDDQKNQKVVEYQKGGESDLGPQPQELGPGDGVGGPPGKSSEPSTSLGELEHYDLDMDEILDVPYIKSSQQLASFTKVTSEKRILGLCTTINGLSGKACSTGSSESSSSNMAPFCVLSPVKSPHLRKASAVIHDQHKLSTEETEISPPLVKCGSAYEPENQSKDFLNKTFSDPHGRKVEKTTPDCQLRAFHLQSSAAESKPEEQVSGLNRTSSQGPEERSEYLKKVKSILNIVKEGQISLLPHLAADNLDKIHDENGNNLLHIAASQGHAECLQHLTSLMGEDCLNERNTEKLTPAGLAIKNGQLECVRWMVSETEAIAELSCSKDFPSLIHYAGCYGQEKILLWLLQFMQEQGISLDEVDQDGNSAVHVASQHGYLGCIQTRLKIQGTWNGSETCLFTHHFSSYPPISSGLQCQGQEGVLFIPDQVGAATNKQVLFQNQLPETKSSY

SEQ ID NO: 36198 - protein, 88 aa, Homo sapiens
  ENSP00000378849
MEAPEYLDLDEIDFSDDISYSVTSLKTIPELCRRCDTQNEDRSATPSCRQSRQNSRRKWKQSITYCGVTGTRRVSTAPHFFDGRRLPQ

SEQ ID NO: 36199 - protein, 66 aa, Homo sapiens; identical to SEQ ID NO: 36185
  ENSP00000427575

SEQ ID NO: 36200 - protein, 603 aa, Homo sapiens
  ENSP00000368854
MTYLIQSHHSRRSQNCAEDVIRKTKTDQNGQLECVRWMVSETEAIAELSCSKDFPSLIHYAGCYGQEKILLWLLQFMQEQGISLDEVDQDGNSAVHVASQHGYLGCIQTLVEYGANVTMQNHAGEKPSQSAERQGHTLCSRYLVVVETCMSLASQVVKLTKQLKEQTVERVTLQNQLQQFLEAQKSEGKSLPSSPSSPSSPASRKSQWKSPDADDDSVAKSKPGVQEGIQVLGSLSASSRARPKAKDEDSDKILRQLLGKEISENVCTQEKLSLEFQDAQASSRNSKKIPLEKRELKLARLRQLMQRSLSESDTDSNNSEDPKTTPVRKADRPRPQPIVESVESMDSAESLHLMIKKHTLASGGRRFPFSIKASKSLDGHSPSPTSESSEPDLESQYPGSGSIPPNQPSGDPQQPSPDSTAAQKVATSPKSALKSPSSKRRTSQNLKLRVTFEEPVVQMEQPSLELNGEKDKDKGRTLQRTSTSNESGDQLKRPFGAFRSIMETLSGNQNNNNNYQAANQLKTSTLPLTSLGRKTDAKGNPASSASKGKNKAEMYSSCINLSSNMLIEEHLCNDTRHNDINRKMKKSYSIKHIAEPESKELFL

SEQ ID NO: 36201 - protein, 62 aa, Homo sapiens; identical to SEQ ID NO: 36193
  ENSP00000394392

SEQ ID NO: 36202 - protein, 88 aa, Homo sapiens; identical to SEQ ID NO: 36198
  ENSP00000426904

SEQ ID NO: 36203 - protein, 113 aa, Homo sapiens; identical to SEQ ID NO: 36196
  ENSP00000441681

SEQ ID NO: 36204 - protein, 1324 aa, Homo sapiens
  ENSP00000384871
MRHGVAWALLVAAALGLGARGVRGAVALADFYPFGAERGDAVTPKQDDGGSGLRPLSVPFPFFGAEHSGLYVNNNGIISFLKEVSQFTPVAFPIAKDRCVVAAFWADVDNRRAGDVYYREATDPAMLRRATEDVRHYFPELLDFNATWVFVATWYRVTFFGGSSSSPVNTFQTVLITDGKLSFTIFNYESIVWTTGTHASSGGNATGLGGIAAQAGFNAGDGQRYFSIPGSRTADMAEVETTTNVGVPGRWAFRIDDAQVRVGGCGHTTSVCLALRPCLNGGKCIDDCVTGNPSYTCSCLSGFTGRRCHLDVNECASQPCQNGGTCTHGINSFRCQCPAGFGGPTCETAQSPCDTKECQHGGQCQVENGSAVCVCQAGYTGAACEMDVDDCSPDPCLNGGSCVDLVGNYTCLCAEPFKGLRCETGDHPVPDACLSAPCHNGGTCVDADQGYVCECPEGFMGLDCRERVPDDCECRNGGRCLGANTTLCQCPLGFFGLLCEFEITAMPCNMNTQCPDGGYCMEHGGSYLCVCHTDHNASHSLPSPCDSDPCFNGGSCDAHDDSYTCECPRGFHGKHCEKARPHLCSSGPCRNGGTCKEAGGEYHCSCPYRFTGRHCEIGKPDSCASGPCHNGGTCFHYIGKYKCDCPPGFSGRHCEIAPSPCFRSPCVNGGTCEDRDTDFFCHCQAGYMGRRCQAEVDCGPPEEVKHATLRFNGTRLGAVALYACDRGYSLSAPSRIRVCQPHGVWSEPPQCLEIDECRSQPCLHGGSCQDRVAGYLCLCSTGYEGAHCELERDECRAHPCRNGGSCRNLPGAYVCRCPAGFVGVHCETEVDACDSSPCQHGGRCESGGGAYLCVCPESFFGYHCETVSDPCFSSPCGGRGYCLASNGSHSCTCKVGYTGEDCAKELFPPTALKMERVEESGVSISWNPPNGPAARQMLDGYAVTYVSSDGSYRRTDFVDRTRSSHQLQALAAGRAYNISVFSVKRNSNNKNDISRPAVLLARTRPRPVEGFEVTNVTASTISVQWALHRIRHATVSGVRVSIRHPEALRDQATDVDRSVDRFTFRALLPGKRYTIQLTTLSGLRGEEHPTESLATAPTHVWTRPLPPANLTAARVTATSAHVVWDAPTPGSLLEAYVINVTTSQSTKSRYVPNGKLASYTVRDLLPGRRYQLSVIAVQSTELGPQHSEPAHLYIITSPRDGADRRWHQGGHHPRVLKNRPPPARLPELRLLNDHSAPETPTQPPRFSELVDGRGRVSARFGGSPSKAATVRSQPTASAQLENMEEAPKRVSLALQLPEHGSKDIGSESAALVGTLGLTDCSQGP

SEQ ID NO: 36205 - protein, 1352 aa, Homo sapiens
  ENSP00000386007
MRHGVAWALLVAAALGLGARGVRGAVALADFYPFGAERGDAVTPKQDDGGSGLRPLSVPFPFFGAEHSGLYVNNNGIISFLKEVSQFTPVAFPIAKDRCVVAAFWADVDNRRAGDVYYREATDPAMLRRATEDVRHYFPELLDFNATWVFVATWYRVTFFGGSSSSPVNTFQTVLITDGKLSFTIFNYESIVWTTGTHASSGGNATGLGGIAAQAGFNAGDGQRYFSIPGSRTADMAEVETTTNVGVPGRWAFRIDDAQVRVGGCGHTTSVCLALRPCLNGGKCIDDCVTGNPSYTCSCLSGFTGRRCHLDVNECASQPCQNGGTCTHGINSFRCQCPAGFGGPTCETAQSPCDTKECQHGGQCQVENGSAVCVCQAGYTGAACEMDVDDCSPDPCLNGGSCVDLVGNYTCLCAEPFKGLRCETGDHPVPDACLSAPCHNGGTCVDADQGYVCECPEGFMGLDCRERVPDDCECRNGGRCLGANTTLCQCPLGFFGLLCEFEITAMPCNMNTQCPDGGYCMEHGGSYLCVCHTDHNASHSLPSPCDSDPCFNGGSCDAHDDSYTCECPRGFHGKHCEKARPHLCSSGPCRNGGTCKEAGGEYHCSCPYRFTGRHCEIGKPDSCASGPCHNGGTCFHYIGKYKCDCPPGFSGRHCEIAPSPCFRSPCVNGGTCEDRDTDFFCHCQAGYMGRRCQAEVDCGPPEEVKHATLRFNGTRLGAVALYACDRGYSLSAPSRIRVCQPHGVWSEPPQCLEIDECRSQPCLHGGSCQDRVAGYLCLCSTGYEGAHCELERDECRAHPCRNGGSCRNLPGAYVCRCPAGFVGVHCETEVDACDSSPCQHGGRCESGGGAYLCVCPESFFGYHCETVSDPCFSSPCGGRGYCLASNGSHSCTCKVGYTGEDCAKELFPPTALKMERVEESGVSISWNPPNGPAARQMLDGYAVTYVSSDGSYRRTDFVDRTRSSHQLQALAAGRAYNISVFSVKRNSNNKNDISRPAVLLARTRPRPVEGFEVTNVTASTISVQWALHRIRHATVSGVRVSIRHPEALRDQATDVDRSVDRFTFRALLPGKRYTIQLTTLSGLRGEEHPTESLATAPTHVWTRPLPPANLTAARVTATSAHVVWDAPTPGSLLEAYVINVTTSQSTKSRYVPNGKLASYTVRDLLPGRRYQLSVIAVQSTELGPQHSEPAHLYIITSPRDGADRRWHQGGHHPRVLKNRPPPARLPELRLLNDHSAPETPTQPPRFSELVDGRGRVSARFGGSPSKAATVRSHVPGNCSENPCQNGGTCVPGADAHSCDCGPGFKGRRCELACIKVSRPCTRLFSETKAFPVWEGGVCHHVKQSKSQTLEKS

SEQ ID NO: 36206 - protein, 1413 aa, Homo sapiens
  ENSP00000308893
MRHGVAWALLVAAALGLGARGVRGAVALADFYPFGAERGDAVTPKQDDGGSGLRPLSVPFPFFGAEHSGLYVNNNGIISFLKEVSQFTPVAFPIAKDRCVVAAFWADVDNRRAGDVYYREATDPAMLRRATEDVRHYFPELLDFNATWVFVATWYRVTFFGGSSSSPVNTFQTVLITDGKLSFTIFNYESIVWTTGTHASSGGNATGLGGIAAQAGFNAGDGQRYFSIPGSRTADMAEVETTTNVGVPGRWAFRIDDAQVRVGGCGHTTSVCLALRPCLNGGKCIDDCVTGNPSYTCSCLSGFTGRRCHLDVNECASQPCQNGGTCTHGINSFRCQCPAGFGGPTCETAQSPCDTKECQHGGQCQVENGSAVCVCQAGYTGAACEMDVDDCSPDPCLNGGSCVDLVGNYTCLCAEPFKGLRCETGDHPVPDACLSAPCHNGGTCVDADQGYVCECPEGFMGLDCRERVPDDCECRNGGRCLGANTTLCQCPLGFFGLLCEFEITAMPCNMNTQCPDGGYCMEHGGSYLCVCHTDHNASHSLPSPCDSDPCFNGGSCDAHDDSYTCECPRGFHGKHCEKARPHLCSSGPCRNGGTCKEAGGEYHCSCPYRFTGRHCEIGKPDSCASGPCHNGGTCFHYIGKYKCDCPPGFSGRHCEIAPSPCFRSPCVNGGTCEDRDTDFFCHCQAGYMGRRCQAEVDCGPPEEVKHATLRFNGTRLGAVALYACDRGYSLSAPSRIRVCQPHGVWSEPPQCLEIDECRSQPCLHGGSCQDRVAGYLCLCSTGYEGAHCELERDECRAHPCRNGGSCRNLPGAYVCRCPAGFVGVHCETEVDACDSSPCQHGGRCESGGGAYLCVCPESFFGYHCETVSDPCFSSPCGGRGYCLASNGSHSCTCKVGYTGEDCAKELFPPTALKMERVEESGVSISWNPPNGPAARQMLDGYAVTYVSSDGSYRRTDFVDRTRSSHQLQALAAGRAYNISVFSVKRNSNNKNDISRPAVLLARTRPRPVEGFEVTNVTASTISVQWALHRIRHATVSGVRVSIRHPEALRDQATDVDRSVDRFTFRALLPGKRYTIQLTTLSGLRGEEHPTESLATAPTHVWTRPLPPANLTAARVTATSAHVVWDAPTPGSLLEAYVINVTTSQSTKSRYVPNGKLASYTVRDLLPGRRYQLSVIAVQSTELGPQHSEPAHLYIITSPRDGADRRWHQGGHHPRVLKNRPPPARLPELRLLNDHSAPETPTQPPRFSELVDGRGRVSARFGGSPSKAATVRSQPTASAQLENMEEAPKRVSLALQLPEHGSKDIGNVPGNCSENPCQNGGTCVPGADAHSCDCGPGFKGRRCELACIKVSRPCTRLFSETKAFPVWEGGVCHHVYKRVYRVHQDICFKESCESTSLKKTPNRKQSKSQTLEKS

SEQ ID NO: 36207 - protein, 300 aa, Homo sapiens
  ENSP00000384789
  MOD_RES (1)..(1): Any amino acid
XSLPHVSDVNECASQPCQNGGTCTHGINSFRCQCPAGFGGPTCETAQSPCDTKECQHGGQCQVENGSAVCVCQAGYTGAACEMDVDDCSPDPCLNGGSCVDLVGNYTCLCAEPFKGLRCETGDHPVPDACLSAPCHNGGTCVDADQGYVCECPEGFMGLDCRERVPDDCECRNGGRCLGANTTLCQCPLGFFGLLCEFEITAMPCNMNTQCPDGGYCMEHGGSYLCVCHTDHNASHSLPSPCDSDPCFNGGSCDAHDDSYTCECPRGFHGKHCEKARPHLCSSGPCRNGGTCKEAGGEYH

SEQ ID NO: 36208 - protein, 272 aa, Homo sapiens
  ENSP00000401865
  MOD_RES (1)..(1): Any amino acid
XPTCETAQSPCDTKECQHGGQCQVENGSAVCVCQAGYTGAACEMDVDDCSPDPCLNGGSCVDLVGNYTCLCAEPFKGLRCETGDHPVPDACLSAPCHNGGTCVDADQGYVCECPEGFMGLDCRERVPDDCECRNGGRCLGANTTLCQCPLGFFGLLCEFEITAMPCNMNTQCPDGGYCMEHGGSYLCVCHTDHNASHSLPSPCDSDPCFNGGSCDAHDDSYTCECPRGFHGKHCEKGMAGRGVRAGVSTLESARGPPSCFSAVSLLVSRIAD

SEQ ID NO: 36209 - protein, 66 aa, Homo sapiens
  ENSP00000394324
QCQVENGSAVCVCQAGYTGAACEMDVDDCSPDPCLNGGSCVDLVGNYTCLCAEPFKGLRCETVVTC

SEQ ID NO: 36210 - protein, 599 aa, Homo sapiens
  ENSP00000342992
MHGILGACGRLRLEPATPLTPLLCAERDECRAHPCRNGGSCRNLPGAYVCRCPAGFVGVHCETEVDACDSSPCQHGGRCESGGGAYLCVCPESFFGYHCETVSDPCFSSPCGGRGYCLASNGSHSCTCKVGYTGEDCAKELFPPTALKMERVEESGVSISWNPPNGPAARQMLDGYAVTYVSSDGSYRRTDFVDRTRSSHQLQALAAGRAYNISVFSVKRNSNNKNDISRPAVLLARTRPRPVEGFEVTNVTASTISVQWALHRIRHATVSGVRVSIRHPEALRDQATDVDRSVDRFTFRALLPGKRYTIQLTTLSGLRGEEHPTESLATAPTHVWTRPLPPANLTAARVTATSAHVVWDAPTPGSLLEAYVINVTTSQSTKSRYVPNGKLASYTVRDLLPGRRYQLSVIAVQSTELGPQHSEPAHLYIITSPRDGADRRWHQGGHHPRVLKNRPPPARLPELRLLNDHSAPETPTQPPRFSELVDGRGRVSARFGGSPSKAATVRSHVPGNCSENPCQNGGTCVPGADAHSCDCGPGFKGRRCELACIKVSRPCTRLFSETKAFPVWEGGVCHHVYKRVYRVHQDICFKESCESTSLK

SEQ ID NO: 36211 - protein, 538 aa, Homo sapiens [sequence omitted]

SEQ ID NO: 36212 - protein, 538 aa, Homo sapiens [sequence omitted]

SEQ ID NO: 36213 - protein, 28 aa, Homo sapiens
  ENSP00000429292
MAVAAAAAAAGPAGAGGGRAQRSGLLEV

SEQ ID NO: 36214 - protein, 193 aa, Homo sapiens
  ENSP00000323435
MLEVHIPSVGPEAEGPRQSPEKSHMVFRVEVLCSGRRHTVPRRYSEFHALHKRIKKLYKVPDFPSKRLPNWRTRGLEQRRQGLEAYIQGILYLNQEVPKELLEFLRLRHFPTDPKASNWGTLREFLPGDSSSQQHQRPVLSFHVDPYVCNPSPESLPNVVVNGVLQGLYSFSISPDKAQPKAACHPAPLPPMP

SEQ ID NO: 36215 - protein, 120 aa, Homo sapiens
  ENSP00000452692
MLEVHIPSVGPEAEGPRQSPEKSHMVFRVEVLCSGRRHTVPRRYSEFHALHKRIKKLYKVPDFPSKRLPNWRTRGLEQRRQGLEAYIQGILYLNQEVPKELLEFLRLRHFPTDPKASNWG

SEQ ID NO: 36216 - protein, 574 aa, Homo sapiens
  ENSP00000311427
MALKGRALYDFHSENKEEISIQQDEDLVIFSETSLDGWLQGQNSRGETGLFPASYVEIVRSGISTNHADYSSSPAGSPGAQVSLYNSPSVASPARSGGGSGFLSNQGSFEEDDDDDWDDWDDGCTVVEEPRAGGLGTNGHPPLNLSYPGAYPSQHMAFRPKPPLERQDSLASAKRGSVVGRNLNRFSCFVRSGVEAFILGDVPMMAKIAETYSIEMGPRGPQWKANPHPFACSVEDPTKQTKFKGIKSYISYKLTPTHAASPVYRRYKHFDWLYNRLLHKFTVISVPHLPEKQATGRFEEDFIEKRKRRLILWMDHMTSHPVLSQYEGFQHFLSCLDDKQWKMGKRRAEKDEMVGASFLLTFQIPTEHQDLQDVEDRVDTFKAFSKKMDDSVLQLSTVASELVRKHVGGFRKEFQKLGSAFQAISHSFQMDPPFCSEALNSAISHTGRTYEAIGEMFAEQPKNDLFQMLDTLSLYQGLLSNFPDIIHLQKGAFAKVKESQRMSDEGRMVQDEADGIRRRCRVVGFALQAEMNHFHQRRELDFKHMMQNYLRQQILFYQRVGQQLEKTLRMYDNL

SEQ ID NO: 36217 - protein, 283 aa, Homo sapiens
  ENSP00000455436
  MOD_RES (1)..(1): Any amino acid
XRGPQWKANPHPFACSVEDPTKQTKFKGIKSYISYKLTPTHAASPVYRRYKHFDWLYNRLLHKFTVISVPHLPEKQATGRFEEDFIEKRKRRLILWMDHMTSHPVLSQYEGFQHFLSCLDDKQWKMGKRRAEKDEMVGASFLLTFQIPTEHQDLQDVEDRVDTFKAFSKKMDDSVLQLSTVASELGLLSNFPDIIHLQKGAFAKVKESQRMSDEGRMVQDEADGIRRRCRVVGFALQAEMNHFHQRRELDFKHMMQNYLRQQILFYQRVGQQLEKTLRMYDNL

SEQ ID NO: 36218 - protein, 550 aa, Homo sapiens
  ENSP00000356591
MVGEEKMSLRNRLSKSRENPEEDEDQRNPAKESLETPSNGRIDIKQLIAKKIKLTAEAEELKPFFMKEVGSHFDDFVTNLIEKSASLDNGGCALTTFSVLEGEKNNHRAKDLRAPPEQGKIFIARRSLLDELLEVDHIRTIYHMFIALLILFILSTLVVDYIDEGRLVLEFSLLSYAFGKFPTVVWTWWIMFLSTFSVPYFLFQHWATGYSKSSHPLIRSLFHGFLFMIFQIGVLGFGPTYVVLAYTLPPASRFIIIFEQIRFVMKAHSFVRENVPRVLNSAKEKSSTVPIPTVNQYLYFLFAPTLIYRDSYPRNPTVRWGYVAMKFAQVFGCFFYVYYIFERLCAPLFRNIKQEPFSARVLVLCVFNSILPGVLILFLTFFAFLHCWLNAFAEMLRFGDRMFYKDWWNSTSYSNYYRTWNVVVHDWLYYYAYKDFLWFFSKRFKSAAMLAVFAVSAVVHEYALAVCLSFFYPVLFVLFMFFGMAFNFIVNDSRKKPIWNVLMWTSLFLGNGVLLCFYSQEWYARQHCPLKNPTFLDYVRPRSWTCRYVF

SEQ ID NO: 36219 - protein, 260 aa, Homo sapiens
  ENSP00000411309
MVGEEKMSLRNRLSKSRENPEEDEDQRNPAKESLETPSNGRIDIKQLIAKKIKLTAEAEELKPFFMKEVGSHFDDFVTNLIEKSASLDNGGCALTTFSVLEGEKNNHRAKDLRAPPEQGKIFIARRSLLDELLEVDHIRTIYHMFIALLILFILSTLVVDYIDEGRLVLEFSLLSYAFGKFPTVVWTWWIMFLSTFSVPYFLFQHWATGYSKSSHPLIRSLFHGFLFMIFQIGVLGFGPTYVVLAYTLPPASRFIIIFEQ

SEQ ID NO: 36220 - protein, 492 aa, Homo sapiens
  ENSP00000445315
MELKPFFMKEVGSHFDDFVTNLIEKSASLDNGGCALTTFSVLEGEKNNHRAKDLRAPPEQGKIFIARRSLLDELLEVDHIRTIYHMFIALLILFILSTLVVDYIDEGRLVLEFSLLSYAFGKFPTVVWTWWIMFLSTFSVPYFLFQHWATGYSKSSHPLIRSLFHGFLFMIFQIGVLGFGPTYVVLAYTLPPASRFIIIFEQIRFVMKAHSFVRENVPRVLNSAKEKSSTVPIPTVNQYLYFLFAPTLIYRDSYPRNPTVRWGYVAMKFAQVFGCFFYVYYIFERLCAPLFRNIKQEPFSARVLVLCVFNSILPGVLILFLTFFAFLHCWLNAFAEMLRFGDRMFYKDWWNSTSYSNYYRTWNVVVHDWLYYYAYKDFLWFFSKRFKSAAMLAVFAVSAVVHEYALAVCLSFFYPVLFVLFMFFGMAFNFIVNDSRKKPIWNVLMWTSLFLGNGVLLCFYSQEWYARQHCPLKNPTFLDYVRPRSWTCRYVF

SEQ ID NO: 36221 - protein, 485 aa, Homo sapiens
  ENSP00000441356
MKEVGSHFDDFVTNLIEKSASLDNGGCALTTFSVLEGEKNNHRAKDLRAPPEQGKIFIARRSLLDELLEVDHIRTIYHMFIALLILFILSTLVVDYIDEGRLVLEFSLLSYAFGKFPTVVWTWWIMFLSTFSVPYFLFQHWATGYSKSSHPLIRSLFHGFLFMIFQIGVLGFGPTYVVLAYTLPPASRFIIIFEQIRFVMKAHSFVRENVPRVLNSAKEKSSTVPIPTVNQYLYFLFAPTLIYRDSYPRNPTVRWGYVAMKFAQVFGCFFYVYYIFERLCAPLFRNIKQEPFSARVLVLCVFNSILPGVLILFLTFFAFLHCWLNAFAEMLRFGDRMFYKDWWNSTSYSNYYRTWNVVVHDWLYYYAYKDFLWFFSKRFKSAAMLAVFAVSAVVHEYALAVCLSFFYPVLFVLFMFFGMAFNFIVNDSRKKPIWNVLMWTSLFLGNGVLLCFYSQEWYARQHCPLKNPTFLDYVRPRSWTCRYVF

SEQ ID NO: 36222 - protein, 873 aa, Homo sapiens
  ENSP00000318900
MAEMEKEGRPPENKRSRKPAHPVKREINEEMKNFAENTMNELLGWYGYDKVELKDGEDIEFRSYPTDGESRQHISVLKENSLPKPKLPEDSVISPYNISTGYSGLATGNGLSDSPAGSKDHGSVPIIVPLIPPPFIKPPAEDDVSNVQIMCAWCQKVGIKRYSLSMGSEVKSFCSEKCFAACRRAYFKRNKARDEDGHAENFPQQHYAKETPRLAFKNNCELLVCDWCKHIRHTKEYLDFGDGERRLQFCSAKCLNQYKMDIFYKETQANLPAGLCSTLHPPMENKAEGTGVQLLTPDSWNIPLTDARRKAPSPVATAGQSQGPGPSASTTVSPSDTANCSVTKIPTPVPKSIPISETPNIPPVSVQPPASIGPPLGVPPRSPPMVMTNRGPVPLPIFMEQQIMQQIRPPFIRGPPHHASNPNSPLSNPMLPGIGPPPGGPRNLGPTSSPMHRPMLSPHIHPPSTPTMPGNPPGLLPPPPPGAPLPSLPFPPVSMMPNGPMPVPQMMNFGLPSLAPLVPPPTLLVPYPVIVPLPVPIPIPIPIPHVSDSKPPNGFSSNGENFIPNAPGDSAAAGGKPSGHSLSPRDSKQGSSKSADSPPGCSGQALSLAPTPAEHGRSEVVDLTRRAGSPPGPPGAGGQLGFPGVLQGPQDGVIDLTVGHRARLHNVIHRALHAHVKAEREPSAAERRTCGGCRDGHCSPPAAGDPGPGAPAGPEAAAACNVIVNGTRGAAAEGAKSAEPPPEQPPPPPPPAPPKKLLSPEEPAVSELESVKENNCASNCHLDGEAAKKLMGEEALAGGDKSDPNLNNPADEDHAYALRMLPKTGCVIQPVPKPAEKAAMAPCIISSPMLSAGPEDLEPPLKRRCLRIRNQNK

SEQ ID NO: 36223 - protein, 149 aa, Homo sapiens
  ENSP00000478366
MAEMEKEGRPPENKRSRKPAHPVKREINEEMKNFAENTMNELLGWYGYDKVELKDGEDIEFRSYPTDGESRQHISVLKENSLPKPKLPEDSVISPYNISTGYSGLATGNGLSDSPAGSKDHGSVPIIVPLIPPPFIKPPADEKTEAQKS

SEQ ID NO: 36224 - protein, 198 aa, Homo sapiens
  ENSP00000339428
MTLRCLEPSGNGGEGTRSQWGTAGSAEEPSPQAARLAKALRELGQTGWYWGSMTVNEAKEKLKEAPEGTFLIRDSSHSDYLLTISVKTSAGPTNLRIEYQDGKFRLDSIICVKSKLKQFDSVVHLIDYYVQMCKDKRTGPEAPRNGTVHLYLTKPLYTSAPSLQHLCRLTINKCTGAIWGLPLPTRLKDYLEEYKFQV

SEQ ID NO: 36225 - protein, 198 aa, Homo sapiens; identical to SEQ ID NO: 36224
  ENSP00000448815

SEQ ID NO: 36226 - protein, 198 aa, Homo sapiens; identical to SEQ ID NO: 36224
  ENSP00000442898

SEQ ID NO: 36227 - protein, 142 aa, Homo sapiens
  ENSP00000447902
MTLRCLEPSGNGGEGTRSQWGTAGSAEEPSPQAARLAKALRELGQTGWYWGSMTVNEAKEKLKEAPEGTFLIRDSSHSDYLLTISVKTSAGPTNLRIEYQDGKFRLDSIICVKSKLKQFDSVVHLIDYYVQMCKDKRTGPEA

SEQ ID NO: 36228 - protein, 198 aa, Homo sapiens; identical to SEQ ID NO: 36224
  ENSP00000447161

SEQ ID NO: 36229 - protein, 102 aa, Homo sapiens
  ENSP00000448709
MTLRCLEPSGNGGEGTRSQWGTAGSAEEPSPQAARLAKALRELGQTGREPIGRDACGRERLPKEAARKRGRGGKQRIRWKYVPCFQGTAESTLAGSWVLGNA

SEQ ID NO: 36230 - protein, 161 aa, Homo sapiens
  ENSP00000448611
MTLRCLEPSGNGGEGTRSQWGTAGSAEEPSPQAARLAKALRELGQTGWYWGSMTVNEAKEKLKEAPEGTFLIRDSSHSDYLLTISVKTSAGPTNLRIEYQDGKFRLDSIICVKSKLKQFDSVVHLIDYYVQMCKDKRTGPEAPRNGTVHLYLTKPLYTSAP

SEQ ID NO: 36231 - protein, 198 aa, Homo sapiens; identical to SEQ ID NO: 36224
  ENSP00000449227

SEQ ID NO: 36232 - protein, 2 aa, Homo sapiens
  ENSP00000473902
MT

SEQ ID NO: 36233 - protein, 116 aa, Homo sapiens
  ENSP00000474805
  MOD_RES (1)..(1): Any amino acid
XYVQMCKDKRTGPEAPRNGTVHLYLTKPLYTSAPSLQHLCRLTINKCTGAIWGLPLPTRLKDYLEEYKFQVQAPVGEKELLIGILKKWEGTKLTQASLQFDMPADQSLLGILYFAF

SEQ ID NO: 36234 - protein, 46 aa, Homo sapiens
  ENSP00000474888
  MOD_RES (1)..(1): Any amino acid
XAPSLQHLCRLTINKCTGAIWGLPLPTRLKDYLEEYKFQPAVFYPG

SEQ ID NO: 36235 - protein, 198 aa, Homo sapiens; identical to SEQ ID NO: 36224
  ENSP00000481249

SEQ ID NO: 36236 - protein, 154 aa, Homo sapiens [sequence omitted]

SEQ ID NO: 36237 - protein, 135 aa, Homo sapiens
  ENSP00000374645
MATKAESNGPVKVWGSIKGLTEGLHGFHVHEFGDNTAGCTSAGPHFNPLSRKHGGPKDEERHVGDLGNVTADKDGVADVSIEDSVISLSGDHCIIGRTLVVHEKADDLGKGGNEESTKTGNAGSRLACGVIGIAQ

SEQ ID NO: 36238 - protein, 54 aa, Homo sapiens
  ENSP00000472134
MLALLCSCLLLAAGASDAWTGEDSAEPNSDSAEWIRDMYAKVTEIWQEVMQRRD

SEQ ID NO: 36239 - protein, 240 aa, Homo sapiens
  ENSP00000371554
MLALLCSCLLLAAGASDAWTGEDSAEPNSDSAEWIRDMYAKVTEIWQEVMQRRDDDGALHAACQVQPSATLDAAQPRVTGVVLFRQLAPRAKLDAFFALEGFPTEPNSSSRAIHVHQFGDLSQGCESTGPHYNPLAVPHPQHPGDFGNFAVRDGSLWRYRAGLAASLAGPHSIVGRAVVVHAGEDDLGRGGNQASVENGNAGRRLACCVVGVCGPGLWERQAREHSERKKRRRESECKAA

SEQ ID NO: 36240 - protein, 731 aa, Homo sapiens
  ENSP00000322182
MSVTLTSVKRVQSSPNLLAAGRDSQSPDSAWRSYNDGNQETLNGDATYSSLAAKGFRSVRPNLQDKRSPTQSQITVNGNSGGAVSPMSYYQRPFSPSAYSLPASLNSSIVMQHGTSLDSTDTYPQHAQSLDGTTSSSIPLYRSSEEEKRVTVIKAPHYPGIGPVDESGIPTAIRTTVDRPKDWYKTMFKQIHMVHKPDDDTDMYNTPYTYNAGLYNPPYSAQSHPAAKTQTYRPLSKSHSDNSPNAFKDASSPVPPPHVPPPVPPLRPRDRSSTEKHDWDPPDRKVDTRKFRSEPRSIFEYEPGKSSILQHERPPPLPTTPTPVPREPGRKPLSSSRLGEVTGSPSPPPRSGAPTPSSRAPALSPTRPPKKPLDYVQDHSSGVFNEASLYQSSIDRSLERPMSSASMASDFRKRRKSEPAVGPPRGLGDQSASRTSPGRVDLPGSSTTLTKSFTSSSPSSPSRAKDRESPRSYSSTLTDMGRSAPRERRGTPEKEKLPAKAVYDFKAQTSKELSFKKGDTVYILRKIDQNWYEGEHHGRVGIFPISYVEKLTPPEKAQPARPPPPAQPGEIGEAIAKYNFNADTNVELSLRKGDRVILLKRVDQNWYEGKIPGTNRQGIFPVSYVEVVKKNTKGAEDYPDPPIPHSYSSDRIHSLSSNKPQRPVFTHENIQGGGEPFQALYNYTPRNEDELELRESDVIDVMEKCDDGWFVGTSRRTKFFGTFPGNYVKRL

SEQ ID NO: 36241 - protein, 644 aa, Homo sapiens
  ENSP00000397262
MSVTLTSVKRVQSSPNLLAAGRDSQSPDSAWRSYNDGNQETLNGDATYSSLAAKGFRSVRPNLQDKRSPTQSQITVNGNSGGAVSPMSYYQRPFSPSAYSLPASLNSSIVMQHGTSLDSTDTYPQHAQSLDGTTSSSIPLYRSSEEEKRVTVIKAPHYPGIGPVDESGIPTAIRTTVDRPKDWYKTMFKQIHMVHKPGLYNPPYSAQSHPAAKTQTYRPLSKSHSDNSPNAFKDASSPVPPPHVPPPVPPLRPRDRSSTEKHDWDPPDRKVDTRKFRSEPRSIFEYEPGKSSILQHERPASLYQSSIDRSLERPMSSASMASDFRKRRKSEPAVGPPRGLGDQSASRTSPGRVDLPGSSTTLTKSFTSSSPSSPSRAKDRESPRSYSSTLTDMGRSAPRERRGTPEKEKLPAKAVYDFKAQTSKELSFKKGDTVYILRKIDQNWYEGEHHGRVGIFPISYVEKLTPPEKAQPARPPPPAQPGEIGEAIAKYNFNADTNVELSLRKGDRVILLKRVDQNWYEGKIPGTNRQGIFPVSYVEVVKKNTKGAEDYPDPPIPHSYSSDRIHSLSSNKPQRPVFTHENIQGGGEPFQALYNYTPRNEDELELRESDVIDVMEKCDDGWFVGTSRRTKFFGTFPGNYVKRL

SEQ ID NO: 36242 - protein, 1200 aa, Homo sapiens
  ENSP00000347852
MNTDSGGCARKRAAMSVTLTSVKRVQSSPNLLAAGRDSQSPDSAWRSYNDGNQETLNGDATYSSLAAKGFRSVRPNLQDKRSPTQSQITVNGNSGGAVSPMSYYQRPFSPSAYSLPASLNSSIVMQHGTSLDSTDTYPQHAQSLDGTTSSSIPLYRSSEEEKRVTVIKAPHYPGIGPVDESGIPTAIRTTVDRPKDWYKTMFKQIHMVHKPDDDTDMYNTPYTYNAGLYNPPYSAQSHPAAKTQTYRPLSKSHSDNSPNAFKDASSPVPPPHVPPPVPPLRPRDRSSTEKHDWDPPDRKVDTRKFRSEPRSIFEYEPGKSSILQHERPASLYQSSIDRSLERPMSSASMASDFRKRRKSEPAVGPPRGLGDQSASRTSPGRVDLPGSSTTLTKSFTSSSPSSPSRAKGGDDSKICPSLCSYSGLNGNPSSELDYCSTYRQHLDVPRDSPRAISFKNGWQMARQNAEIWSSTEETVSPKIKSRSCDDLLNDDCDSFPDPKVKSESMGSLLCEEDSKESCPMAWGSPYVPEVRSNGRSRIRHRSARNAPGFLKMYKKMHRINRKDLMNSEVICSVKSRILQYESEQQHKDLLRAWSQCSTEEVPRDMVPTRISEFEKLIQKSKSMPNLGDDMLSPVTLEPPQNGLCPKRRFSIEYLLEEENQSGPPARGRRGCQSNALVPIHIEVTSDEQPRAHVEFSDSDQDGVVSDHSDYIHLEGSSFCSESDFDHFSFTSSESFYGSSHHHHHHHHHHHRHLISSCKGRCPASYTRFTTMLKHERARHENTEEPRRQEMDPGLSKLAFLVSPVPFRRKKNSAPKKQTEKAKCKASVFEALDSALKDICDQIKAEKKRGSLPDNSILHRLISELLPDVPERNSSLRALRRSPLHQPLHPLPPDGAIHCPPYQNDCGRMPRSASFQDVDTANSSCHHQDRGGALQDRESPRSYSSTLTDMGRSAPRERRGTPEKEKLPAKAVYDFKAQTSKELSFKKGDTVYILRKIDQNWYEGEHHGRVGIFPISYVEKLTPPEKAQPARPPPPAQPGEIGEAIAKYNFNADTNVELSLRKGDRVILLKRVDQNWYEGKIPGTNRQGIFPVSYVEVVKKNTKGAEDYPDPPIPHSYSSDRIHSLSSNKPQRPVFTHENIQGGGEPFQALYNYTPRNEDELELRESDVIDVMEKCDDGWFVGTSRRTKFFGTFPGNYVKRL

SEQ ID NO: 36243 - protein, 666 aa, Homo sapiens
  ENSP00000377162
MNTGRDSQSPDSAKGFRSVRPNLQDKRSPTQSQITVNGNSGGAVSPMSYYQRPFSPSAYSLPASLNSSIVMQHGTSLDSTDTYPQHAQSLDGTTSSSIPLYRSSEEEKRVTVIKAPHYPGIGPVDESGIPTAIRTTVDRPKDWYKTMFKQIHMVHKPDDDTDMYNTPYTYNAGLYNPPYSAQSHPAAKTQTYRPLSKSHSDNSPNAFKDASSPVPPPHVPPPVPPLRPRDRSSTEKHDWDPPDRKVDTRKFRSEPRSIFEYEPGKSSILQHERPTDRINPDDIDLENEPWYKFFSELEFGRPPPKKPLDYVQDHSSGVFNEASLYQSSIDRSLERPMSSASMASDFRKRRKSEPAVGPPRGLGDQSASRTSPGRVDLPGSSTTLTKSFTSSSPSSPSRAKDRESPRSYSSTLTDMGRSAPRERRGTPEKEKLPAKAVYDFKAQTSKELSFKKGDTVYILRKIDQNWYEGEHHGRVGIFPISYVEKLTPPEKAQPARPPPPAQPGEIGEAIAKYNFNADTNVELSLRKGDRVILLKRVDQNWYEGKIPGTNRQGIFPVSYVEVVKKNTKGAEDYPDPPIPHSYSSDRIHSLSSNKPQRPVFTHENIQGGGEPFQALYNYTPRNEDELELRESDVIDVMEKCDDGWFVGTSRRTKFFGTFPGNYVKRL

SEQ ID NO: 36244 - protein, 636 aa, Homo sapiens
  ENSP00000321983
MNTGRDSQSPDSAKGFRSVRPNLQDKRSPTQSQITVNGNSGGAVSPMSYYQRPFSPSAYSLPASLNSSIVMQHGTSLDSTDTYPQHAQSLDGTTSSSIPLYRSSEEEKRVTVIKAPHYPGIGPVDESGIPTAIRTTVDRPKDWYKTMFKQIHMVHKPDDDTDMYNTPYTYNAGLYNPPYSAQSHPAAKTQTYRPLSKSHSDNSPNAFKDASSPVPPPHVPPPVPPLRPRDRSSTEKHDWDPPDRKVDTRKFRSEPRSIFEYEPGKSSILQHERPPPLPTTPTPVPREPGRKPLSSSRLGEVTGSPSPPPRSGAPTPSSRAPALSPTRPPKKPLDYVQDHSSGVFNEASLYQSSIDRSLERPMSSASMASDFRKRRKSEPAVGPPRGLGDQSASRTSPGRVDLPGSSTTLTKSFTSSSPSSPSRAKDRESPRSYSSTLTDMGRSAPRERRGTPEKEKLPAKAVYDFKAQTSKELSFKKGDTVYILRKIDQNWYEGEHHGRVGIFPISYVEKLTPPEKAQPARPPPPAQPGEIGEAIAKYNFNADTNVELSLRKGDRVILLKRVDQNWYEGKIPGTNRQGIFPVSYVEVVKKNTKGAEDYPDPPIPHSYSSDRIHSLSSNKPQRPVFTHENIQGGGEP

SEQ ID NO: 36245 - protein, 291 aa, Homo sapiens
  ENSP00000401818
QTYRPLSKSHSDNSPNAFKDASSPVPPPHVPPPVPPLRPRDRSSTEKHDWDPPDRKVDTRKFRSEPRSIFEYEPGKSSILQHERPPPKKPLDYVQDHSSGVFNEASLYQSSIDRSLERPMSSASMASDFRKRRKSEPAVGPPRGLGDQSASRTSPGRVDLPGSSTTLTKSFTSSSPSSPSRAKDRESPRSYSSTLTDMGRSAPRERRGTPEKEKLPAKAVYDFKAQTSKELSFKKGDTVYILRKIDQNWYEGEHHGRVGIFPISYVEKLTPPEKAQPARPPPPAQPGEIGE

SEQ ID NO: 36246 - protein, 291 aa, Homo sapiens
  ENSP00000389995
  MOD_RES (1)..(1): Any amino acid
XSEEEKRVTVIKAPHYPGIGPVDESGIPTAIRTTVDRPKDWYKTMFKQIHMVHKPDDDTDMYNTPYTYNAGLYNPPYSAQSHPAAKTQTYRPLSKSHSDNSPNAFKDASSPVPPPHVPPPVPPLRPRDRSSTEKHDWDPPDRKVDTRKFRSEPRSIFEYEPGKSSILQHERPASLYQSSIDRSLERPMSSASMASDFRKRRKSEPAVGPPRGLGDQSASRTSPGRVDLPGSSTTLTKSFTSSSPSSPSRAKDRESPRSYSSTLTDMGRSAPRERRGTPEKEKLPAKAVYDF

SEQ ID NO: 36247 - protein, 253 aa, Homo sapiens
  ENSP00000391940
  MOD_RES (1)..(1): Any amino acid
XQIHMVHKPDDDTDMYNTPYTYNAGLYNPPYSAQSHPAAKTQTYRPLSKSHSDNSPNAFKDASSPVPPPHVPPPVPPLRPRDRSSTEKHDWDPPDRKVDTRKFRSEPRSIFEYEPGKSSILQHERPPPLPTTPTPVPREPGRKPLSSSRLGEVTGSPSPPPRSGAPTPSSRAPALSPTRSSIDRSLERPMSSASMASDFRKRRKSEPAVGPPRGLGDQSASRTSPGRVDLPGSSTTLTKSFTSSSPSSPSRAK

SEQ ID NO: 36248 - protein, 100 aa, Homo sapiens
  ENSP00000399048
MSYYQRPFSPSAYSLPASLNSSIVMQHGTSLDSTDTYPQHAQSLDGTTSSSIPLYRSSEEEKRVTVIKAPHYPGIGPVDESGIPTAIRTTVDRPKDWYKT

SEQ ID NO: 36249 - protein, 93 aa, Homo sapiens
  ENSP00000408909
MSYYQRPFSPSAYSLPASLNSSIVMQHGTSLDSTDTYPQHAQSLDGTTSSSIPLYRSSEEEKRVTVIKAPHYPGIGPVDESGIPTAIRTTVDR

SEQ ID NO: 36250 - protein, 89 aa, Homo sapiens
  ENSP00000410483
MSYYQRPFSPSAYSLPASLNSSIVMQHGTSLDSTDTYPQHAQSLDGTTSSSIPLYRSSEEEKRVTVIKAPHYPGIGPVDESGIPTAIRT

SEQ ID NO: 36251 - protein, 119 aa, Homo sapiens
  ENSP00000405349
MNTGRDSQSPDSAKGFRSVRPNLQDKRSPTQSQITVNGNSGGAVSPMSYYQRPFSPSAYSLPASLNSSIVMQHGTSLDSTDTYPQHAQSLDGTTSSSIPLYRSSEEEKRVTVIKAPHYP

SEQ ID NO: 36252 - protein, 73 aa, Homo sapiens
  ENSP00000415680
MSYYQRPFSPSAYSLPASLNSSIVMQHGTSLDSTDTYPQHAQSLDGTTSSSIPLYRSSEEEKRVTVIKAPHYP

SEQ ID NO: 36253 - protein, 68 aa, Homo sapiens
  ENSP00000397664
MSYYQRPFSPSAYSLPASLNSSIVMQHGTSLDSTDTYPQHAQSLDGTTSSSIPLYRSSEEEKRVTVIK

SEQ ID NO: 36254 - protein, 59 aa, Homo sapiens
  ENSP00000398335
MSYYQRPFSPSAYSLPASLNSSIVMQHGTSLDSTDTYPQHAQSLDGTTSSSIPLYRSSE

SEQ ID NO: 36255 - protein, 55 aa, Homo sapiens
  ENSP00000410967
MSYYQRPFSPSAYSLPASLNSSIVMQHGTSLDSTDTYPQHAQSLDGTTSSSIPLY

SEQ ID NO: 36256 - protein, 121 aa, Homo sapiens
  ENSP00000415637
MNTGRDSQSPDSAWRSYNDGNQETLNGDATYSSLAAKGFRSVRPNLQDKRSPTQSQITVNGNSGGAVSPMSYYQRPFSPSAYSLPASLNSSIVMQHGTSLDSTDTYPQHAQSLDGTTSSSI

SEQ ID NO: 36257 - protein, 120 aa, Homo sapiens
  ENSP00000416464
MNTGRDSQSPDSAWRSYNDGNQETLNGDATYSSLAAKGFRSVRPNLQDKRSPTQSQITVNGNSGGAVSPMSYYQRPFSPSAYSLPASLNSSIVMQHGTSLDSTDTYPQHAQSLDGTTSSS

SEQ ID NO: 36258 - protein, 109 aa, Homo sapiens
  ENSP00000405092
MNTGRDSQSPDSAWRSYNDGNQETLNGDATYSSLAAKGFRSVRPNLQDKRSPTQSQITVNGNSGGAVSPMSYYQRPFSPSAYSLPASLNSSIVMQHGTSLDSTDTYPQH

SEQ ID NO: 36259 - protein, 100 aa, Homo sapiens
  ENSP00000396183
MSVTLTSVKRVQSSPNLLAAGRDSQSPDSAKGFRSVRPNLQDKRSPTQSQITVNGNSGGAVSPMSYYQRPFSPSAYSLPASLNSSIVMQHGTSLDSTDTY

SEQ ID NO: 36260 - protein, 116 aa, Homo sapiens
  ENSP00000403417
MSVTLTSVKRVQSSPNLLAAGRDSQSPDSAWRSYNDGNQETLNGDATYSSLAAKGFRSVRPNLQDKRSPTQSQITVNGNSGGAVSPMSYYQRPFSPSAYSLPASLNSSIVMQHGTS

SEQ ID NO: 36261 - protein, 113 aa, Homo sapiens
  ENSP00000408504
MNTDSGGCARKRAAMSVTLTSVKRVQSSPNLLAAGRDSQSPDSAWRSYNDGNQETLNGDATYSSLAAKGFRSVRPNLQDKRSPTQSQITVNGNSGGAVSPMSYYQRPFSPSAY

SEQ ID NO: 36262 - protein, 9 aa, Homo sapiens
  ENSP00000377158
MSYYQRPFS

SEQ ID NO: 36263 - protein, 107 aa, Homo sapiens
  ENSP00000410233
MNTDSGGCARKRAAMSVTLTSVKRVQSSPNLLAAGRDSQSPDSAWRSYNDGNQETLNGDATYSSLAAKGFRSVRPNLQDKRSPTQSQITVNGNSGGAVSPMSYYQRP

SEQ ID NO: 36264 - protein, 75 aa, Homo sapiens
  ENSP00000405646
MNTDSGGCARKRAAMSVTLTSVKRVQSSPNLLAAGRDSQSPDSAKGFRSVRPNLQDKRSPTQSQITVNGNSGGAV

SEQ ID NO: 36265 - protein, 96 aa, Homo sapiens
  ENSP00000405314
MNTDSGGCARKRAAMSVTLTSVKRVQSSPNLLAAGRDSQSPDSAWRSYNDGNQETLNGDATYSSLAAKGFRSVRPNLQDKRSPTQSQITVNGNSGG

SEQ ID NO: 36266 - protein, 80 aa, Homo sapiens
  ENSP00000405432
MSVTLTSVKRVQSSPNLLAAGRDSQSPDSAWRSYNDGNQETLNGDATYSSLAAKGFRSVRPNLQDKRSPTQSQITVNGNS

SEQ ID NO: 36267 - protein, 80 aa, Homo sapiens; identical to SEQ ID NO: 36266
  ENSP00000415166

SEQ ID NO: 36268 - protein, 80 aa, Homo sapiens; identical to SEQ ID NO: 36266
  ENSP00000415392

SEQ ID NO: 36269 - protein, 87 aa, Homo sapiens
  ENSP00000407006
MNTDSGGCARKRAAMSVTLTSVKRVQSSPNLLAAGRDSQSPDSAWRSYNDGNQETLNGDATYSSLAAKGFRSVRPNLQDKRSPTQSQ

SEQ ID NO: 36270 - protein, 118 aa, Homo sapiens
  ENSP00000404430
MNTDSGGCARKRAAMSVTLTSVKRVQSSPNLLAAGRDSQSPDSAKGFRSVRPNLQDKRSPTQLGNQNLPASVLEVNASQTHRQTTPEASPPCPPSVVPLNRATFSPGSGTSSASLSLP

SEQ ID NO: 36271 - protein, 85 aa, Homo sapiens
  ENSP00000402328
MNTGRDSQSPDSAWRSYNDGNQETLNGDATYSSLAAKGFRSVRPNLQDKRSPTQLGNQNLPASVLEVNASQTHRQTTPEASPPCP

SEQ ID NO: 36272 - protein, 182 aa, Homo sapiens
  ENSP00000393258
MNTDSGGCARKRAAMSVTLTSVKRVQSSPNLLAAGRDSQSPDSAWRSYNDGNQETLNGDATYSSLAAKGFRSVRPNLQDKRSPTQAPPPPERKESFHSSLITSHTKGVILDQLVTNTQIPSSTEYFANKKPLQGTMYSNEDSRQTIVYSEESNTTMSYTQKITNPLPAASSTDPAPFANINT

SEQ ID NO: 36273 - protein, 71 aa, Homo sapiens
  ENSP00000412447
MSVTLTSVKRVQSSPNLLAAGRDSQSPDSAWRSYNDGNQETLNGDATYSSLAAKGFRSVRPNLQDKRSPTQ

SEQ ID NO: 36274 - protein, 70 aa, Homo sapiens
  ENSP00000390162
MSVTLTSVKRVQSSPNLLAAGRDSQSPDSAWRSYNDGNQETLNGDATYSSLAAKGFRSVRPNLQDKRSPT

SEQ ID NO: 36275 - protein, 15 aa, Homo sapiens
  ENSP00000389829
MNTDSGGCARKRAAM

SEQ ID NO: 36276 - protein, 1004 aa, Homo sapiens
  ENSP00000397482
MKATTPLQTVDRPKDWYKTMFKQIHMVHKPGLYNPPYSAQSHPAAKTQTYRPLSKSHSDNSPNAFKDASSPVPPPHVPPPVPPLRPRDRSSTEKHDWDPPDRKVDTRKFRSEPRSIFEYEPGKSSILQHERPASLYQSSIDRSLERPMSSASMASDFRKRRKSEPAVGPPRGLGDQSASRTSPGRVDLPGSSTTLTKSFTSSSPSSPSRAKGGDDSKICPSLCSYSGLNGNPSSELDYCSTYRQHLDVPRDSPRAISFKNGWQMARQNAEIWSSTEETVSPKIKSRSCDDLLNDDCDSFPDPKVKSESMGSLLCEEDSKESCPMAWGSPYVPEVRSNGRSRIRHRSARNAPGFLKMYKKMHRINRKDLMNSEVICSVKSRILQYESEQQHKDLLRAWSQCSTEEVPRDMVPTRISEFEKLIQKSKSMPNLGDDMLSPVTLEPPQNGLCPKRRFSIEYLLEEENQSGPPARGRRGCQSNALVPIHIEVTSDEQPRAHVEFSDSDQDGVVSDHSDYIHLEGSSFCSESDFDHFSFTSSESFYGSSHHHHHHHHHHHRHLISSCKGRCPASYTRFTTMLKHERARHENTEEPRRQEMDPGLSKLAFLVSPVPFRRKKNSAPKKQTEKAKCKASVFEALDSALKDICDQIKAEKKRGSLPDNSILHRLISELLPDVPERNSSLRALRRSPLHQPLHPLPPDGAIHCPPYQNDCGRMPRSASFQDVDTANSSCHHQDRGGALQDRESPRSYSSTLTDMGRSAPRERRGTPEKEKLPAKAVYDFKAQTSKELSFKKGDTVYILRKIDQNWYEGEHHGRVGIFPISYVEKLTPPEKAQPARPPPPAQPGEIGEAIAKYNFNADTNVELSLRKGDRVILLKRVDQNWYEGKIPGTNRQGIFPVSYVEVVKKNTKGAEDYPDPPIPHSYSSDRIHSLSSNKPQRPVFTHENIQGGGEPFQALYNYTPRNEDELELRESDVIDVMEKCDDGWFVGTSRRTKFFGTFPGNYVKRL

SEQ ID NO: 36277 - protein, 661 aa, Homo sapiens
  ENSP00000409158
MNTGRDSQSPDSAWRSYNDGNQETLNGDATYSSLAAKGFRSVRPNLQDKRSPTQSQITVNGNSGGAVSPMSYYQRPFSPSAYSLPASLNSSIVMQHGTSLDSTDTYPQHAQSLDGTTSSSIPLYRSSEEEKRVTVIKAPHYPGIGPVDESGIPTAIRTTVDRPKDWYKTMFKQIHMVHKPDDDTDMYNTPYTYNAGLYNPPYSAQSHPAAKTQTYRPLSKSHSDNSPNAFKDASSPVPPPHVPPPVPPLRPRDRSSTEKHDWDPPDRKVDTRKFRSEPRSIFEYEPGKSSILQHERPPPKKPLDYVQDHSSGVFNEASLYQSSIDRSLERPMSSASMASDFRKRRKSEPAVGPPRGLGDQSASRTSPGRVDLPGSSTTLTKSFTSSSPSSPSRAKDRESPRSYSSTLTDMGRSAPRERRGTPEKEKLPAKAVYDFKAQTSKELSFKKGDTVYILRKIDQNWYEGEHHGRVGIFPISYVEKLTPPEKAQPARPPPPAQPGEIGEAIAKYNFNADTNVELSLRKGDRVILLKRVDQNWYEGKIPGTNRQGIFPVSYVEVVKKNTKGAEDYPDPPIPHSYSSDRIHSLSSNKPQRPVFTHENIQGGGEPFQALYNYTPRNEDELELRESDVIDVMEKCDDGWFVGTSRRTKFFGTFPGNYVKRL

SEQ ID NO: 36278 - protein, 824 aa, Homo sapiens
  ENSP00000396008
MYSNEDSRQTIVYSEESNTTMSYTQKITNPLPAASSTDPAPFANINTPVLQEDYRQDSQTRRISTLKLTHNQDLGSSSPISTPQFSKSVEVPSFLKRPRSLTPNPVPETHTASLSIQIAPLSGQDLESHKQLPELSPETAKIPLQQERQKSAVAAASQSSDCRVSQITVNGNSGGAVSPMSYYQRPFSPSAYSLPASLNSSIVMQHGTSLDSTDTYPQHAQSLDGTTSSSIPLYRSSEEEKRVTVIKAPHYPGIGPVDESGIPTAIRTTVDRPKDWYKTMFKQIHMVHKPDDDTDMYNTPYTYNAGLYNPPYSAQSHPAAKTQTYRPLSKSHSDNSPNAFKDASSPVPPPHVPPPVPPLRPRDRSSTEKHDWDPPDRKVDTRKFRSEPRSIFEYEPGKSSILQHERPPPLPTTPTPVPREPGRKPLSSSRLGEVTGSPSPPPRSGAPTPSSRAPALSPTRPPKKPLDYVQDHSSGVFNEASLYQSSIDRSLERPMSSASMASDFRKRRKSEPAVGPPRGLGDQSASRTSPGRVDLPGSSTTLTKSFTSSSPSSPSRAKDRESPRSYSSTLTDMGRSAPRERRGTPEKEKLPAKAVYDFKAQTSKELSFKKGDTVYILRKIDQNWYEGEHHGRVGIFPISYVEKLTPPEKAQPARPPPPAQPGEIGEAIAKYNFNADTNVELSLRKGDRVILLKRVDQNWYEGKIPGTNRQGIFPVSYVEVVKKNTKGAEDYPDPPIPHSYSSDRIHSLSSNKPQRPVFTHENIQGGGEPFQALYNYTPRNEDELELRESDVIDVMEKCDDGWFVGTSRRTKFFGTFPGNYVKRL

SEQ ID NO: 36279 - protein, 1100 aa, Homo sapiens
  ENSP00000284776
MSYYQRPFSPSAYSLPASLNSSIVMQHGTSLDSTDTYPQHAQSLDGTTSSSIPLYRSSEEEKRVTVIKAPHYPGIGPVDESGIPTAIRTTVDRPKDWYKTMFKQIHMVHKPDDDTDMYNTPYTYNAGLYNPPYSAQSHPAAKTQTYRPLSKSHSDNSPNAFKDASSPVPPPHVPPPVPPLRPRDRSSTEKHDWDPPDRKVDTRKFRSEPRSIFEYEPGKSSILQHERPASLYQSSIDRSLERPMSSASMASDFRKRRKSEPAVGPPRGLGDQSASRTSPGRVDLPGSSTTLTKSFTSSSPSSPSRAKGGDDSKICPSLCSYSGLNGNPSSELDYCSTYRQHLDVPRDSPRAISFKNGWQMARQNAEIWSSTEETVSPKIKSRSCDDLLNDDCDSFPDPKVKSESMGSLLCEEDSKESCPMAWGSPYVPEVRSNGRSRIRHRSARNAPGFLKMYKKMHRINRKDLMNSEVICSVKSRILQYESEQQHKDLLRAWSQCSTEEVPRDMVPTRISEFEKLIQKSKSMPNLGDDMLSPVTLEPPQNGLCPKRRFSIEYLLEEENQSGPPARGRRGCQSNALVPIHIEVTSDEQPRAHVEFSDSDQDGVVSDHSDYIHLEGSSFCSESDFDHFSFTSSESFYGSSHHHHHHHHHHHRHLISSCKGRCPASYTRFTTMLKHERARHENTEEPRRQEMDPGLSKLAFLVSPVPFRRKKNSAPKKQTEKAKCKASVFEALDSALKDICDQIKAEKKRGSLPDNSILHRLISELLPDVPERNSSLRALRRSPLHQPLHPLPPDGAIHCPPYQNDCGRMPRSASFQDVDTANSSCHHQDRGGALQDRESPRSYSSTLTDMGRSAPRERRGTPEKEKLPAKAVYDFKAQTSKELSFKKGDTVYILRKIDQNWYEGEHHGRVGIFPISYVEKLTPPEKAQPARPPPPAQPGEIGEAIAKYNFNADTNVELSLRKGDRVILLKRVDQNWYEGKIPGTNRQGIFPVSYVEVVKKNTKGAEDYPDPPIPHSYSSDRIHSLSSNKPQRPVFTHENIQGGGEPFQALYNYTPRNEDELELRESDVIDVMEKCDDGWFVGTSRRTKFFGTFPGNYVKRL

SEQ ID NO: 36280 - protein, 671 aa, Homo sapiens
  ENSP00000240123
MQGPPRSLRAGLSLDDFIPGHLQSHIGSSSRGTRVPVIRNGGSNTLNFQFHDPAPRTVCNGGYTPRRDASQHPDPAWYQTWPGPGSKPSASTKIPASQHTQNWSATWTKDSKRRDKRWVKYEGIGPVDESGMPIAPRSSVDRPRDWYRRMFQQIHRKMPDLQLDWTFEEPPRDPRHLGAQQRPAHRPGPATSSSGRSWDHSEELPRSTFNYRPGAFSTVLQPSNQVLRRREKVDNVWTEESWNQFLQELETGQRPKKPLVDDPGEKPSQPIEVLLERELAELSAELDKDLRAIETRLPSPKSSPAPRRAPEQRPPAGPASAWSSSYPHAPYLGSARSLSPHKMADGGSPFLGRRDFVYPSSTRDPSASNGGGSPARREEKKRKAARLKFDFQAQSPKELTLQKGDIVYIHKEVDKNWLEGEHHGRLGIFPANYVEVLPADEIPKPIKPPTYQVLEYGEAVAQYTFKGDLEVELSFRKGEHICLIRKVNENWYEGRITGTGRQGIFPASYVQVSREPRLRLCDDGPQLPTSPRLTAAARSARHPSSPSALRSPADPIDLGGQTSPRRTGFSFPTQEPRPQTQNLGTPGPALSHSRGPSHPLDLGTSSPNTSQIHWTPYRAMYQYRPQNEDELELREGDRVDVMQQCDDGWFVGVSRRTQKFGTFPGNYVAPV

SEQ ID NO: 36281 - protein, 328 aa, Homo sapiens
  ENSP00000429723
MQGPPRSLRAGLSLDDFIPGHLQSHIGSSSRGTRVPVIRNGGSNTLNFQFHDPAPRTVCNGGYTPRRDASQHPDPAWYQTWPGPGSKPSASTKIPASQHTQNWSATWTKDSKRRDKRWVKYEGIGPVDESGMPIAPRSSVDRPRDWYRRMFQQIHRKMPDLQLDWTFEEPPRDPRHLGAQQRPAHRPGPATSSSGRSWDHSEELPRSTFNYRPGAFSTVLQPSNQVLRRREKVDNVWTEESWNQFLQELETGQRPKKPLVDDPGEKPSQPIEVLLERELAELSAELDKDLRAIETRLPSPKPGLSLELQLPTCTLPGFRPVPESPQNG

SEQ ID NO: 36282 - protein, 152 aa, Homo sapiens
  ENSP00000428102
  MOD_RES (1)..(1): Any amino acid
XNFQFHDPAPRTVCNGGYTPRRDASQHPDPAWYQTWPGPGSKPSASTKIPASQHTQNWSATWTKDSKRRDKRWVKYEGIGPVDESGMPIAPRSSVDRPRDWYRRMFQQIHRKMPEEAGTTLKSYLEAPSTTDLEHSPLCCSPQIRCSDAGKK

SEQ ID NO: 36283 - protein, 174 aa, Homo sapiens
  ENSP00000431128
MADGGSPFLGRRDFVYPSSTRDPSASNGGGSPARREEKKRKAARLKFDFQAQSPKELTLQKGDIVYIHKEVDKNWLEGEHHGRLGIFPANYVEVLPADEIPKPIKPPTYQVLEYGEAVAQYTFKGDLEVELSFRKGEHICLIRKVNENWYEGRITGTGRQGIFPASYVQVSREP

SEQ ID NO: 36284 - protein, 329 aa, Homo sapiens
  ENSP00000429764
MADGGSPFLGRRDFVYPSSTRDPSASNGGGSPARREEKKRKAARLKFDFQAQSPKELTLQKGDIVYIHKEVDKNWLEGEHHGRLGIFPANYVEVLPADEIPKPIKPPTYQVLEYGEAVAQYTFKGDLEVELSFRKGEHICLIRKVNENWYEGRITGTGRQGIFPASYVQVSREPRLRLCDDGPQLPTSPRLTAAARSARHPSSPSALRSPADPIDLGGQTSPRRTGFSFPTQEPRPQTQNLGTPGPALSHSRGPSHPLDLGTSSPNTSQIHWTPYRAMYQYRPQNEDELELREGDRVDVMQQCDDGWFVGVSRRTQKFGTFPGNYVAPV

SEQ ID NO: 36285 - protein, 94 aa, Homo sapiens
  ENSP00000429479
MADGGSPFLGRRDFVYPSSTRDPSASNGGGSPARREEKKRKAARLKFDFQAQSPKELTLQKGDIVYIHKEVDKNWLEGEHHGRLGIFPANYVEV

SEQ ID NO: 36286 - protein, 226 aa, Homo sapiens
  ENSP00000428678
AVLVPTCRELTLQKGDIVYIHKEVDKNWLEGEHHGRLGIFPANYVEVLPADEIPKPIKPPTYQVLEYGEAVAQYTFKGDLEVELSFRKGEHICLIRKVNENWYEGRITGTGRQGIFPASYVQVSREPRLRLCDDGPQLPTSPRLTAAARSARHPSSPSALRSPADPIDLGGQTSPRRTGFSFPTQEPRPQTQNLGTPGPALSHSRGPSHPLDLGTSSPNTSQIHWT

SEQ ID NO: 36287 - protein, 186 aa, Homo sapiens
  ENSP00000428327
  MOD_RES (1)..(1): Any amino acid
XNWYEGRITGTGRQGIFPASYVQVSREPRLRLCDDGPQLPTSPRLTAAARSARHPSSPSALRSPADPIDLGGQTSPRRTGFSFPTQEPRPQTQNLGTPGPALSHSRGPSHPLDLGTSSPNTSQIHWTPYRAMYQYRPQNEDELELREGDRVDVMQQCDDGWFVGVSRRTQKFGTFPGNYVAPVGLL

SEQ ID NO: 36288 - protein, 1222 aa, Homo sapiens
  ENSP00000358715
MEAARTERPAGRPGAPLVRTGLLLLSTWVLAGAEITWDATGGPGRPAAPASRPPALSPLSPRAVASQWPEELASARRAAVLGRRAGPELLPQQGGGRGGEMQVEAGGTSPAGERRGRGIPAPAKLGGARRSRRAQPPITQERGDAWATAPADGSRGSRPLAKGSREEVKAPRAGGSAAEDLRLPSTSFALTGDSAHNQAMVHWSGHNSSVILILTKLYDFNLGSVTESSLWRSTDYGTTYEKLNDKVGLKTVLSYLYVNPTNKRKIMLLSDPEMESSILISSDEGATYQKYRLTFYIQSLLFHPKQEDWVLAYSLDQKLYSSMDFGRRWQLMHERITPNRFYWSVAGLDKEADLVHMEVRTTDGYAHYLTCRIQECAETTRSGPFARSIDISSLVVQDEYIFIQVTTSGRASYYVSYRREAFAQIKLPKYSLPKDMHIISTDENQVFAAVQEWNQNDTYNLYISDTRGIYFTLAMENIKSSRGLMGNIIIELYEVAGIKGIFLANKKVDDQVKTYITYNKGRDWRLLQAPDVDLRGSPVHCLLPFCSLHLHLQLSENPYSSGRISSKETAPGLVVATGNIGPELSYTDIGVFISSDGGNTWRQIFDEEYNVWFLDWGGALVAMKHTPLPVRHLWVSFDEGHSWDKYGFTSVPLFVDGALVEAGMETHIMTVFGHFSLRSEWQLVKVDYKSIFSRHCTKEDYQTWHLLNQGEPCVMGERKIFKKRKPGAQCALGRDHSGSVVSEPCVCANWDFECDYGYERHGESQCVPAFWYNPASPSKDCSLGQSYLNSTGYRRIVSNNCTDGLREKYTAKAQMCPGKAPRGLHVVTTDGRLVAEQGHNATFIILMEEGDLQRTNIQLDFGDGIAVSYANFSPIEDGIKHVYKSAGIFQVTAYAENNLGSDTAVLFLHVVCPVEHVHLRVPFVAIRNKEVNISAVVWPSQLGTLTYFWWFGNSTKPLITLDSSISFTFLAEGTDTITVQVAAGNALIQDTKEIAVHEYFQSQLLSFSPNLDYHNPDIPEWRKDIGNVIKRALVKVTSVPEDQILIAVFPGLPTSAELFILPPKNLTERRKGNEGDLEQIVETLFNALNQNLVQFELKPGVQVIVYVTQLTLAPLVDSSAGHSSSAMLMLLSVVFVGLAVFLIYKFKRKIPWINIYAQVQHDKEQEMIGSVSQSENAPKITLSDFTEPEELLDKELDTRVIGGIATIANSESTKEIPNCTSV

SEQ ID NO: 36289 - protein, 152 aa, Homo sapiens
  ENSP00000376876
ENPYSSGRISSKETAPGLVVATGNIGPELSYTDIGVFISSDGGNTWRQIFDEEYNVWFLDWGGALVAMKHTPLPVRHLWVSFDEGHSWDKYGFTSVPLFVDGALVEAGMETHIMTDYGYERHGESQCVPAFWYNPASPSKDCSLGQSYLNST

SEQ ID NO: 36290 - protein, 1222 aa, Homo sapiens; identical to SEQ ID NO: 36288
  ENSP00000358713

SEQ ID NO: 36291 - protein, 1333 aa, Homo sapiens [sequence omitted]

SEQ ID NO: 36292 - protein, 1318 aa, Homo sapiens
  ENSP00000378479
MQAQQLPYEFFSEENAPKWRGLLVPALKKVQGQVHPTLESNDDALQYVEELILQLLNMLCQAQPRSASDVEERVQKSFPHPIDKWAIADAQSAIEKRKRRNPLSLPVEKIHPLLKEVLGYKIDHQVSVYIVAVLEYISADILKLVGNYVRNIRHYEITKQDIKVAMCADKVLMDMFHQDVEDINILSLTDEEPSTSGEQTYYDLVKAFMAEIRQYIRELNLIIKVFREPFVSNSKLFSANDVENIFSRIVDIHELSVKLLGHIEDTVEMTDEGSPHPLVGSCFEDLAEELAFDPYESYARDILRPGFHDRFLSQLSKPGAALYLQSIGEGFKEAVQYVLPRLLLAPVYHCLHYFELLKQLEEKSEDQEDKECLKQAITALLNVQSGMEKICSKSLAKRRLSESACRFYSQQMKGKQLAIKKMNEIQKNIDGWEGKDIGQCCNEFIMEGTLTRVGAKHERHIFLFDGLMICCKSNHGQPRLPGASNAEYRLKEKFFMRKVQINDKDDTNEYKHAFEIILKDENSVIFSAKSAEEKNNWMAALISLQYRSTLERMLDVTMLQEEKEEQMRLPSADVYRFAEPDSEENIIFEENMQPKAGIPIIKAGTVIKLIERLTYHMYADPNFVRTFLTTYRSFCKPQELLSLIIERFEIPEPEPTEADRIAIENGDQPLSAELKRFRKEYIQPVQLRVLNVCRHWVEHHFYDFERDAYLLQRMEEFIGTVRGKAMKKWVESITKIIQRKKIARDNGPGHNITFQSSPPTVEWHISRPGHIETFDLLTLHPIEIARQLTLLESDLYRAVQPSELVGSVWTKEDKEINSPNLLKMIRHTTNLTLWFEKCIVETENLEERVAVVSRIIEILQVFQELNNFNGVLEVVSAMNSSPVYRLDHTFEQIPSRQKKILEEAHELSEDHYKKYLAKLRSINPPCVPFFGIYLTNILKTEEGNPEVLKRHGKELINFSKRRKVAEITGEIQQYQNQPYCLRVESDIKRFFENLNPMGNSMEKEFTDYLFNKSLEIEPRNPKPLPRFPKKYSYPLKSPGVRPSNPRPGTMRHPTPLQQEPRKISYSRIPESETESTASAPNSPRTPLTPPPASGASSTTDVCSVFDSDHSSPFHSRSASVSSISLTKGTDEVPVPPPVPPRRRPESAPAESSPSKIMSKHLDSPPAIPPRQPTSKAYSPRYSISDRTSISDPPESPPLLPPREPVRTPDVFSSSPLHLQPPPLGKKSDHGNAFFPNSPSPFTPPPPQTPSPHGTRRHLPSPPLTQEVDLHSIAGPPVPPRQSTSQHIPKLPPKTYKREHTHPSMHRDGPPLLENAHSS

SEQ ID NO: 36293 - protein, 102 aa, Homo sapiens
  ENSP00000393899
MLCQAQPRSASDVEERVQKSFPHPIDKWAIADAQSAIEKRKRRNPLSLPVEKIHPLLKEVLGYKIDHQVSVYIVAVLEYISADILKLVGNYVRNIRHYEITK

SEQ ID NO: 36294 - protein, 1333 aa, Homo sapiens [sequence omitted]

SEQ ID NO: 36295 - protein, 213 aa, Homo sapiens
  ENSP00000414853
MAEEQDLSEVELSPVGSEEPRCLSPGSAPSLGPDGGGGGSGLRASPGPGELGKVKKEQQDGEADDDKFPVCIREAVSQVLSGYDWTLVPMPVRVNGASKSKPHVKRPMNAFMVWAQAARRKLADQYPHLHNAELSKTLGKLWRLLNESDKRPFIEEAERLRMQHKKDHPDYKYQPRRRKNGKAAQGEAECPGGEAEQGGTAAIQAHYKSAHLD

SEQ ID NO: 36296 - protein, 466 aa, Homo sapiens
  ENSP00000354130
MAEEQDLSEVELSPVGSEEPRCLSPGSAPSLGPDGGGGGSGLRASPGPGELGKVKKEQQDGEADDDKFPVCIREAVSQVLSGYDWTLVPMPVRVNGASKSKPHVKRPMNAFMVWAQAARRKLADQYPHLHNAELSKTLGKLWRLLNESDKRPFIEEAERLRMQHKKDHPDYKYQPRRRKNGKAAQGEAECPGGEAEQGGTAAIQAHYKSAHLDHRHPGEGSPMSDGNPEHPSGQSHGPPTPPTTPKTELQSGKADPKRDGRSMGEGGKPHIDFGNVDIGEISHEVMSNMETFDVAELDQYLPPNGHPGHVSSYSAAGYGLGSALAVASGHSAWISKPPGVALPTVSPPGVDAKAQVKTETAGPQGPPHYTDQPSTSQIAYTSLSLPHYGSAFPSISRPQFDYSDHQPSGPYYGHSGQASGLYSAFSYMGPSQRPLYTAISDPSPSGPQSHSPTHWEQPVYTTLSRP

SEQ ID NO: 36297 - protein, 179 aa, Homo sapiens
  ENSP00000399777
  MOD_RES (1)..(1): Any amino acid
XQYPHLHNAELSKTLGKLWRLLNESDKRPFIEEAERLRMQHKKDHPDYKYQPRRRKNGKAAQGEAECPGGEAEQGGTAAIQAHYKSAHLDHRHPGEGSPMSDGNPEHPSGQSHGPPTPPTTPKTELQSGKADPKRDGRSMGEGGKPHIDFGNVDIGEISHEMGKLKFARLMLRSAGARI

SEQ ID NO: 36298 - protein, 466 aa, Homo sapiens; identical to SEQ ID NO: 36296
  ENSP00000380093

SEQ ID NO: 36299 - protein, 622 aa, Homo sapiens
  ENSP00000356172
MSMRSPISAQLALDGVGTMVNCTIKSEEKKEPCHEAPQGSATAAEPQPGDPARASQDSADPQAPAQGNFRGSWDCSSPEGNGSPEPKRPGVSEAASGSQEKLDFNRNLKEVVPAIEKLLSSDWKERFLGRNSMEAKDVKGTQESLAEKELQLLVMIHQLSTLRDQLLTAHSEQKNMAAMLFEKQQQQMELARQQQEQIAKQQQQLIQQQHKINLLQQQIQQVNMPYVMIPAFPPSHQPLPVTPDSQLALPIQPIPCKPVEYPLQLLHSPPAPVVKRPGAMATHHPLQEPSQPLNLTAKPKAPELPNTSSSPSLKMSSCVPRPPSHGGPTRDLQSSPPSLPLGFLGEGDAVTKAIQDARQLLHSHSGALDGSPNTPFRKDLISLDSSPAKERLEDGCVHPLEEAMLSCDMDGSRHFPESRNSSHIKRPMNAFMVWAKDERRKILQAFPDMHNSSISKILGSRWKSMTNQEKQPYYEEQARLSRQHLEKYPDYKYKPRPKRTCIVEGKRLRVGEYKALMRTRRQDARQSYVIPPQAGQVQMSSSDVLYPRAAGMPLAQPLVEHYVPRSLDPNMPVIVNTCSLREEGEGTDDRHSVADGEMYRYSEDEDSEGEEKSDGELVVLTD

SEQ ID NO: 36300 - protein, 57 aa, Homo sapiens
  ENSP00000433595
MSMRSPISAQLALDGVGTMVNCTIKSEEKKEPCHEAPQGSATAAEPQPGDPARASQD

SEQ ID NO: 36301 - protein, 179 aa, Homo sapiens
  ENSP00000436297
MSMRSPISAQLALDGVGTMVNCTIKSEEKKEPCHEAPQGSATAAEPQPGDPARASQDSADPQAPAQGNFRGSWDCSSPEGNGSPEPKRPGVSEAASGSQEKLDFNRNLKEVVPAIEKLLSSDWKERFLGRNSMEAKDVKGTQESLAEKELQLLVMIHQLSTLRDQLLTAHSEQKNMAAM

SEQ ID NO: 36302 - protein, 128 aa, Homo sapiens
  ENSP00000434093
  MOD_RES (1)..(1): Any amino acid
XTQESLAEKELQLLVMIHQLSTLRDQLLTAHSEQKNMAAMLFEKQQQQMELARQQQEQIAKQQQQLIQQQHKINLLQQQIQQVNMPYVMIPAFPPSHQPLPVTPDSQLALPIQPIPCKPGLFSLLPFP

SEQ ID NO: 36303 - protein, 622 aa, Homo sapiens; identical to SEQ ID NO: 36299
  ENSP00000478239

SEQ ID NO: 36304 - protein, 317 aa, Homo sapiens
  ENSP00000323588
MYNMMETELKPPGPQQTSGGGGGNSTAAAAGGNQKNSPDRVKRPMNAFMVWSRGQRRKMAQENPKMHNSEISKRLGAEWKLLSETEKRPFIDEAKRLRALHMKEHPDYKYRPRRKTKTLMKKDKYTLPGGLLAPGGNSMASGVGVGAGLGAGVNQRMDSYAHMNGWSNGSYSMMQDQLGYPQHPGLNAHGAAQMQPMHRYDVSALQYNSMTSSQTYMNGSPTYSMSYSQQGTPGMALGSMGSVVKSEASSSPPVVTSSSHSRAPCQAGDLRDMISMYLPGAEVPEPAAPSRLHMSQHYQSGPVPGTAINGTLPLSHM

SEQ ID NO: 36305 - protein, 808 aa, Homo sapiens
  ENSP00000324948
MSSKQATSPFACAADGEDAMTQDLTSREKEEGSDQHVASHLPLHPIMHNKPHSEELPTLVSTIQQDADWDSVLSSQQRMESENNKLCSLYSFRNTSTSPHKPDEGSRDREIMTSVTFGTPERRKGSLADVVDTLKQKKLEEMTRTEQEDSSCMEKLLSKDWKEKMERLNTSELLGEIKGTPESLAEKERQLSTMITQLISLREQLLAAHDEQKKLAASQIEKQRQQMDLARQQQEQIARQQQQLLQQQHKINLLQQQIQVQGHMPPLMIPIFPHDQRTLAAAAAAQQGFLFPPGITYKPGDNYPVQFIPSTMAAAAASGLSPLQLQKGHVSHPQINQRLKGLSDRFGRNLDTFEHGGGHSYNHKQIEQLYAAQLASMQVSPGAKMPSTPQPPNTAGTVSPTGIKNEKRGTSPVTQVKDEAAAQPLNLSSRPKTAEPVKSPTSPTQNLFPASKTSPVNLPNKSSIPSPIGGSLGRGSSLDILSSLNSPALFGDQDTVMKAIQEARKMREQIQREQQQQQPHGVDGKLSSINNMGLNSCRNEKERTRFENLGPQLTGKSNEDGKLGPGVIDLTRPEDAEGGATVAEARVYRDARGRASSEPHIKRPMNAFMVWAKDERRKILQAFPDMHNSNISKILGSRWKSMSNQEKQPYYEEQARLSKIHLEKYPNYKYKPRPKRTCIVDGKKLRIGEYKQLMRSRRQEMRQFFTVGQQPQIPITTGTGVVYPGAITMATTTPSPQMTSDCSSTSASPEPSLPVIQSTYGMKTDGGSLAGNEMINGEDEMEMYDDYEDDPKSDYSSENEAPEAVSAN

SEQ ID NO: 36306 - protein, 801 aa, Homo sapiens
  ENSP00000432134
MSSKQATSPFACAADGEDAMTQDLTSREKEEGSDQHVASHLPLHPIMHNKPHSEELPTLVSTIQQDADWDSVLSSQQRMESENNKLCSLYSFRNTSTSPHKPDEGSRDREIMTSVTFGTPERRKGSLADVVDTLKQKKLEEMTRTEQEDSSCMEKLLSKDWKEKMERLNTSELLGEIKGTPESLAEKERQLSTMITQLISLREQLLAAHDEQKKLAASQIEKQRQQMDLARQQQEQIARQQQQLLQQQHKINLLQQQIQVQGHMPPLMIPIFPHDQRTLAAAAAAQQGFLFPPGITYKPGDNYPVQFIPSTMAAAAASGLSPLQLQQLYAAQLASMQVSPGAKMPSTPQPPNTAGTVSPTGIKNEKRGTSPVTQVKDEAAAQPLNLSSRPKTAEPVKSPTSPTQNLFPASKTSPVNLPNKSSIPSPIGGSLGRGSSLGKWKSQHQEETYELDILSSLNSPALFGDQDTVMKAIQEARKMREQIQREQQQQQPHGVDGKLSSINNMGLNSCRNEKERTRFENLGPQLTGKSNEDGKLGPGVIDLTRPEDAEGSKAMNGSAAKLQQYYCWPTGGATVAEARVYRDARGRASSEPHIKRPMNAFMVWAKDERRKILQAFPDMHNSNISKILGSRWKSMSNQEKQPYYEEQARLSKIHLEKYPNYKYKPRPKRTCIVDGKKLRIGEYKQLMRSRRQEMRQFFTVGQQPQIPITTGTGVVYPGAITMATTTPSPQMTSDCSSTSASPEPSLPVIQSTYGMKTDGGSLAGNEMINGEDEMEMYDDYEDDPKSDYSSENEAPEAVSAN

SEQ ID NO: 36307 - protein, 804 aa, Homo sapiens
  ENSP00000434455
MGRMSSKQATSPFACAADGEDAMTQDLTSREKEEGSDQHVASHLPLHPIMHNKPHSEELPTLVSTIQQDADWDSVLSSQQRMESENNKLCSLYSFRNTSTSPHKPDEGSRDREIMTSVTFGTPERRKGSLADVVDTLKQKKLEEMTRTEQEDSSCMEKLLSKDWKEKMERLNTSELLGEIKGTPESLAEKERQLSTMITQLISLREQLLAAHDEQKKLAASQIEKQRQQMDLARQQQEQIARQQQQLLQQQHKINLLQQQIQVQGHMPPLMIPIFPHDQRTLAAAAAAQQGFLFPPGITYKPGDNYPVQFIPSTMAAAAASGLSPLQLQQLYAAQLASMQVSPGAKMPSTPQPPNTAGTVSPTGIKNEKRGTSPVTQVKDEAAAQPLNLSSRPKTAEPVKSPTSPTQNLFPASKTSPVNLPNKSSIPSPIGGSLGRGSSLGKWKSQHQEETYELDILSSLNSPALFGDQDTVMKAIQEARKMREQIQREQQQQQPHGVDGKLSSINNMGLNSCRNEKERTRFENLGPQLTGKSNEDGKLGPGVIDLTRPEDAEGSKAMNGSAAKLQQYYCWPTGGATVAEARVYRDARGRASSEPHIKRPMNAFMVWAKDERRKILQAFPDMHNSNISKILGSRWKSMSNQEKQPYYEEQARLSKIHLEKYPNYKYKPRPKRTCIVDGKKLRIGEYKQLMRSRRQEMRQFFTVGQQPQIPITTGTGVVYPGAITMATTTPSPQMTSDCSSTSASPEPSLPVIQSTYGMKTDGGSLAGNEMINGEDEMEMYDDYEDDPKSDYSSENEAPEAVSAN

SEQ ID NO: 36308 - protein, 828 aa, Homo sapiens
  ENSP00000433233
MSSKQATSPFACAADGEDAMTQDLTSREKEEGSDQHVASHLPLHPIMHNKPHSEELPTLVSTIQQDADWDSVLSSQQRMESENNKLCSLYSFRNTSTSPHKPDEGSRDREIMTSVTFGTPERRKGSLADVVDTLKQKKLEEMTRTEQEDSSCMEKLLSKDWKEKMERLNTSELLGEIKGTPESLAEKERQLSTMITQLISLREQLLAAHDEQKKLAASQIEKQRQQMDLARQQQEQIARQQQQLLQQQHKINLLQQQIQVQGHMPPLMIPIFPHDQRTLAAAAAAQQGFLFPPGITYKPGDNYPVQFIPSTMAAAAASGLSPLQLQKGHVSHPQINQRLKGLSDRFGRNLDTFEHGGGHSYNHKQIEQLYAAQLASMQVSPGAKMPSTPQPPNTAGTVSPTGIKNEKRGTSPVTQVKDEAAAQPLNLSSRPKTAEPVKSPTSPTQNLFPASKTSPVNLPNKSSIPSPIGGSLGRGSSLDILSSLNSPALFGDQDTVMKAIQEARKMREQIQREQQQQQPHGVDGKLSSINNMGLNSCRNEKERTRFENLGPQLTGKSNEDGKLGPGVIDLTRPEDAEGSKAMNGSAAKLQQYYCWPTGGATVAEARVYRDARGRASSEPHIKRPMNAFMVWAKDERRKILQAFPDMHNSNISKILGSRWKSMSNQEKQPYYEEQARLSKIHLEKYPNYKYKPRPKRTCIVDGKKLRIGEYKQLMRSRRQEMRQFFTVGQQPQIPITTGTGVVYPGAITMATTTPSPQMTSDCSSTSASPEPSLPVIQSTYGMKTDGGSLAGNEMINGEDEMEMYDDYEDDPKSDYSSENEAPEAVSAN

SEQ ID NO: 36309 - protein, 159 aa, Homo sapiens
  ENSP00000436170
MSSKQATSPFACAADGEDAMTQDLTSREKEEGSDQHVASHLPLHPIMHNKPHSEELPTLVSTIQQDADWDSVLSSQQRMESENNKLCSLYSFRNTSTSPHKPDEGSRDREIMTSVTFGTPERRKGSLADVVDTLKQKKLEEMTRTEQEDSSCMEKLLSK

SEQ ID NO: 36310 - protein, 159 aa, Homo sapiens
  ENSP00000432577
MSSKQATSPFACAADGEDAMTQDLTSREKEEGSDQHVASHLPLHPIMHNKPHSEELPTLVSTIQQDADWDSVLSSQQRMESENNKLCSLYSFRNTSTSPHKPDEGSRDREIMTSVTFGTPERRKGSLADVVDTLKQKKLEEMTRTEQEASLSFKISGVP

SEQ ID NO: 36311 - protein, 139 aa, Homo sapiens
  ENSP00000434892
MSSKQATSPFACAADGEDAMTQDLTSREKEEGSDQHVASHLPLHPIMHNKPHSEELPTLVSTIQQDADWDSVLSSQQRMESENNKLCSLYSFRNTSTSPHKPDEGSRDREIMTSVTFGTPERRKGSLADVVDTLKQKKL

SEQ ID NO: 36312 - protein, 79 aa, Homo sapiens
  ENSP00000432596
MSSKQATSPFACAADGEDAMTQDLTSREKEEGSDQHVASHLPLHPIMHNKPHSEELPTLVSTIQQDADWDSVLSSQQRM

SEQ ID NO: 36313 - protein, 808 aa, Homo sapiens; identical to SEQ ID NO: 36305
  ENSP00000379644

SEQ ID NO: 36314 - protein, 446 aa, Homo sapiens [sequence omitted]

SEQ ID NO: 36315 - protein, 509 aa, Homo sapiens
  ENSP00000245479
MNLLDPFMKMTDEQEKGLSGAPSPTMSEDSAGSPCPSGSGSDTENTRPQENTFPKGEPDLKKESEEDKFPVCIREAVSQVLKGYDWTLVPMPVRVNGSSKNKPHVKRPMNAFMVWAQAARRKLADQYPHLHNAELSKTLGKLWRLLNESEKRPFVEEAERLRVQHKKDHPDYKYQPRRRKSVKNGQAEAEEATEQTHISPNAIFKALQADSPHSSSGMSEVHSPGEHSGQSQGPPTPPTTPKTDVQPGKADLKREGRPLPEGGRQPPIDFRDVDIGELSSDVISNIETFDVNEFDQYLPPNGHPGVPATHGQVTYTGSYGISSTAATPASAGHVWMSKQQAPPPPPQQPPQAPPAPQAPPQPQAAPPQQPAAPPQQPQAHTLTTLSSEPGQSQRTHIKTEQLSPSHYSEQQQHSPQQIAYSPFNLPHYSPSYPPITRSQYDYTDHQNSSSYYSHAAGQGTGLYSTFTYMNPAQRPMYTPIADTSGVPSIPQTHSPQHWEQPVYTQLTRP

SEQ ID NO: 36316 - protein, 398 aa, Homo sapiens
  ENSP00000364430
MAAVAVLRNDSLQAFLQDRTPSASPDLGKHSPLALLAATCSRIGQPGAAAPPDFLQVPYDPALGSPSRLFHPWTADMPAHSPGALPPPHPSLGLTPQKTHLQPSFGAAHELPLTPPADPSYPYEFSPVKMLPSSMAALPASCAPAYVPYAAQAALPPGYSNLLPPPPPPPPPPTCRQLSPNPAPDDLPWWSIPQAGAGPGASGVPGSGLSGACAGAPHAPRFPASAAAAAAAAAALQRGLVLGPSDFAQYQSQIAALLQTKAPLAATARRCRRCRCPNCQAAGGAPEAEPGKKKQHVCHVPGCGKVYGKTSHLKAHLRWHTGERPFVCNWLFCGKSFTRSDELQRHLRTHTGEKRFACPECGKRFMRSDHLAKHVKTHQNKKLKVAEAGVKREDARDL

SEQ ID NO: 36317 - protein, 1193 aa, Homo sapiens
  ENSP00000323300
MWRVKKLSLSLSPSPQTGKPSMRTPLRELTLQPGALTNSGKRSPACSSLTPSLCKLGLQEGSNNSSPVDFVNNKRTDLSSEHFSHSSKWLETCQHESDEQPLDPIPQISSTPKTSEEAVDPLGNYMVKTIVLVPSPLGQQQDMIFEARLDTMAETNSISLNGPLRTDDLVREEVAPCMGDRFSEVAAVSEKPIFQESPSHLLEESPPNPCSEQLHCSKESLSSRTEAVREDLVPSESNAFLPSSVLWLSPSTALAADFRVNHVDPEEEIVEHGAMEEREMRFPTHPKESETEDQALVSSVEDILSTCLTPNLVEMESQEAPGPAVEDVGRILGSDTESWMSPLAWLEKGVNTSVMLENLRQSLSLPSMLRDAAIGTTPFSTCSVGTWFTPSAPQEKSTNTSQTGLVGTKHSTSETEQLLCGRPPDLTALSRHDLEDNLLSSLVILEVLSRQLRDWKSQLAVPHPETQDSSTQTDTSHSGITNKLQHLKESHEMGQALQQARNVMQSWVLISKELISLLHLSLLHLEEDKTTVSQESRRAETLVCCCFDLLKKLRAKLQSLKAEREEARHREEMALRGKDAAEIVLEAFCAHASQRISQLEQDLASMREFRGLLKDAQTQLVGLHAKQEELVQQTVSLTSTLQQDWRSMQLDYTTWTALLSRSRQLTEKLTVKSQQALQERDVAIEEKQEVSRVLEQVSAQLEECKGQTEQLELENSRLATDLRAQLQILANMDSQLKELQSQHTHCAQDLAMKDELLCQLTQSNEEQAAQWQKEEMALKHMQAELQQQQAVLAKEVRDLKETLEFADQENQVAHLELGQVECQLKTTLEVLRERSLQCENLKDTVENLTAKLASTIADNQEQDLEKTRQYSQKLGLLTEQLQSLTLFLQTKLKEKTEQETLLLSTACPPTQEHPLPNDRTFLGSILTAVADEEPESTPVPLLGSDKSAFTRVASMVSLQPAETPGMEESLAEMSIMTTELQSLCSLLQESKEEAIRTLQRKICELQARLQAQEEQHQEVQKAKEADIEKLNQALCLRYKNEKELQEVIQQQNEKILEQIDKSGELISLREEVTHLTRSLRRAETETKVLQEALAGQLDSNCQPMATNWIQEKVWLSQEVDKLRVMFLEMKNEKEKLMIKFQSHRNILEENLRRSDKELEKLDDIVQHIYKTLLSIPEVVRGCKELQGLLEFLS

SEQ ID NO: 36318 - protein, 185 aa, Homo sapiens
  ENSP00000466061
  MOD_RES (1)..(1): Any amino acid
XESKEEAIRTLQRKICELQARLQAQEEQHQEVQKAKEADIEKLNQALCLRYKNEKELQEVIQQQNEKILEQIDKSGELISLREEVTHLTRSLRRAETETKVLQEALAGQLDSNCQPMATNWIQEKVWLSQEVDKLRVMFLEMKNEKEKLMIKFQSHRNILEENLRRSDKELEKLDDIVQHIYKRW

SEQ ID NO: 36319 - protein, 186 aa, Homo sapiens
  ENSP00000466021
  MOD_RES (1)..(1): Any amino acid
XLATDLRAQLQILANMDSQLKELQSQHTHCAQDLAMKDELLCQLTQSNEEQAAQWQKEEMALKHMQAELQQQQAVLAKEVRDLKETLEFADQENQVAHLELGQVECQLKTTLEVLRERSLQCENLKDTVENLTAKLASTIADNQEQDLEKTRQYSQKLGLLTEQLQSLTLFLQTKLKEKLFFLLCP

SEQ ID NO: 36320 - protein, 57 aa, Homo sapiens
  ENSP00000464280
QEQDLEKTRQYSQKLGLLTEQLQSLTLFLQTKLKEKTMFQESRNIAFFGLPAVCTKQ

SEQ ID NO: 36321 - protein, 129 aa, Homo sapiens
  ENSP00000464474
SRRAETLVCCCFDLLKKLRAKLQSLKAEREEARHREEMALRGKDAVGLHAKQEELVQQTVSLTSTLQQDWRSMQLDYTTWTALLSRSRQLTEKLTVKSQQALQERDVAIEEKQEISGLSCRFWPTWTAS

SEQ ID NO: 36322 - protein, 238 aa, Homo sapiens
  ENSP00000463095
  MOD_RES (1)..(1): Any amino acid
XPHPETQDSSTQTDTSHSGITNKLQHLKESHEMGQALQQARNVMQSWVLISKELISLLHLSLLHLEEDKTTVSQESRRAETLVCCCFDLLKKLRAKLQSLKAEREEARHREEMALRGKDAVGLHAKQEELVQQTVSLTSTLQQDWRSMQLDYTTWTALLSRSRQLTEKLTVKSQQALQERDVAIEEKQEVSRVLEQVSAQLEECKGQTEQLELENSRLATDLRAQLQILANMDSQLKE

SEQ ID NO: 36323 - protein, 73 aa, Homo sapiens
  ENSP00000464400
MWRVKKLSLSLSPSPQTGKPSMRTPLRELTLQPGALTNSGKRSPACSSLTPSLCKLGLQQISVSIMWTQRRKL

SEQ ID NO: 36324 - protein, 72 aa, Homo sapiens
  ENSP00000462663
MWRVKKLSLSLSPSPQTGKPSMRTPLRELTLQPGALTNSGKRSPACSSLTPSLCKLGLQISVSIMWTQRRKL

SEQ ID NO: 36325 - protein, 272 aa, Homo sapiens
  ENSP00000444223
MWRVKKLSLSLSPSPQTGKPSMRTPLRELTLQPGALTNSGKRSPACSSLTPSLCKLGLQVRFAWTASRLGCLPREGSNNSSPVDFVNNKRTDLSSEHFSHSSKWLETCQHESDEQPLDPIPQISSTPKTSEEAVDPLGNYMVKTIVLVPSPLGQQQDMIFEARLDTMAETNSISLNGPLRTDDLVREEVAPCMGDRFSEVAAVSEKPIFQESPSHLLEESPPNPCSEQLHCSKESLSSRTEAVREDLVPSESNAFLPSSVLWLSPSTALAAD

SEQ ID NO: 36326 - protein, 1321 aa, Homo sapiens
  ENSP00000262013
MELEDGVVYQEEPGGSGAVMSERVSGLAGSIYREFERLIGRYDEEVVKELMPLVVAVLENLDSVFAQDQEHQVELELLRDDNEQLITQYEREKALRKHAEEKFIEFEDSQEQEKKDLQTRVESLESQTRQLELKAKNYADQISRLEEREAELKKEYNALHQRHTEMIHNYMEHLERTKLHQLSGSDQLESTAHSRIRKERPISLGIFPLPAGDGLLTPDAQKGGETPGSEQWKFQELSQPRSHTSLKVSNSPEPQKAVEQEDELSDVSQGGSKATTPASTANSDVATIPTDTPLKEENEGFVKVTDAPNKSEISKHIEVQVAQETRNVSTGSAENEEKSEVQAIIESTPELDMDKDLSGYKGSSTPTKGIENKAFDRNTESLFEELSSAGSGLIGDVDEGADLLGMGREVENLILENTQLLETKNALNIVKNDLIAKVDELTCEKDVLQGELEAVKQAKLKLEEKNRELEEELRKARAEAEDARQKAKDDDDSDIPTAQRKRFTRVEMARVLMERNQYKERLMELQEAVRWTEMIRASRENPAMQEKKRSSIWQFFSRLFSSSSNTTKKPEPPVNLKYNAPTSHVTPSVKKRSSTLSQLPGDKSKAFDFLSEETEASLASRREQKREQYRQVKAHVQKEDGRVQAFGWSLPQKYKQVTNGQGENKMKNLPVPVYLRPLDEKDTSMKLWCAVGVNLSGGKTRDGGSVVGASVFYKDVAGLDTEGSKQRSASQSSLDKLDQELKEQQKELKNQEELSSLVWICTSTHSATKVLIIDAVQPGNILDSFTVCNSHVLCIASVPGARETDYPAGEDLSESGQVDKASLCGSMTSNSSAETDSLLGGITVVGCSAEGVTGAATSPSTNGASPVMDKPPEMEAENSEVDENVPTAEEATEATEGNAGSAEDTVDISQTGVYTEHVFTDPLGVQIPEDLSPVYQSSNDSDAYKDQISVLPNEQDLVREEAQKMSSLLPTMWLGAQNGCLYVHSSVAQWRKCLHSIKLKDSILSIVHVKGIVLVALADGTLAIFHRGVDGQWDLSNYHLLDLGRPHHSIRCMTVVHDKVWCGYRNKIYVVQPKAMKIEKSFDAHPRKESQVRQLAWVGDGVWVSIRLDSTLRLYHAHTYQHLQDVDIEPYVSKMLGTGKLGFSFVRITALMVSCNRLWVGTGNGVIISIPLTETNKTSGVPGNRPGSVIRVYGDENSDKVTPGTFIPYCSMAHAQLCFHGHRDAVKFFVAVPGQVISPQSSSSGTDLTGDKAGPSAQEPGSQTPLKSMLVISGGEGYIDFRMGDEGGESELLGEDLPLEPSVTKAERSHLIVWQVMYGNE

SEQ ID NO: 36327 - protein, 1177 aa, Homo sapiens
  ENSP00000423165
MSPGCMLLFVFGFVGGAVVINSAILVSLSVLLLVHFSISTGVPALTQNLPRILRKERPISLGIFPLPAGDGLLTPDAQKGGETPGSEQWKFQELSQPRSHTSLKDELSDVSQGGSKATTPASTANSDVATIPTDTPLKEENEGFVKVTDAPNKSEISKHIEVQVAQETRNVSTGSAENEEKSEVQAIIESTPELDMDKDLSGYKGSSTPTKGIENKAFDRNTESLFEELSSAGSGLIGDVDEGADLLGMGREVENLILENTQLLETKNALNIVKNDLIAKVDELTCEKDVLQGELEAVKQAKLKLEEKNRELEEELRKARAEAEDARQKAKDDDDSDIPTAQRKRFTRVEMARVLMERNQYKERLMELQEAVRWTEMIRASRENPAMQEKKRSSIWQFFSRLFSSSSNTTKKPEPPVNLKYNAPTSHVTPSVKKRSSTLSQLPGDKSKAFDFLSEETEASLASRREQKREQYRQVKAHVQKEDGRVQAFGWSLPQKYKQVTNGQGENKMKNLPVPVYLRPLDEKDTSMKLWCAVGVNLSGGKTRDGGSVVGASVFYKDVAGLDTEGSKQRSASQSSLDKLDQELKEQQKELKNQEELSSLVWICTSTHSATKVLIIDAVQPGNILDSFTVCNSHVLCIASVPGARETDYPAGEDLSESGQVDKASLCGSMTSNSSAETDSLLGGITVVGCSAEGVTGAATSPSTNGASPVMDKPPEMEAENSEVDENVPTAEEATEATEGNAGSAEDTVDISQTGVYTEHVFTDPLGVQIPEDLSPVYQSSNDSDAYKDQISVLPNEQDLVREEAQKMSSLLPTMWLGAQNGCLYVHSSVAQWRKCLHSIKLKDSILSIVHVKGIVLVALADGTLAIFHRGVDGQWDLSNYHLLDLGRPHHSIRCMTVVHDKVWCGYRNKIYVVQPKAMKIEKSFDAHPRKESQVRQLAWVGDGVWVSIRLDSTLRLYHAHTYQHLQDVDIEPYVSKMLGTGKLGFSFVRITALMVSCNRLWVGTGNGVIISIPLTETVILHQGRLLGLRANKTSGVPGNRPGSVIRVYGDENSDKVTPGTFIPYCSMAHAQLCFHGHRDAVKFFVAVPGQVISPQSSSSGTDLTGDKAGPSAQEPGSQTPLKSMLVISGGEGYIDFRMGDEGGESELLGEDLPLEPSVTKAERSHLIVWQVMYGNE

SEQ ID NO: 36328 - protein, 1311 aa, Homo sapiens
  ENSP00000426900
MELEDGVVYQEEPGGSGAVMSERVSGLAGSIYREFERLIGRYDEEVVKELMPLVVAVLENLDSVFAQDQEHQVELELLRDDNEQLITQYEREKALRKHAEEKFIEFEDSQEQEKKDLQTRVESLESQTRQLELKAKNYADQISRLEEREAELKKEYNALHQRHTEMIHNYMEHLERTKLHQLSGSDQLESTAHSRIRKERPISLGIFPLPAGDGLLTPDAQKGGETPGSEQWKFQELSQPRSHTSLKDELSDVSQGGSKATTPASTANSDVATIPTDTPLKEENEGFVKVTDAPNKSEISKHIEVQVAQETRNVSTGSAENEEKSEVQAIIESTPELDMDKDLSGYKGSSTPTKGIENKAFDRNTESLFEELSSAGSGLIGDVDEGADLLGMGREVENLILENTQLLETKNALNIVKNDLIAKVDELTCEKDVLQGELEAVKQAKLKLEEKNRELEEELRKARAEAEDARQKAKDDDDSDIPTAQRKRFTRVEMARVLMERNQYKERLMELQEAVRWTEMIRASRENPAMQEKKRSSIWQFVPTRFSRLFSSSSNTTKKPEPPVNLKYNAPTSHVTPSVKKRSSTLSQLPGDKSKAFDFLSEETEASLASRREQKREQYRQVKAHVQKEDGRVQAFGWSLPQKYKQVTNGQGENKMKNLPVPVYLRPLDEKDTSMKLWCAVGVNLSGGKTRDGGSVVGASVFYKDVAGLDTEGSKQRSASQSSLDKLDQELKEQQKELKNQEELSSLVWICTSTHSATKVLIIDAVQPGNILDSFTVCNSHVLCIASVPGARETDYPAGEDLSESGQVDKASLCGSMTSNSSAETDSLLGGITVVGCSAEGVTGAATSPSTNGASPVMDKPPEMEAENSEVDENVPTAEEATEATEGNAGSAEDTVDISQTGVYTEHVFTDPLGVQIPEDLSPVYQSSNDSDAYKDQISVLPNEQDLVREEAQKMSSLLPTMWLGAQNGCLYVHSSVAQWRKCLHSIKLKDSILSIVHVKGIVLVALADGTLAIFHRGVDGQWDLSNYHLLDLGRPHHSIRCMTVVHDKVWCGYRNKIYVVQPKAMKIEKSFDAHPRKESQVRQLAWVGDGVWVSIRLDSTLRLYHAHTYQHLQDVDIEPYVSKMLGTGKLGFSFVRITALMVSCNRLWVGTGNGVIISIPLTETNKTSGVPGNRPGSVIRVYGDENSDKVTPGTFIPYCSMAHAQLCFHGHRDAVKFFVAVPGQVISPQSSSSGTDLTGDKAGPSAQEPGSQTPLKSMLVISGGEGYIDFRMGDEGGESELLGEDLPLEPSVTKAERSHLIVWQVMYGNE

SEQ ID NO: 36329 - protein, 1307 aa, Homo sapiens
  ENSP00000349636
MELEDGVVYQEEPGGSGAVMSERVSGLAGSIYREFERLIGRYDEEVVKELMPLVVAVLENLDSVFAQDQEHQVELELLRDDNEQLITQYEREKALRKHAEEKFIEFEDSQEQEKKDLQTRVESLESQTRQLELKAKNYADQISRLEEREAELKKEYNALHQRHTEMIHNYMEHLERTKLHQLSGSDQLESTAHSRIRKERPISLGIFPLPAGDGLLTPDAQKGGETPGSEQWKFQELSQPRSHTSLKDELSDVSQGGSKATTPASTANSDVATIPTDTPLKEENEGFVKVTDAPNKSEISKHIEVQVAQETRNVSTGSAENEEKSEVQAIIESTPELDMDKDLSGYKGSSTPTKGIENKAFDRNTESLFEELSSAGSGLIGDVDEGADLLGMGREVENLILENTQLLETKNALNIVKNDLIAKVDELTCEKDVLQGELEAVKQAKLKLEEKNRELEEELRKARAEAEDARQKAKDDDDSDIPTAQRKRFTRVEMARVLMERNQYKERLMELQEAVRWTEMIRASRENPAMQEKKRSSIWQFFSRLFSSSSNTTKKPEPPVNLKYNAPTSHVTPSVKKRSSTLSQLPGDKSKAFDFLSEETEASLASRREQKREQYRQVKAHVQKEDGRVQAFGWSLPQKYKQVTNGQGENKMKNLPVPVYLRPLDEKDTSMKLWCAVGVNLSGGKTRDGGSVVGASVFYKDVAGLDTEGSKQRSASQSSLDKLDQELKEQQKELKNQEELSSLVWICTSTHSATKVLIIDAVQPGNILDSFTVCNSHVLCIASVPGARETDYPAGEDLSESGQVDKASLCGSMTSNSSAETDSLLGGITVVGCSAEGVTGAATSPSTNGASPVMDKPPEMEAENSEVDENVPTAEEATEATEGNAGSAEDTVDISQTGVYTEHVFTDPLGVQIPEDLSPVYQSSNDSDAYKDQISVLPNEQDLVREEAQKMSSLLPTMWLGAQNGCLYVHSSVAQWRKCLHSIKLKDSILSIVHVKGIVLVALADGTLAIFHRGVDGQWDLSNYHLLDLGRPHHSIRCMTVVHDKVWCGYRNKIYVVQPKAMKIEKSFDAHPRKESQVRQLAWVGDGVWVSIRLDSTLRLYHAHTYQHLQDVDIEPYVSKMLGTGKLGFSFVRITALMVSCNRLWVGTGNGVIISIPLTETNKTSGVPGNRPGSVIRVYGDENSDKVTPGTFIPYCSMAHAQLCFHGHRDAVKFFVAVPGQVISPQSSSSGTDLTGDKAGPSAQEPGSQTPLKSMLVISGGEGYIDFRMGDEGGESELLGEDLPLEPSVTKAERSHLIVWQVMYGNE

SEQ ID NO: 36330 - protein, 152 aa, Homo sapiens
  ENSP00000423346
TSNSSAETDSLLGGITVVGCSAEGVTGAATSPSTNGASPVMDKPPEMEAENSEVDENVPTAEEATEATEGNAGSAEDTVDISQTGVYTEHVFTDPLGVQIPEDLSPVYQSSNDSDAYKDQISVLPNEQDLVREEAQKMSSLLPTMWLGAQNG

SEQ ID NO: 36331 - protein, 250 aa, Homo sapiens
  ENSP00000430205
  MOD_RES (1)..(1): Any amino acid
XEQQKELKNQEELSSLVWICTSTHSATKVLIIDAVQPGNILDSFTVCNSHVLCIASVPGARETDYPAGEDLSESGQVDKASLCGSMTSNSSAETDSLLGGITVVGCSAEGVTGAATSPSTNGASPVMDKPPAEEATEATEGNAGSAEDTVDISQTGVYTEHVFTDPLGVQIPEDLSPVYQSSNDSDAYKDQISVLPNEQDLVREEAQKMSSLLPTMWLGAQNGCLYVHSSVAQWRKCLHSIKLKDSILSI

SEQ ID NO: 36332 - protein, 174 aa, Homo sapiens
  ENSP00000429343
GSAENEEKSEVQAIIESTPELDMDKDLSGYKGSSTPTKGIENKAFDRNTESLFEELSSAGSGLIGDVDEGADLLGEYSDHNFFGMGREVENLILENTQLLETKNALNIVKNDLIAKVDELTCEKDVLQGELEAVKQAKLKLEEKNRELEEELRKARAEAEDARQKAKDDDDSDI

SEQ ID NO: 36333 - protein, 156 aa, Homo sapiens
  ENSP00000426061
MSPGCMLLFVFGFVGGAVVINSAILVSLSVLLLVHFSISTGVPALTQNLPRILRKERPISLGIFPLPAGDGLLTPDAQKGGETPGSEQWKFQELSQPRSHTSLKVSNSPEPQKAVEQEDELSDVSQGGSKATTPASTANSDVATIPTDTPLKEENE

SEQ ID NO: 36334 - protein, 1312 aa, Homo sapiens [sequence omitted]

SEQ ID NO: 36335 - protein, 303 aa, Homo sapiens
  ENSP00000231061
MRAWIFFLLCLAGRALAAPQQEALPDETEVVEETVAEVTEVSVGANPVQVEVGEFDDGAEETEEEVVAENPCQNHHCKHGKVCELDENNTPMCVCQDPTSCPAPIGEFEKVCSNDNKTFDSSCHFFATKCTLEGTKKGHKLHLDYIGPCKYIPPCLDSELTEFPLRMRDWLKNVLVTLYERDEDNNLLTEKQKLRVKKIHENEKRLEAGDHPVELLARDFEKNYNMYIFPVHWQFGQLDQHPIDGYLSHTELAPLRAPLIPMEHCTTRFFETCDLDNDKYIALDEWAGCFGIKQKDIDKDLVI

SEQ ID NO: 36336 - protein, 149 aa, Homo sapiens
  ENSP00000440127
MCVCQDPTSCPAPIGEFEKVCSNDNKTFDSSCHFFATKCTLEGTKKGHKLHLDYIGPCKYIPPCLDSELTEFPLRMRDWLKNVLVTLYERDEDNNLLTEKQKLRVKKIHENEKRLEAGDHPVELLARDFEKNYNMYIFPVHWQFGQLDQ

SEQ ID NO: 36337 - protein, 115 aa, Homo sapiens
  ENSP00000428119
MCVCQDPTSCPAPIGEFEKVCSNDNKTFDSSCHFFATKCTLEGTKKGHKLHLDYIGPCKYIPPCLDSELTEFPLRMRDWLKNVLVTLYERDEDNNLLTEKQKLRVKKIHENEKRL

SEQ ID NO: 36338 - protein, 111 aa, Homo sapiens
  ENSP00000444998
MRAWIFFLLCLAGRALAAPQQEALPDETEVVEETVAEVTEVSVGANPVQVEVGEFDDGAEETEEEVVAENPCQNHHCKHGKVCELDENNTPMCVCQDPTSCPAPIGEFEKV

SEQ ID NO: 36339 - protein, 53 aa, Homo sapiens
  ENSP00000429152
MRAWIFFLLCLAGRALAAPQQEALPDETEVVEETVAEVTEVSVGANPVQVEVG

SEQ ID NO: 36340 - protein, 664 aa, Homo sapiens
  ENSP00000282470
MKTGLFFLCLLGTAAAIPTNARLLSDHSKPTAETVAPDNTAIPSLRAEAEENEKETAVSTEDDSHHKAEKSSVLKSKEESHEQSAEQGKSSSQELGLKDQEDSDGHLSVNLEYAPTEGTLDIKEDMSEPQEKKLSENTDFLAPGVSSFTDSNQQESITKREENQEQPRNYSHHQLNRSSKHSQGLRDQGNQEQDPNISNGEEEEEKEPGEVGTHNDNQERKTELPREHANSKQEEDNTQSDDILEESDQPTQVSKMQEDEFDQGNQEQEDNSNAEMEEENASNVNKHIQETEWQSQEGKTGLEAISNHKETEEKTVSEALLMEPTDDGNTTPRNHGVDDDGDDDGDDGGTDGPRHSASDDYFIPSQAFLEAERAQSIAYHLKIEEQREKVHENENIGTTEPGEHQEAKKAENSSNEEETSSEGNMRVHAVDSCMSFQCKRGHICKADQQGKPHCVCQDPVTCPPTKPLDQVCGTDNQTYASSCHLFATKCRLEGTKKGHQLQLDYFGACKSIPTCTDFEVIQFPLRMRDWLKNILMQLYEANSEHAGYLNEKQRNKVKKIYLDEKRLLAGDHPIDLLLRDFKKNYHMYVYPVHWQFSELDQHPMDRVLTHSELAPLRASLVPMEHCITRFFEECDPNKDKHITLKEWGHCFGIKEEDIDENLLF

SEQ ID NO: 36341 - protein, 539 aa, Homo sapiens
  ENSP00000422903
MSEPQEKKLSENTDFLAPGVSSFTDSNQQESITKREENQEQPRNYSHHQLNRSSKHSQGLRDQGNQEQDPNISNGEEEEEKEPGEVGTHNDNQERKTELPREHANSKQEEDNTQSDDILEESDQPTQVSKMQEDEFDQGNQEQEDNSNAEMEEENASNVNKHIQETEWQSQEGKTGLEAISNHKETEEKTVSEALLMEPTDDGNTTPRNHGVDDDGDDDGDDGGTDGPRHSASDDYFIPSQAFLEAERAQSIAYHLKIEEQREKVHENENIGTTEPGEHQEAKKAENSSNEEETSSEGNMRVHAVDSCMSFQCKRGHICKADQQGKPHCVCQDPVTCPPTKPLDQVCGTDNQTYASSCHLFATKCRLEGTKKGHQLQLDYFGACKSIPTCTDFEVIQFPLRMRDWLKNILMQLYEANSEHAGYLNEKQRNKVKKIYLDEKRLLAGDHPIDLLLRDFKKNYHMYVYPVHWQFSELDQHPMDRVLTHSELAPLRASLVPMEHCITRFFEECDPNKDKHITLKEWGHCFGIKEEDIDENLLF

SEQ ID NO: 36342 - protein, 18 aa, Homo sapiens
  ENSP00000445678
MSEPQEKKLSENTDFLAP

SEQ ID NO: 36343 - protein, 143 aa, Homo sapiens
  ENSP00000423483
MKTGLFFLCLLGTAAAIPTNARLLSDHSKPTAETVAPDNTAIPSLRAEAEENEKETAVSTEDDSHHKAEKSSVLKSKEESHEQSAEQGKSSSQELGLKDQEDSDGHLSVNLEYAPTEGTLDIKEDMSEPQEKKLSENTDFLAP

SEQ ID NO: 36344 - protein, 141 aa, Homo sapiens
  ENSP00000416971
MKTGLFFLCLLGTAAAIPTNARLLSDHSKPTAETVAPDNTAIPSLRAEAEENEKETAVSTEDDSHHKAEKSSVLKSKEESHEQSAEQGKSSSQELGLKDQEDSDGHLSVNLEYAPTEGTLDIKEDMSEPQEKKLSENTDFL

SEQ ID NO: 36345 - protein, 127 aa, Homo sapiens
  ENSP00000438188
MKTGLFFLCLLGTAAAIPTNARLLSDHSKPTAETVAPDNTAIPSLRAEAEENEKETAVSTEDDSHHKAEKSSVLKSKEESHEQSAEQGKSSSQELGLKDQEDSDGHLSVNLEYAPTEGTLDIKEDMS

SEQ ID NO: 36346 - protein, 120 aa, Homo sapiens
  ENSP00000423448
MKTGLFFLCLLGTAAAIPTNARLLSDHSKPTAETVAPDNTAIPSLRAEAEENEKETAVSTEDDSHHKAEKSSVLKSKEESHEQSAEQGKSSSQELGLKDQEDSDGHLSVNLEYAPTEGTL

SEQ ID NO: 36347 - protein, 89 aa, Homo sapiens
  ENSP00000444832
MKTGLFFLCLLGTAAAIPTNARLLSDHSKPTAETVAPDNTAIPSLRAEAEENEKETAVSTEDDSHHKAEKSSVLKSKEESHEQSAEQGK

SEQ ID NO: 36348 - protein, 56 aa, Homo sapiens
  ENSP00000406251
MKTGLFFLCLLGTAAAIPTNARLLSDHSKPTAETVAPDNTAIPSLRAEAEENEKET

SEQ ID NO: 36349 - protein, 664 aa, Homo sapiens; identical to SEQ ID NO: 36340
  ENSP00000414856

SEQ ID NO: 36350 - protein, 1277 aa, Homo sapiens
  ENSP00000398560
MTQAAVRPWAPCLENMTTAPNGLGPGPAAPCAGSDLKDAKMVTSLACGNGVCGCSPGGDTDTQEAKLSPAKLVRLFSTSRKRTGAHPERPHSMVLVGNSSTWNTLASFRKMGSFKKLKSSVLKGIQSREGSNACSKGEASEHGLGKSIPNGAVPGAQASRGSPLAPGPACGALRPAEWGTLDGSDLEDTDDAFQRSTHRSRSLRRAYGLGRICLLDAPQNHATPTIATGQVPAVCEILVRDPENNSMGYRRSKSTDNLAFLKKSSFKRKSTSNLADLRTAHDARVPQRTLSSSSTDSQKLGSGRTKRWRSPIRAKDFDRVFKLVSNVTEAAWRRESPRSGAPSPGEASLRLQAHSRLHDDYSRRVSRSTEQDSRRGGAVMHGTTATCTVAPGFGSATSKGPHLDADTAVFPLETKSSWAVESDSSCTCSSLPSPIVQDVLSKDSCDPNAGSQLTFDPEQPPTPLRPTTPKPQSPQSPQSPGAGSASCHSNHSALSANSEESEGRAEEPAQREPGPVSLQDPLEATHGDEGSKDLLVNIGVAAGPEEKEKEEVVPDGPWRRSSSQDEERTEAQRTPKRRWGSGRRPRPRPFSDYGQLASRSLSIPEDSVAADPQKEDRVDEDPQASMTSASPEDQNAPVGCPKGARRRRPISVIGGVSLYGTNQTEELDNLLTQPASRPPMPAHQVPPYKAVSARFRPFTFSQSTPIGLDRVGRRRQMRASNVSSDGGTEPSALVDDNGSEEDFSYEDLCQASPRYLQPGGEQLAINELISDGNVVCAEALWDHVTMDDQELGFKAGDVIQVLEASNKDWWWGRSEDKEAWFPASFVRLRVNQEELSENSSSTPSEEQDEEASQSRHRHCENKQQMRTNVIREIMDTERVYIKHLRDICEGYIRQCRKHTGMFTVAQLATIFGNIEDIYKFQRKFLKDLEKQYNKEEPHLSEIGSCFLQNQEGFAIYSEYCNNHPGACLELANLMKQGKYRHFFEACRLLQQMIDIAIDGFLLTPVQKICKYPLQLAELLKYTTQEHGDYSNIKAAYEAMKNVACLINERKRKLESIDKIARWQVSIVGWEGLDILDRSSELIHSGELTKITKQGKSQQRTFFLFDHQLVSCKKDLLRRDMLYYKGRLDMDEMELVDLGDGRDKDCNLSVKNAFKLVSRTTDEVYLFCAKKQEDKARWLQACADERRRVQEDKEMGMEISENQKKLAMLNAQKAGHGKSKGYNRCPVAPPHQGLHPIHQRHITMPTSVPQQQVFGLAEPKRKSSLFWHTFNRLTPFRK

SEQ ID NO: 36351 - protein, 652 aa, Homo sapiens
  ENSP00000371527
MTSASPEDQNAPVGCPKGARRRRPISVIGGVSLYGTNQTEELDNLLTQPASRPPMPAHQVPPYKAVSARFRPFTFSQSTPIGLDRVGRRRQMRASNVSSDGGTEPSALVDDNGSEEDFSYEDLCQASPRYLQPGGEQLAINELISDGNVVCAEALWDHVTMDDQELGFKAGDVIQVLEASNKDWWWGRSEDKEAWFPASFVRLRVNQEELSENSSSTPSEEQDEEASQSRHRHCENKQQMRTNVIREIMDTERVYIKHLRDICEGYIRQCRKHTGMFTVAQLATIFGNIEDIYKFQRKFLKDLEKQYNKEEPHLSEIGSCFLQNQEGFAIYSEYCNNHPGACLELANLMKQGKYRHFFEACRLLQQMIDIAIDGFLLTPVQKICKYPLQLAELLKYTTQEHGDYSNIKAAYEAMKNVACLINERKRKLESIDKIARWQVSIVGWEGLDILDRSSELIHSGELTKITKQGKSQQRTFFLFDHQLVSCKKDLLRRDMLYYKGRLDMDEMELVDLGDGRDKDCNLSVKNAFKLVSRTTDEVYLFCAKKQEDKARWLQACADERRRVQEDKEMGMEISENQKKLAMLNAQKAGHGKSKGYNRCPVAPPHQGLHPIHQRHITMPTSVPQQQVFGLAEPKRKSSLFWHTFNRLTPFRK

SEQ ID NO: 36352 - protein, 550 aa, Homo sapiens
  ENSP00000401605
TDFAFFLQPASRPPMPAHQVPPYKAVSARFRPFTFSQSTPIGLDRVGRRRQMRASNVSSDGGTEPSALVDDNGSEEDFSYEDLCQASPRYLQPGGEQLAINELISDGNVVCAEALWDHVTMDDQELGFKAGDVIQVLEASNKDWWWGRSEDKEAWFPASFVRGYIRQCRKHTGMFTVAQLATIFGNIEDIYKFQRKFLKDLEKQYNKEEPHLSEIGSCFLQNQEGFAIYSEYCNNHPGACLELANLMKQGKYRHFFEACRLLQQMIDIAIDGFLLTPVQKICKYPLQLAELLKYTTQEHGDYSNIKAAYEAMKNVACLINERKRKLESIDKIARWQVSIVGWEGLDILDRSSELIHSGELTKITKQGKSQQRTFFLFDHQLVSCKKDLLRRDMLYYKGRLDMDEMELVDLGDGRDKDCNLSVKNAFKLVSRTTDEVYLFCAKKQEDKARWLQACADERRRVQEDKEMGMEISENQKKLAMLNAQKAGHGKSKGYNRCPVAPPHQGLHPIHQRHITMPTSVPQQQVFGLAEPKRKSSLFWHTFNRLTPFRK

SEQ ID NO: 36353 - protein, 23 aa, Homo sapiens
  ENSP00000477296
MGFIIHIQQVKKQRKKLDQGLIL

SEQ ID NO: 36354 - protein, 574 aa, Homo sapiens
  ENSP00000382830
MVARGEIARFWSLESLHLVSSDGGTEPSALVDDNGSEEDFSYEDLCQASPRYLQPGGEQLAINELISDGNVVCAEALWDHVTMDDQELGFKAGDVIQVLEASNKDWWWGRSEDKEAWFPASFVRLRVNQEELSENSSSTPSEEQDEEASQSRHRHCENKQQMRTNVIREIMDTERVYIKHLRDICEGYIRQCRKHTGMFTVAQLATIFGNIEDIYKFQRKFLKDLEKQYNKEEPHLSEIGSCFLQNQEGFAIYSEYCNNHPGACLELANLMKQGKYRHFFEACRLLQQMIDIAIDGFLLTPVQKICKYPLQLAELLKYTTQEHGDYSNIKAAYEAMKNVACLINERKRKLESIDKIARWQVSIVGWEGLDILDRSSELIHSGELTKITKQGKSQQRTFFLFDHQLVSCKKDLLRRDMLYYKGRLDMDEMELVDLGDGRDKDCNLSVKNAFKLVSRTTDEVYLFCAKKQEDKARWLQACADERRRVQEDKEMGMEISENQKKLAMLNAQKAGHGKSKGYNRCPVAPPHQGLHPIHQRHITMPTSVPQQQVFGLAEPKRKSSLFWHTFNRLTPFRK

SEQ ID NO: 36355 - protein, 512 aa, Homo sapiens
  ENSP00000386471
MVARGEIARFWSLESLHLVSSDGGTEPSALVDDNGSEEDFSYEDLCQASPRYLQPGGEQLAINELISDGNVVCAEALWDHVTMDDQELGFKAGDVIQVLEASNKDWWWGRSEDKEAWFPASFVRGYIRQCRKHTGMFTVAQLATIFGNIEDIYKFQRKFLKDLEKQYNKEEPHLSEIGSCFLQNQEGFAIYSEYCNNHPGACLELANLMKQGKYRHFFEACRLLQQMIDIAIDGFLLTPVQKICKYPLQLAELLKYTTQEHGDYSNIKAAYEAMKNVACLINERKRKLESIDKIARWQVSIVGWEGLDILDRSSELIHSGELTKITKQGKSQQRTFFLFDHQLVSCKKDLLRRDMLYYKGRLDMDEMELVDLGDGRDKDCNLSVKNAFKLVSRTTDEVYLFCAKKQEDKARWLQACADERRRVQEDKEMGMEISENQKKLAMLNAQKAGHGKSKGYNRCPVAPPHQGLHPIHQRHITMPTSVPQQQVFGLAEPKRKSSLFWHTFNRLTPFRK

SEQ ID NO: 36356 - protein, 146 aa, Homo sapiens
  ENSP00000397498
MGFIIHIQQVKKQRKKLDQGLILKKEKYRKEKKCASLSFEVSSDGGTEPSALVDDNGSEEDFSYEDLCQASPRYLQPGGEQLAINELISDGNVVCAEALWDHVTMDDQELGFKAGDVIQVLEASNKDWWWGRSEDKEAWFPASFVR

SEQ ID NO: 36357 - protein, 23 aa, Homo sapiens
  ENSP00000477304
MGFIIHIQQVKKQRKKLDQGLIL

SEQ ID NO: 36358 - protein, 596 aa, Homo sapiens
  ENSP00000343631
MGFIIHIQQVKKQRKKLDQGLILKKEKYRKEKKCASLSFEVSSDGGTEPSALVDDNGSEEDFSYEDLCQASPRYLQPGGEQLAINELISDGNVVCAEALWDHVTMDDQELGFKAGDVIQVLEASNKDWWWGRSEDKEAWFPASFVRLRVNQEELSENSSSTPSEEQDEEASQSRHRHCENKQQMRTNVIREIMDTERVYIKHLRDICEGYIRQCRKHTGMFTVAQLATIFGNIEDIYKFQRKFLKDLEKQYNKEEPHLSEIGSCFLQNQEGFAIYSEYCNNHPGACLELANLMKQGKYRHFFEACRLLQQMIDIAIDGFLLTPVQKICKYPLQLAELLKYTTQEHGDYSNIKAAYEAMKNVACLINERKRKLESIDKIARWQVSIVGWEGLDILDRSSELIHSGELTKITKQGKSQQRTFFLFDHQLVSCKKDLLRRDMLYYKGRLDMDEMELVDLGDGRDKDCNLSVKNAFKLVSRTTDEVYLFCAKKQEDKARWLQACADERRRVQEDKEMGMEISENQKKLAMLNAQKAGHGKSKGYNRCPVAPPHQGLHPIHQRHITMPTSVPQQQVFGLAEPKRKSSLFWHTFNRLTPFRK

SEQ ID NO: 36359 - protein, 1277 aa, Homo sapiens; identical to SEQ ID NO: 36350
  ENSP00000371542

SEQ ID NO: 36360 - protein, 178 aa, Homo sapiens
  ENSP00000427257
MPIKPVGWICGQVLKNFSGRIEGIQKAIMDLVDEFKDEFPTILRLSQSNQVRKGSLFEIISFPAKTALTSIIYASYAALIYLAVCVNAVLKKVKNIFQEEESIRQNREESENCRKAFSEPVLSEPMFAEGEIKAKPYRSLPEKPDISDYPKLLANKQSNNIQVLHSVFDQSAEMNEQI

SEQ ID NO: 36361 - protein, 254 aa, Homo sapiens
  ENSP00000325491
MPIKPVGWICGQVLKNFSGRIEGIQKAIMDLVDEFKDEFPTILRLSQSNQKREPAQKTSKIRMAIALAKINRATLIRGLNSISRSSKSVAKLLHPQLACRLLELRDISGRLLREVNAPRQPLYNIQVRKGSLFEIISFPAKTALTSIIYASYAALIYLAVCVNAVLKKVKNIFQEEESIRQNREESENCRKAFSEPVLSEPMFAEGEIKAKPYRSLPEKPDISDYPKLLANKQSNNIQVLHSVFDQSAEMNEQI

SEQ ID NO: 36362 - protein, 254 aa, Homo sapiens; identical to SEQ ID NO: 36361
  ENSP00000274432

SEQ ID NO: 36363 - protein, 135 aa, Homo sapiens
  ENSP00000420883
MPIKPVGWICGQVLKNFSGRIEGIQKAIMDLVDEFKDEFPTILRLSQSNQKREPAQKTSKIRMAIALAKINRATLIRGLNSISRSSKSVAKLLHPQLACRLLELRDISGRLLREVNAPRQPLYNIQEKKMGLQLS

SEQ ID NO: 36364 - protein, 591 aa, Homo sapiens
  ENSP00000366690
MSLLTNYEGLRHQIERLVRENEELKKLVRLIRENHELKSAIKTQAGGLGISGFTSGLGEATAGLSSRQNNGVFLPPSPAVANERVLEEVGIMALAPLAEMLTSLQPSATPGSLMSPLTGTLSTLLSGPAPTSQSSPLTSFLTSPIAGPLTGTLASSLGLPSTGTLTPSSLVAGPVAMSQSSPLIAPVMGTVAVSLSSPLLSSTATPPGVSQNLLANPMSNLVLPEAPRLRLAEPLRGGPTGPQSPACVVPTATTKVPLSTEPPQSTQDPEPLSMAFAGAPLQTSTPIGAMGTPAPKTAFSFNTSDTQAQPSAAQEQVVPASVPTSPTTSPTVTVLASAPALAPQVATSYTPSSTTHIAQGAPHPPSRMHNSPTQNLPVPHCPPHNAHSPPRTSSSPASVNDSRGPRTTEPSTKSMMEVERKLAHRKTSKFPENPRESKQLAWERLVGEIAFQLDRRILSSIFPERVRLYGFTVSNIPEKIIQASLNPSDHKLDEKLCQRLTQRYVSVMNRLQSLGYNGRVHPALTEQLVNAYGILRERPELAASEGGPYTVDFLQRVVVETVHPGMLADALLLLSCLSQLAHDDGKPMFIW

SEQ ID NO: 36365 - protein, 441 aa, Homo sapiens
  ENSP00000387613
MSLLTNYEGLRHQIERLVRENEELKKLVRLIRENHELKSAIKTQAGGLGISGFTSGLGEATAGLSSRQNNGVFLPPSPAVANERVLEEVGIMALAPLAEMLTSLQPSATPGSLMSPLTGTLSTLLSGPAPTSQSSPLTSFLTSPIAGPLTGTLASSLGLPSTGTLTPSSLVAGPVAMSQSSPLIAPVMGTVAVSLSSPLLSSTATPPGVSQNLLANPMSNLVLPEAPRLRLAEPLRGGPTGPQSPACVVPTATTKVPLSTEPPQSTQDPEPLSMAFAGAPLQTSTPIGAMGTPAPKTAFSFNTSDTQAQPSAAQEQVVPASVPTSPTTSPTVTVLASAPALAPQVATSYTPSSTTHIAQGAPHPPSRMHNSPTQNLPVPHCPPHNAHSPPRTSSSPASVNDSRGPRTTEPSTKSMMEVERKLAHRKTSKFPENPRGFPEPQ

SEQ ID NO: 36366 - protein, 1068 aa, Homo sapiens
  ENSP00000378898
MRSAAKPWNPAIRAGGHGPDRVRPLPAASSGMKSSKSSTSLAFESRLSRLKRASSEDTLNKPGSTAASGVVRLKKTATAGAISELTESRLRSGTGAFTTTKRTGIPAPREFSVTVSRERSVPRGPSNPRKSVSSPTSSNTPTPTKHLRTPSTKPKQENEGGEKAALESQVRELLAEAKAKDSEINRLRSELKKYKEKRTLNAEGTDALGPNVDGTSVSPGDTEPMIRALEEKNKNFQKELSDLEEENRVLKEKLIYLEHSPNSEGAASHTGDSSCPTSITQESSFGSPTGNQMSSDIDEYKKNIHGNALRTSGSSSSDVTKASLSPDASDFEHITAETPSRPLSSTSNPFKSSKCSTAGSSPNSVSELSLASLTEKIQKMEENHHSTAEELQATLQELSDQQQMVQELTAENEKLVDEKTILETSFHQHRERAEQLSQENEKLMNLLQERVKNEEPTTQEGKIIELEQKCTGILEQGRFEREKLLNIQQQLTCSLRKVEEENQGALEMIKRLKEENEKLNEFLELERHNNNMMAKTLEECRVTLEGLKMENGSLKSHLQGEKQKATEASAVEQTAESCEVQEMLKVARAEKDLLELSCNELRQELLKANGEIKHVSSLLAKVEKDYSYLKEICDHQAEQLSRTSLKLQEKASESDAEIKDMKETIFELEDQVEQHRAVKLHNNQLISELESSVIKLEEQKSDLERQLKTLTKQMKEETEEWRRFQADLQTAVVVANDIKCEAQQELRTVKRKLLEEEEKNARLQKELGDVQGHGRVVTSRAAPPPVDEEPESSEVDAAGRWPGVCVSRTSPTPPESATTVKSLIKSFDLGRPGGAGQNISVHKTPRSPLSGIPVRTAPAAAVSPMQRHSTYSSVRPASRGVTQRLDLPDLPLSDILKGRTETLKPDPHLRKSPSLESLSRPPSLGFGDTRLLSASTRAWKPQSKLSVERKDPLAALAREYGGSKRNALLKWCQKKTQGYANIDITNFSSSWSDGLAFCALLHTYLPAHIPYQELNSQEKKRNLLLAFEAAESVGIKPSLELSEMLYTDRPDWQSVMQYVAQIYKYFET

SEQ ID NO: 36367 - protein, 101 aa, Homo sapiens
  ENSP00000463006
MRSAAKPWNPAIRAGGHGPDRVRPLPAASSGMKSSKSSTSLAFESRLSRLKRASSEDTLNKPGSTAASGVVRLKKTATAGAISELTESRLRSGTGAFTTTK

SEQ ID NO: 36368 - protein, 78 aa, Homo sapiens
  ENSP00000461918
MRSAAKPWNPAIRAGGHGPDRVRPLPAASSGMKSSKSSTSLAFESRLSRLKRASSEDTLNKPGSTAASGVVRLKKTAT

SEQ ID NO: 36369 - protein, 132 aa, Homo sapiens
  ENSP00000464489
MRSAAKPWNPAIRAGGHGPDRVRPLPAASSGMKSSKSSTSLAFESRLSRLKRASSEDTLNKPGSTAASGVVRLKKTATAGAISELTESRLRSGTGAFTTTKRTGIPAPREFSVTVSRERSVPRGPSNPRKSV

SEQ ID NO: 36370 - protein, 19 aa, Homo sapiens
  ENSP00000462266
MRSAAKPWNPAIRAGGHGP

SEQ ID NO: 36371 - protein, 21 aa, Homo sapiens
  ENSP00000464639
MRSAAKPWNPAIRAGGHGPDR

SEQ ID NO: 36372 - protein, 790 aa, Homo sapiens
  ENSP00000378900
MRSAAKPWNPAIRAGGHGPDRVRPLPAASSGMKSSKSSTSLAFESRLSRLKRASSEDTLNKPGSTAASGVVRLKKTATAGAISELTESRLRSGTGAFTTTKRTGIPAPREFSVTVSRERSVPRGPSNPRKSVSSPTSSNTPTPTKHLRTPSTKPKQENEGGEKAALESQVRELLAEAKAKDSEINRLRSELKKYKEKRTLNAEGTDALGPNVDGTSVSPGDTEPMIRALEEKNKNFQKELSDLEEENRVLKEKLIYLEHSPNSEGAASHTGDSSCPTSITQESSFGSPTGNQMSSDIDEYKKNIHGNALRTSGSSSSDVTKASLSPDASDFEHITAETPSRPLSSTSNPFKSSKCSTAGSSPNSVSELSLASLTEKIQKMEENHHSTAEELQATLQELSDQQQMVQELTAENEKLVDEKTILETSFHQHRERAEQLSQENEKLMNLLQERVKNEEPTTQEGKIIELEQKCTGILEQGRFEREKLLNIQQQLTCSLRKVEEENQGALEMIKRLKEENEKLNEFLELERHNNNMMAKTLEECRVTLEGLKMENGSLKSHLQGEKQKATEASAVEQTAESCEVQEMLKVARAEKDLLELSCNELRQELLKANGEIKHVSSLLAKVEKDYSYLKEICDHQAEQLSRTSLKLQEKASESDAEIKDMKETIFELEDQVEQHRAVKLHNNQLISELESSVIKLEEQKSDLERQLKTLTKQMKEETEEWRRFQADLQTAVVVANDIKCEAQQELRTVKRKLLEEEEKNARLQKELGDVQGHGRVVTSRAAPPSLGSVS

SEQ ID NO: 36373 - protein, 1068 aa, Homo sapiens; identical to SEQ ID NO: 36366
  ENSP00000261503

SEQ ID NO: 36374 - protein, 102 aa, Homo sapiens
  ENSP00000464341
MRSAAKPWNPAIRAGGHGPDRVRPLPAASSGMKSSKSSTSLAFESRLSRLKRASSEDTLNKPGSTAASGVVRLKKTATAGAISELTESRLRSGTGAFTTTKR

SEQ ID NO: 36375 - protein, 73 aa, Homo sapiens
  ENSP00000461944
MRSAAKPWNPAIRAGGHGPDRVRPLPAASSGMKSSKSSTSLAFESRLSRLKRASSEDTLNKPGSTAASGVVRL

SEQ ID NO: 36376 - protein, 987 aa, Homo sapiens
  ENSP00000378901
MGNHSGRPEDPEPGAFTTTKRTGIPAPREFSVTVSRERSVPRGPSNPRKSVSSPTSSNTPTPTKHLRTPSTKPKQENEGGEKAALESQVRELLAEAKAKDSEINRLRSELKKYKEKRTLNAEGTDALGPNVDGTSVSPGDTEPMIRALEEKNKNFQKELSDLEEENRVLKEKLIYLEHSPNSEGAASHTGDSSCPTSITQESSFGSPTGNQMSSDIDEYKKNIHGNALRTSGSSSSDVTKASLSPDASDFEHITAETPSRPLSSTSNPFKSSKCSTAGSSPNSVSELSLASLTEKIQKMEENHHSTAEELQATLQELSDQQQMVQELTAENEKLVDEKTILETSFHQHRERAEQLSQENEKLMNLLQERVKNEEPTTQEGKIIELEQKCTGILEQGRFEREKLLNIQQQLTCSLRKVEEENQGALEMIKRLKEENEKLNEFLELERHNNNMMAKTLEECRVTLEGLKMENGSLKSHLQGEKQKATEASAVEQTAESCEVQEMLKVARAEKDLLELSCNELRQELLKANGEIKHVSSLLAKVEKDYSYLKEICDHQAEQLSRTSLKLQEKASESDAEIKDMKETIFELEDQVEQHRAVKLHNNQLISELESSVIKLEEQKSDLERQLKTLTKQMKEETEEWRRFQADLQTAVVVANDIKCEAQQELRTVKRKLLEEEEKNARLQKELGDVQGHGRVVTSRAAPPPVDEEPESSEVDAAGRWPGVCVSRTSPTPPESATTVKSLIKSFDLGRPGGAGQNISVHKTPRSPLSGIPVRTAPAAAVSPMQRHSTYSSVRPASRGVTQRLDLPDLPLSDILKGRTETLKPDPHLRKSPSLESLSRPPSLGFGDTRLLSASTRAWKPQSKLSVERKDPLAALAREYGGSKRNALLKWCQKKTQGYANIDITNFSSSWSDGLAFCALLHTYLPAHIPYQELNSQEKKRNLLLAFEAAESVGIKPSLELSEMLYTDRPDWQSVMQYVAQIYKYFET

SEQ ID NO: 36377 - protein, 25 aa, Homo sapiens
  ENSP00000463130
MGNHSGRPEDPEPGGKGLFIPEGDM

SEQ ID NO: 36378 - protein, 703 aa, Homo sapiens
  ENSP00000378893
MGNHSGRPEDPEPGAFTTTKRTGIPAPREFSVTVSRERSVPRGPSNPRKSVSSPTSSNTPTPTKHLRTPSTKPKQENEGGEKAALESQVRELLAEAKAKDSEINRLRSELKKYKEKRTLNAEGTDALGPNVDGTSVSPGDTEPMIRALEEKNKNFQKELSDLEEENRVLKEKLIYLEHSPNSEGAASHTGDSSCPTSITQESSFGSPTGNQMSSDIDEYKKNIHGNALRTSGSSSSDVTKASLSPDASDFEHITAETPSRPLSSTSNPFKSSKCSTAGSSPNSVSELSLASLTEKIQKMEENHHSTAEELQATLQELSDQQQMVQELTAENEKLVDEKTILETSFHQHRERAEQLSQENEKLMNLLQERVKNEEPTTQEGKIIELEQKCTGILEQGRFEREKLLNIQQQLTCSLRKVEEENQGALEMIKRLKEENEKLNEFLELERHNNNMMAKTLEECRVTLEGLKMENGSLKSHLQGEKQKATEASAVEQTAESCEVQEMLKVARAEKDLLELSCNELRQELLKANGEIKHVSSLLAKVEKDYSYLKEICDHQAEQLSRTSLKLQEKASESDAEIKDMKETIFELEDQVEQHRAVKLHNNQLISELESSVIKLEEQKSDLERQLKTLTKQMKEETEEWRRFQADLQTAVVVANDIKCEAQQELRTVKRKLLEEEEKNARLQKELGDVQGHGRVVTSRAAPP

SEQ ID NO: 36379 - protein, 709 aa, Homo sapiens
  ENSP00000378896
MGNHSGRPEDPEPGAFTTTKRTGIPAPREFSVTVSRERSVPRGPSNPRKSVSSPTSSNTPTPTKHLRTPSTKPKQENEGGEKAALESQVRELLAEAKAKDSEINRLRSELKKYKEKRTLNAEGTDALGPNVDGTSVSPGDTEPMIRALEEKNKNFQKELSDLEEENRVLKEKLIYLEHSPNSEGAASHTGDSSCPTSITQESSFGSPTGNQMSSDIDEYKKNIHGNALRTSGSSSSDVTKASLSPDASDFEHITAETPSRPLSSTSNPFKSSKCSTAGSSPNSVSELSLASLTEKIQKMEENHHSTAEELQATLQELSDQQQMVQELTAENEKLVDEKTILETSFHQHRERAEQLSQENEKLMNLLQERVKNEEPTTQEGKIIELEQKCTGILEQGRFEREKLLNIQQQLTCSLRKVEEENQGALEMIKRLKEENEKLNEFLELERHNNNMMAKTLEECRVTLEGLKMENGSLKSHLQGEKQKATEASAVEQTAESCEVQEMLKVARAEKDLLELSCNELRQELLKANGEIKHVSSLLAKVEKDYSYLKEICDHQAEQLSRTSLKLQEKASESDAEIKDMKETIFELEDQVEQHRAVKLHNNQLISELESSVIKLEEQKSDLERQLKTLTKQMKEETEEWRRFQADLQTAVVVANDIKCEAQQELRTVKRKLLEEEEKNARLQKELGDVQGHGRVVTSRAAPPSLGSVS

SEQ ID NO: 36380 - protein, 534 aa, Homo sapiens
  ENSP00000462471
  MOD_RES (1)..(1): Any amino acid
XKVEEENQGALEMIKRLKEENEKLNEFLELERHNNNMMAKTLEECRVTLEGLKMENGSLKSHLQGEKQKATEASAVEQTAESCEVQEMLKVARAEKDLLELSCNELRQELLKANGEIKHVSSLLAKVEKDYSYLKEICDHQAEQLSRTSLKLQEKASESDAEIKDMKETIFELEDQVEQHRAVKLHNNQLISELESSVIKLEEQKSDLERQLKTLTKQMKEETEEWRRFQADLQTAVVVANDIKCEAQQELRTVKRKLLEEEEKNARLQKELGDVQGHGRVVTSRAAPPPVDEEPESSEVDAAGRWPGVCVSRTSPTPPESATTVKSLIKSFDLGRPGGAGQNISVHKTPRSPLSGIPVRTAPAAAVSPMQRHSTYSSVRPASRGVTQRLDLPDLPLSDILKGRTETLKPDPHLRKSPSLESLSRPPSLGFGDTRLLSASTRAWKPQSKLSVERKDPLAALAREYGGSKRNALLKWCQKKTQGYAKRNLLLAFEAAESVGIKPSLELSEMLYTDRPDWQSVMQYVAQIYKYFET

SEQ ID NO: 36381 - protein, 167 aa, Homo sapiens
  ENSP00000462092
  MOD_RES (1)..(1): Any amino acid
XATEASAVEQTAESCEVQEMLKVARAEKDLLELSCNELRQELLKANGEIKHVSSLLAKVEKDYSYLKEICDHQAEQLSRTSLKLQEKASESDAEIKDMKETIFELEDQVEQHRAVKLHNNQLISELESSVIKLEEQKSDLERQLKTLTKQMKKDSPALAMIGSRSHL

SEQ ID NO: 36382 - protein, 202 aa, Homo sapiens
  ENSP00000463799
MLKVARAEKDLLELSCNELRQELLKANGEIKHVSSLLAKVEKDYSYLKEICDHQAEQLSRTSLKLQEKASESDAEIKDMKETIFELEDQVEQHRAVKLHNNQLISELESSVIKLEEQKSDLERQLKTLTKQMKEETEEWRRFQADLQTAVVVANDIKCEAQQELRTVKRKLLEEEEKNARLQKELGDVQGHGRVVTSRAAPP

SEQ ID NO: 36383 - protein, 46 aa, Homo sapiens
  ENSP00000462987
  MOD_RES (1)..(1): Any amino acid
XPAHIPYQELNSQEKKRNLLLAFEAAESVGIKPSLVRILFCILVIL

SEQ ID NO: 36384 - protein, 3267 aa, Homo sapiens
  ENSP00000311684
MQKARGTRGEDAGTRAPPSPGVPPKRAKVGAGGGAPVAVAGAPVFLRPLKNAAVCAGSDVRLRVVVSGTPQPSLRWFRDGQLLPAPAPEPSCLWLRRCGAQDAGVYSCMAQNERGRASCEAVLTVLEVGDSETAEDDISDVQGTQRLELRDDGAFSTPTGGSDTLVGTSLDTPPTSVTGTSEEQVSWWGSGQTVLEQEAGSGGGTRRLPGSPRQAQATGAGPRHLGVEPLVRASRANLVGASWGSEDSLSVASDLYGSAFSLYRGRALSIHVSVPQSGLRREEPDLQPQLASEAPRRPAQPPPSKSALLPPPSPRVGKRSPPGPPAQPAATPTSPHRRTQEPVLPEDTTTEEKRGKKSKSSGPSLAGTAESRPQTPLSEASGRLSALGRSPRLVRAGSRILDKLQFFEERRRSLERSDSPPAPLRPWVPLRKARSLEQPKSERGAPWGTPGASQEELRAPGSVAERRRLFQQKAASLDERTRQRSPASDLELRFAQELGRIRRSTSREELVRSHESLRATLQRAPSPREPGEPPLFSRPSTPKTSRAVSPAAAQPPSPSSAEKPGDEPGRPRSRGPAGRTEPGEGPQQEVRRRDQFPLTRSRAIQECRSPVPPPAADPPEARTKAPPGRKREPPAQAVRFLPWATPGLEGAAVPQTLEKNRAGPEAEKRLRRGPEEDGPWGPWDRRGARSQGKGRRARPTSPELESSDDSYVSAGEEPLEAPVFEIPLQNVVVAPGADVLLKCIITANPPPQVSWHKDGSALRSEGRLLLRAEGERHTLLLREARAADAGSYMATATNELGQATCAASLTVRPGGSTSPFSSPITSDEEYLSPPEEFPEPGETWPRTPTMKPSPSQNRRSSDTGSKAPPTFKVSLMDQSVREGQDVIMSIRVQGEPKPVVSWLRNRQPVRPDQRRFAEEAEGGLCRLRILAAERGDAGFYTCKAVNEYGARQCEARLEVRAHPESRSLAVLAPLQDVDVGAGEMALFECLVAGPTDVEVDWLCRGRLLQPALLKCKMHFDGRKCKLLLTSVHEDDSGVYTCKLSTAKDELTCSARLTVRPSLAPLFTRLLEDVEVLEGRAARFDCKISGTPPPVVTWTHFGCPMEESENLRLRQDGGLHSLHIAHVGSEDEGLYAVSAVNTHGQAHCSAQLYVEEPRTAASGPSSKLEKMPSIPEEPEQGELERLSIPDFLRPLQDLEVGLAKEAMLECQVTGLPYPTISWFHNGHRIQSSDDRRMTQYRDVHRLVFPAVGPQHAGVYKSVIANKLGKAACYAHLYVTDVVPGPPDGAPQVVAVTGRMVTLTWNPPRSLDMAIDPDSLTYTVQHQVLGSDQWTALVTGLREPGWAATGLRKGVQHIFRVLSTTVKSSSKPSPPSEPVQLLEHGPTLEEAPAMLDKPDIVYVVEGQPASVTVTFNHVEAQVVWRSCRGALLEARAGVYELSQPDDDQYCLRICRVSRRDMGALTCTARNRHGTQTCSVTLELAEAPRFESIMEDVEVGAGETARFAVVVEGKPLPDIMWYKDEVLLTESSHVSFVYEENECSLVVLSTGAQDGGVYTCTAQNLAGEVSCKAELAVHSAQTAMEVEGVGEDEDHRGRRLSDFYDIHQEIGRGAFSYLRRIVERSSGLEFAAKFIPSQAKPKASARREARLLARLQHDCVLYFHEAFERRRGLVIVTELCTEELLERIARKPTVCESEIRAYMRQVLEGIHYLHQSHVLHLDVKPENLLVWDGAAGEQQVRICDFGNAQELTPGEPQYCQYGTPEFVAPEIVNQSPVSGVTDIWPVGVVAFLCLTGISPFVGENDRTTLMNIRNYNVAFEETTFLSLSREARGFLIKVLVQDRLRPTAEETLEHPWFKTQAKGAEVSTDHLKLFLSRRRWQRSQISYKCHLVLRPIPELLRAPPERVWVTMPRRPPPSGGLSSSSDSEEEELEELPSVPRPLQPEFSGSRVSLTDIPTEDEALGTPETGAATPMDWQEQGRAPSQDQEAPSPEALPSPGQEPAAGASPRRGELRRGSSAESALPRAGPRELGRGLHKAASVELPQRRSPSPGATRLARGGLGEGEYAQRLQALRQRLLRGGPEDGKVSGLRGPLLESLGGRARDPRMARAASSEAAPHHQPPLENRGLQKSSSFSQGEAEPRGRHRRAGAPLEIPVARLGARRLQESPSLSALSEAQPSSPARPSAPKPSTPKSAEPSATTPSDAPQPPAPQPAQDKAPEPRPEPVRASKPAPPPQALQTLALPLTPYAQIIQSLQLSGHAQGPSQGPAAPPSEPKPHAAVFARVASPPPGAPEKRVPSAGGPPVLAEKARVPTVPPRPGSSLSSSIENLESEAVFEAKFKRSRESPLSLGLRLLSRSRSEERGPFRGAEEEDGIYRPSPAGTPLELVRRPERSRSVQDLRAVGEPGLVRRLSLSLSQRLRRTPPAQRHPAWEARGGDGESSEGGSSARGSPVLAMRRRLSFTLERLSSRLQRSGSSEDSGGASGRSTPLFGRLRRATSEGESLRRLGLPHNQLAAQAGATTPSAESLGSEASATSGSSAPGESRSRLRWGFSRPRKDKGLSPPNLSASVQEELGHQYVRSESDFPPVFHIKLKDQVLLEGEAATLLCLPAACPAPHISWMKDKKSLRSEPSVIIVSCKDGRQLLSIPRAGKRHAGLYECSATNVLGSITSSCTVAVARVPGKLAPPEVPQTYQDTALVLWKPGDSRAPCTYTLERRVDGESVWHPVSSGIPDCYYNVTHLPVGVTVRFRVACANRAGQGPFSNSSEKVFVRGTQDSSAVPSAAHQEAPVTSRPARARPPDSPTSLAPPLAPAAPTPPSVTVSPSSPPTPPSQALSSLKAVGPPPQTPPRRHRGLQAARPAEPTLPSTHVTPSEPKPFVLDTGTPIPASTPQGVKPVSSSTPVYVVTSFVSAPPAPEPPAPEPPPEPTKVTVQSLSPAKEVVSSPGSSPRSSPRPEGTTLRQGPPQKPYTFLEEKARGRFGVVRACRENATGRTFVAKIVPYAAEGKRRVLQEYEVLRTLHHERIMSLHEAYITPRYLVLIAESCGNRELLCGLSDRFRYSEDDVATYMVQLLQGLDYLHGHHVLHLDIKPDNLLLAPDNALKIVDFGSAQPYNPQALRPLGHRTGTLEFMAPEMVKGEPIGSATDIWGAGVLTYIMLSGRSPFYEPDPQETEARIVGGRFDAFQLYPNTSQSATLFLRKVLSVHPWSRPSLQDCLAHPWLQDAYLMKLRRQTLTFTTNRLKEFLGEQRRRRAEAATRHKVLLRSYPGGP

SEQ ID NO: 36385 - protein, 187 aa, Homo sapiens
  ENSP00000393134
MLLTFQRGPAGGENRPFPPGLWPTHPCEVFRSCRKQSYDSETAEDDISDVQGTQRLELRDDGAFSTPTGGSDTLVGTSLDTPPTSVTGTSEEQVSWWGSGQTVLEQEAGSGGGTRRLPGSPSSVPQSGLRREEPDLQPQLASEAPRRPAQPPPSKSALLPPPSPRVGKRSPPGPPAQPAATPTSPHR

SEQ ID NO: 36386 - protein, 53 aa, Homo sapiens
  ENSP00000383902
MKKLWVKKRFQKTGHSRRAFGRLTHGAWTVGVLALAHAYSSSWSLSLCEASSS

SEQ ID NO: 36387 - protein, 299 aa, Homo sapiens
  ENSP00000410986
MKKLWVKKRFQKTGHSRRAFGRLTHVFRSCRKQSYDSETAEDDISDVQGTQRLELRDDGAFSTPTGGSDTLVGTSLDTPPTSVTGTSEEQVSWWGSGQTVLEQEAGSGGGTRRLPGSPSSVPQSGLRREEPDLQPQLASEAPRRPAQPPPSKSALLPPPSPRVGKRSPPGPPAQPAATPTSPHRRTQEPVLPEDTTTEEKRGKKSKSSGPSLAGTAESRPQTPLSEASGRLSALGRSPRLVRAGSRILDKLQFFEERRRSLERSDSPPAPLRPWVPLRKARSLEQPKSERGAPWGTPGA

SEQ ID NO: 36388 - protein, 858 aa, Homo sapiens
  ENSP00000379926
MKKLWVKKRFQKTGHSRRAFGRLTHDSETAEDDISDVQGTQRLELRDDGAFSTPTGGSDTLVGTSLDTPPTSVTGTSEEQVSWWGSGQTVLEQEAGSGGGTRRLPGSPRQAQATGAGPRHLGVEPLVRASRANLVGASWGSEDSLSVASDLYGSAFSLYRGRALSIHVSVPQSGLRREEPDLQPQLASEAPRRPAQPPPSKSALLPPPSPRVGKRSPPGPPAQPAATPTSPHRRTQEPVLPEDTTTEEKRGKKSKSSGPSLAGTAESRPQTPLSEASGRLSALGRSPRLVRAGSRILDKLQFFEERRRSLERSDSPPAPLRPWVPLRKARSLEQPKSERGAPWGTPGASQEELRAPGSVAERRRLFQQKAASLDERTRQRSPASDLELRFAQELGRIRRSTSREELVRSHESLRATLQRAPSPREPGEPPLFSRPSTPKTSRAVSPAAAQPPSPSSAEKPGDEPGRPRSRGPAGRTEPGEGPQQEVRRRDQFPLTRSRAIQECRSPVPPPAADPPEARTKAPPGRKREPPAQAVRFLPWATPGLEGAAVPQTLEKNRAGPEAEKRLRRGPEEDGPWGPWDRRGARSQGKGRRARPTSPELESSDDSYVSAGEEPLEAPVFEIPLQNVVVAPGADVLLKCIITANPPPQVSWHKDGSALRSEGRLLLRAEGERHTLLLREARAADAGSYMATATNELGQATCAASLTVRPGGSTSPFSSPITSDEEYLSPPEEFPEPGETWPRTPTMKPSPSQNRRSSDTGSKAPPTFKVSLMDQSVREGQDVIMSIRVQGEPKPVVSWLRNRQPVRPDQRRFAEEAEGGLCRLRILAAERGDAGFYTCKAVNEYGARQCEARLEVRGE

SEQ ID NO: 36389 - protein, 84 aa, Homo sapiens
  ENSP00000406530
MKKLWVKKRFQKTGHSRRAFGRLTHAKFSAPAESKVTTQRRLRMTSAMCREPSAWSFGMTGPSAPPRGVLTPWWAPPWTHPRPP

SEQ ID NO: 36390 - protein, 53 aa, Homo sapiens; identical to SEQ ID NO: 36386
  ENSP00000397514

SEQ ID NO: 36391 - protein, 184 aa, Homo sapiens
  ENSP00000414549
  MOD_RES (1)..(1): Any amino acid
XETAEDDISDVQGTQRLELRDDGAFSTPTGTSEEQVSWWGSGQTVLEQEAGSGGGTRRLPGSPRQAQATGAGPRHLGVEPLVRASRANLVGASWGSEDSLSVASDLYGSAFSLYRGRALSIHVSVPQSGLRREEPDLQPQLASEAPRRPAQPPPSKSALLPPPSPRVGKRSPPGPPAQPAATPT

SEQ ID NO: 36392 - protein, 43 aa, Homo sapiens
  ENSP00000387344
  MOD_RES (1)..(1): Any amino acid
XSRANLVGASWGSEDSLSVASDLYGSAFSLYRGRALSIHVVFG

SEQ ID NO: 36393 - protein, 113 aa, Homo sapiens
  ENSP00000379919
MKPSPSQNRRSSDTGSKAPPTFKVSLMDQSVREGQDVIMSIRVQGEPKPVVSWLRNRQPVRPDQRRFAEEAEGGLCRLRILAAERGDAGFYTCKAVNEYGARQCEARLEVRGE

SEQ ID NO: 36394 - protein, 113 aa, Homo sapiens; identical to SEQ ID NO: 36393
  ENSP00000379917

SEQ ID NO: 36395 - protein, 113 aa, Homo sapiens; identical to SEQ ID NO: 36393
  ENSP00000379920

SEQ ID NO: 36396 - protein, 343 aa, Homo sapiens
  ENSP00000390353
  MOD_RES (1)..(1): Any amino acid
XMLSGRSPFYEPDPQETEARIVGGRFDAFQLYPNTSQSATLFLRKVLSVHPWSRPSLQDCLAHPWLQDAYLMKLRRQTLTFTTNRLKEFLGEQRRRRAEAATRHKMSKAAPAKKPVAVAPAPGCTLDINDPQVQSAAIRIQASYRGHRSRKELREKGPPRVLEPLKDVVLIEGSAAKLTCRISAFPDPFIRWSKDGKELRDGPKYRYVFEDPDVVALVVRDGELADLGQYSINVTNPFGQCSDSARILVEVPTKIQKGPDNTKARKGTTVTLTAEILGEPAPDVGWTKDGEDIEEDDRVFFEIGSTTTTLTIRRATPQDSGKYEVYVENSLGMDQSFARVDVA

SEQ ID NO: 36397 - protein, 238 aa, Homo sapiens
  ENSP00000479190
MSKAAPAKKPVAVAPAPGCTLDINDPQVQSAAIRIQASYRGHRSRKELREKGPPRVLEPLKDVVLIEGSAAKLTCRISAFPDPFIRWSKDGKELRDGPKYRYVFEDPDVVALVVRDGELADLGQYSINVTNPFGQCSDSARILVEVPTKIQKGPDNTKARKGTTVTLTAEILGEPAPDVGWTKDGEDIEEDDRVFFEIGSTTTTLTIRRATPQDSGKYEVYVENSLGMDQSFARVDVA

SEQ ID NO: 36398 - protein, 654 aa, Homo sapiens
  ENSP00000245222
MNGHLEAEEQQDQRPDQELTGSWGHGPRSTLVRAKAMAPPPPPLAASTPLLHGEFGSYPARGPRFALTLTSQALHIQRLRPKPEARPRGGLVPLAEVSGCCTLRSRSPSDSAAYFCIYTYPRGRRGARRRATRTFRADGAATYEENRAEAQRWATALTCLLRGLPLPGDGEITPDLLPRPPRLLLLVNPFGGRGLAWQWCKNHVLPMISEAGLSFNLIQTERQNHARELVQGLSLSEWDGIVTVSGDGLLHEVLNGLLDRPDWEEAVKMPVGILPCGSGNALAGAVNQHGGFEPALGLDLLLNCSLLLCRGGGHPLDLLSVTLASGSRCFSFLSVAWGFVSDVDIQSERFRALGSARFTLGTVLGLATLHTYRGRLSYLPATVEPASPTPAHSLPRAKSELTLTPDPAPPMAHSPLHRSVSDLPLPLPQPALASPGSPEPLPILSLNGGGPELAGDWGGAGDAPLSPDPLLSSPPGSPKAALHSPVSEGAPVIPPSSGLPLPTPDARVGASTCGPPDHLLPPLGTPLPPDWVTLEGDFVLMLAISPSHLGADLVAAPHARFDDGLVHLCWVRSGISRAALLRLFLAMERGSHFSLGCPQLGYAAARAFRLEPLTPRGVLTVDGEQVEYGPLQAQMHPGIGTLLTGPPGCPGREP

SEQ ID NO: 36399 - protein, 255 aa, Homo sapiens
  ENSP00000471180
MAPPPPPLAASTPLLHGEFGSYPARGPRFALTLTSQALHIQRLRPKPEARPRGGLVPLAEVSGCCTLRSRSPSDSAAYFCIYTYPRGRRGARRRATRTFRADGAATYEENRAEAQRWATALTCLLRGLPLPGDGEITPDLLPRPPRLLLLVNPFGGRGLAWQWCKNHVLPMISEAGLSFNLIQTERQNHARELVQGLSLSEWDGIVTVSGDGLLHEVLNGLLDRPDWEEAVKMPVGILPCGSGNALAGAVNQHGG

SEQ ID NO: 36400 - protein, 595 aa, Homo sapiens
  ENSP00000470092
MNGHLEAEEQQDQALHIQRLRPKPEARPRGGLVPLAEVSGCCTLRSRSPSDSAAYFCIYTYPRGRRGARRRATRTFRADGAATYEENRAEAQRWATALTCLLRGLPLPGDGEITPDLLPRPPRLLLLVNPFGGRGLAWQWCKNHVLPMISEAGLSFNLIQTERQNHARELVQGLSLSEWDGIVTVSGDGLLHEVLNGLLDRPDWEEAVKMPVGILPCGSGNALAGAVNQHGGFEPALGLDLLLNCSLLLCRGGGHPLDLLSVTLASGSRCFSFLSVAWGFVSDVDIQSERFRALGSARFTLGTVLGLATLHTYRGRLSYLPATVEPASPTPAHSLPRAKSELTLTPDPAPPMAHSPLHRSVSDLPLPLPQPALASPGSPEPLPILSLNGGGPELAGDWGGAGDAPLSPDPLLSSPPGSPKAALHSPVSEGAPVIPPSSGLPLPTPDARVGASTCGPPDHLLPPLGTPLPPDWVTLEGDFVLMLAISPSHLGADLVAAPHARFDDGLVHLCWVRSGISRAALLRLFLAMERGSHFSLGCPQLGYAAARAFRLEPLTPRGVLTVDGEQVEYGPLQAQMHPGIGTLLTGPPGCPGREP

SEQ ID NO: 36401 - protein, 654 aa, Homo sapiens; identical to SEQ ID NO: 36398
  ENSP00000469158

SEQ ID NO: 36402 - protein, 49 aa, Homo sapiens
  ENSP00000410044
MNGHLEAEEQQDQRSPLTCYLGRPGCFYWSIPLGVGAWPGSGVRTTCFP

SEQ ID NO: 36403 - protein, 349 aa, Homo sapiens
  ENSP00000471111
MAPPPPPLAASTPLLHGEFGSYPARGPRFALTLTSQALHIQRLRPKPEARPRGGLVPLAEVSGCCTLRSRSPSDSAAYFCIYTYPRGRRGARRRATRTFRADGAATYEENRAEAQRWATALTCLLRGLPLPGDGEITPDLLPRPPRLLLLVNPFGGRGLAWQWCKNHVLPMISEAGLSFNLIQTERQNHARELVQGLSLSEWDGIVTVSGDGLLHEVLNGLLDRPDWEEAVKMPVGILPCGSGNALAGAVNQHGGPREDSDSSTSSSACPLWTTARSCPRAAASMPGSCPLLPQQLALGFSRFIQDRVNGGGGRIGSLTCRGHTQRTLPAPAREGGGSLFLKNINVFIC

SEQ ID NO: 36404 - protein, 133 aa, Homo sapiens
  ENSP00000469448
MAPPPPPLAASTPLLHGEFGSYPARGPRFALTLTSQALHIQRLRPKPEARPRGGLVPLAEVSGCCTLRSRSPSDSAAYFCIYTYPRGRRGARRRATRTFRADGAATYEENRAEAQRWATALTCLLRGLPLPGD

SEQ ID NO: 36405 - protein, 72 aa, Homo sapiens
  ENSP00000470679
MAPPPPPLAASTPLLHGEFGSYPARGPRFALTLTSQALHIQRLRPKPEARPRGGLVPLAEVSGCCTLRSRSP

SEQ ID NO: 36406 - protein, 618 aa, Homo sapiens
  ENSP00000471205
MAPPPPPLAASTPLLHGEFGSYPARGPRFALTLTSQALHIQRLRPKPEARPRGGLVPLAEVSGCCTLRSRSPSDSAAYFCIYTYPRGRRGARRRATRTFRADGAATYEENRAEAQRWATALTCLLRGLPLPGDGEITPDLLPRPPRLLLLVNPFGGRGLAWQWCKNHVLPMISEAGLSFNLIQTERQNHARELVQGLSLSEWDGIVTVSGDGLLHEVLNGLLDRPDWEEAVKMPVGILPCGSGNALAGAVNQHGGFEPALGLDLLLNCSLLLCRGGGHPLDLLSVTLASGSRCFSFLSVAWGFVSDVDIQSERFRALGSARFTLGTVLGLATLHTYRGRLSYLPATVEPASPTPAHSLPRAKSELTLTPDPAPPMAHSPLHRSVSDLPLPLPQPALASPGSPEPLPILSLNGGGPELAGDWGGAGDAPLSPDPLLSSPPGSPKAALHSPVSEGAPVIPPSSGLPLPTPDARVGASTCGPPDHLLPPLGTPLPPDWVTLEGDFVLMLAISPSHLGADLVAAPHARFDDGLVHLCWVRSGISRAALLRLFLAMERGSHFSLGCPQLGYAAARAFRLEPLTPRGVLTVDGEQVEYGPLQAQMHPGIGTLLTGPPGCPGREP

SEQ ID NO: 36407 - protein, 663 aa, Homo sapiens
  ENSP00000472983
MAPPPPPLAASTPLLHGEFGSYPARGPRFALTLTSQALHIQRLRPKPEARPRGGLVPLAEVSGCCTLRSRSPSDSAAYFCIYTYPRGRRGARRRATRTFRADGAATYEENRAEAQRWATALTCLLRGLPLPGDGEITPDLLPRPPRLLLLVNPFGGRGLAWQWCKNHVLPMISEAGLSFNLIQTERQNHARELVQGLSLSEWDGIVTVSGDGLLHEVLNGLLDRPDWEEAVKMPVGILPCGSGNALAGAVNQHGGFEPALGLDLLLNCSLLLCRGGGHPLDLLSVTLASGSRCFSFLSVAWGFVSDVDIQSERFRALGSARFTLGTVLGLATLHTYRGRLSYLPATVEPASPTPAHSLPRAKSELTLTPDPAPPMAHSPLHRSVSDLPLPLPQPALASPGSPEPLPILSLNGGGPELAGDWGGAGDAPLSPDPLLSSPPGSPKAALHSPVSEGAPVIPPSSGLPLPTPDARVGASTCGPPDHLLPPLGTPLPPDWVTLEGDFVLMLAISPSHLGADLVAAPHARFDDGLVHLCWVRSGISRAALLRLFLAMERGSHFSLGCPQLGYAAARAFRLEPLTPRGVLTVDGEQVEYGPLQAQMHPGIARGRTQTPALPAAPALYGRQPGAAHGLQPVCQGAALFFHNSWLWGSQDLFRIVLTEAVGG

SEQ ID NO: 36408 - protein, 448 aa, Homo sapiens
  ENSP00000341091
MISEAGLSFNLIQTERQNHARELVQGLSLSEWDGIVTVSGDGLLHEVLNGLLDRPDWEEAVKMPVGILPCGSGNALAGAVNQHGGFEPALGLDLLLNCSLLLCRGGGHPLDLLSVTLASGSRCFSFLSVAWGFVSDVDIQSERFRALGSARFTLGTVLGLATLHTYRGRLSYLPATVEPASPTPAHSLPRAKSELTLTPDPAPPMAHSPLHRSVSDLPLPLPQPALASPGSPEPLPILSLNGGGPELAGDWGGAGDAPLSPDPLLSSPPGSPKAALHSPVSEGAPVIPPSSGLPLPTPDARVGASTCGPPDHLLPPLGTPLPPDWVTLEGDFVLMLAISPSHLGADLVAAPHARFDDGLVHLCWVRSGISRAALLRLFLAMERGSHFSLGCPQLGYAAARAFRLEPLTPRGVLTVDGEQVEYGPLQAQMHPGIGTLLTGPPGCPGREP

SEQ ID NO: 36409 - protein, 1700 aa, Homo sapiens
  ENSP00000375909
MDGNSLLSVPSNLESSRMYDVLEPQQGRGCGSSGSGPGNSITACKKVLRSNSLLESTDYWLQNQRMPCQIGFVEDKSENCASVCFVNLDVNKDECSTEHLQQKLVNVSPDLPKLISSMNVQQPKENEIVVLSGLASGNLQADFEVSQCPWLPDICLVQCARGNRPNSTNCIIFEINKFLIGLELVQERQLHLETNILKLEDDTNCSLSSIEEDFLTASEHLEEESEVDESRNDYENINVSANVLESKQLKGATQVEWNCNKEKWLYALEDKYINKYPTPLIKTERSPENLTKNTALQSLDPSAKPSQWKREAVGNGRQATHYYHSEAFKGQMEKSQALYIPKDAYFSMMDKDVPSACAVAEQRSNLNPGDHEDTRNALPPRQDGEVTTGKYATNLAESVLQDAFIRLSQSQSTLPQESAVSVSVGSSLLPSCYSTKDTVVSRSWNELPKIVVVQSPDGSDAAPQPGISSWPEMEVSVETSSILSGENSSRQPQSALEVALACAATVIGTISSPQATERLKMEQVVSNFPPGSSGALQTQAPQGLKEPSINEYSFPSALCGMTQVASAVAVCGLGEREEVTCSVAPSGSLPPAAEASEAMPPLCGLASMELGKEAIAKGLLKEAALVLTRPNTYSSIGDFLDSMNRRIMETASKSQTLCSENVVRNELAHTLSNVILRHSIDEVHHKNMIIDPNDNRHSSEILDTLMESTNQLLLDVICFTFKKMSHIVRLGECPAVLSKETIRRRETEPSCQPSDPGASQAWTKATESSSSSPLSNSHNTSLVINNLVDGMYSKQDKGGVRPGLFKNPTLQSQLSRSHRVPDSSTATTSSKEIYLKGIAGEDTKSPHHSENECRASSEGQRSPTVSQSRSGSQEAEESIHPNTQEKYNCATSRINEVQVNLSLLGDDLLLPAQSTLQTKHPDIYCITDFAEELADTVVSMATEIAAICLDNSSGKQPWFCAWKRGSEFLMTPNVPCRSLKRKKESQGSGTAVRKHKPPRLSEIKRKTDEHPELKEKLMNRVVDESMNLEDVPDSVNLFANEVAAKIMNLTEFSMVDGMWQAQGYPRNRLLSGDRWSRLKASSCESIPEEDSEARAYVNSLGLMSTLSQPVSRASSVSKQSSCESITDEFSRFMVNQMENEGRGFELLLDYYAGKNASSILNSAMQQACRKSDHLSVRPSCPSKQSSTESITEEFYRYMLRDIERDSRESASSRRSSQDWTAGLLSPSLRSPVCHRQSSMPDSRSPCSRLTVNVPIKANSLDGFAQNCPQDFLSVQPVSSASSSGLCKSDSCLYRRGGTDHITNMLIHETWASSIEALMRKNKIIVDDAEEADTEPVSGGSPSQAEKCANRLAASRMCSGPTLLVQESLDCPRKDSVTECKQPPVSSLSKTASLTNHSPLDSKKETSSCQDPVPINHKRRSLCSREVPLIQIETDQREACAGEPEPFLSKSSLLEEAEGHSNDKNIPDVVRGGDTAVSACQIHSDSLDTRDVPEAEASTEARAPDEAPNPPSSSEESTGSWTQLANEEDNPDDTSSFLQLSERSMSNGNSSATSSLGIMDLDIYQESMPSSPMINELVEEKKILKGQSESTEAPASGPPTGTASPQRSLLVINFDLEPECPDAELRATLQWIAASELGIPTIYFKKSQENRIEKFLDVVQLVHRKSWKVGDIFHAVVQYCKMHEEQKDGRLSLFDWLLELG

SEQ ID NO: 36410 - protein, 1671 aa, Homo sapiens
  ENSP00000339886
MDGNSLLSVPSNLESSRMYDVLEPQQGRGCGSSGSGPGNSITACKKVLRSNSLLESTDYWLQNQRMPCQIGFVEDKSENCASVCFVNLDVNKDECSTEHLQQKLVNVSPDLPKLISSMNVQQPKENEIVVLSGLASGNLQADFEVSQCPWLPDICLVQCARGNRPNSTNCIIFEINKFLIGLELVQERQLHLETNILKLEDDTNCSLSSIEEDFLTASEHLEEESEVDESRNDYENINVSANVLESKQLKGATQVEWNCNKEKWLYALEDKYINKYPTPLIKTERSPENLTKNTALQSLDPSAKPSQWKREAVGNGRQATHYYHSEAFKGQMEKSQALYIPKDAYFSMMDKDVPSACAVAEQRSNLNPGDHEDTRNALPPRQDGEVTTGKYATNLAESVLQDAFIRLSQSQSTLPQESAVSVSVGSSLLPSCYSTKDTVVSRSWNELPKIVVVQSPDGSDAAPQPGISSWPEMEVSVETSSILSGENSSRQPQSALEVALACAATVIGTISSPQATERLKMEQVVSNFPPGSSGALQTQAPQGLKEPSINEYSFPSALCGMTQVASAVAVCGLGEREEVTCSVAPSGSLPPAAEASEAMPPLCGLASMELGKEAIAKGLLKEAALVLTRPNTYSSIGDFLDSMNRRIMETASKSQTLCSENVVRNELAHTLSNVILRHSIDEVHHKNMIIDPNDNRHSSEILDTLMESTNQLLLDVICFTFKKMSHIVRLGECPAVLSKETIRRRETEPSCQPSDPGASQAWTKATESSSSSPLSNSHNTSLVINNLVDGMYSKQDKGGVRPGLFKNPTLQSQLSRSHRVPDSSTATTSSKEIYLKGIAGEDTKSPHHSENECRASSEGQRSPTVSQSRSGSQEAEESIHPNTQEKYNCATSRINEVQVNLSLLGDDLLLPAQSTLQTKHPDIYCITDFAEELADTVVSMATEIAAICLDNSSGKQPWFCAWKRGSEFLMTPNVPCRSLKRKKESQGSGTAVRKHKPPRLSEIKRKTDEHPELKEKLMNRVVDESMNLEDVPDSVNLFANEVAAKIMNLTEFSMVDGMWQAQGYPRNRLLSGDRWSRLKASSCESIPEEDSEARAYVNSLGLMSTLSQPVSRASSVSKQSSCESITDEFSRFMVNQMENEGRGFELLLDYYAGKNASSILNSAMQQACRKSDHLSVRPSCPSKQSSTESITEEFYRYMLRDIERDSRESASSRRSSQDWTAGLLSPSLRSPVCHRQSSMPDSRSPCSRLTVNVPIKANSLDGFAQNCPQDFLSVQPVSSASSSGLCKSDSCLYRRGGTDHITNMLIHETWASSIEALMRKNKIIVDDAEEADTEPVSGGSPSQAEKCANRLAASRMCSGPTLLVQESLDCPRKDSVTECKQPPVSSLSKTASLTNHSPLDSKKETSSCQDPVPINHKRRSLCSREVPLIQIETDQREACAGEPEPFLSKSSLLEEAEGHSNDKNIPDVVRGGDTAVSACQIHSDSLDTRDVPEAEASTEARAPDEAPNPPSSSEESTGSWTQLANEEDNPDDTSSFLQLSERSMSELVEEKKILKGQSESTEAPASGPPTGTASPQRSLLVINFDLEPECPDAELRATLQWIAASELGIPTIYFKKSQENRIEKFLDVVQLVHRKSWKVGDIFHAVVQYCKMHEEQKDGRLSLFDWLLELG

SEQ ID NO: 36411 - protein, 436 aa, Homo sapiens
  ENSP00000349677
MLKVSAVLCVCAAAWCSQSLAAAAAVAAAGGRSDGGNFLDDKQWLTTISQYDKEVGQWNKFRDEVEDDYFRTWSPGKPFDQALDPAKDPCLKMKCSRHKVCIAQDSQTAVCISHRRLTHRMKEAGVDHRQWRGPILSTCKQCPVVYPSPVCGSDGHTYSFQCKLEYQACVLGKQISVKCEGHCPCPSDKPTSTSRNVKRACSDLEFREVANRLRDWFKALHESGSQNKKTKTLLRPERSRFDTSILPICKDSLGWMFNRLDTNYDLLLDQSELRSIYLDKNEQCTKAFFNSCDTYKDSLISNNEWCYCFQRQQDPPCQTELSNIQKRQGVKKLLGQYIPLCDEDGYYKPTQCHGSVGQCWCVDRYGNEVMGSRINGVADCAIDFEISGDFASGDFHEWTDDEDDEDDIMNDEDEIEDDDEDEGDDDDGGDDHDVYI

SEQ ID NO: 36412 - protein, 433 aa, Homo sapiens
  ENSP00000350153
MLKVSAVLCVCAAAWCSQSLAAAAAVAAAGGRSDGGNFLDDKQWLTTISQYDKEVGQWNKFRDDDYFRTWSPGKPFDQALDPAKDPCLKMKCSRHKVCIAQDSQTAVCISHRRLTHRMKEAGVDHRQWRGPILSTCKQCPVVYPSPVCGSDGHTYSFQCKLEYQACVLGKQISVKCEGHCPCPSDKPTSTSRNVKRACSDLEFREVANRLRDWFKALHESGSQNKKTKTLLRPERSRFDTSILPICKDSLGWMFNRLDTNYDLLLDQSELRSIYLDKNEQCTKAFFNSCDTYKDSLISNNEWCYCFQRQQDPPCQTELSNIQKRQGVKKLLGQYIPLCDEDGYYKPTQCHGSVGQCWCVDRYGNEVMGSRINGVADCAIDFEISGDFASGDFHEWTDDEDDEDDIMNDEDEIEDDDEDEGDDDDGGDDHDVYI

SEQ ID NO: 36413 - protein, 433 aa, Homo sapiens; identical to SEQ ID NO: 36412
  ENSP00000425570

SEQ ID NO: 36414 - protein, 436 aa, Homo sapiens; identical to SEQ ID NO: 36411
  ENSP00000423421

SEQ ID NO: 36415 - protein, 436 aa, Homo sapiens; identical to SEQ ID NO: 36411
  ENSP00000420920

SEQ ID NO: 36416 - protein, 344 aa, Homo sapiens
  ENSP00000441396
MKCSRHKVCIAQDSQTAVCISHRRLTHRMKEAGVDHRQWRGPILSTCKQCPVVYPSPVCGSDGHTYSFQCKLEYQACVLGKQISVKCEGHCPCPSDKPTSTSRNVKRACSDLEFREVANRLRDWFKALHESGSQNKKTKTLLRPERSRFDTSILPICKDSLGWMFNRLDTNYDLLLDQSELRSIYLDKNEQCTKAFFNSCDTYKDSLISNNEWCYCFQRQQDPPCQTELSNIQKRQGVKKLLGQYIPLCDEDGYYKPTQCHGSVGQCWCVDRYGNEVMGSRINGVADCAIDFEISGDFASGDFHEWTDDEDDEDDIMNDEDEIEDDDEDEGDDDDGGDDHDVYI

SEQ ID NO: 36417 - protein, 393 aa, Homo sapiens
  ENSP00000426716
MLKVSAVLCVCAAAWCSQSLAAAAAVAAAGGRSDGGNFLDDKQWLTTISQYDKEVGQWNKFRDDDYFRTWSPGKPFDQALDPAKDPCLKMKCSRHKVCIAQDSQTAVCISHRRLTHRMKEAGVDHRQWRGPILSTCKQCPVVYPSPVCGSDGHTYSFQCKLEYQACVLGKQISVKCEGHCPCPSDKPTSTSRNVKRGFDTSILPICKDSLGWMFNRLDTNYDLLLDQSELRSIYLDKNEQCTKAFFNSCDTYKDSLISNNEWCYCFQRQQDPPCQTELSNIQKRQGVKKLLGQYIPLCDEDGYYKPTQCHGSVGQCWCVDRYGNEVMGSRINGVADCAIDFEISGDFASGDFHEWTDDEDDEDDIMNDEDEIEDDDEDEGDDDDGGDDHDVYI

SEQ ID NO: 36418 - protein, 436 aa, Homo sapiens; identical to SEQ ID NO: 36411
  ENSP00000423606

SEQ ID NO: 36419 - protein, 79 aa, Homo sapiens
  ENSP00000425712
MLKVSAVLCVCAAAWCSQSLAAAAAVAAAGGRSDGGNFLDDKQWLTTISQYDKEVGQWNKFRDDDYFRTWSPGKPFDQG

SEQ ID NO: 36420 - protein, 338 aa, Homo sapiens
  ENSP00000426318
MLKVSAVLCVCAAAWCSQSLAAAAAVAAAGGRSDGGNFLDDKQWLTTISQYDKEVGQWNKFRDCKLEYQACVLGKQISVKCEGHCPCPSDKPTSTSRNVKRACSDLEFREVANRLRDWFKALHESGSQNKKTKTLLRPERSRFDTSILPICKDSLGWMFNRLDTNYDLLLDQSELRSIYLDKNEQCTKAFFNSCDTYKDSLISNNEWCYCFQRQQDPPCQTELSNIQKRQGVKKLLGQYIPLCDEDGYYKPTQCHGSVGQCWCVDRYGNEVMGSRINGVADCAIDFEISGDFASGDFHEWTDDEDDEDDIMNDEDEIEDDDEDEGDDDDGGDDHDVYI

SEQ ID NO: 36421 - protein, 433 aa, Homo sapiens; identical to SEQ ID NO: 36412
  ENSP00000425502

SEQ ID NO: 36422 - protein, 71 aa, Homo sapiens
  ENSP00000424677
MLKVSAVLCVCAAAWCSQSLAAAAAVAAAGGRSDGGNFLDDKQWLTTISQYDKEVGQWNKFRDDERSRSRP

SEQ ID NO: 36423 - protein, 63 aa, Homo sapiens
  ENSP00000424980
MLKVSAVLCVCAAAWCSQSLAAAAAVAAAGGRSDGGNFLDDKQWLTTISQYDKEVGQWNKFRD

SEQ ID NO: 36424 - protein, 64 aa, Homo sapiens
  ENSP00000422170
MLKVSAVLCVCAAAWCSQSLAAAAAVAAAGGRSDGGNFLDDKQWLTTISQYDKEVGQWNKFRDL

SEQ ID NO: 36425 - protein, 313 aa, Homo sapiens
  ENSP00000426177
MLKVSAVLCVCAAAWCSQSLAAAAAVAAAGGRSDGGNFLDDKQWLTTISQYDKEVGQWNKFRDDDYFRTWSPGKPFDQALDPAKDPCLKMKCSRHKVCIAQDSQTAVCISHRRLTHRMKEAGVDHRQWRGPILSTCKQCPVVYPSPVCGSDGHTYSFQCKLEYQACVLGKQISVKCEGHCPCPSDKPTSTSRNVKRACSDLEFREVANRLRDWFKALHESGSQNKKTKTLLRPERSRFDTSILPICKDSLGWMFNRLDTNYDLLLDQSELRSIYLDKNEQCTKAFFNSCDTYKDSLISNNEWCYCFQRQQGKR

SEQ ID NO: 36426 - protein, 172 aa, Homo sapiens
  ENSP00000423176
MLKVSAVLCVCAAAWCSQSLAAAAAVAAAGGRSDGGNFLDDKQWLTTISQYDKEVGQWNKFRDDDYFRTWSPGKPFDQACSDLEFREVANRLRDWFKALHESGSQNKKTKTLLRPERSRFDTSILPICKDSLGWMFNRLDTNYDLLLDQSELRSIYLDKNEQCTKAFFNSCD

SEQ ID NO: 36427 - protein, 83 aa, Homo sapiens
  ENSP00000425859
NFLDDKQWLTTISQYDKEVGQWNKFRDDDYFRTWSPGKPFDQALDPAKDPCLKMKCSRHKVCIAQDSQTAVCISHRRLTHSAN

SEQ ID NO: 36428 - protein, 79 aa, Homo sapiens; identical to SEQ ID NO: 36419
  ENSP00000424674

SEQ ID NO: 36429 - protein, 122 aa, Homo sapiens
  ENSP00000420928
MLKVSAVLCVCAAAWCSQSLAAAAAVAAAGGRSDGGNFLDDKQWLTTISQYDKEVGQWNKFRDEVEDDYFRTWSPGKPFDQALDPAKDPCLKMKCSRHKVCIAQDSQTAVCISHRRLTHSAN

SEQ ID NO: 36430 - protein, 122 aa, Homo sapiens; identical to SEQ ID NO: 36429
  ENSP00000422336

SEQ ID NO: 36431 - protein, 161 aa, Homo sapiens
  ENSP00000423367
MLKVSAVLCVCAAAWCSQSLAAAAAVAAAGGRSDGGNFLDDKQWLTTISQYDKEVGQWNKFRDDDYFRTWSPGKPFDQALDPAKDPCLKMKCSRHKVCIAQDSQTAVCISHRRLTHRMKEAGVDHRQWRGPILSTCKQCPVVYPSPVCGSDGHTYSFQCKL

SEQ ID NO: 36432 - protein, 89 aa, Homo sapiens
  ENSP00000426995
MLKVSAVLCVCAAAWCSQSLAAAAAVAAAGGRSDGGNFLDDKQWLTTISQYDKEVGQWNKFRDDDYFRTWSPGKPFDQALSFHDLGIFV

SEQ ID NO: 36433 - protein, 115 aa, Homo sapiens
  ENSP00000424168
MLKVSAVLCVCAAAWCSQSLAAAAAVAAAGGRSDGGNFLDDKQWLTTISQYDKEVGQWNKFRDEVEDDYFRTWSPGKPFDQALDPAKDPCLKMKCSRHKVCIAQDSQTAVCISHR

SEQ ID NO: 36434 - protein, 115 aa, Homo sapiens; identical to SEQ ID NO: 36433
  ENSP00000425407

SEQ ID NO: 36435 - protein, 385 aa, Homo sapiens
  ENSP00000411344
MITQDHIHMSSGLSQDDYFRTWSPGKPFDQALDPAKDPCLKMKCSRHKVCIAQDSQTAVCISHRRLTHRMKEAGVDHRQWRGPILSTCKQCPVVYPSPVCGSDGHTYSFQCKLEYQACVLGKQISVKCEGHCPCPSDKPTSTSRNVKRACSDLEFREVANRLRDWFKALHESGSQNKKTKTLLRPERSRFDTSILPICKDSLGWMFNRLDTNYDLLLDQSELRSIYLDKNEQCTKAFFNSCDTYKDSLISNNEWCYCFQRQQDPPCQTELSNIQKRQGVKKLLGQYIPLCDEDGYYKPTQCHGSVGQCWCVDRYGNEVMGSRINGVADCAIDFEISGDFASGDFHEWTDDEDDEDDIMNDEDEIEDDDEDEGDDDDGGDDHDVYI

SEQ ID NO: 36436 - protein, 316 aa, Homo sapiens
  ENSP00000444789
MKEAGVDHRQWRGPILSTCKQCPVVYPSPVCGSDGHTYSFQCKLEYQACVLGKQISVKCEGHCPCPSDKPTSTSRNVKRACSDLEFREVANRLRDWFKALHESGSQNKKTKTLLRPERSRFDTSILPICKDSLGWMFNRLDTNYDLLLDQSELRSIYLDKNEQCTKAFFNSCDTYKDSLISNNEWCYCFQRQQDPPCQTELSNIQKRQGVKKLLGQYIPLCDEDGYYKPTQCHGSVGQCWCVDRYGNEVMGSRINGVADCAIDFEISGDFASGDFHEWTDDEDDEDDIMNDEDEIEDDDEDEGDDDDGGDDHDVYI

SEQ ID NO: 36437 - protein, 807 aa, Homo sapiens
  ENSP00000460236
MRLSPAPLKLSRTPALLALALPLAAALAFSDETLDKVPKSEGYCSRILRAQGTRREGYTEFSLRVEGDPDFYKPGTSYRVTLSAAPPSYFRGFTLIALRENREGDKEEDHAGTFQIIDEEETQFMSNCPVAVTESTPRRRTRIQVFWIAPPAGTGCVILKASIVQKRIIYFQDEGSLTKKLCEQDSTFDGVTDKPILDCCACGTAKYRLTFYGNWSEKTHPKDYPRRANHWSAIIGGSHSKNYVLWEYGGYASEGVKQVAELGSPVKMEEEIRQQSDEVLTVIKAKAQWPAWQPLNVRAAPSAEFSVDRTRHLMSFLTMMGPSPDWNVGLSAEDLCTKECGWVQKVVQDLIPWDAGTDSGVTYESPNKPTIPQEKIRPLTSLDHPQSPFYDPEGGSITQVARVVIERIARKGEQCNIVPDNVDDIVADLAPEEKDEDDTPETCIYSNWSPWSACSSSTCDKGKRMRQRMLKAQLDLSVPCPDTQDFQPCMGPGCSDEDGSTCTMSEWITWSPCSISCGMGMRSRERYVKQFPEDGSVCTLPTEETEKCTVNEECSPSSCLMTEWGEWDECSATCGMGMKKRHRMIKMNPADGSMCKAETSQAEKCMMPECHTIPCLLSPWSEWSDCSVTCGKGMRTRQRMLKSLAELGDCNEDLEQVEKCMLPECPIDCELTEWSQWSECNKSCGKGHVIRTRMIQMEPQFGGAPCPETVQRKKCRIRKCLRNPSIQKLRWREARESRRSEQLKEESEGEQFPGCRMRPWTAWSECTKLCGGGIQERYMTVKKRFKSSQFTSCKDKKEIRACNVHPC

SEQ ID NO: 36438 - protein, 331 aa, Homo sapiens
  ENSP00000290902
MENPSPAAALGKALCALLLATLGAAGQPLGGESICSARALAKYSITFTGKWSQTAFPKQYPLFRPPAQWSSLLGAAHSSDYSMWRKNQYVSNGLRDFAERGEAWALMKEIEAAGEALQSVHAVFSAPAVPSGTGQTSAELEVQRRHSLVSFVVRIVPSPDWFVGVDSLDLCDGDRWREQAALDLYPYDAGTDSGFTFSSPNFATIPQDTVTEITSSSPSHPANSFYYPRLKALPPIARVTLVRLRQSPRAFIPPAPVLPSRDNEIVDSASVPETPLDCEVSLWSSWGLCGGHCGRLGTKSRTRYVRVQPANNGSPCPELEEEAECVPDNCV

SEQ ID NO: 36439 - protein, 108 aa, Homo sapiens
  ENSP00000424542
MENPSPAAALGKALCALLLATLGAAGQPLGGESICSARALAKYSITFTGKWSQTAFPKQYPLFRPPAQWSSLLGAAHSSDYSMWRKNQYVSNGLRDFAERGEAWALMK

SEQ ID NO: 36440 - protein, 64 aa, Homo sapiens
  ENSP00000425871
MENPSPAAALGKALCALLLATLGAAGQPLGGESICSARALAKYSITFTGKWSQTAFPKQYPLFR

SEQ ID NO: 36441 - protein, 61 aa, Homo sapiens
  ENSP00000422516
MENPSPAAALGKALCALLLATLGAAGQPLGGESICSARALAKYSITFTGKWSQTAFPKQYP

SEQ ID NO: 36442 - protein, 24 aa, Homo sapiens
  ENSP00000421634
MENPSPAAALGKALCALLLATLGA

SEQ ID NO: 36443 - protein, 16 aa, Homo sapiens
  ENSP00000421379
MENPSPAAALGKALCA

SEQ ID NO: 36444 - protein, 15 aa, Homo sapiens
  ENSP00000423414
MENPSPAAALGKALC

SEQ ID NO: 36445 - protein, 7 aa, Homo sapiens
  ENSP00000421858
MENPSPA

SEQ ID NO: 36446 - protein, 331 aa, Homo sapiens; identical to SEQ ID NO: 36438
  ENSP00000483599

SEQ ID NO: 36447 - protein, 331 aa, Homo sapiens; identical to SEQ ID NO: 36438
  ENSP00000394832

SEQ ID NO: 36448 - protein, 300 aa, Homo sapiens
  ENSP00000237623
MRIAVICFCLLGITCAIPVKQADSGSSEEKQLYNKYPDAVATWLNPDPSQKQNLLAPQTLPSKSNESHDHMDDMDDEDDDDHVDSQDSIDSNDSDDVDDTDDSHQSDESHHSDESDELVTDFPTDLPATEVFTPVVPTVDTYDGRGDSVVYGLRSKSKKFRRPDIQYPDATDEDITSHMESEELNGAYKAIPVAQDLNAPSDWDSRGKDSYETSQLDDQSAETHSHKQSRLYKRKANDESNEHSDVIDSQELSKVSREFHSHEFHSHEDMLVVDPKSKEEDKHLKFRISHELDSASSEVN

SEQ ID NO: 36449 - protein, 314 aa, Homo sapiens
  ENSP00000378517
MRIAVICFCLLGITCAIPVKQADSGSSEEKQLYNKYPDAVATWLNPDPSQKQNLLAPQNAVSSEETNDFKQETLPSKSNESHDHMDDMDDEDDDDHVDSQDSIDSNDSDDVDDTDDSHQSDESHHSDESDELVTDFPTDLPATEVFTPVVPTVDTYDGRGDSVVYGLRSKSKKFRRPDIQYPDATDEDITSHMESEELNGAYKAIPVAQDLNAPSDWDSRGKDSYETSQLDDQSAETHSHKQSRLYKRKANDESNEHSDVIDSQELSKVSREFHSHEFHSHEDMLVVDPKSKEEDKHLKFRISHELDSASSEVN

SEQ ID NO: 36450 - protein, 241 aa, Homo sapiens
  ENSP00000422973
MRIAVICFCLLGITCAIPVKQADSGSSEEKQTLPSKSNESHDHMDDMDDEDDDDHVDSQDSIDSNDSDDVDDTDDSHQSDESHHSDESDELVTDFPTDLPATEVFTPVVPTVDTYDGRGDSVVYGLRSKSKKFRRPDIQYPDATDEDITSHMESEELNGAYKAIPVAQDLNAPSDWDSRGKDSYETSQLDDQSAETHSHKQSRLYKRKANDESNEHSDVIDSQELSKVSREFHSHEFHSHE

SEQ ID NO: 36451 - protein, 287 aa, Homo sapiens
  ENSP00000354042
MRIAVICFCLLGITCAIPVKQADSGSSEEKQNAVSSEETNDFKQETLPSKSNESHDHMDDMDDEDDDDHVDSQDSIDSNDSDDVDDTDDSHQSDESHHSDESDELVTDFPTDLPATEVFTPVVPTVDTYDGRGDSVVYGLRSKSKKFRRPDIQYPDATDEDITSHMESEELNGAYKAIPVAQDLNAPSDWDSRGKDSYETSQLDDQSAETHSHKQSRLYKRKANDESNEHSDVIDSQELSKVSREFHSHEFHSHEDMLVVDPKSKEEDKHLKFRISHELDSASSEVN

SEQ ID NO: 36452 - protein, 292 aa, Homo sapiens
  ENSP00000477824
MRIAVICFCLLGITCAIPVKQADSGSSEEKQLYNKYPDAVATWLNPDPSQKQNLLAPQNAVSSEETNDFKQETLPSKSNESHDHMDDMDDEDDDSHQSDESHHSDESDELVTDFPTDLPATEVFTPVVPTVDTYDGRGDSVVYGLRSKSKKFRRPDIQYPDATDEDITSHMESEELNGAYKAIPVAQDLNAPSDWDSRGKDSYETSQLDDQSAETHSHKQSRLYKRKANDESNEHSDVIDSQELSKVSREFHSHEFHSHEDMLVVDPKSKEEDKHLKFRISHELDSASSEVN

SEQ ID NO: 36453 - protein, 454 aa, Homo sapiens
  ENSP00000467540
MAQMGGKVGDPLWILRKWGLGGCSLELVPGSRTQQASKPASLLPLPQAAPSPPTRLPGSPSLPPRPGSRCPSPAPPEPAREPERKGGGGGRVAAARSPAGASQTTLECTLKPGLVYNKVNPIFHHWSLGDCKFGLTFQSPAEADEFQKSLLAALAALGRGSLTPSSSSSSSSPSQDTAETPCPLTSHVDSDSSSSHSRQETPPSAAAAPIITMESASGFGPTTPPQRRRSSAQSYPPLLPFTGIPEPSEPLAGAGGLGWGGRGYEDYRRSGPPAPLALSTCVVRFAKTGALRGAALGPPAALPAPLTEAAPPAPPARPPPGPGPSSAPAKASPEAEEAARCVHCRALFRRRADGRGGRCAEAPDPGRLLVRRLSCLWCAESLLYHCLSDAEGDFSDPCACEPGHPRPAARWAALAALSLAVPCLCCYAPLRACHWVAARCGCAGCGGRHEEAAR

SEQ ID NO: 36454 - protein, 410 aa, Homo sapiens
  ENSP00000466568
MVRVRAVVMARDDSSGGWLPVGGGGLSQVSVCRVRGARPEGGARQGHYVIHGERLRDQKTTLECTLKPGLVYNKVNPIFHHWSLGDCKFGLTFQSPAEADEFQKSLLAALAALGRGSLTPSSSSSSSSPSQDTAETPCPLTSHVDSDSSSSHSRQETPPSAAAAPIITMESASGFGPTTPPQRRRSSAQSYPPLLPFTGIPEPSEPLAGAGGLGWGGRGYEDYRRSGPPAPLALSTCVVRFAKTGALRGAALGPPAALPAPLTEAAPPAPPARPPPGPGPSSAPAKASPEAEEAARCVHCRALFRRRADGRGGRCAEAPDPGRLLVRRLSCLWCAESLLYHCLSDAEGDFSDPCACEPGHPRPAARWAALAALSLAVPCLCCYAPLRACHWVAARCGCAGCGGRHEEAAR

SEQ ID NO: 36455 - protein, 181 aa, Homo sapiens
  ENSP00000467532
MVRVRAVVMARDDSSGGWLPVGGGGLSQVSVCRVRGARPEGGARQGHYVIHGERLRDQKTTLECTLKPGLVYNKVNPIFHHWSLGDCKFGLTFQSPAEADEFQKSLLAALAALGRGSLTPSSSSSSSSPSQDTAETPCPLTSHVDSDSSSSHSRQETPPSAAAAPIITMESASGFGPTTPP

SEQ ID NO: 36456 - protein, 410 aa, Homo sapiens; identical to SEQ ID NO: 36454
  ENSP00000345405

SEQ ID NO: 36457 - protein, 121 aa, Homo sapiens
  ENSP00000465713
MVRVRAVVMARDDSSGGWLPVGGGGLSQTTLECTLKPGLVYNKVNPIFHHWSLGDCKFGLTFQSPAEADEFQKSLLAALAALGRGSLTPSSSSSSSSPSQDTAETPCPLTLSQYFRHMLCP

SEQ ID NO: 36458 - protein, 273 aa, Homo sapiens
  ENSP00000311609
MGQKLSGSLKSVEVREPALRPAKRELRGAEPGRPARLDQLLDMPAAGLAVQLRHAWNPEDRSLNVFVKDDDRLTFHRHPVAQSTDGIRGKVGHARGLHAWQINWPARQRGTHAVVGVATARAPLHSVGYTALVGSDAESWGWDLGRSRLYHDGKNQPGVAYPAFLGPDEAFALPDSLLVVLDMDEGTLSFIVDGQYLGVAFRGLKGKKLYPVVSAVWGHCEVTMRYINGLDPEPLPLMDLCRRSIRSALGRQRLQDISSLPLPQSLKNYLQYQ

SEQ ID NO: 36459 - protein, 90 aa, Homo sapiens
  ENSP00000422034
  MOD_RES (1)..(1): Any amino acid
XVVLDMDEGTLSFIVDGQYLGVAFRGLKGKKLYPVVSAVWGHCEVTMRYINGLDHGVSLGCPGQSAVARSRLTATSASRVQAILLPQLPE

SEQ ID NO: 36460 - protein, 2328 aa, Homo sapiens
  ENSP00000451752
MTSATEFENVGNQPPYSRINARWDAPDDELDNDNSSARLFERSRIKALADEREVVQKKTFTKWVNSHLARVSCRITDLYKDLRDGRMLIKLLEVLSGEMLPKPTKGKMRIHCLENVDKALQFLKEQRVHLENMGSHDIVDGNHRLVLGLIWTIILRFQIQDIVVQTQEGRETRSAKDALLLWCQMKTAGYPHVNVTNFTSSWKDGLAFNALIHKHRPDLIDFDKLKDSNARHNLEHAFNVAERQLGIIPLLDPEDVFTENPDEKSIITYVVAFYHYFSKMKVLAVEGKRVGKVIDHAIETEKMIEKYSGLASDLLTWIEQTITVLNSRKFANSLTGVQQQLQAFSTYRTVEKPPKFQEKGNLEVLLFTIQSRMRANNQKVYTPHDGKLVSDINRAWESLEEAEYRRELALRNELIRQEKLEQLARRFDRKAAMRETWLSENQRLVAQDNFGYDLAAVEAAKKKHEAIETDTAAYEERVRALEDLAQELEKENYHDQKRITARKDNILRLWSYLQELLQSRRQRLETTLALQKLFQDMLHSIDWMDEIKAHLLSAEFGKHLLEVEDLLQKHKLMEADIAIQGDKVKAITAATLKFTEGKGYQPCDPQVIQDRISHLEQCFEELSNMAAGRKAQLEQSKRLWKFFWEMDEAESWIKEKEQIYSSLDYGKDLTSVLILQRKHKAFEDELRGLDAHLEQIFQEAHGMVARKQFGHPQIEARIKEVSAQWDQLKDLAAFCKKNLQDAENFFQFQGDADDLKAWLQDAHRLLSGEDVGQDEGATRALGKKHKDFLEELEESRGVMEHLEQQAQGFPEEFRDSPDVTHRLQALRELYQQVVAQADLRQQRLQEALDLYTVFGETDACELWMGEKEKWLAEMEMPDTLEDLEVVQHRFDILDQEMKTLMTQIDGVNLAANSLVESGHPRSREVKQYQDHLNTRWQAFQTLVSERREAVDSALRVHNYCVDCEETSKWITDKTKVVESTKDLGRDLAGIIAIQRKLSGLERDVAAIQARVDALERESQQLMDSHPEQKEDIGQRQKHLEELWQGLQQSLQGQEDLLGEVSQLQAFLQDLDDFQAWLSITQKAVASEDMPESLPEAEQLLQQHAGIKDEIDGHQDSYQRVKESGEKVIQGQTDPEYLLLGQRLEGLDTGWNALGRMWESRSHTLAQCLGFQEFQKDAKQAEAILSNQEYTLAHLEPPDSLEAAEAGIRKFEDFLGSMENNRDKVLSPVDSGNKLVAEGNLYSDKIKEKVQLIEDRHRKNNEKAQEASVLLRDNLELQNFLQNCQELTLWINDKLLTSQDVSYDEARNLHNKWLKHQAFVAELASHEGWLENIDAEGKQLMDEKPQFTALVSQKLEALHRLWDELQATTKEKTQHLSAARSSDLRLQTHADLNKWISAMEDQLRSDDPGKDLTSVNRMLAKLKRVEDQVNVRKEELGELFAQVPSMGEEGGDADLSIEKRFLDLLEPLGRRKKQLESSRAKLQISRDLEDETLWVEERLPLAQSADYGTNLQTVQLFMKKNQTLQNEILGHTPRVEDVLQRGQQLVEAAEIDCQDLEERLGHLQSSWDRLREAAAGRLQRLRDANEAQQYYLDADEAEAWIGEQELYVISDEIPKDEEGAIVMLKRHLRQQRAVEDYGRNIKQLASRAQGLLSAGHPEGEQIIRLQGQVDKHYAGLKDVAEERKRKLENMYHLFQLKRETDDLEQWISEKELVASSPEMGQDFDHVTLLRDKFRDFARETGAIGQERVDNVNAFIERLIDAGHSEAATIAEWKDGLNEMWADLLELIDTRMQLLAASYDLHRYFYTGAEILGLIDEKHRELPEDVGLDASTAESFHRVHTAFERELHLLGVQVQQFQDVATRLQTAYAGEKAEAIQNKEQEVSAAWQALLDACAGRRTQLVDTADKFRFFSMARDLLSWMESIIRQIETQERPRDVSSVELLMKYHQGINAEIETRSKNFSACLELGESLLQRQHQASEEIREKLQQVMSRRKEMNEKWEARWERLRMLLEVCQFSRDASVAEAWLIAQEPYLASGDFGHTVDSVEKLIKRHEAFEKSTASWAERFAALEKPTTLELKERQIAERPAEETGPQEEEGETAGEAPVSHHAATERTSPGEEEGTWPQNLQQPPPPGQHKDGQKSTGDERPTTEPLFKVLDTPLSEGDEPATLPAPRDHGQSVQMEGYLGRKHDLEGPNKKASNRSWNNLYCVLRNSELTFYKDAKNLALGMPYHGEEPLALRHAICEIAANYKKKKHVFKLRLSNGSEWLFHGKDEEEMLSWLQGVSTAINESQSIRVKAQSLPLPSLSGPDASLGKKDKEKRFSFFPKKK

SEQ ID NO: 36461 - protein, 1028 aa, Homo sapiens
  ENSP00000451324
GKQLMDEKPQFTALVSQKLEALHRLWDELQATTKEKTQHLSAARSSDLRLQTHADLNKWISAMEDQLRSDDPGKDLTSVNRMLAKLKRVEDQVNVRKEELGELFAQVPSMGEEGGDADLSIEKRFLDLLEPLGRRKKQLESSRAKLQISRDLEDETLWVEERLPLAQSADYGTNLQTVQLFMKKNQTLQNEILGHTPRVEDVLQRGQQLVEAAEIDCQDLEERLGHLQSSWDRLREAAAGRLQRLRDANEAQQYYLDADEAEAWIGEQELYVISDEIPKDEEGAIVMLKRHLRQQRAVEDYGRNIKQLASRAQGLLSAGHPEGEQIIRLQGQVDKHYAGLKDVAEERKRKLENMYHLFQLKRETDDLEQWISEKELVASSPEMGQDFDHVTLLRDKFRDFARETGAIGQERVDNVNAFIERLIDAGHSEAATIAEWKDGLNEMWADLLELIDTRMQLLAASYDLHRYFYTGAEILGLIDEKHRELPEDVGLDASTAESFHRVHTAFERELHLLGVQVQQFQDVATRLQTAYAGEKAEAIQNKEQEVSAAWQALLDACAGRRTQLVDTADKFRFFSMARDLLSWMESIIRQIETQERPRDVSSVELLMKYHQGINAEIETRSKNFSACLELGESLLQRQHQASEEIREKLQQVMSRRKEMNEKWEARWERLRMLLEVCQFSRDASVAEAWLIAQEPYLASGDFGHTVDSVEKLIKRHEAFEKSTASWAERFAALEKPTTLELKERQIAERPAEETGPQEEEGETAGEAPVSHHAATERTSPGEEEGTWPQNLQQPPPPGQHKDGQKSTGDERPTTEPLFKVLDTPLSEGDEPATLPAPRDHGQSVQMEGYLGRKHDLEGPNKKASNSKGEEGEERRETEEEDEEEEETESVAVEMQQHASHVSWNNLYCVLRNSELTFYKDAKNLALGMPYHGEEPLALRHAICEIAANYKKKKHVFKLRLSNGSEWLFHGKDEEEMLSWLQGVSTAINESQSIRVKAQSLPLPSLSGPDASLGKKDKEKRFSFFPKKK

SEQ ID NO: 36462 - protein, 2137 aa, Homo sapiens
  ENSP00000374371
MTSATEFENVGNQPPYSRINARWDAPDDELDNDNSSARLFERSRIKALADEREVVQKKTFTKWVNSHLARVSCRITDLYKDLRDGRMLIKLLEVLSGEMLPKPTKGKMRIHCLENVDKALQFLKEQRVHLENMGSHDIVDGNHRLVLGLIWTIILRFQIQDIVVQTQEGRETRSAKDALLLWCQMKTAGYPHVNVTNFTSSWKDGLAFNALIHKHRPDLIDFDKLKDSNARHNLEHAFNVAERQLGIIPLLDPEDVFTENPDEKSIITYVVAFYHYFSKMKVLAVEGKRVGKVIDHAIETEKMIEKYSGLASDLLTWIEQTITVLNSRKFANSLTGVQQQLQAFSTYRTVEKPPKFQEKGNLEVLLFTIQSRMRANNQKVYTPHDGKLVSDINRAWESLEEAEYRRELALRNELIRQEKLEQLARRFDRKAAMRETWLSENQRLVAQDNFGYDLAAVEAAKKKHEAIETDTAAYEERVRALEDLAQELEKENYHDQKRITARKDNILRLWSYLQELLQSRRQRLETTLALQKLFQDMLHSIDWMDEIKAHLLSAEFGKHLLEVEDLLQKHKLMEADIAIQGDKVKAITAATLKFTEGKGYQPCDPQVIQDRISHLEQCFEELSNMAAGRKAQLEQSKRLWKFFWEMDEAESWIKEKEQIYSSLDYGKDLTSVLILQRKHKAFEDELRGLDAHLEQIFQEAHGMVARKQFGHPQIEARIKEVSAQWDQLKDLAAFCKKNLQDAENFFQFQGDADDLKAWLQDAHRLLSGEDVGQDEGATRALGKKHKDFLEELEESRGVMEHLEQQAQGFPEEFRDSPDVTHRLQALRELYQQVVAQADLRQQRLQEALDLYTVFGETDACELWMGEKEKWLAEMEMPDTLEDLEVVQHRFDILDQEMKTLMTQIDGVNLAANSLVESGHPRSREVKQYQDHLNTRWQAFQTLVSERREAVDSALRVHNYCVDCEETSKWITDKTKVVESTKDLGRDLAGIIAIQRKLSGLERDVAAIQARVDALERESQQLMDSHPEQKEDIGQRQKHLEELWQGLQQSLQGQEDLLGEVSQLQAFLQDLDDFQAWLSITQKAVASEDMPESLPEAEQLLQQHAGIKDEIDGHQDSYQRVKESGEKVIQGQTDPEYLLLGQRLEGLDTGWNALGRMWESRSHTLAQCLGFQEFQKDAKQAEAILSNQEYTLAHLEPPDSLEAAEAGIRKFEDFLGSMENNRDKVLSPVDSGNKLVAEGNLYSDKIKEKVQLIEDRHRKNNEKAQEASVLLRDNLELQNFLQNCQELTLWINDKLLTSQDVSYDEARNLHNKWLKHQAFVAELASHEGWLENIDAEGKQLMDEKPQFTALVSQKLEALHRLWDELQATTKEKTQHLSAARSSDLRLQTHADLNKWISAMEDQLRSDDPGKDLTSVNRMLAKLKRVEDQVNVRKEELGELFAQVPSMGEEGGDADLSIEKRFLDLLEPLGRRKKQLESSRAKLQISRDLEDETLWVEERLPLAQSADYGTNLQTVQLFMKKNQTLQNEILGHTPRVEDVLQRGQQLVEAAEIDCQDLEERLGHLQSSWDRLREAAAGRLQRLRDANEAQQYYLDADEAEAWIGEQELYVISDEIPKDEEGAIVMLKRHLRQQRAVEDYGRNIKQLASRAQGLLSAGHPEGEQIIRLQGQVDKHYAGLKDVAEERKRKLENMYHLFQLKRETDDLEQWISEKELVASSPEMGQDFDHVTLLRDKFRDFARETGAIGQERVDNVNAFIERLIDAGHSEAATIAEWKDGLNEMWADLLELIDTRMQLLAASYDLHRYFYTGAEILGLIDEKHRELPEDVGLDASTAESFHRVHTAFERELHLLGVQVQQFQDVATRLQTAYAGEKAEAIQNKEQEVSAAWQALLDACAGRRTQLVDTADKFRFFSMARDLLSWMESIIRQIETQERPRDVSSVELLMKYHQGINAEIETRSKNFSACLELGESLLQRQHQASEEIREKLQQVMSRRKEMNEKWEARWERLRMLLEVCQFSRDASVAEAWLIAQEPYLASGDFGHTVDSVEKLIKRHEAFEKSTASWAERFAALEKPTTLELKERQIAERPAEETGPQEEEGETAGEAPVSHHAATERTSPVSLWSRLSSSWESLQPEPSHPY

SEQ ID NO: 36463 - protein, 2106 aa, Homo sapiens
  ENSP00000374370
MTSATEFENVGNQPPYSRINARWDAPDDELDNDNSSARLFERSRIKALADEREVVQKKTFTKWVNSHLARVSCRITDLYKDLRDGRMLIKLLEVLSGEMLPKPTKGKMRIHCLENVDKALQFLKEQRVHLENMGSHDIVDGNHRLVLGLIWTIILRFQIQDIVVQTQEGRETRSAKDALLLWCQMKTAGYPHVNVTNFTSSWKDGLAFNALIHKHRPDLIDFDKLKDSNARHNLEHAFNVAERQLGIIPLLDPEDVFTENPDEKSIITYVVAFYHYFSKMKVLAVEGKRVGKVIDHAIETEKMIEKYSGLASDLLTWIEQTITVLNSRKFANSLTGVQQQLQAFSTYRTVEKPPKFQEKGNLEVLLFTIQSRMRANNQKVYTPHDGKLVSDINRAWESLEEAEYRRELALRNELIRQEKLEQLARRFDRKAAMRETWLSENQRLVAQDNFGYDLAAVEAAKKKHEAIETDTAAYEERVRALEDLAQELEKENYHDQKRITARKDNILRLWSYLQELLQSRRQRLETTLALQKLFQDMLHSIDWMDEIKAHLLSAEFGKHLLEVEDLLQKHKLMEADIAIQGDKVKAITAATLKFTEGKGYQPCDPQVIQDRISHLEQCFEELSNMAAGRKAQLEQSKRLWKFFWEMDEAESWIKEKEQIYSSLDYGKDLTSVLILQRKHKAFEDELRGLDAHLEQIFQEAHGMVARKQFGHPQIEARIKEVSAQWDQLKDLAAFCKKNLQDAENFFQFQGDADDLKAWLQDAHRLLSGEDVGQDEGATRALGKKHKDFLEELEESRGVMEHLEQQAQGFPEEFRDSPDVTHRLQALRELYQQVVAQADLRQQRLQEALDLYTVFGETDACELWMGEKEKWLAEMEMPDTLEDLEVVQHRFDILDQEMKTLMTQIDGVNLAANSLVESGHPRSREVKQYQDHLNTRWQAFQTLVSERREAVDSALRVHNYCVDCEETSKWITDKTKVVESTKDLGRDLAGIIAIQRKLSGLERDVAAIQARVDALERESQQLMDSHPEQKEDIGQRQKHLEELWQGLQQSLQGQEDLLGEVSQLQAFLQDLDDFQAWLSITQKAVASEDMPESLPEAEQLLQQHAGIKDEIDGHQDSYQRVKESGEKVIQGQTDPEYLLLGQRLEGLDTGWNALGRMWESRSHTLAQCLGFQEFQKDAKQAEAILSNQEYTLAHLEPPDSLEAAEAGIRKFEDFLGSMENNRDKVLSPVDSGNKLVAEGNLYSDKIKEKVQLIEDRHRKNNEKAQEASVLLRDNLELQNFLQNCQELTLWINDKLLTSQDVSYDEARNLHNKWLKHQAFVAELASHEGWLENIDAEGKQLMDEKPQFTALVSQKLEALHRLWDELQATTKEKTQHLSAARSSDLRLQTHADLNKWISAMEDQLRSDDPGKDLTSVNRMLAKLKRVEDQVNVRKEELGELFAQVPSMGEEGGDADLSIEKRFLDLLEPLGRRKKQLESSRAKLQISRDLEDETLWVEERLPLAQSADYGTNLQTVQLFMKKNQTLQNEILGHTPRVEDVLQRGQQLVEAAEIDCQDLEERLGHLQSSWDRLREAAAGRLQRLRDANEAQQYYLDADEAEAWIGEQELYVISDEIPKDEEGAIVMLKRHLRQQRAVEDYGRNIKQLASRAQGLLSAGHPEGEQIIRLQGQVDKHYAGLKDVAEERKRKLENMYHLFQLKRETDDLEQWISEKELVASSPEMGQDFDHVTLLRDKFRDFARETGAIGQERVDNVNAFIERLIDAGHSEAATIAEWKDGLNEMWADLLELIDTRMQLLAASYDLHRYFYTGAEILGLIDEKHRELPEDVGLDASTAESFHRVHTAFERELHLLGVQVQQFQDVATRLQTAYAGEKAEAIQNKEQEVSAAWQALLDACAGRRTQLVDTADKFRFFSMARDLLSWMESIIRQIETQERPRDVSSVELLMKYHQGINAEIETRSKNFSACLELGESLLQRQHQASEEIREKLQQVMSRRKEMNEKWEARWERLRMLLEVCQFSRDASVAEAWLIAQEPYLASGDFGHTVDSVEKLIKRHEAFEKSTASWAERFAALEKPTTASRGGRRDSRGGSSFPPCGHRENVPGQSLVSFV

SEQ ID NO: 36464 - protein, 2328 aa, Homo sapiens; identical to SEQ ID NO: 36460
  ENSP00000374372

SEQ ID NO: 36465 - protein, 2390 aa, Homo sapiens
  ENSP00000432568
MSSTLSPTDFDSLEIQGQYSDINNRWDLPDSDWDNDSSSARLFERSRIKALADEREAVQKKTFTKWVNSHLARVTCRVGDLYSDLRDGRNLLRLLEVLSGEILPKPTKGRMRIHCLENVDKALQFLKEQKVHLENMGSHDIVDGNHRLTLGLVWTIILRFQIQDISVETEDNKEKKSAKDALLLWCQMKTAGYPNVNVHNFTTSWRDGLAFNAIVHKHRPDLLDFESLKKCNAHYNLQNAFNLAEKELGLTKLLDPEDVNVDQPDEKSIITYVATYYHYFSKMKALAVEGKRIGKVLDHAMEAERLVEKYESLASELLQWIEQTIVTLNDRQLANSLSGVQNQLQSFNSYRTVEKPPKFTEKGNLEVLLFTIQSKLRANNQKVYTPREGRLISDINKAWERLEKAEHERELALRTELIRQEKLEQLAARFDRKAAMRETWLSENQRLVSQDNFGLELAAVEAAVRKHEAIETDIVAYSGRVQAVDAVAAELAAERYHDIKRIAARQHNVARLWDFLRQMVAARRERLLLNLELQKVFQDLLYLMDWMEEMKGRLQSQDLGRHLAGVEDLLQLHELVEADIAVQAERVRAVSASALRFCNPGKEYRPCDPQLVSERVAKLEQSYEALCELAAARRARLEESRRLWRFLWEVGEAEAWVREQQHLLASADTGRDLTGALRLLNKHTALRGEMSGRLGPLKLTLEQGQQLVAEGHPGASQASARAAELQAQWERLEALAEERAQRLAQAASLYQFQADANDMEAWLVDALRLVSSPELGHDEFSTQALARQHRALEEEIRSHRPTLDALREQAAALPPTLSRTPEVQSRVPTLERHYEELQARAGERARALEAALALYTMLSEAGACGLWVEEKEQWLNGLALPERLEDLEVVQQRFETLEPEMNTLAAQITAVNDIAEQLLKANPPGKDRIVNTQEQLNHRWQQFRRLADGKKAALTSALSIQNYHLECTETQAWMREKTKVIESTQGLGNDLAGVLALQRKLAGTERDLEAIAARVGELTREANALAAGHPAQAVAINARLREVQTGWEDLRATMRRREESLGEARRLQDFLRSLDDFQAWLGRTQTAVASEEGPATLPEAEALLAQHAALRGEVERAQSEYSRLRALGEEVTRDQADPQCLFLRQRLEALGTGWEELGRMWESRQGRLAQAHGFQGFLRDARQAEGVLSSQEYVLSHTEMPGTLQAADAAIKKLEDFMSTMDANGERIHGLLEAGRQLVSEGNIHADKIREKADSIERRHKKNQDAAQQFLGRLRDNREQQHFLQDCHELKLWIDEKMLTAQDVSYDEARNLHTKWQKHQAFMAELAANKDWLDKVDKEGRELTLEKPELKALVSEKLRDLHRRWDELETTTQAKARSLFDANRAELFAQSCCALESWLESLQAQLHSDDYGKDLTSVNILLKKQQMLEWEMAVREKEVEAIQAQAKALAQEDQGAGEVERTSRAVEEKFRALCQPMRERCRRLQASREQHQFHRDVEDEILWVTERLPMASSMEHGKDLPSVQLLMKKNQTLQKEIQGHEPRIADLRERQRALGAAAAGPELAELQEMWKRLGHELELRGKRLEDALRAQQFYRDAAEAEAWMGEQELHMMGQEKAKDELSAQAEVKKHQVLEQALADYAQTIHQLAASSQDMIDHEHPESTRISIRQAQVDKLYAGLKELAGERRERLQEHLRLCQLRRELDDLEQWIQEREVVAASHELGQDYEHVTMLRDKFREFSRDTSTIGQERVDSANALANGLIAGGHAARATVAEWKDSLNEAWADLLELLDTRGQVLAAAYELQRFLHGARQALARVQHKQQQLPDGTGRDLNAAEALQRRHCAYEHDIQALSPQVQQVQDDGHRLQKAYAGDKAEEIGRHMQAVAEAWAQLQGSSAARRQLLLDTTDKFRFFKAVRELMLWMDEVNLQMDAQERPRDVSSADLVIKNQQGIKAEIEARADRFSSCIDMGKELLARSHYAAEEISEKLSQLQARRQETAEKWQEKMDWLQLVLEVLVFGRDAGMAEAWLCSQEPLVRSAELGCTVDEVESLIKRHEAFQKSAVAWEERFCALEKLTALEEREKERKRKREEEERRKQPPAPEPTASVPPGDLVGGQTASDTTWDGTQPRPPPSTQAPSVNGVCTDGEPSQPLLGQQRLEHSSFPEGPGPGSGDEANGPRGERQTRTRGPAPSAMPQSRSTESAHAATLPPRGPEPSAQEQMEGMLCRKQEMEAFGKKAANRSWQNVYCVLRRGSLGFYKDAKAASAGVPYHGEVPVSLARAQGSVAFDYRKRKHVFKLGLQDGKEYLFQAKDEAEMSSWLRVVNAAIATASSASGEPEEPVVPSTTRGMTRAMTMPPVSPVGAEGPVVLRSKDGREREREKRFSFFKKNK

SEQ ID NO: 36466 - protein, 2365 aa, Homo sapiens
  ENSP00000433593
MSSTLSPTDFDSLEIQGQYSDINNRWDLPDSDWDNDSSSARLFERSRIKALADEREAVQKKTFTKWVNSHLARVTCRVGDLYSDLRDGRNLLRLLEVLSGEILPKPTKGRMRIHCLENVDKALQFLKEQKVHLENMGSHDIVDGNHRLTLGLVWTIILRFQIQDISVETEDNKEKKSAKDALLLWCQMKTAGYPNVNVHNFTTSWRDGLAFNAIVHKHRPDLLDFESLKKCNAHYNLQNAFNLAEKELGLTKLLDPEDVNVDQPDEKSIITYVATYYHYFSKMKALAVEGKRIGKVLDHAMEAERLVEKYESLASELLQWIEQTIVTLNDRQLANSLSGVQNQLQSFNSYRTVEKPPKFTEKGNLEVLLFTIQSKLRANNQKVYTPREGRLISDINKAWERLEKAEHERELALRTELIRQEKLEQLAARFDRKAAMRETWLSENQRLVSQDNFGLELAAVEAAVRKHEAIETDIVAYSGRVQAVDAVAAELAAERYHDIKRIAARQHNVARLWDFLRQMVAARRERLLLNLELQKVFQDLLYLMDWMEEMKGRLQSQDLGRHLAGVEDLLQLHELVEADIAVQAERVRAVSASALRFCNPGKEYRPCDPQLVSERVAKLEQSYEALCELAAARRARLEESRRLWRFLWEVGEAEAWVREQQHLLASADTGRDLTGALRLLNKHTALRGEMSGRLGPLKLTLEQGQQLVAEGHPGASQASARAAELQAQWERLEALAEERAQRLAQAASLYQFQADANDMEAWLVDALRLVSSPELGHDEFSTQALARQHRALEEEIRSHRPTLDALREQAAALPPTLSRTPEVQSRVPTLERHYEELQARAGERARALEAALALYTMLSEAGACGLWVEEKEQWLNGLALPERLEDLEVVQQRFETLEPEMNTLAAQITAVNDIAEQLLKANPPGKDRIVNTQEQLNHRWQQFRRLADGKKAALTSALSIQNYHLECTETQAWMREKTKVIESTQGLGNDLAGVLALQRKLAGTERDLEAIAARVGELTREANALAAGHPAQAVAINARLREVQTGWEDLRATMRRREESLGEARRLQDFLRSLDDFQAWLGRTQTAVASEEGPATLPEAEALLAQHAALRGEVERAQSEYSRLRALGEEVTRDQADPQCLFLRQRLEALGTGWEELGRMWESRQGRLAQAHGFQGFLRDARQAEGVLSSQEYVLSHTEMPGTLQAADAAIKKLEDFMSTMDANGERIHGLLEAGRQLVSEGNIHADKIREKADSIERRHKKNQDAAQQFLGRLRDNREQQHFLQDCHELKLWIDEKMLTAQDVSYDEARNLHTKWQKHQAFMAELAANKDWLDKVDKEGRELTLEKPELKALVSEKLRDLHRRWDELETTTQAKARSLFDANRAELFAQSCCALESWLESLQAQLHSDDYGKDLTSVNILLKKQQMLEWEMAVREKEVEAIQAQAKALAQEDQGAGEVERTSRAVEEKFRALCQPMRERCRRLQASREQHQFHRDVEDEILWVTERLPMASSMEHGKDLPSVQLLMKKNQTLQKEIQGHEPRIADLRERQRALGAAAAGPELAELQEMWKRLGHELELRGKRLEDALRAQQFYRDAAEAEAWMGEQELHMMGQEKAKDELSAQAEVKKHQVLEQALADYAQTIHQLAASSQDMIDHEHPESTRISIRQAQVDKLYAGLKELAGERRERLQEHLRLCQLRRELDDLEQWIQEREVVAASHELGQDYEHVTMLRDKFREFSRDTSTIGQERVDSANALANGLIAGGHAARATVAEWKDSLNEAWADLLELLDTRGQVLAAAYELQRFLHGARQALARVQHKQQQLPDGTGRDLNAAEALQRRHCAYEHDIQALSPQVQQVQDDGHRLQKAYAGDKAEEIGRHMQAVAEAWAQLQGSSAARRQLLLDTTDKFRFFKAVRELMLWMDEVNLQMDAQERPRDVSSADLVIKNQQGIKAEIEARADRFSSCIDMGKELLARSHYAAEEISEKLSQLQARRQETAEKWQEKMDWLQLVLEVLVFGRDAGMAEAWLCSQEPLVRSAELGCTVDEVESLIKRHEAFQKSAVAWEERFCALEKLTALEEREKERKRKREEEERRKQPPAPEPTASVPPGDLVGGQTASDTTWDGTQPRPPPSTQAPSVNGVCTDGEPSQPLLGQQRLEHSSFPEGPGPGSGDEANGPRGERQTRTRGPAPSAMPQSRSTESAHAATLPPRGPEPSAQEQMEGMLCRKQEMEAFGKKAANRSWQNVYCVLRRGSLGFYKDAKAASAGVPYHGEVPVSLARAQGSVAFDYRKRKHVFKLGLQDGKEYLFQAKDEVSCPSCSSLSVPFQKLPAADSPSFPVLPLFPGLVLCGKTGCVRRPHQAALPV

SEQ ID NO: 36467 - protein, 117 aa, Homo sapiens
  ENSP00000433631
MSSTLSPTDFDSLEIQGQYSDINNRWDLPDSDWDNDSSSARLFERSRIKALADEREAVQKKTFTKWVNSHLARVTCRVGDLYSDLRDGRNLLRLLEVLSGEILPKPTKGRMRIHCLE

SEQ ID NO: 36468 - protein, 2390 aa, Homo sapiens; identical to SEQ ID NO: 36465
  ENSP00000311489

SEQ ID NO: 36469 - protein, 934 aa, Homo sapiens
  ENSP00000482000
MSSTLSPTDFDSLEIQGQYSDINNRWDLPDSDWDNDSSSARLFERSRIKALADEREAVQKKTFTKWVNSHLARVTCRVGDLYSDLRDGRNLLRLLEVLSGEILPKPTKGRMRIHCLENVDKALQFLKEQKVHLENMGSHDIVDGNHRLTLGLVWTIILRFQIQDISVETEDNKEKKSAKDALLLWCQMKTAGYPNVNVHNFTTSWRDGLAFNAIVHKHRPDLLDFESLKKCNAHYNLQNAFNLAEKELGLTKLLDPEDVNVDQPDEKSIITYVATYYHYFSKMKALAVEGKRIGKVLDHAMEAERLVEKYESLASELLQWIEQTIVTLNDRQLANSLSGVQNQLQSFNSYRTVEKPPKFTEKGNLEVLLFTIQSKLRANNQKVYTPREGRLISDINKAWERLEKAEHERELALRTELIRQEKLEQLAARFDRKAAMRETWLSENQRLVSQDNFGLELAAVEAAVRKHEAIETDIVAYSGRVQAVDAVAAELAAERYHDIKRIAARQHNVARLWDFLRQMVAARRERLLLNLELQKVFQDLLYLMDWMEEMKGRLQSQDLGRHLAGVEDLLQLHELVEADIAVQAERVRAVSASALRFCNPGKEYRPCDPQLVSERVAKLTALEEREKERKRKREEEERRKQPPAPEPTASVPPGDLVGGQTASDTTWDGTQPRPPPSTQAPSVNGVCTDGEPSQPLLGQQRLEHSSFPEGPGPGSGDEANGPRGERQTRTRGPAPSAMPQSRSTESAHAATLPPRGPEPSAQEQMEGMLCRKQEMEAFGKKAANRSWQNVYCVLRRGSLGFYKDAKAASAGVPYHGEVPVSLARAQGSVAFDYRKRKHVFKLGLQDGKEYLFQAKDEAEMSSWLRVVNAAIATASSASGEPEEPVVPSTTRGMTRAMTMPPVSPVGAEGPVVLRSKDGREREREKRFSFFKKNK

SEQ ID NO: 36470 - protein, 934 aa, Homo sapiens; identical to SEQ ID NO: 36469
  ENSP00000480692

SEQ ID NO: 36471 - protein, 685 aa, Homo sapiens
  ENSP00000337991
MDFREILMIASKGQGVNNVPKRYSLAVGPPKKDPKVKGVQSAAVQAFLKRKEEELRRKALEEKRRKEELVKKRIELKHDKKARAMAKRTKDNFHGYNGIPIEEKSKKRQATESHTSQGTDREYEMEEENEFLEYNHAESEQEYEEEQEPPKVESKPKVPLKSAPPPMNFTDLLRLAEKKQFEPVEIKVVKKSEERPMTAEELREREFLERKHRRKKLETDGKLPPTVSKKAPSQKESVGTKLSKGSGDRHPSSKGMPLPHAEKKSRPSMANEKHLALSSSKSMPGERIKAGSGNSSQPSLREGHDKPVFNGAGKPHSSTSSPSVPKTSASRTQKSAVEHKAKKSLSHPSHSRPGPMVTPHNKAKSPGVRQPGSSSSSAPGQPSTGVARPTVSSGPVPRRQNGSSSSGPERSISGSKKPTNDSNPSRRTVSGTCGPGQPASSSGGPGRPISGSVSSARPLGSSRGPGRPVSSPHELRRPVSGLGPPGRSVSGPGRSISGSIPAGRTVSNSVPGRPVSSLGPGQTVSSSGPTIKPKCTVVSETISSKNIISRSSNGQMNGMKPPLSGYRAAQGPQRLPFPTGYKRQREYEEEDDDDDEYDSEMEDFIEDEGEPQEEISKHIREIFGYDRKKYKDESDYALRYMESSWKEQQKEEAKSLRLGMQEDLEEMRREEEEMQRRRAKKLKRR

SEQ ID NO: 36472 - protein, 536 aa, Homo sapiens
  ENSP00000362680
MGSNKSKPKDASQRRRSLEPAENVHGAGGGAFPASQTPSKPASADGHRGPSAAFAPAAAEPKLFGGFNSSDTVTSPQRAGPLAGGVTTFVALYDYESRTETDLSFKKGERLQIVNNTEGDWWLAHSLSTGQTGYIPSNYVAPSDSIQAEEWYFGKITRRESERLLLNAENPRGTFLVRESETTKGAYCLSVSDFDNAKGLNVKHYKIRKLDSGGFYITSRTQFNSLQQLVAYYSKHADGLCHRLTTVCPTSKPQTQGLAKDAWEIPRESLRLEVKLGQGCFGEVWMGTWNGTTRVAIKTLKPGTMSPEAFLQEAQVMKKLRHEKLVQLYAVVSEEPIYIVTEYMSKGSLLDFLKGETGKYLRLPQLVDMAAQIASGMAYVERMNYVHRDLRAANILVGENLVCKVADFGLARLIEDNEYTARQGAKFPIKWTAPEAALYGRFTIKSDVWSFGILLTELTTKGRVPYPGMVNREVLDQVERGYRMPCPPECPESLHDLMCQCWRKEPEERPTFEYLQAFLEDYFTSTEPQYQPGENL

SEQ ID NO: 36473 - protein, 536 aa, Homo sapiens; identical to SEQ ID NO: 36472
  ENSP00000362668

SEQ ID NO: 36474 - protein, 542 aa, Homo sapiens
  ENSP00000362659
MGSNKSKPKDASQRRRSLEPAENVHGAGGGAFPASQTPSKPASADGHRGPSAAFAPAAAEPKLFGGFNSSDTVTSPQRAGPLAGGVTTFVALYDYESRTETDLSFKKGERLQIVNNTRKVDVREGDWWLAHSLSTGQTGYIPSNYVAPSDSIQAEEWYFGKITRRESERLLLNAENPRGTFLVRESETTKGAYCLSVSDFDNAKGLNVKHYKIRKLDSGGFYITSRTQFNSLQQLVAYYSKHADGLCHRLTTVCPTSKPQTQGLAKDAWEIPRESLRLEVKLGQGCFGEVWMGTWNGTTRVAIKTLKPGTMSPEAFLQEAQVMKKLRHEKLVQLYAVVSEEPIYIVTEYMSKGSLLDFLKGETGKYLRLPQLVDMAAQIASGMAYVERMNYVHRDLRAANILVGENLVCKVADFGLARLIEDNEYTARQGAKFPIKWTAPEAALYGRFTIKSDVWSFGILLTELTTKGRVPYPGMVNREVLDQVERGYRMPCPPECPESLHDLMCQCWRKEPEERPTFEYLQAFLEDYFTSTEPQYQPGENL

SEQ ID NO: 36475 - protein, 536 aa, Homo sapiens; identical to SEQ ID NO: 36472
  ENSP00000350941

SEQ ID NO: 36476 - protein, 1183 aa, Homo sapiens
  ENSP00000480869
MGNAPSQDPERSSPPMLSADDAEYPREYRTLGGGGGGGSGGRRFSNVGLVHTSERRHTVIAAQSLEALSGLQKADADRKRDAFMDHLKSKYPQHALALRGQQDRMREQPNYWSFKTRSSRHTQGAQPGLADQAAKLSYASAESLETMSEAELPLGFSRMNRFRQSLPLSRSASQTKLRSPGVLFLQFGEETRRVHITHEVSSLDTLHALIAHMFPQKLTMGMLKSPNTAILIKDEARNVFYELEDVRDIQDRSIIKIYRKEPLYAAFPGSHLTNGDLRREMVYASRESSPTRRLNNLSPAPHLASGSPPPGLPSGLPSGLQSGSPSRSRLSYAGGRPPSYAGSPVHHAAERLGGAPAAQGVSPSPSAILERRDVKPDEDLASKAGGMVLVKGEGLYADPYGLLHEGRLSLAAAAGDPFAYPGAGGLYKRGSVRSLSTYSAAALQSDLEDSLYKAAGGGGPLYGDGYGFRLPPSSPQKLADVAAPPGGPPPPHSPYSGPPSRGSPVRQSFRKDSGSSSVFAESPGGKTRSAGSASTAGAPPSELFPGPGERSLVGFGPPVPAKDTETRERMEAMEKQIASLTGLVQSALLRGSEPETPSEKIEGSNGAATPSAPCGSGGRSSGATPVSGPPPPSASSTPAGQPTAVSRLQMQLHLRGLQNSASDLRGQLQQLRKLQLQNQESVRALLKRTEAELSMRVSEAARRQEDPLQRQRTLVEEERLRYLNDEELITQQLNDLEKSVEKIQRDVSHNHRLVPGPELEEKALVLKQLGETLTELKAHFPGLQSKMRVVLRVEVEAVKFLKEEPQRLDGLLKRCRGVTDTLAQIRRQVDEGVWPPPNNLLSQSPKKVTAETDFNKSVDFEMPPPSPPLNLHELSGPAEGASLTPKGGNPTKGLDTPGKRSVDKAVSVEAAERDWEEKRAALTQYSAKDINRLLEETQAELLKAIPDLDCASKAHPGPAPTPDHKPPKAPHGQKAAPRTEPSGRRGSDELTVPRYRTEKPSKSPPPPPPRRSFPSSHGLTTTRTGEVVVTSKKDSAFIKKAESEELEVQKPQVKLRRAVSEVARPASTPPIMASAIKDEDDEDRIIAELESGGGSVPPMKVVTPGASRLKAAQGQAGSPDKSKHGKQRAEYMRIQAQQQATKPSKEMSGSNETSSPVSEKPSASRTSIPVLTSFGARNSSISF

SEQ ID NO: 36477 - protein, 1217 aa, Homo sapiens
  ENSP00000488014
MGNAPSQDPERSSPPMLSADDAEYPREYRTLGGGGGGGSGGRRFSNVGLVHTSERRHTVIAAQSLEALSGLQKADADRKRDAFMDHLKSKYPQHALALRGQQDRMREQVGGWTVDPVCLLSSLCSHLHGDSAPSGAGQPAQQPNYWSFKTRSSRHTQGAQPGLADQAAKLSYASAESLETMSEAELPLGFSRMNRFRQSLPLSRSASQTKLRSPGVLFLQFGEETRRVHITHEVSSLDTLHALIAHMFPQKLTMGMLKSPNTAILIKDEARNVFYELEDVRDIQDRSIIKIYRKEPLYAAFPGSHLTNGDLRREMVYASRESSPTRRLNNLSPAPHLASGSPPPGLPSGLPSGLQSGSPSRSRLSYAGGRPPSYAGSPVHHAAERLGGAPAAQGVSPSPSAILERRDVKPDEDLASKAGGMVLVKGEGLYADPYGLLHEGRLSLAAAAGDPFAYPGAGGLYKRGSVRSLSTYSAAALQSDLEDSLYKAAGGGGPLYGDGYGFRLPPSSPQKLADVAAPPGGPPPPHSPYSGPPSRGSPVRQSFRKDSGSSSVFAESPGGKTRSAGSASTAGAPPSELFPGPGERSLVGFGPPVPAKDTETRERMEAMEKQIASLTGLVQSALLRGSEPETPSEKIEGSNGAATPSAPCGSGGRSSGATPVSGPPPPSASSTPAGQPTAVSRLQMQLHLRGLQNSASDLRGQLQQLRKLQLQNQESVRALLKRTEAELSMRVSEAARRQEDPLQRQRTLVEEERLRYLNDEELITQQLNDLEKSVEKIQRDVSHNHRLVPGPELEEKALVLKQLGETLTELKAHFPGLQSKMRVVLRVEVEAVKFLKEEPQRLDGLLKRCRGVTDTLAQIRRQVDEGVWPPPNNLLSQSPKKVTAETDFNKSVDFEMPPPSPPLNLHELSGPAEGASLTPKGGNPTKGLDTPGKRSVDKAVSVEAAERDWEEKRAALTQYSAKDINRLLEETQAELLKAIPDLDCASKAHPGPAPTPDHKPPKAPHGQKAAPRTEPSGRRGSDELTVPRYRTEKPSKSPPPPPPRRSFPSSHGLTTTRTGEVVVTSKKDSAFIKKAESEELEVQKPQVKLRRAVSEVARPASTPPIMASAIKDEDDEDRIIAELESGGGSVPPMKVVTPGASRLKAAQGQAGSPDKSKHGKQRAEYMRIQAQQQATKPSKEMSGSNETSSPVSEKPSASRTSIPVLTSFGARNSSISF

SEQ ID NO: 36478 - protein, 928 aa, Homo sapiens
  ENSP00000488440
  MOD_RES (1)..(1): Any amino acid
XFPQKLTMGMLKSPNTAILIKDEARNVFYELEDVRDIQDRSIIKIYRKEPLYAAFPGSHLTNGDLRREMVYASRESSPTRRLNNLSPAPHLASGSPPPGLPSGLPSGLQSGSPSRSRLSYAGGRPPSYAGSPVHHAAERLGGAPAAQGVSPSPSAILERRDVKPDEDLASKAGGMVLVKGEGLYADPYGLLHEGRLSLAAAAGDPFAYPGAGGLYKRGSVRSLSTYSAAALQSDLEDSLYKAAGGGGPLYGDGYGFRLPPSSPQKLADVAAPPGGPPPPHSPYSGPPSRGSPVRQSFRKDSGSSSVFAESPGGKTRSAGSASTAGAPPSELFPGPGERSLVGFGPPVPAKDTETRERMEAMEKQIASLTGLVQSALLRGSEPETPSEKIEGSNGAATPSAPCGSGGRSSGATPVSGPPPPSASSTPAGQPTAVSRLQMQLHLRGLQNSASDLRGQLQQLRKLQLQNQESVRALLKRTEAELSMRVSEAARRQEDPLQRQRTLVEEERLRYLNDEELITQQLNDLEKSVEKIQRDVSHNHRLVPGPELEEKALVLKQLGETLTELKAHFPGLQSKMRVVLRVEVEAVKFLKEEPQRLDGLLKRCRGVTDTLAQIRRQVDEGVWPPPNNLLSQSPKKVTAETDFNKSVDFEMPPPSPPLNLHELSGPAEGASLTPKGGNPTKGLDTPGKRSVDKAVSVEAAERDWEEKRAALTQYSAKDINRLLEETQAELLKAIPDLDCASKAHPGPAPTPDHKPPKAPHGQKAAPRTEPSGRRGSDELTVPRYRTEKPSKSPPPPPPRRSFPSSHGLTTTRTGEVVVTSKKDSAFIKKAESEELEVQKPQVKLRRAVSEVARPASTPPIMASAIKDEDDEDRIIAELESGGGSVPPMKVVTPGASRLKAAQGQAGSPDKSKHGKQRAEYMRIQAQQQV

SEQ ID NO: 36479 - protein, 306 aa, Homo sapiens
  ENSP00000488254
  MOD_RES (1)..(1): Any amino acid
XSEELEVQKPQVKLRRAVSEVARPASTPPIMASAIKDEDDEDRIIAELEVFERSSVSSLPPTPRRQLIPTLLSPQDLGPPGGSAPGPTRKAAPGPRAFCVPRIILTECAPNPPSPPEARLEELGPRTAPTPRPQTLADSTRGWDGPQSPPGVVGETSGPRSSFMPRKEGAALKRLGGGGSSLEDGGARVQCPQGPAQDGTPETSTADTYPEEILKDSGHDAQTCSREHQGQAAANSGRTTWGATAQQMDSLEETLRELEATLSNMGTGPAMGSPGSPPPLPLRPQVAARFSSSSAAFLLHFQSQTE

SEQ ID NO: 36480 - protein, 473 aa, Homo sapiens
  ENSP00000487679
MQPWQCLRRFALAWWERTAEGRARSPREEAGPRDPGGRGEPDPERSSPPMLSADDAEYPREYRTLGGGGGGGSGGRRFSNVGLVHTSERRHTVIAAQSLEALSGLQKADADRKRDAFMDHLKSKYPQHALALRGQQDRMREQVGGWTVDPVCLLSSLCSHLHGDSAPSGAGQPAQTRSSRHTQGAQPGLADQAAKLSYASAESLETMSEAELPLGFSRMNRFRQSLPLSRSASQTKLRSPGVLFLQFGEETRRVHITHEVSSLDTLHALIAHMFPQKLTMGMLKSPNTAILIKDEARNVFYELEDVRDIQDRSIIKIYRKEPLYAAFPGSHLTNGDLRREMVYASRESSPTRRLNNLSPAPHLASGSPPPGLPSGLPSGLQSGSPSRSRLSYAGGRPPSYAGSPVHHAAERLGGAPAAQGVSPSPSAILERRDVKPDEDLASKAGGMVLVKGEGLYADPYGLLHEGRLSLAAA

SEQ ID NO: 36481 - protein, 1183 aa, Homo sapiens; identical to SEQ ID NO: 36476
  ENSP00000484715

SEQ ID NO: 36482 - protein, 1217 aa, Homo sapiens; identical to SEQ ID NO: 36477
  ENSP00000483931

SEQ ID NO: 36483 - protein, 928 aa, Homo sapiens; identical to SEQ ID NO: 36478
  ENSP00000479718
  MOD_RES (1)..(1): Any amino acid

SEQ ID NO: 36484 - protein, 306 aa, Homo sapiens; identical to SEQ ID NO: 36479
  ENSP00000477811
  MOD_RES (1)..(1): Any amino acid

SEQ ID NO: 36485 - protein, 473 aa, Homo sapiens; identical to SEQ ID NO: 36480
  ENSP00000478342

SEQ ID NO: 36486 - protein, 1085 aa, Homo sapiens
  ENSP00000347198
MSTPSRFKKDKEIIAEYESQVKEIRAQLVEQQKCLEQQTEMRVQLLQDLQDFFRKKAEIETEYSRNLEKLAERFMAKTRSTKDHQQYKKDQNLLSPVNCWYLLLNQVRRESKDHATLSDIYLNNVIMRFMQISEDSTRMFKKSKEIAFQLHEDLMKVLNELYTVMKTYHMYHAESISAESKLKEAEKQEEKQIGRSGDPVFHIRLEERHQRRSSVKKIEKMKEKRQAKYSENKLKSIKARNEYLLTLEATNASVFKYYIHDLSDLIDCCDLGYHASLNRALRTYLSAEYNLETSRHEGLDIIENAVDNLEPRSDKQRFMEMYPAAFCPPMKFEFQSHMGDEVCQVSAQQPVQAELMLRYQQLQSRLATLKIENEEVKKTTEATLQTIQDMVTIEDYDVSECFQHSRSTESVKSTVSETYLSKPSIAKRRANQQETEQFYFMKLREYLEGSNLITKLQAKHDLLQRTLGEGHRAEYMTTRPPNVPPKPQKHRKSRPRSQYNTKLFNGDLETFVKDSGQVIPLIVESCIRFINLYGLQHQGIFRVSGSQVEVNDIKNSFERGENPLADDQSNHDINSVAGVLKLYFRGLENPLFPKERFNDLISCIRIDNLYERALHIRKLLLTLPRSVLIVMRYLFAFLNHLSQYSDENMMDPYNLAICFGPTLMPVPEIQDQVSCQAHVNEIIKTIIIHHETIFPDAKELDGPVYEKCMAGDDYCDSPYSEHGTLEEVDQDAGTEPHTSEDECEPIEAIAKFDYVGRSARELSFKKGASLLLYHRASEDWWEGRHNGIDGLVPHQYIVVQDMDDTFSDTLSQKADSEASSGPVTEDKSSSKDMNSPTDRHPDGYLARQRKRGEPPPPVRRPGRTSDGHCPLHPPHALSNSSVDLGSPSLASHPRGLLQNRGLNNDSPERRRRPGHGSLTNISRHDSLKKIDSPPIRRSTSSGQYTGFNDHKPLDPETIAQDIEETMNTALNELRELERQSTAKHAPDVVLDTLEQVKNSPTPATSTESLSPLHNVALRSSEPQIRRSTSSSSDTMSTFKPMVAPRMGVQLKPPALRPKPAVLPKTNPTIGPAPPPQGPTDKSCTM

SEQ ID NO: 36487 - protein, 1022 aa, Homo sapiens
  ENSP00000437948
MRVQLLQDLQDFFRKKAEIETEYSRNLEKLAERFMAKTRSTKDHQQYKKDQNLLSPVNCWYLLLNQVRRESKDHATLSDIYLNNVIMRFMQISEDSTRMFKKSKEIAFQLHEDLMKVLNELYTVMKTYHMYHAESISAESKLKEAEKQEEKQIGRSGDPVFHIRLEERHQRRSSVKKIEKMKEKRQAKYSENKLKSIKARNEYLLTLEATNASVFKYYIHDLSDLIDCCDLGYHASLNRALRTYLSAEYNLETSRHEGLDIIENAVDNLEPRSDKQRFMEMYPAAFCPPMKFEFQSHMGDEVCQVSAQQPVQAELMLRYQQLQSRLATLKIENEEVKKTTEATLQTIQDMVTIEDYDVSECFQHSRSTESVKSTVSETYLSKPSIAKRRANQQETEQFYFMKLREYLEGSNLITKLQAKHDLLQRTLGEGHRAEYMTTSRGRRNSHTRHQDSGQVIPLIVESCIRFINLYGLQHQGIFRVSGSQVEVNDIKNSFERGENPLADDQSNHDINSVAGVLKLYFRGLENPLFPKERFNDLISCIRIDNLYERALHIRKLLLTLPRSVLIVMRYLFAFLNHLSQYSDENMMDPYNLAICFGPTLMPVPEIQDQVSCQAHVNEIIKTIIIHHETIFPDAKELDGPVYEKCMAGDDYCDSPYSEHGTLEEVDQDAGTEPHTSEDECEPIEAIAKFDYVGRSARELSFKKGASLLLYHRASEDWWEGRHNGIDGLVPHQYIVVQDMDDTFSDTLSQKADSEASSGPVTEDKSSSKDMNSPTDRHPDGYLARQRKRGEPPPPVRRPGRTSDGHCPLHPPHALSNSSVDLGSPSLASHPRGLLQNRGLNNDSPERRRRPGHGSLTNISRHDSLKKIDSPPIRRSTSSGQYTGFNDHKPLDPETIAQDIEETMNTALNELRELERQSTAKHAPDVVLDTLEQVKNSPTPATSTESLSPLHNVALRSSEPQIRRSTSSSSDTMSTFKPMVAPRMGVQLKPPALRPKPAVLPKTNPTIGPAPPPQGPTDKSCTM

SEQ ID NO: 36488 - protein, 1022 aa, Homo sapiens; identical to SEQ ID NO: 36487
  ENSP00000485752

SEQ ID NO: 36489 - protein, 158 aa, Homo sapiens
  ENSP00000242465
MMQKLLKCSRLVLALALILVLESSVQGYPTRRARYQWVRCNPDSNSANCLEEKGPMFELLPGESNKIPRLRTDLFPKTRIQDLNRIFPLSEDYSGSGFGSGSGSGSGSGSGFLTEMEQDYQLVDESDAFHDNLRSLDRNLPSDSQDLGQHGLEEDFML

SEQ ID NO: 36490 - protein, 464 aa, Homo sapiens
  ENSP00000367794
MGSPAHRPALLLLLPPLLLLLLLRVPPSRSFPGSGDSPLEDDEVGYSHPRYKDTPWCSPIKVKYGDVYCRAPQGGYYKTALGTRCDIRCQKGYELHGSSLLICQSNKRWSDKVICKQKRCPTLAMPANGGFKCVDGAYFNSRCEYYCSPGYTLKGERTVTCMDNKAWSGRPASCVDMEPPRIKCPSVKERIAEPNKLTVRVSWETPEGRDTADGILTDVILKGLPPGSNFPEGDHKIQYTVYDRAENKGTCKFRVKVRVKRCGKLNAPENGYMKCSSDGDNYGATCEFSCIGGYELQGSPARVCQSNLAWSGTEPTCAAMNVNVGVRTAAALLDQFYEKRRLLIVSTPTARNLLYRLQLGMLQQAQCGLDLRHITVVELVGVFPTLIGRIGAKIMPPALALQLRLLLRIPLYSFSMVLVDKHGMDKERYVSLVMPVALFNLIDTFPLRKEEMVLQAEMSQTCNT

SEQ ID NO: 36491 - protein, 405 aa, Homo sapiens
  ENSP00000411165
MGSPAHRPALLLLLPPLLLLLLLRVPPSRSFPGSGDSPLEDDEVGYSHPRYKDTPWCSPIKVKYGDVYCRAPQGGYYKTALGTRCDIRCQKGYELHGSSLLICQSNKRWSDKVICKHMEPPRIKCPSVKERIAEPNKLTVRVSWETPEGRDTADGILTDVILKGLPPGSNFPEGDHKIQYTVYDRAENKGTCKFRVKVRVKRCGKLNAPENGYMKCSSDGDNYGATCEFSCIGGYELQGSPARVCQSNLAWSGTEPTCAAMNVNVGVRTAAALLDQFYEKRRLLIVSTPTARNLLYRLQLGMLQQAQCGLDLRHITVVELVGVFPTLIGRIGAKIMPPALALQLRLLLRIPLYSFSMVLVDKHGMDKERYVSLVMPVALFNLIDTFPLRKEEMVLQAEMSQTCNT

SEQ ID NO: 36492 - protein, 444 aa, Homo sapiens
  ENSP00000440758
MGSPAHRPALLLLLPPLLLLLLLRVPPSRSFPDTPWCSPIKVKYGDVYCRAPQGGYYKTALGTRCDIRCQKGYELHGSSLLICQSNKRWSDKVICKQKRCPTLAMPANGGFKCVDGAYFNSRCEYYCSPGYTLKGERTVTCMDNKAWSGRPASCVDMEPPRIKCPSVKERIAEPNKLTVRVSWETPEGRDTADGILTDVILKGLPPGSNFPEGDHKIQYTVYDRAENKGTCKFRVKVRVKRCGKLNAPENGYMKCSSDGDNYGATCEFSCIGGYELQGSPARVCQSNLAWSGTEPTCAAMNVNVGVRTAAALLDQFYEKRRLLIVSTPTARNLLYRLQLGMLQQAQCGLDLRHITVVELVGVFPTLIGRIGAKIMPPALALQLRLLLRIPLYSFSMVLVDKHGMDKERYVSLVMPVALFNLIDTFPLRKEEMVLQAEMSQTCNT

SEQ ID NO: 36493 - protein, 379 aa, Homo sapiens
  ENSP00000445034
MGSPAHRPALLLLLPPLLLLLLLRVPPSRSFPGSGDSPLEDDEVGYSHPRYKDTPWCSPIKVKYGDVYCRAPQGGYYKTALGTRCDIRCQKGYELHGSSLLICQSNKRWSDKVICKQKRCPTLAMPANGGFKCVDGAYFNSRCEYYCSPGYTLKGERTVTCMDNKAWSGRPASCVDMEPPRIKCPSVKERIAEPNKLTVRVSWETPEGRDTADGILTDVILKGLPPGSNFPEGDHKIQYTVYDRAENKGTCKFRVKVRVKRCGKLNAPENGYMKCSSDGDNYGATCEFSCIGGYELQGSPARVCQSNLAWSGTEPTCAAMNVNVGVRTAAALLDQFYEKRRLLIVSTPTARNLLYRLQLGMLQAVAANPTLLLQYGASG

SEQ ID NO: 36494 - protein, 611 aa, Homo sapiens
  ENSP00000267260
MASVQQGEKQLFEKFWRGTFKAVATPRPESIIVASITARKPLPRTEPQNNPVVPAQDGPSEKLGQHLATEPLGTNSWERDKTCRELGATRGHSASHDKDLTPPPSSRGKKKKKKSTRKKRRRSSSYSPSPVKKKKKKSSKKHKRRRSFSKKRRHSSSSPKSKRRDEKRHKKQSRSRPRKSHRHRHHRCPSRSQSSESRPSSCESRHRGRSPEEGQKSRRRHSRRCSKTLCKDSPEAQSSRPPSQPLQMLGYLSARGVITGSGSAADLFTKTASPLTTSRGRSQEYDSGNDTSSPPSTQTSSARSRGQEKGSPSGGLSKSRELNSGNTSDSGNSFTTSSPQNKGAMLENLSPTSRGRESRGFQSPCLECAEVKKSSLVPSTARSSPMKGCSRSSSYASTRSSSHSSRSPNPRASPRYTQSRSTSSEKRSYSRSPSYSSKSGKRSPPSRSSRSRRSPSYSRYSPSRERDPKYSEKDSQQRERERARRRRRSYSPMRKRRRDSPSHLEARRITSARKRPIPYYRPSPSSSGSLSSTSSWYSSSSSRSASRSYSRSRSRSRSRRRSRTRTSSSSSSRSPSPGSRSRSRSRSRSRSRSRSQSRSYSSADSYSSTRR

SEQ ID NO: 36495 - protein, 66 aa, Homo sapiens
  ENSP00000493188
  MOD_RES (1)..(1): Any amino acid
XHRGRSPEEGQKSRRRHSRRCSKTLCKDSPEAQSSRPPSQPLQMLGYLSARGVEEFLLDHWVGVCC

SEQ ID NO: 36496 - protein, 95 aa, Homo sapiens
  ENSP00000484891
MHRDSCPLDCKVYVGNLGNNGNKTELERAFGYYGPLRSVWVARNPPGFAFVEFEDPRDAADAVRELDGRLECNGVILARCNLCLLGSSDSPASAA

SEQ ID NO: 36497 - protein, 164 aa, Homo sapiens
  ENSP00000362820
MHRDSCPLDCKVYVGNLGNNGNKTELERAFGYYGPLRSVWVARNPPGFAFVEFEDPRDAADAVRELDGRTLCGCRVRVELSNGEKRSRNRGPPPSWGRRPRDDYRRRSPPPRRRSPRRRSFSRSRSRSLSRDRRRERSLSRERNHKPSRSFSRSRSRSRSNERK

SEQ ID NO: 36498 - protein, 124 aa, Homo sapiens
  ENSP00000436036
MHRDSCPLDCKVYVGNLGNNGNKTELERAFGYYGPLRSVWVARNPPGFAFVEFEDPRDAADAVRELDGRTLCGCRVRVELSNGEKRSRNRGPPPSWGRRPRDDYRRRSPPPRRRVTIMSLLTTL

SEQ ID NO: 36499 - protein, 164 aa, Homo sapiens; identical to SEQ ID NO: 36497
  ENSP00000482833

SEQ ID NO: 36500 - protein, 1049 aa, Homo sapiens
  ENSP00000315713
MALVTLQRSPTPSAASSSASNSELEAGSEEDRKLNLSLSESFFMVKGAALFLQQGSSPQGQRSLQHPHKHAGDLPQHLQVMINLLRCEDRIKLAVRLESAWADRVRYMVVVYSSGRQDTEENILLGVDFSSKESKSCTIGMVLRLWSDTKIHLDGDGGFSVSTAGRMHIFKPVSVQAMWSALQVLHKACEVARRHNYFPGGVALIWATYYESCISSEQSCINEWNAMQDLESTRPDSPALFVDKPTEGERTERLIKAKLRSIMMSQDLENVTSKEIRNELEKQMNCNLKELKEFIDNEMLLILGQMDKPSLIFDHLYLGSEWNASNLEELQGSGVDYILNVTREIDNFFPGLFAYHNIRVYDEETTDLLAHWNEAYHFINKAKRNHSKCLVHCKMGVSRSASTVIAYAMKEFGWPLEKAYNYVKQKRSITRPNAGFMRQLSEYEGILDASKQRHNKLWRQQTDSSLQQPVDDPAGPGDFLPETPDGTPESQLPFLDDAAQPGLGPPLPCCFRRLSDPLLPSPEDETGSLVHLEDPEREALLEEAAPPAEVHRPARQPQQGSGLCEKDVKKKLEFGSPKGRSGSLLQVEETEREEGLGAGRWGQLPTQLDQNLLNSENLNNNSKRSCPNGMEDDAIFGILNKVKPSYKSCADCMYPTASGAPEASRERCEDPNAPAICTQPAFLPHITSSPVAHLASRSRVPEKPASGPTEPPPFLPPAGSRRADTSGPGAGAALEPPASLLEPSRETPKVLPKSLLLKNSHCDKNPPSTEVVIKEESSPKKDMKPAKDLRLLFSNESEKPTTNSYLMQHQESIIQLQKAGLVRKHTKELERLKSVPADPAPPSRDGPASRLEASIPEESQDPAALHELGPLVMPSQAGSDEKSEAAPASLEGGSLKSPPPFFYRLDHTSSFSKDFLKTICYTPTSSSMSSNLTRSSSSDSIHSVRGKPGLVKQRTQEIETRLRLAGLTVSSPLKRSHSLAKLGSLTFSTEDLSSEADPSTVADSQDTTLSESSFLHEPQGTPRDPAATSKPSGKPAPENLKSPSWMSKS

SEQ ID NO: 36501 - protein, 95 aa, Homo sapiens
  ENSP00000447629
  MOD_RES (1)..(1): Any amino acid
XAMQDLESTRPDSPALFVDKPTEGERTERLIKAKLRSIMMSQDLENVTSKEIRNELEKQMNCNLKELKEFIDNEMLLILGQMDKPSLIFDHLYLG

SEQ ID NO: 36502 - protein, 692 aa, Homo sapiens
  ENSP00000448824
MALVTLQRSPTPSAASSSASNSELEAGSEEDRKLNLSLSESFFMVKGAALFLQQGSSPQGQRSLQHPHKHAGDLPQHLQVMINLLRCEDRIKLAVRLESAWADRVRYMVVVYSSGRQDTEENILLGVDFSSKESKSCTIGMVLRLWSDTKIHLDGDGGFSVSTAGRMHIFKPVSVQAMWSALQVLHKACEVARRHNYFPGGVALIWATYYESCISSEQSCINEWNAMQDLESTRPDSPALFVDKPTEGERTERLIKAKLRSIMMSQDLENVTSKEIRNELEKQMNCNLKELKEFIDNEMLLILGQMDKPSLIFDHLYLGSEWNASNLEELQGSGVDYILNVTREIDNFFPGLFAYHNIRVYDEETTDLLAHWNEAYHFINKAKRNHSKCLVHCKMGVSRSASTVIAYAMKEFGWPLEKAYNYVKQKRSITRPNAGFMRQLSEYEGILDASKQRHNKLWRQQTDSSLQQPVDDPAGPGDFLPETPDGTPESQLPFLDDAAQPGLGPPLPCCFRRLSDPLLPSPEDETGSLVHLEDPEREALLEEAAPPAEVHRPARQPQQGSGLCEKDVKKKLEFGSPKGRSGSLLQVEETEREEGLGAGRWGQLPTQLDQNLLNSENLNNNSKRSCPNGMEVGRARPAGWHTPSLPSHSNWPTSASVVGTTGTRHHTQLIFFYCLLWAPSSHLQGPEGSFTG

SEQ ID NO: 36503 - protein, 703 aa, Homo sapiens
  ENSP00000326107
MARARRAVVGSVRDVSTAATNLFYFTDFCIFLQPTHCFCCPEVSSSNYLSESFFMVKGAALFLQQGSSPQGQRSLQHPHKHAGDLPQHLQVMINLLRCEDRIKLAVRLESAWADRVRYMVVVYSSGRQDTEENILLGVDFSSKESKSCTIGMVLRLWSDTKIHLDGDGGFSVSTAGRMHIFKPVSVQAMWSALQVLHKACEVARRHNYFPGGVALIWATYYESCISSEQSCINEWNAMQDLESTRPDSPALFVDKPTEGERTERLIKAKLRSIMMSQDLENVTSKEIRNELEKQMNCNLKELKEFIDNEMLLILGQMDKPSLIFDHLYLGSEWNASNLEELQGSGVDYILNVTREIDNFFPGLFAYHNIRVYDEETTDLLAHWNEAYHFINKAKRNHSKCLVHCKMGVSRSASTVIAYAMKEFGWPLEKAYNYVKQKRSITRPNAGFMRQLSEYEGILDASKQRHNKLWRQQTDSSLQQPVDDPAGPGDFLPETPDGTPESQLPFLDDAAQPGLGPPLPCCFRRLSDPLLPSPEDETGSLVHLEDPEREALLEEAAPPAEVHRPARQPQQGSGLCEKDVKKKLEFGSPKGRSGSLLQVEETEREEGLGAGRWGQLPTQLDQNLLNSENLNNNSKRSCPNGMEVGRARPAGWHTPSLPSHSNWPTSASVVGTTGTRHHTQLIFFYCLLWAPSSHLQGPEGSFTG

SEQ ID NO: 36504 - protein, 37 aa, Homo sapiens
  ENSP00000448586
MALVTLQRSPTPSAASSSASNSELEAGSEEDRKLNLR

SEQ ID NO: 36505 - protein, 154 aa, Homo sapiens
  ENSP00000446652
MVSKAKVIVNGWLFPACLGFCLSESFFMVKGAALFLQQGSSPQGQRSLQHPHKHAGDLPQHLQVMINLLRCEDRIKLAVRLESAWADRVRYMVVVYSSGRQDTEENILLGVDFSSKESKSCTIGMVLRLWSDTKIHLDGDGGFSVSTAGRMHIF

SEQ ID NO: 36506 - protein, 391 aa, Homo sapiens
  ENSP00000267377
MFPNGTASSPSSSPSPSPGSCGEGGGSRGPGAGAADGMEEPGRNASQNGTLSEGQGSAILISFIYSVVCLVGLCGNSMVIYVILRYAKMKTATNIYILNLAIADELLMLSVPFLVTSTLLRHWPFGALLCRLVLSVDAVNMFTSIYCLTVLSVDRYVAVVHPIKAARYRRPTVAKVVNLGVWVLSLLVILPIVVFSRTAANSDGTVACNMLMPEPAQRWLVGFVLYTFLMGFLLPVGAICLCYVLIIAKMRMVALKAGWQQRKRSERKITLMVMMVVMVFVICWMPFYVVQLVNVFAEQDDATVSQLSVILGYANSCANPILYGFLSDNFKRSFQRILCLSWMDNAAEEPVDYYATALKSRAYSVEDFQPENLESGGVFRNGTCTSRITTL

SEQ ID NO: 36507 - protein, 369 aa, Homo sapiens
  ENSP00000350198
MDMADEPLNGSHTWLSIPFDLNGSVVSTNTSNQTEPYYDLTSNAVLTFIYFVVCIIGLCGNTLVIYVILRYAKMKTITNIYILNLAIADELFMLGLPFLAMQVALVHWPFGKAICRVVMTVDGINQFTSIFCLTVMSIDRYLAVVHPIKSAKWRRPRTAKMITMAVWGVSLLVILPIMIYAGLRSNQWGRSSCTINWPGESGAWYTGFIIYTFILGFLVPLTIICLCYLFIIIKVKSSGIRVGSSKRKKSEKKVTRMVSIVVAVFIFCWLPFYIFNVSSVSMAISPTPALKGMFDFVVVLTYANSCANPILYAFLSDNFKKSFQNVLCLVKVSGTDDGERSDSKQDKSRLNETTETQRTLLNGDLQTSI

SEQ ID NO: 36508 - protein, 369 aa, Homo sapiens
  ENSP00000216218
MDPRKVNELRAFVKMCKQDPSVLHTEEMRFLREWVESMGGKVPPATQKAKSEENTKEEKPDSKKVEEDLKADEPSSEESDLEIDKEGVIEPDTDAPQEMGDENAEITEEMMDQANDKKVAAIEALNDGELQKAIDLFTDAIKLNPRLAILYAKRASVFVKLQKPNAAIRDCDRAIEINPDSAQPYKWRGKAHRLLGHWEEAAHDLALACKLDYDEDASAMLKEVQPRAQKIAEHRRKYERKREEREIKERIERVKKAREEHERAQREEEARRQSGAQYGSFPGGFPGGMPGNFPGGMPGMGGGMPGMAGMPGLNEILSDPEVLAAMQDPEVMVAFQDVAQNPANMSKYQSNPKVMNLISKLSAKFGGQA

SEQ ID NO: 36509 - protein, 38 aa, Homo sapiens
  ENSP00000397062
MDPRKVNELRAFVKMCKQDPSVLHTEEMRFLREWVERN

SEQ ID NO: 36510 - protein, 146 aa, Homo sapiens
  ENSP00000412049
  MOD_RES (1)..(1): Any amino acid
XIEPDTDAPQEMGDENAEITEEMMDQANDKKVAAIEALNDGELQKAIDLFTDAIKLNPRLAILYAKRASVFVKLQKPNAAIRDCDRAIEINPDSAQPYKWRGKAHRLLGHWEEAAHDLALACKLDYDEDASAMLKEVQPRVCTTTL

SEQ ID NO: 36511 - protein, 162 aa, Homo sapiens
  ENSP00000392067
MGGKVPPATQKAKSEENTKEEKPDSKKVEEDLKADEPSSEESDLEIDKEGVIEPDTDAPQEMGDENAEITEEMMDQANDKKVAAIEALNDGELQKAIDLFTDAIKLNPRLAILYAKRASVFVKLQKPNAAIRDCDRAIEINPDSAQPYKWRGKAHRLLGHWE

SEQ ID NO: 36512 - protein, 211 aa, Homo sapiens [sequence omitted]

SEQ ID NO: 36513 - protein, 1047 aa, Homo sapiens
  ENSP00000276480
MDAEAEDKTLRTRSKGTEVPMDSLIQELSVAYDCSMAKKRTAEDQALGVPVNKRKSLLMKPRHYSPKADCQEDRSDRTEDDGPLETHGHSTAEEIMIKPMDESLLSTAQENSSRKEDRYSCYQELMVKSLMHLGKFEKNVSVQTVSENLNDSGIQSLKAESDEADECFLIHSDDGRDKIDDSQPPFCSSDDNESNSESAENGWDSGSNFSEETKPPRVPKYVLTDHKKDLLEVPEIKTEGDKFIPCENRCDSETERKDPQNALAEPLDGNAQPSFPDVEEEDSESLAVMTEEGSDLEKAKGNLSLLEQAIALQAERGCVFHNTYKELDRFLLEHLAGERRQTKVIDMGGRQIFNNKHSPRPEKRETKCPIPGCDGTGHVTGLYPHHRSLSGCPHKVRVPLEILAMHENVLKCPTPGCTGRGHVNSNRNTHRSLSGCPIAAAEKLAMSQDKNQLDSPQTGQCPDQAHRTSLVKQIEFNFPSQAITSPRATVSKEQEKFGKVPFDYASFDAQVFGKRPLIQTVQGRKTPPFPESKHFPNPVKFPNRLPSAGAHTQSPGRASSYSYGQCSEDTHIAAAAAILNLSTRCREATDILSNKPQSLHAKGAEIEVDENGTLDLSMKKNRILDKSAPLTSSNTSIPTPSSSPFKTSSILVNAAFYQALCDQEGWDTPINYSKTHGKTEEEKEKDPVSSLENLEEKKFPGEASIPSPKPKLHARDLKKELITCPTPGCDGSGHVTGNYASHRSVSGCPLADKTLKSLMAANSQELKCPTPGCDGSGHVTGNYASHRSLSGCPRARKGGVKMTPTKEEKEDPELKCPVIGCDGQGHISGKYTSHRTASGCPLAAKRQKENPLNGASLSWKLNKQELPHCPLPGCNGLGHVNNVFVTHRSLSGCPLNAQVIKKGKVSEELMTIKLKATGGIESDEEIRHLDEEIKELNESNLKIEADMMKLQTQITSMESNLKTIEEENKLIEQNNESLLKELAGLSQALISSLADIQLPQMGPISEQNFEAYVNTLTDMYSNLERDYSPECKALLESIKQAVKGIHV

SEQ ID NO: 36514 - protein, 94 aa, Homo sapiens
  ENSP00000429579
MDAEAEDKTLRTRSKGTEVPMDSLIQELSVAYDCSMAKKRTAEDQALGVPVNKRKSLLMKPRHYSPKADCQEDRSDRTEDDGPLETHGHSTRKS

SEQ ID NO: 36515 - protein, 41 aa, Homo sapiens
  ENSP00000428920
MDAEAEDKTLRTRSKGTEVPMDSLIQELRISVPVDMRPLTW

SEQ ID NO: 36516 - protein, 364 aa, Homo sapiens
  ENSP00000430763
MDAEAEDKTLRTRSKGTEVPMDSLIQELSVAYDCSMAKKRTAEDQALGVPVNKRKSLLMKPRHYSPKADCQEDRSDRTEDDGPLETHGHSTAEEIMIKPMDESLLSTAQENSSRKEDRYSCYQELMVKSLMHLGKFEKNVSVQTVSENLNDSGIQSLKAESDEADECFLIHSDDGRDKIDDSQPPFCSSDDNESNSESAENGWDSGSNFSEETKPPRVPKYVLTDHKKDLLEVPEIKTEGDKFIPCENRCDSETERKDPQNALAEPLDGNAQPSFPDVEEEDSESLAVMTEEGSDLEKAKGNLSLLEQAIALQAERGCVFHNTYKELDRFLLEHLAGERRQTKVIDMGGRQIFNNKHYPPIKLC

SEQ ID NO: 36517 - protein, 620 aa, Homo sapiens
  ENSP00000428521
MDAEAEDKTLRTRSKGTEVPMDSLIQELSVAYDCSMAKKRTAEDQALGVPVNKRKSLLMKPRHYSPKADCQEDRSDRTEDDGPLETHGHSTAEEIMIKPMDESLLSTAQENSSRKEDRYSCYQELMVKSLMHLGKFEKNVSVQTVSENLNDSGIQSLKAESDEADECFLIHSDDGRDKIDDSQPPFCSSDDNESNSESAENGWDSGSNFSEETKPPRVPKYVLTDHKKDLLEVPEIKTEGDKFIPCENRCDSETERKDPQNALAEPLDGNAQPSFPDVEEEDSESLAVMTEEGSDLEKAKGNLSLLEQAIALQAERGCVFHNTYKELDRFLLEHLAGERRQTKVIDMGGRQIFNNKHSPRPEKRETKCPIPGCDGTGHVTGLYPHHRSLSGCPHKVRVPLEILAMHENVLKCPTPGCTGRGHVNSNRNTHRSLSGCPIAAAEKLAMSQDKNQLDSPQTGQCPDQAHRTSLVKQIEFNFPSQAITSPRATVSKEQEKFGKVPFDYASFDAQVFGKRPLIQTVQGRKTPPFPESKHFPNPVKFPNRLPSAGAHTQSPGRASSYSYGQCSEDTHIAAAAAILNLSTRCREATDILSNKPQSLHAKGAEIEVDENGTLDLSMKK

SEQ ID NO: 36518 - protein, 12 aa, Homo sapiens
  ENSP00000428096
MDAEAEDKTLRT

SEQ ID NO: 36519 - protein, 350 aa, Homo sapiens
  ENSP00000377257
MKCSLRVWFLSVAFLLVFIMSLLFTYSHHSMATLPYLDSGALDGTHRVKLVPGYAGLQRLSKERLSGKSCACRRCMGDAGASDWFDSHFDGNISPVWTRENMDLPPDVQRWWMMLQPQFKSHNTNEVLEKLFQIVPGENPYRFRDPHQCRRCAVVGNSGNLRGSGYGQDVDGHNFIMRMNQAPTVGFEQDVGSRTTHHFMYPESAKNLPANVSFVLVPFKVLDLLWIASALSTGQIRFTYAPVKSFLRVDKEKVQIYNPAFFKYIHDRWTEHHGRYPSTGMLVLFFALHVCDEVNVYGFGADSRGNWHHYWENNRYAGEFRKTGVHDADFEAHIIDMLAKASKIEVYRGN

SEQ ID NO: 36520 - protein, 350 aa, Homo sapiens; identical to SEQ ID NO: 36519
  ENSP00000345477

SEQ ID NO: 36521 - protein, 418 aa, Homo sapiens
  ENSP00000491316
MRTKAAGCAERRPLQPRTEAAAAPAGRAMPSEYTYVKLRSDCSRPSLQWYTRAQSKMRRPSLLLKDILKCTLLVFGVWILYILKLNYTTEECDMKKMHYVDPDHVKRAQKYAQQVLQKECRPKFAKTSMALLFEHRYSVDLLPFVQKAPKDSEAESKYDPPFGFRKFSSKVQTLLELLPEHDLPEHLKAKTCRRCVVIGSGGILHGLELGHTLNQFDVVIRLNSAPVEGYSEHVGNKTTIRMTYPEGAPLSDLEYYSNDLFVAVLFKSVDFNWLQAMVKKETLPFWVRLFFWKQVAEKIPLQPKHFRILNPVIIKETAFDILQYSEPQSRFWGRDKNVPTIGVIAVVLATHLCDEVSLAGFGYDLNQPRTPLHYFDSQCMAAMNFQTMHNVTTETKFLLKLVKEGVVKDLSGGIDREF

SEQ ID NO: 36522 - protein, 49 aa, Homo sapiens
  ENSP00000492030
EECDMKKMHYVDPDHVKTYTVPLKEAGPSLLKHSVSPGTSIFKPSLFSP

SEQ ID NO: 36523 - protein, 395 aa, Homo sapiens
  ENSP00000377397
MASVPMPSEYTYVKLRSDCSRPSLQWYTRAQSKMRRPSLLLKDILKCTLLVFGVWILYILKLNYTTEECDMKKMHYVDPDHVKRAQKYAQQVLQKECRPKFAKTSMALLFEHRYSVDLLPFVQKAPKDSEAESKYDPPFGFRKFSSKVQTLLELLPEHDLPEHLKAKTCRRCVVIGSGGILHGLELGHTLNQFDVVIRLNSAPVEGYSEHVGNKTTIRMTYPEGAPLSDLEYYSNDLFVAVLFKSVDFNWLQAMVKKETLPFWVRLFFWKQVAEKIPLQPKHFRILNPVIIKETAFDILQYSEPQSRFWGRDKNVPTIGVIAVVLATHLCDEVSLAGFGYDLNQPRTPLHYFDSQCMAAMNFQTMHNVTTETKFLLKLVKEGVVKDLSGGIDREF

SEQ ID NO: 36524 - protein, 390 aa, Homo sapiens
  ENSP00000377394
MPSEYTYVKLRSDCSRPSLQWYTRAQSKMRRPSLLLKDILKCTLLVFGVWILYILKLNYTTEECDMKKMHYVDPDHVKRAQKYAQQVLQKECRPKFAKTSMALLFEHRYSVDLLPFVQKAPKDSEAESKYDPPFGFRKFSSKVQTLLELLPEHDLPEHLKAKTCRRCVVIGSGGILHGLELGHTLNQFDVVIRLNSAPVEGYSEHVGNKTTIRMTYPEGAPLSDLEYYSNDLFVAVLFKSVDFNWLQAMVKKETLPFWVRLFFWKQVAEKIPLQPKHFRILNPVIIKETAFDILQYSEPQSRFWGRDKNVPTIGVIAVVLATHLCDEVSLAGFGYDLNQPRTPLHYFDSQCMAAMNFQTMHNVTTETKFLLKLVKEGVVKDLSGGIDREF

SEQ ID NO: 36525 - protein, 390 aa, Homo sapiens; identical to SEQ ID NO: 36524
  ENSP00000491564

SEQ ID NO: 36526 - protein, 47 aa, Homo sapiens
  ENSP00000491395
  MOD_RES (1)..(1): Any amino acid
XRTKAAGCAERRPLQPRTEAAAAPAGRGTVKTVVCKAETPACMESAF

SEQ ID NO: 36527 - protein, 107 aa, Homo sapiens
  ENSP00000491398
MRTKAAGCAERRPLQPRTEAAAAPAGRAMPSEYTYVKLRSDCSRPSLQWYTRAQSKMRRPSLLLKDILKCTLLVFGVWILYILKLNYTTEECDMKKMHYVDPDHVKV

SEQ ID NO: 36528 - protein, 378 aa, Homo sapiens
  ENSP00000366549
MRTKAAGCAERRPLQPRTEAAAAPAGRAMPSEYTYVKLRSDCSRPSLQWYTRAQSKMRRPSLLLKDILKCTLLVFGVWILYILKLNYTTEECDMKKMHYVDPDHVKKAPKDSEAESKYDPPFGFRKFSSKVQTLLELLPEHDLPEHLKAKTCRRCVVIGSGGILHGLELGHTLNQFDVVIRLNSAPVEGYSEHVGNKTTIRMTYPEGAPLSDLEYYSNDLFVAVLFKSVDFNWLQAMVKKETLPFWVRLFFWKQVAEKIPLQPKHFRILNPVIIKETAFDILQYSEPQSRFWGRDKNVPTIGVIAVVLATHLCDEVSLAGFGYDLNQPRTPLHYFDSQCMAAMNFQTMHNVTTETKFLLKLVKEGVVKDLSGGIDREF

SEQ ID NO: 36529 - protein, 365 aa, Homo sapiens
  ENSP00000492045
MRTKAAGCAERRPLQPRTEAAAAPAGRAMPSEYTYVKLRSDCSRPSLQWYTRAQSKMRRPSLLLKDILKCTLLVFGVWILYILKLNYTTEECDMKKMHYVDPDHVKRAQKYAQQVLQKECRPKFAKTSMALLFEHRYSVDLLPFVQKAPKDSEAESKYDPPFGFRKFSSKVQTLLELLPEHDLPEHLKAKTCRRCVVIGSGGILHGLELGHTLNQFDVVIRLNSAPVEGYSEHVGNKTTIRMTYPEGAPLSDLEYYSNDLFVAVLFKSVDFNWLQAMVKKETLNVPTIGVIAVVLATHLCDEVSLAGFGYDLNQPRTPLHYFDSQCMAAMNFQTMHNVTTETKFLLKLVKEGVVKDLSGGIDREF

SEQ ID NO: 36530 - protein, 61 aa, Homo sapiens
  ENSP00000491495
  MOD_RES (1)..(1): Any amino acid
XKKMHYVDPDHVKMQLLKRRPGSLASIQLAHAPLSSPVAISELLRVPLATSQMFLSVLGDL

SEQ ID NO: 36531 - protein, 437 aa, Homo sapiens
  ENSP00000492098
MCHHAQGSRQSLCSVGYSCAPAPEGLRKRQRLRGTRQKSNIKRQCFTMPSEYTYVKLRSDCSRPSLQWYTRAQSKMRRPSLLLKDILKCTLLVFGVWILYILKLNYTTEECDMKKMHYVDPDHVKRAQKYAQQVLQKECRPKFAKTSMALLFEHRYSVDLLPFVQKAPKDSEAESKYDPPFGFRKFSSKVQTLLELLPEHDLPEHLKAKTCRRCVVIGSGGILHGLELGHTLNQFDVVIRLNSAPVEGYSEHVGNKTTIRMTYPEGAPLSDLEYYSNDLFVAVLFKSVDFNWLQAMVKKETLPFWVRLFFWKQVAEKIPLQPKHFRILNPVIIKETAFDILQYSEPQSRFWGRDKNVPTIGVIAVVLATHLCDEVSLAGFGYDLNQPRTPLHYFDSQCMAAMNFQTMHNVTTETKFLLKLVKEGVVKDLSGGIDREF

SEQ ID NO: 36532 - protein, 223 aa, Homo sapiens
  ENSP00000492089
AERRPLQPRTEAAAAPAGRAMPSEYTYVKLRSDCSRPSLQWYTRAQSKMRRPSLLLKDILKCTLLVFGVWILYILKLNYTTEECDMKKMHYVDPDHVKRAQKYAQQVLQKECRPKFAKTSMALLFEHRYSVDLLPFVQKAPKDSEAESKYDPPFGFRKFSSKVQTLLELLPEHDLPEHLKAKTCRRCVVIGSGGILHGLELGHTLNQFDVVIRVLISTGFKQW

SEQ ID NO: 36533 - protein, 47 aa, Homo sapiens
  ENSP00000492602
MRTKAAGCAERRPLQPRTEAAAAPAGRGTVKTVVCKAETPACMESAF

SEQ ID NO: 36534 - protein, 78 aa, Homo sapiens
  ENSP00000491084
  MOD_RES (1)..(1): Any amino acid
XVKLRSDCSRPSLQWYTRAQSKMRRPSLLLKDILKCTLLVFGVWILYILKLNYTTEECDMKKMHYVDPDHVKVVSSSF

SEQ ID NO: 36535 - protein, 390 aa, Homo sapiens; identical to SEQ ID NO: 36524
  ENSP00000491828

SEQ ID NO: 36536 - protein, 110 aa, Homo sapiens
  ENSP00000492305
MPSEYTYVKLRSDCSRPSLQWYTRAQSKMRRPSLLLKDILKCTLLVFGVWILYILKLNYTTEECDMKKMHYVDPDHVKTYTVPLKEAGPSLLKHSVSPGTSIFKPSLFSP

SEQ ID NO: 36537 - protein, 390 aa, Homo sapiens; identical to SEQ ID NO: 36524
  ENSP00000492299

SEQ ID NO: 36538 - protein, 390 aa, Homo sapiens; identical to SEQ ID NO: 36524
  ENSP00000492753

SEQ ID NO: 36539 - protein, 247 aa, Homo sapiens
  ENSP00000492459
  MOD_RES (1)..(1): Any amino acid
XGCAERRPLQPRTEAAAAPAGRAMPSEYTYVKLRSDCSRPSLQWYTRAQSKMRRPSLLLKDILKCTLLVFGVWILYILKLNYTTEECDMKKMHYVDPDHVKRAQKYAQQVLQKECRPKFAKTSMALLFEHRYSVDLLPFVQKAPKDSEAESKYDPPFGFRKFSSKVQTLLELLPEHDLPEHLKAKTCRRCVVIGSGGILHGLELGHTLNQFDVVIRTQCTALGQCGSRNSEGHRKLFTVPAHKGLNV

SEQ ID NO: 36540 - protein, 231 aa, Homo sapiens
  ENSP00000492847
  MOD_RES (1)..(1): Any amino acid
XRTKAAGCAERRPLQPRTEAAAAPAGRAMPSEYTYVKLRSDCSRPSLQWYTRAQSKMRRPSLLLKDILKCTLLVFGVWILYILKLNYTTEECDMKKMHYVDPDHVKRAQKYAQQVLQKECRPKFAKTSMALLFEHRYSVDLLPFVQKAPKDSEAESKYDPPFGFRKFSSKVQTLLELLPEHDLPEHLKAKTCRRCVVIGSGGILHGLELGHTLNQFDVVIRVLISTGFKQW

SEQ ID NO: 36541 - protein, 47 aa, Homo sapiens; identical to SEQ ID NO: 36533
  ENSP00000491027

SEQ ID NO: 36542 - protein, 112 aa, Homo sapiens
  ENSP00000492209
MRTKAAGCAERRPLQPRTEAAAAPAGRAMPSEYTYVKLRSDCSRPSLQWYTRAQSKMRRPSLLLKDILKCTLLVFGVWILYILKLNYTTEECDMKKMHYVDPDHVKVVSSSF

SEQ ID NO: 36543 - protein, 47 aa, Homo sapiens; identical to SEQ ID NO: 36533
  ENSP00000491356

SEQ ID NO: 36544 - protein, 47 aa, Homo sapiens; identical to SEQ ID NO: 36533
  ENSP00000492635

SEQ ID NO: 36545 - protein, 149 aa, Homo sapiens
  ENSP00000492468
MRTKAAGCAERRPLQPRTEAAAAPAGRAMPSEYTYVKLRSDCSRPSLQWYTRAQSKMRRPSLLLKDILKELRNMLSKSCRRNVVPSLPRHQWRCYLSTGIAWTYSLLCRRPPKTVKLSPSTILLLGSGSSPVKSRPSWNSCQSTTSLNT

SEQ ID NO: 36546 - protein, 47 aa, Homo sapiens; identical to SEQ ID NO: 36533
  ENSP00000491802

SEQ ID NO: 36547 - protein, 138 aa, Homo sapiens
  ENSP00000491238
MRTKAAGCAERRPLQPRTEAAAAPAGRAMPSEYTYVKLRSDCSRPSLQWYTRAQSKMRRPSLLLKDILKCTLLVFGVWILYILKLNYTTEECDMKKMHYVDPDHVKTYTVPLKEAGPSLLKHSVSPGTSIFKPSLFSP

SEQ ID NO: 36548 - protein, 184 aa, Homo sapiens
  ENSP00000492035
  MOD_RES (1)..(1): Any amino acid
XAMPSEYTYVKLRSDCSRPSLQWYTRAQSKMRRPSLLLKDILKCTLLVFGVWILYILKLNYTTEECDMKKMHYVDPDHVKTLSPCGWHCVQLIMARWTQPLLHRLLSDSADLHRAFKGSRALPAEAFSEPRHQHLQTESFLSLVLLPAFQAFLGYLRESSEICSASLAEGMSSQVCQDINGAVI

SEQ ID NO: 36549 - protein, 337 aa, Homo sapiens
  ENSP00000492103
MPSEYTYVKLRSDCSRPSLQWYTRAQSKMRRPSLLLKDILKCTLLVFGVWILYILKLNYTTEECDMKKMHYVDPDHVKRAQKYAQQVLQKECRPKFAKTSMALLFEHRYSVDLLPFVQKAPKDSEAESKYDPPFGFRKFSSKVQTLLELLPEHDLPEHLKAKTCRRCVVIGSGGILHGLELGHTLNQFDVVIRLNSAPVEGYSEHVGNKTTIRMTYPEGAPLSDLEYYSNDLFVAVLFKSVDFNWLQAMVKKETLNVPTIGVIAVVLATHLCDEVSLAGFGYDLNQPRTPLHYFDSQCMAAMNFQTMHNVTTETKFLLKLVKEGVVKDLSGGIDREF

SEQ ID NO: 36550 - protein, 149 aa, Homo sapiens; identical to SEQ ID NO: 36545
  ENSP00000490979

SEQ ID NO: 36551 - protein, 110 aa, Homo sapiens; identical to SEQ ID NO: 36536
  ENSP00000491699

SEQ ID NO: 36552 - protein, 407 aa, Homo sapiens
  ENSP00000492244
  MOD_RES (1)..(1): Any amino acid
XRTKAAGCAERRPLQPRTEAAAAPAGRAMPSEYTYVKLRSDCSRPSLQWYTRAQSKMRRPSLLLKDILKCTLLVFGVWILYILKLNYTTEECDMKKMHYVDPDHVKRAQKYAQQVLQKECRPKFAKTSMALLFEHRYSVDLLPFVQKAPKDSEAESKYDPPFGFRKFSSKVQTLLELLPEHDLPEHLKAKTCRRCVVIGSGGILHGLELGHTLNQFDVVIRLNSAPVEGYSEHVGNKTTIRMTYPEGAPLSDLEYYSNDLFVAVLFKSVDFNWLQAMVKKETLVAEKIPLQPKHFRILNPVIIKETAFDILQYSEPQSRFWGRDKNVPTIGVIAVVLATHLCDEVSLAGFGYDLNQPRTPLHYFDSQCMAAMNFQTMHNVTTETKFLLKLVKEGVVKDLSGGIDREF

SEQ ID NO: 36553 - protein, 390 aa, Homo sapiens; identical to SEQ ID NO: 36524
  ENSP00000491853

SEQ ID NO: 36554 - protein, 112 aa, Homo sapiens; identical to SEQ ID NO: 36542
  ENSP00000492473

SEQ ID NO: 36555 - protein, 107 aa, Homo sapiens
  ENSP00000492280
MRTKAAGCAERRPLQPRTEAAAAPAGRAMPSEYTYVKLRSDCSRPSLQWYTRAQSKMRRPSLLLKDILKCTLLVFGVWILYILKLNYTTEECDMKKMHYVDPDHVKS

SEQ ID NO: 36556 - protein, 107 aa, Homo sapiens; identical to SEQ ID NO: 36555
  ENSP00000492866

SEQ ID NO: 36557 - protein, 114 aa, Homo sapiens
  ENSP00000492097
MRTKAAGCAERRPLQPRTEAAAAPAGRAMPSEYTYVKLRSDCSRPSLQWYTRAQSKMRRPSLLLKDILKCTLLVFGVWILYILKLNYTTEECDMKKMHYVDPDHVKLLKVRHSP

SEQ ID NO: 36558 - protein, 107 aa, Homo sapiens
  ENSP00000491172
  MOD_RES (1)..(1): Any amino acid
XYTYVKLRSDCSRPSLQWYTRAQSKMRRPSLLLKDILKCTLLVFGVWILYILKLNYTTEECDMKKMHYVDPDHVKTYTVPLKEAGPSLLKHSVSPGTSIFKPSLFSP

SEQ ID NO: 36559 - protein, 14 aa, Homo sapiens
  ENSP00000491443
  MOD_RES (1)..(1): Any amino acid
XCKAETPACMESAF

SEQ ID NO: 36560 - protein, 135 aa, Homo sapiens
  ENSP00000491880
  MOD_RES (1)..(1): Any amino acid
XGCAERRPLQPRTEAAAAPAGRAMPSEYTYVKLRSDCSRPSLQWYTRAQSKMRRPSLLLKDILKCTLLVFGVWILYILKLNYTTEECDMKKMHYVDPDHVKRAQKYAQQVLQKECRPKFAKTSMALLFEHRARPP

SEQ ID NO: 36561 - protein, 39 aa, Homo sapiens
  ENSP00000491315
AERRPLQPRTEAAAAPAGRGTVKTVVCKAETPACMESAF

SEQ ID NO: 36562 - protein, 73 aa, Homo sapiens
  ENSP00000491038
  MOD_RES (1)..(1): Any amino acid
XDCSRPSLQWYTRAQSKMRRPSLLLKDILKCTLLVFGVWILYILKLNYTTEECDMKKMHYVDPDHVKVVSSSF

SEQ ID NO: 36563 - protein, 104 aa, Homo sapiens
  ENSP00000491664
  MOD_RES (1)..(1): Any amino acid
XVKLRSDCSRPSLQWYTRAQSKMRRPSLLLKDILKCTLLVFGVWILYILKLNYTTEECDMKKMHYVDPDHVKTYTVPLKEAGPSLLKHSVSPGTSIFKPSLFSP

SEQ ID NO: 36564 - protein, 73 aa, Homo sapiens
  ENSP00000492710
SDCSRPSLQWYTRAQSKMRRPSLLLKDILKCTLLVFGVWILYILKLNYTTEECDMKKMHYVDPDHVKVKQCTS

SEQ ID NO: 36565 - protein, 103 aa, Homo sapiens
  ENSP00000491701
VKLRSDCSRPSLQWYTRAQSKMRRPSLLLKDILKCTLLVFGVWILYILKLNYTTEECDMKKMHYVDPDHVKTYTVPLKEAGPSLLKHSVSPGTSIFKPSLFSP

SEQ ID NO: 36566 - protein, 43 aa, Homo sapiens
  ENSP00000306247
MRTKAAGCAERRPLQPRTEAAAAPAGRDVHCLCLECGSFISSS

SEQ ID NO: 36567 - protein, 47 aa, Homo sapiens; identical to SEQ ID NO: 36533
  ENSP00000491029

SEQ ID NO: 36568 - protein, 41 aa, Homo sapiens
  ENSP00000491857
ILKCTLLVFGVWILYILKLNYTTEECDMKKMHYVDPDHVKS

SEQ ID NO: 36569 - protein, 139 aa, Homo sapiens
  ENSP00000401375
MPSEYTYVKLRSDCSRPSLQWYTRAQSKMRRPSLLLKDILKCTLLVFGVWILYILKLNYTTEECDMKKMHYVDPDHVKRAQKYAQQVLQKECRPKFAKTSMALLFEHRYSVDLLPFVQKAPKDSEAESKYDPPFGFRKF

SEQ ID NO: 36570 - protein, 18 aa, Homo sapiens
  ENSP00000491917
VKTVVCKAETPACMESAF

SEQ ID NO: 36571 - protein, 220 aa, Homo sapiens
  ENSP00000491314
MRTKAAGCAERRPLQPRTEAAAAPAGRAMPSEYTYVKLRSDCSRPSLQWYTRAQSKMRRPSLLLKDILKCTLLVFGVWILYILKLNYTTEECDMKKMHYVDPDHVKTLSPCGWHCVQLIMARWTQPLLHRLLSDSADLHRAFKGSRALPAEAFSEPRHQHLQTESFLSLVLLPAFQAFLGYLRAPEGAALALRHFLLSCELWASSGGGREQLKQMPVQLT

SEQ ID NO: 36572 - protein, 47 aa, Homo sapiens; identical to SEQ ID NO: 36533
  ENSP00000408635

SEQ ID NO: 36573 - protein, 37 aa, Homo sapiens
  ENSP00000491126
MPSEYTYVKLRSDCSRPSLQWYTRAQSKMRRPSLLLK

SEQ ID NO: 36574 - protein, 717 aa, Homo sapiens
  ENSP00000435097
MTMTANKNSSITHGAGGTKAPRGTLSRKSFEFEDASSLQSLYPSSPTENGTENQPKFGSKSTLEENAYEDIVGDLPKENPYEDVDLKSRRAGRKSQQLSENSLDSLHRMWSPQDRKYNSPPTQLSLKPNSQSLRSGNWSERKSHRLPRLPKRHSHDDMLLLAQLSLPSSPSSLNEDSLSTTSELLSSRRARRIPKLVQRINSIYNAKRGKKRLKKLSMSSIETASLRDENSESESDSDDRFKAHTQRLVHIQSMLKRAPSYRTLELELLEWQERELFEYFVVVSLKKKPSRNTYLPEVSYQFPKLDRPTKQMREAEERLKAIPQFCFPDAKDWLPVSEYSSETFSFMLTGEDGSRRFGYCRRLLPSGKGPRLPEVYCVISRLGCFGLFSKVLDEVERRRGISAALVYPFMRSLMESPFPAPGKTIKVKTFLPGAGNEVLELRRPMDSRLEHVDFECLFTCLSVRQLIRIFASLLLERRVIFVADKLSTLSSCSHAVVALLYPFSWQHTFIPVLPASMIDIVCCPTPFLVGLLSSSLPKLKELPVEEALMVNLGSDRFIRQMDDEDTLLPRKLQAALEQALERKNELISQDSDSDSDDECNTLNGLVSEVFIRFFVETVGHYSLFLTQSEKGERAFQREAFRKSVASKSIRRFLEVFMESQMFAGFIQDRELRKCRAKGLFEQRVEQYLEELPDTEQSGMNKFLRGLGNKMKFLHKKN

SEQ ID NO: 36575 - protein, 1137 aa, Homo sapiens
  ENSP00000433528
MTMTANKNSSITHGAGGTKAPRGTLSRSQSVSPPPVLSPPRSPIYPLSDSETSACRYPSHSSSRVLLKDRHPPAPSPQNPQDPSPDTSPPTCPFKTASFGYLDRSPSACKRDAQKESVQGAAQDVAGVAACLPLAQSTPFPGPAAGPRGVLLTRTGTRAHSLGIREKISAWEGRREASPRMSMCGEKREGSGSEWAASEGCPSLGCPSVVPSPCSSEKTFDFKGLRRMSRTFSECSYPETEEEGEALPVRDSFYRLEKRLGRSEPSAFLRGHGSRKESSAVLSRIQKIEQVLKEQPGRGLPQLPSSCYSVDRGKRKTGTLGSLEEPAGGASVSAGSRAVGVAGVAGEAGPPPEREGSGSTKPGTPGNSPSSQRLPSKSSLDPAVNPVPKPKRTFEYEADKNPKSKPSNGLPPSPTPAAPPPLPSTPAPPVTRRPKKDMRGHRKSQSRKSFEFEDASSLQSLYPSSPTENGTENQPKFGSKSTLEENAYEDIVGDLPKENPYEDVDLKSRRAGRKSQQLSENSLDSLHRMWSPQDRKYNSPPTQLSLKPNSQSLRSGNWSERKSHRLPRLPKRHSHDDMLLLAQLSLPSSPSSLNEDSLSTTSELLSSRRARRIPKLVQRINSIYNAKRGKKRLKKLSMSSIETASLRDENSESESDSDDRFKAHTQRLVHIQSMLKRAPSYRTLELELLEWQERELFEYFVVVSLKKKPSRNTYLPEVSYQFPKLDRPTKQMREAEERLKAIPQFCFPDAKDWLPVSEYSSETFSFMLTGEDGSRRFGYCRRLLPSGKGPRLPEVYCVISRLGCFGLFSKVLDEVERRRGISAALVYPFMRSLMESPFPAPGKTIKVKTFLPGAGNEVLELRRPMDSRLEHVDFECLFTCLSVRQLIRIFASLLLERRVIFVADKLSTLSSCSHAVVALLYPFSWQHTFIPVLPASMIDIVCCPTPFLVGLLSSSLPKLKELPVEEALMVNLGSDRFIRQMDDEDTLLPRKLQAALEQALERKNELISQDSDSDSDDECNTLNGLVSEVFIRFFVETVGHYSLFLTQSEKGERAFQREAFRKSVASKSIRRFLEVFMESQMFAGFIQDRELRKCRAKGLFEQRVEQYLEELPDTEQSGMNKFLRGLGNKMKFLHKKN

SEQ ID NO: 36576 - protein, 1137 aa, Homo sapiens; identical to SEQ ID NO: 36575
  ENSP00000319678

SEQ ID NO: 36577 - protein, 609 aa, Homo sapiens
  ENSP00000432887
MWSPQDRKYNSPPTQLSLKPNSQSLRSGNWSERKSHRLPRLPKRHSHDDMLLLAQLSLPSSPSSLNEDSLSTTSELLSSRRARRIPKLVQRINSIYNAKRGKKRLKKLSMSSIETASLRDENSESESDSDDRFKAHTQRLVHIQSMLKRAPSYRTLELELLEWQERELFEYFVVVSLKKKPSRNTYLPEVSYQFPKLDRPTKQMREAEERLKAIPQFCFPDAKDWLPVSEYSSETFSFMLTGEDGSRRFGYCRRLLPSGKGPRLPEVYCVISRLGCFGLFSKVLDEVERRRGISAALVYPFMRSLMESPFPAPGKTIKVKTFLPGAGNEVLELRRPMDSRLEHVDFECLFTCLSVRQLIRIFASLLLERRVIFVADKLSTLSSCSHAVVALLYPFSWQHTFIPVLPASMIDIVCCPTPFLVGLLSSSLPKLKELPVEEALMVNLGSDRFIRQMDDEDTLLPRKLQAALEQALERKNELISQDSDSDSDDECNTLNGLVSEVFIRFFVETVGHYSLFLTQSEKGERAFQREAFRKSVASKSIRRFLEVFMESQMFAGFIQDRELRKCRAKGLFEQRVEQYLEELPDTEQSGMNKFLRGLGNKMKFLHKKN

SEQ ID NO: 36578 - protein, 650 aa, Homo sapiens
  ENSP00000436808
MPTLQRDLPKENPYEDVDLKSRRAGRKSQQLSENSLDSLHRMWSPQDRKYNSPPTQLSLKPNSQSLRSGNWSERKSHRLPRLPKRHSHDDMLLLAQLSLPSSPSSLNEDSLSTTSELLSSRRARRIPKLVQRINSIYNAKRGKKRLKKLSMSSIETASLRDENSESESDSDDRFKAHTQRLVHIQSMLKRAPSYRTLELELLEWQERELFEYFVVVSLKKKPSRNTYLPEVSYQFPKLDRPTKQMREAEERLKAIPQFCFPDAKDWLPVSEYSSETFSFMLTGEDGSRRFGYCRRLLPSGKGPRLPEVYCVISRLGCFGLFSKVLDEVERRRGISAALVYPFMRSLMESPFPAPGKTIKVKTFLPGAGNEVLELRRPMDSRLEHVDFECLFTCLSVRQLIRIFASLLLERRVIFVADKLSTLSSCSHAVVALLYPFSWQHTFIPVLPASMIDIVCCPTPFLVGLLSSSLPKLKELPVEEALMVNLGSDRFIRQMDDEDTLLPRKLQAALEQALERKNELISQDSDSDSDDECNTLNGLVSEVFIRFFVETVGHYSLFLTQSEKGERAFQREAFRKSVASKSIRRFLEVFMESQMFAGFIQDRELRKCRAKGLFEQRVEQYLEELPDTEQSGMNKFLRGLGNKMKFLHKKN

SEQ ID NO: 36579 - protein, 328 aa, Homo sapiens
  ENSP00000433349
MVLDEVERRRGISAALVYPFMRSLMESPFPAPGKTIKVKTFLPGAGNEVLELRRPMDSRLEHVDFECLFTCLSVRQLIRIFASLLLERRVIFVADKLSTLSSCSHAVVALLYPFSWQHTFIPVLPASMIDIVCCPTPFLVGLLSSSLPKLKELPVEEALMVNLGSDRFIRQMDDEDTLLPRKLQAALEQALERKNELISQDSDSDSDDECNTLNGLVSEVFIRFFVETVGHYSLFLTQSEKGERAFQREAFRKSVASKSIRRFLEVFMESQMFAGFIQDRELRKCRAKGLFEQRVEQYLEELPDTEQSGMNKFLRGLGNKMKFLHKKN

SEQ ID NO: 36580 - protein, 717 aa, Homo sapiens; identical to SEQ ID NO: 36574
  ENSP00000436802

SEQ ID NO: 36581 - protein, 111 aa, Homo sapiens
  ENSP00000433043
  MOD_RES (1)..(1): Any amino acid
XPASVCASSSESLPHCCWSAGSFLWQISSAASEHIPGPFWEGRSQGLVLGLAGYSSSANLGSWKRCPSCSAWGLPLAGEGRVPSPAAPTRWWPCSTPSPGSTPSFLSSRPP

SEQ ID NO: 36582 - protein, 344 aa, Homo sapiens
  ENSP00000433588
MWSPQDRKYNSPPTQLSLKPNSQSLRSGNWSERKSHRLPRLPKRHSHDDMLLLAQLSLPSSPSSLNEDSLSTTSELLSSRRARRIPKLVQRINSIYNAKRGKKRLKKLSMSSIETASLRDENSESESDSDDRFKAHTQRLVHIQSMLKRAPSYRTLELELLEWQERELFEYFVVVSLKKKPSRNTYLPEVSYQFPKLDRPTKQMREAEERLKAIPQFCFPDAKDWLPVSEYSSETFSFMLTGEDGSRRFGYCRRLLPSGKGPRLPEVYCVISRLGCFGLFSKVLDEVERRRGISAALVYPFMRSLMESPFPAPGKTIKVKTFLPGAGNEVLELRRPMDSRLEHV

SEQ ID NO: 36583 - protein, 98 aa, Homo sapiens
  ENSP00000435016
  MOD_RES (1)..(1): Any amino acid
XVHIQSMLKRAPSYRTLELELLEWQERELFEYFVVVSLKKKPSRNTYLPEVSYQFPKLDRPTKQMREAEERLKAIPQFCFPDAKDWLPVSEYSPLTPP

SEQ ID NO: 36584 - protein, 356 aa, Homo sapiens
  ENSP00000433793
MTSRKNGGGAHSWQETPWEQRRALGLQRAEMTMTANKNSSITHGAGGTKAPRGTLSRKSFEFEDASSLQSLYPSSPTENGTENQPKFGSKSTLEENAYEDIVGDLPKENPYEDVDLKSRRAGRKSQQLSENSLDSLHRMWSPQDRKYNSPPTQLSLKPNSQSLRSGNWSERKSHRLPRLPKRHSHDDMLLLAQLSLPSSPSSLNEDSLSTTSELLSSRRARRIPKLVQRINSIYNAKRGKKRLKKLSMSSIETASLRDENSESESDSDDRFKAHTQRLVHIQSMLKRAPSYRTLELELLEWQERELFEYFVVVSLKKKPSRNTYLPEVSYQFPKECAFSSSSRGCWLLLISQALLK

SEQ ID NO: 36585 - protein, 217 aa, Homo sapiens
  ENSP00000437096
MWSPQDRKYNSPPTQLSLKPNSQSLRSGNWSERKSHRLPRLPKRHSHDDMLLLAQLSLPSSPSSLNEDSLSTTSELLSSRRARRIPKLVQRINSIYNAKRGKKRLKKLSMSSIETASLRAHTQRLVHIQSMLKRAPSYRTLELELLEWQERELFEYFVVVSLKKKPSRNTYLPEVSYQFPKLDRPTKQMREAEERLKAIPQFCFPDAKDWLPVSEYS

SEQ ID NO: 36586 - protein, 179 aa, Homo sapiens
  ENSP00000431580
MWSPQDRKYNSPPTQLSLKPNSQSLRSGNWSERKSHRLPRLPKRHSHDDMLLLAQLSLPSSPSSLNEDSLSTTSELLSSRRARRIPKLVQRINSIYNAKRGKKRLKKLSMSSIETASLRDENSESESDSDDRFKAHTQRLVHIQSMLKRAPSYRTLELELLEWQERELFEYFVVVSLKK

SEQ ID NO: 36587 - protein, 145 aa, Homo sapiens
  ENSP00000433858
GRKSQQLSENSLDSLHRMWSPQDRKYNSPPTQLSLKPNSQSLRSGNWSERKSHRLPRLPKRHSHDDMLLLAQLSLPSSPSSLNEDSLSTTSELLSSRRARRIPKVPSPEAAHWSRAGGRAGSQPFSLFPGFLPSLIWTASSIPFE

SEQ ID NO: 36588 - protein, 47 aa, Homo sapiens
  ENSP00000437006
MWSPQDRKYNSPPTQLSLKPNSQSLRSGNWSERKSHRLPRLPKRHSH

SEQ ID NO: 36589 - protein, 148 aa, Homo sapiens
  ENSP00000431564
MTMTANKNSSITHGAGGTKAPRGTLSRKSFEFEDASSLQSLYPSSPTENGTENQPKFGSKSTLEENAYEDIVGDLPKENPYEDVDLKSRRAGRKSQQLSENSLDSLHRMWSPQDRKYNSPPTQLSLKPNSQSLRSGNWSERKSHRLPR

SEQ ID NO: 36590 - protein, 137 aa, Homo sapiens
  ENSP00000434701
MTMTANKNSSITHGAGGTKAPRGTLSRKSFEFEDASSLQSLYPSSPTENGTENQPKFGSKSTLEENAYEDIVGDLPKENPYEDVDLKSRRAGRKSQQLSENSLDSLHRMWSPQDRKYNSPPTQPVPAQWELVRKEEP

SEQ ID NO: 36591 - protein, 135 aa, Homo sapiens
  ENSP00000432521
MTMTANKNSSITHGAGGTKAPRGTLSRKSFEFEDASSLQSLYPSSPTENGTENQPKFGSKSTLEENAYEDIVGDLPKENPYEDVDLKSRRAGRKSQQLSENSLDSLHRMWSPQDRKYNSPPTQLSLKPNSQSLRS

SEQ ID NO: 36592 - protein, 77 aa, Homo sapiens
  ENSP00000436506
MTMTANKNSSITHGAGGTKAPRGTLSRKSFEFEDASSLQSLYPSSPTENGTENQPKFGSKSTLEENAYEDIVGDLPK

SEQ ID NO: 36593 - protein, 76 aa, Homo sapiens
  ENSP00000435292
MTMTANKNSSITHGAGGTKAPRGTLSRKSFEFEDASSLQSLYPSSPTENGTENQPKFGSKSTLEENAYEDIVGDLP

SEQ ID NO: 36594 - protein, 72 aa, Homo sapiens
  ENSP00000436760
MTMTANKNSSITHGAGGTKAPRGTLSRKSFEFEDASSLQSLYPSSPTENGTENQPKFGSKSTLEENAYEDIV

SEQ ID NO: 36595 - protein, 154 aa, Homo sapiens
  ENSP00000433647
MTMTANKNSSITHGAGGTKAPRGTLSRSQSVSPPPVLSPPRSPIYPLSDSETSACRYPSHSSSRVLLKDRHPPAPSPQNPQDPSPDTSPPTCPFKTASFGYLDRSPSACKRDAQKESVQGAAQDVAGVAACLPLAQSTPFPGPAAGPRGVLLTR

SEQ ID NO: 36596 - protein, 183 aa, Homo sapiens
  ENSP00000431252
MTSRKNGGGAHSWQETPWEQRRALGLQRAEMTMTANKNSSITHGAGGTKAPRGTLSRSQSVSPPPVLSPPRSPIYPLSDSETSACRYPSHSSSRVLLKDRHPPAPSPQNPQDPSPDTSPPTCPFKTASFGYLDRSPSACKRDAQKESVQGAAQDVAGVAACLPLAQSTPFPGPAAGPRGVLLT

SEQ ID NO: 36597 - protein, 144 aa, Homo sapiens
  ENSP00000434935
MTMTANKNSSITHGAGGTKAPRGTLSRSQSVSPPPVLSPPRSPIYPLSDSETSACRYPSHSSSRVLLKDRHPPAPSPQNPQDPSPDTSPPTCPFKTASFGYLDRSPSACKRDAQKESVQGAAQDVAGVAACLPLAQSTPFPGPA

SEQ ID NO: 36598 - protein, 142 aa, Homo sapiens
  ENSP00000433346
MTMTANKNSSITHGAGGTKAPRGTLSRSQSVSPPPVLSPPRSPIYPLSDSETSACRYPSHSSSRVLLKDRHPPAPSPQNPQDPSPDTSPPTCPFKTASFGYLDRSPSACKRDAQKESVQGAAQDVAGVAACLPLAQSTPFPG

SEQ ID NO: 36599 - protein, 139 aa, Homo sapiens
  ENSP00000433008
MTMTANKNSSITHGAGGTKAPRGTLSRSQSVSPPPVLSPPRSPIYPLSDSETSACRYPSHSSSRVLLKDRHPPAPSPQNPQDPSPDTSPPTCPFKTASFGYLDRSPSACKRDAQKESVQGAAQDVAGVAACLPLAQSTP

SEQ ID NO: 36600 - protein, 155 aa, Homo sapiens
  ENSP00000431332
MQFVEKFQRALGLQRAEMTMTANKNSSITHGAGGTKAPRGTLSRSQSVSPPPVLSPPRSPIYPLSDSETSACRYPSHSSSRVLLKDRHPPAPSPQNPQDPSPDTSPPTCPFKTASFGYLDRSPSACKRDAQKESVQGAAQDVAGVAACLPLAQST

SEQ ID NO: 36601 - protein, 124 aa, Homo sapiens
  ENSP00000431139
MTMTANKNSSITHGAGGTKAPRGTLSRSQSVSPPPVLSPPRSPIYPLSDSETSACRYPSHSSSRVLLKDRHPPAPSPQNPQDPSPDTSPPTCPFKTASFGYLDRSPSACKRDAQKESVQGAAQD

SEQ ID NO: 36602 - protein, 122 aa, Homo sapiens
  ENSP00000432872
MTMTANKNSSITHGAGGTKAPRGTLSRSQSVSPPPVLSPPRSPIYPLSDSETSACRYPSHSSSRVLLKDRHPPAPSPQNPQDPSPDTSPPTCPFKTASFGYLDRSPSACKRDAQKESVQGAA

SEQ ID NO: 36603 - protein, 111 aa, Homo sapiens
  ENSP00000431673
MTMTANKNSSITHGAGGTKAPRGTLSRSQSVSPPPVLSPPRSPIYPLSDSETSACRYPSHSSSRVLLKDRHPPAPSPQNPQDPSPDTSPPTCPFKTASFGYLDRSPSACKR

SEQ ID NO: 36604 - protein, 123 aa, Homo sapiens
  ENSP00000434332
MFGAEGVLPGERALGLQRAEMTMTANKNSSITHGAGGTKAPRGTLSRSQSVSPPPVLSPPRSPIYPLSDSETSACRYPSHSSSRVLLKDRHPPAPSPQNPQDPSPDTSPPTCPFKTASFGYLD

SEQ ID NO: 36605 - protein, 95 aa, Homo sapiens
  ENSP00000431990
MTMTANKNSSITHGAGGTKAPRGTLSRSQSVSPPPVLSPPRSPIYPLSDSETSACRYPSHSSSRVLLKDRHPPAPSPQNPQDPSPDTSPPTCPFK

SEQ ID NO: 36606 - protein, 83 aa, Homo sapiens
  ENSP00000435228
MTMTANKNSSITHGAGGTKAPRGTLSRSQSVSPPPVLSPPRSPIYPLSDSETSACRYPSHSSSRVLLKDRHPPAPSPQNPQDP

SEQ ID NO: 36607 - protein, 74 aa, Homo sapiens
  ENSP00000436748
MTMTANKNSSITHGAGGTKAPRGTLSRSQSVSPPPVLSPPRSPIYPLSDSETSACRYPSHSSSRVLLKDRHPPA

SEQ ID NO: 36608 - protein, 74 aa, Homo sapiens; identical to SEQ ID NO: 36607
  ENSP00000434930

SEQ ID NO: 36609 - protein, 57 aa, Homo sapiens
  ENSP00000435925
MTMTANKNSSITHGAGGTKAPRGTLSRSQSVSPPPVLSPPRSPIYPLSDSETSACRY

SEQ ID NO: 36610 - protein, 53 aa, Homo sapiens
  ENSP00000435180
MTMTANKNSSITHGAGGTKAPRGTLSRSQSVSPPPVLSPPRSPIYPLSDSETS

SEQ ID NO: 36611 - protein, 52 aa, Homo sapiens
  ENSP00000435562
MTMTANKNSSITHGAGGTKAPRGTLSRSQSVSPPPVLSPPRSPIYPLSDSET

SEQ ID NO: 36612 - protein, 40 aa, Homo sapiens
  ENSP00000433175
MTMTANKNSSITHGAGGTKAPRGTLSRSQSVSPPPVLSPP

SEQ ID NO: 36613 - protein, 30 aa, Homo sapiens
  ENSP00000436363
MTMTANKNSSITHGAGGTKAPRGTLSRSQS

SEQ ID NO: 36614 - protein, 26 aa, Homo sapiens
  ENSP00000436154
MTMTANKNSSITHGAGGTKAPRGTLS

SEQ ID NO: 36615 - protein, 356 aa, Homo sapiens; identical to SEQ ID NO: 36584
  ENSP00000486899

SEQ ID NO: 36616 - protein, 529 aa, Homo sapiens
  ENSP00000355273
MKPHLKQWRQRMLFGIFAWGLLFLLIFIYFTDSNPAEPVPSSLSFLETRRLLPVQGKQRAIMGAAHEPSPPGGLDARQALPRAHPAGSFHAGPGDLQKWAQSQDGFEHKEFFSSQVGRKSQSAFYPEDDDYFFAAGQPGWHSHTQGTLGFPSPGEPGPREGAFPAAQVQRRRVKKRHRRQRRSHVLEEGDDGDRLYSSMSRAFLYRLWKGNVSSKMLNPRLQKAMKDYLTANKHGVRFRGKREAGLSRAQLLCQLRSRARVRTLDGTEAPFSALGWRRLVPAVPLSQLHPRGLRSCAVVMSAGAILNSSLGEEIDSHDAVLRFNSAPTRGYEKDVGNKTTIRIINSQILTNPSHHFIDSSLYKDVILVAWDPAPYSANLNLWYKKPDYNLFTPYIQHRQRNPNQPFYILHPKFIWQLWDIIQENTKEKIQPNPPSSGFIGILIMMSMCREVHVYEYIPSVRQTELCHYHELYYDAACTLGAYHPLLYEKLLVQRLNMGTQGDLHRKGKVVLPGFQAVHCPAPSPVIPHS

SEQ ID NO: 36617 - protein, 529 aa, Homo sapiens; identical to SEQ ID NO: 36616
  ENSP00000386942

SEQ ID NO: 36618 - protein, 95 aa, Homo sapiens
  ENSP00000355386
  MOD_RES (1)..(1): Any amino acid
XSGFIGILIMMSMCREVHVYEYIPSVRQTELCHYHELYYDAACTLGAYHPLLYEKLLVQRLNMGTQGDLHRKGKVVLPGFQAVHCPAPSPVIPHS

SEQ ID NO: 36619 - protein, 466 aa, Homo sapiens
  ENSP00000387332
MKPHLKQWRQRMLFGIFAWGLLFLLIFIYFTDSNPAEPVPSSLSFLETRRLLPVQGKQRAIMGAAHEPSPPGGLDARQALPRAHPAGSFHAGPGDLQKWAQSQDGFEHKEFFSSQVGRKSQSAFYPEDDDYFFAAGQPGWHSHTQGTLGFPSPGEPGPREGAFPAAQVQRRRVKKRHRRQRRSHVLEEGDDGDRLYSSMSRAFLYRLWKGNVSSKMLNPRLQKAMKDYLTANKHGVRFRGKREAGLSRAQLLCQLRSRARVRTLDGTEAPFSALGWRRLVPAVPLSQLHPRGLRSCAVVMSAGAILNSSLGEEIDSHDAVLRFNSAPTRGYEKDVGNKTTIRIINSQILTNPSHHFIDSSLYKDVILVAWDPAPYSANLNLWYKKPDYNLFTPYIQHRQRNPNQPFYILHPKFIWQLWDIIQENTKEKIQPNPPSSGFIGSFVKIGHIRACSEPRSRDCTPAWTTE

SEQ ID NO: 36620 - protein, 34 aa, Homo sapiens
  ENSP00000395581
MKPHLKQWRQRMLFGIFAWGLLFLLIFIYFTDSN

SEQ ID NO: 36621 - protein, 305 aa, Homo sapiens
  ENSP00000329214
MACILKRKSVIAVSFIAAFLFLLVVRLVNEVNFPLLLNCFGQPGTKWIPFSYTYRRPLRTHYGYINVKTQEPLQLDCDLCAIVSNSGQMVGQKVGNEIDRSSCIWRMNNAPTKGYEEDVGRMTMIRVVSHTSVPLLLKNPDYFFKEANTTIYVIWGPFRNMRKDGNGIVYNMLKKTVGIYPNAQIYVTTEKRMSYCDGVFKKETGKDRVQSGSYLSTGWFTFLLAMDACYGIHVYGMINDTYCKTEGYRKVPYHYYEQGRDECDEYFLHEHAPYGGHRFITEKKVFAKWAKKHRIIFTHPNWTLS

SEQ ID NO: 36622 - protein, 139 aa, Homo sapiens [sequence omitted]

SEQ ID NO: 36623 - protein, 336 aa, Homo sapiens
  ENSP00000417583
MKTLMRHGLAVCLALTTMCTSLLLVYSSLGGQKERPPQQQQQQQQQQQQASATGSSQPAAESSTQQRPGVPAGPRPLDGYLGVADHKPLKMHCRDCALVTSSGHLLHSRQGSQIDQTECVIRMNDAPTRGYGRDVGNRTSLRVIAHSSIQRILRNRHDLLNVSQGTVFIFWGPSSYMRRDGKGQVYNNLHLLSQVLPRLKAFMITRHKMLQFDELFKQETGKDRKISNTWLSTGWFTMTIALELCDRINVYGMVPPDFCRDPNHPSVPYHYYEPFGPDECTMYLSHERGRKGSHHRFITEKRVFKNWARTFNIHFFQPDWKPESLAINHPENKPVF

SEQ ID NO: 36624 - protein, 236 aa, Homo sapiens
  ENSP00000436263
MKTLMRHGLAVCLALTTMCTSLLLVYSSLGGQKERPPQQQQQQQQQQQQASATGSSQPAAESSTQQRPGVPAGPRPLDGYLGVADHKPLKMHCRDCALVTSSGHLLHSRQGSQIDQTECVIRMNDAPTRGYGRDVGNRTSLRVIAHSSIQRILRNRHDLLNVSQGTVFIFWGPSSYMRRDGKGQVYNNLHLLSQVLPRLKAFMITRHKMLQFDELFKQETGKDRYPTLGSALAGLQ

SEQ ID NO: 36625 - protein, 2551 aa, Homo sapiens
  ENSP00000373539
MMLQHLVIFCLGLVVQNFCSPAETTGQARRCDRKSLLTIRTECRSCALNLGVKCPDGYTMITSGSVGVRDCRYTFEVRTYSLSLPGCRHICRKDYLQPRCCPGRWGPDCIECPGGAGSPCNGRGSCAEGMEGNGTCSCQEGFGGTACETCADDNLFGPSCSSVCNCVHGVCNSGLDGDGTCECYSAYTGPKCDKPIPECAALLCPENSRCSPSTEDENKLECKCLPNYRGDGKYCDPINPCLRKICHPHAHCTYLGPNRHSCTCQEGYRGDGQVCLPVDPCQINFGNCPTKSTVCKYDGPGQSHCECKEHYQNFVPGVGCSMTDICKSDNPCHRNANCTTVAPGRTECICQKGYVGDGLTCYGNIMERLRELNTEPRGKWQGRLTSFISLLDKAYAWPLSKLGPFTVLLPTDKGLKGFNVNELLVDNKAAQYFVKLHIIAGQMNIEYMNNTDMFYTLTGKSGEIFNSDKDNQIKLKLHGGKKKVKIIQGDIIASNGLLHILDRAMDKLEPTFESNNEQTIMTMLQPRYSKFRSLLEETNLGHALDEDGVGGPYTIFVPNNEALNNMKDGTLDYLLSPEGSRKLLELVRYHIVPFTQLEVATLISTPHIRSMANQLIQFNTTDNGQILANDVAMEEIEITAKNGRIYTLTGVLIPPSIVPILPHRCDETKREMKLGTCVSCSLVYWSRCPANSEPTALFTHRCVYSGRFGSLKSGCARYCNATVKIPKCCKGFYGPDCNQCPGGFSNPCSGNGQCADSLGGNGTCICEEGFQGSQCQFCSDPNKYGPRCNKKCLCVHGTCNNRIDSDGACLTGTCRDGSAGRLCDKQTSACGPYVQFCHIHATCEYSNGTASCICKAGYEGDGTLCSEMDPCTGLTPGGCSRNAECIKTGTGTHTCVCQQGWTGNGRDCSEINNCLLPSAGGCHDNASCLYVGPGQNECECKKGFRGNGIDCEPITSCLEQTGKCHPLASCQSTSSGVWSCVCQEGYEGDGFLCYGNAAVELSFLSEAAIFNRWINNASLQPTLSATSNLTVLVPSQQATEDMDQDEKSFWLSQSNIPALIKYHMLLGTYRVADLQTLSSSDMLATSLQGNFLHLAKVDGNITIEGASIVDGDNAATNGVIHIINKVLVPQRRLTGSLPNLLMRLEQMPDYSIFRGYIIQYNLANAIEAADAYTVFAPNNNAIENYIREKKVLSLEEDVLRYHVVLEEKLLKNDLHNGMHRETMLGFSYFLSFFLHNDQLYVNEAPINYTNVATDKGVIHGLGKVLEIQKNRCDNNDTTIIRGRCRTCSSELTCPFGTKSLGNEKRRCIYTSYFMGRRTLFIGCQPKCVRTVITRECCAGFFGPQCQPCPGNAQNVCFGNGICLDGVNGTGVCECGEGFSGTACETCTEGKYGIHCDQACSCVHGRCNQGPLGDGSCDCDVGWRGVHCDNATTEDNCNGTCHTSANCLTNSDGTASCKCAAGFQGNGTICTAINACEISNGGCSAKADCKRTTPGRRVCTCKAGYTGDGIVCLEINPCLENHGGCDKNAECTQTGPNQAACNCLPAYTGDGKVCTLINVCLTKNGGCSEFAICNHTGQVERTCTCKPNYIGDGFTCRGSIYQELPKNPKTSQYFFQLQEHFVKDLVGPGPFTVFAPLSAAFDEEARVKDWDKYGLMPQVLRYHVVACHQLLLENLKLISNATSLQGEPIVISVSQSTVYINNKAKIISSDIISTNGIVHIIDKLLSPKNLLITPKDNSGRILQNLTTLATNNGYIKFSNLIQDSGLLSVITDPIHTPVTLFWPTDQALHALPAEQQDFLFNQDNKDKLKEYLKFHVIRDAKVLAVDLPTSTAWKTLQGSELSVKCGAGRDIGDLFLNGQTCRIVQRELLFDLGVAYGIDCLLIDPTLGGRCDTFTTFDASGECGSCVNTPSCPRWSKPKGVKQKCLYNLPFKRNLEGCRERCSLVIQIPRCCKGYFGRDCQACPGGPDAPCNNRGVCLDQYSATGECKCNTGFNGTACEMCWPGRFGPDCLPCGCSDHGQCDDGITGSGQCLCETGWTGPSCDTQAVLPAVCTPPCSAHATCKENNTCECNLDYEGDGITCTVVDFCKQDNGGCAKVARCSQKGTKVSCSCQKGYKGDGHSCTEIDPCADGLNGGCHEHATCKMTGPGKHKCECKSHYVGDGLNCEPEQLPIDRCLQDNGQCHADAKCVDLHFQDTTVGVFHLRSPLGQYKLTFDKAREACANEAATMATYNQLSYAQKAKYHLCSAGWLETGRVAYPTAFASQNCGSGVVGIVDYGPRPNKSEMWDVFCYRMKDVNCTCKVGYVGDGFSCSGNLLQVLMSFPSLTNFLTEVLAYSNSSARGRAFLEHLTDLSIRGTLFVPQNSGLGENETLSGRDIEHHLANVSMFFYNDLVNGTTLQTRLGSKLLITASQDPLQPTETRFVDGRAILQWDIFASNGIIHVISRPLKAPPAPVTLTHTGLGAGIFFAIILVTGAVALAAYSYFRINRRTIGFQHFESEEDINVAALGKQQPENISNPLYESTTSAPPEPSYDPFTDSEERQLEGNDPLRTL

SEQ ID NO: 36626 - protein, 33 aa, Homo sapiens
  ENSP00000449282
QKNRCDNNDTTIIRGRCRTCSSELTCPFGTKSL

SEQ ID NO: 36627 - protein, 135 aa, Homo sapiens
  ENSP00000446629
EDINVAALGKQQPENISNPLYESTTSAPPEPSYDPFTMKKLQPSWDDLSWATQLQAGETKTGGPTPSPSCLPTQGSSTNKHAQHIRVHSAQGESCLRPVATRKIQLGLNTQNALPPYNPLFSRTLKNGSLRAMTP

SEQ ID NO: 36628 - protein, 402 aa, Homo sapiens
  ENSP00000273183
MIPPSSPREDGVDGLPKEAVGAEQPPSPASTSSQESKLQKLKRSLSFKTKSLRSKSADNFFQRTNSEDMKLQAHMVAEISPSSSPLPAPGSLTSTPARAGLHPGGKAHAFQEYIFKKPTFCDVCNHMIVGTNAKHGLRCKACKMSIHHKCTDGLAPQRCMGKLPKGFRRYYSSPLLIHEQFGCIKEVMPIACGNKVDPVYETLRFGTSLAQRTKKGSSGSGSDSPHRTSTSDLVEVPEEANGPGGGYDLRKRSNSVFTYPENGTDDFRDPAKNINHQGSLSKDPLQMNTYVALYKFVPQENEDLEMRPGDIITLLEDSNEDWWKGKIQDRIGFFPANFVQRLQQNEKIFRCVRTFIGCKEQGQITLKENQICVSSEEEQDGFIRVLSGKKKGLIPLDVLENI

SEQ ID NO: 36629 - protein, 341 aa, Homo sapiens
  ENSP00000393713
MIPPSSPREDGVDGLPKEAVGAEQPPSPASTSSQESKLQKLKRSLSFKTKSLRSKSADNFFQRTNSEDMKLQAHMVAEISPSSSPLPAPGSLTSTPARAGLHPGGKAHAFQEYIFKKPTFCDVCNHMIVACGNKVDPVYETLRFGTSLAQRTKKGSSGSGSDSPHRTSTSDLVEVPEEANGPGGGYDLRKRSNSVFTYPENGTDDFRDPAKNINHQGSLSKDPLQMNTYVALYKFVPQENEDLEMRPGDIITLLEDSNEDWWKGKIQDRIGFFPANFVQRLQQNEKIFRCVRTFIGCKEQGQITLKENQICVSSEEEQDGFIRVLSGKKKGLIPLDVLENI

SEQ ID NO: 36630 - protein, 51 aa, Homo sapiens
  ENSP00000397521
MIPPSSPREDGVDGLPKEAVGAEQPPSPASTSSQESKEQMLSMDCAAKPVR

SEQ ID NO: 36631 - protein, 252 aa, Homo sapiens
  ENSP00000398403
MIPPSSPREDGVDGLPKEAVGAEQPPSPASTSSQESKTKSLRSKSADNFFQRTNSEDMKLQAHMVAEISPSSSPLPAPGSLTSTPARAGLHPGGKAHAFQEYIFKKPTFCDVCNHMIVACGNKVDPVYETLRFGTSLAQRTKKGSSGSGSDSPHRTSTSDLVEVPEEANGPGGGYDLRKRSNSVFTYPENGTDDFRDPAKNINHQGSLSKDPLQMNTYVALYKFVPQENEDLEMRPGDIITLLEDSNEDWWK

SEQ ID NO: 36632 - protein, 411 aa, Homo sapiens
  ENSP00000327509
MTEMSEKENEPDDAATHSPPGTVSALQETKLQRFKRSLSLKTILRSKSLENFFLRSGSELKCPTEVLLTPPTPLPPPSPPPTASDRGLATPSPSPCPVPRPLAALKPVRLHSFQEHVFKRASPCELCHQLIVGNSKQGLRCKMCKVSVHLWCSEEISHQQCPGKTSTSFRRNFSSPLLVHEPPPVCATSKESPPTGDSGKVDPVYETLRYGTSLALMNRSSFSSTSESPTRSLSERDELTEDGEGSIRSSEEGPGDSASPVFTAPAESEGPGPEEKSPGQQLPKATLRKDVGPMYSYVALYKFLPQENNDLALQPGDRIMLVDDSNEDWWKGKIGDRVGFFPANFVQRVRPGENVWRCCQPFSGNKEQGYMSLKENQICVGVGRSKDADGFIRVSSGKKRGLVPVDALTEI

SEQ ID NO: 36633 - protein, 148 aa, Homo sapiens
  ENSP00000463299
MTEMSEKENEPDDAATHSPPGTVSALQETKLQRFKRSLSLKTILRSKSLENFFLRSGSELKCPTEETPNRACDVRCAKSASTSGALRRSPTSNAQARRPPPSAATSVPLSWCMSRHQSVPQAKSPHPLGTVGRWTLSTRPCAMAPPWH

SEQ ID NO: 36634 - protein, 1225 aa, Homo sapiens
  ENSP00000400359
MSSPLQRAVGDTKRALSASSSSSASLPFDDRDSNHTSEGNGDSLLADEDTDFEDSLNRNVKKRAAKRPPKTTPVAKHPKKGSRVVHRHSRKQSEPPANDLFNAVKAAKSDMQSLVDEWLDSYKQDQDAGFLELVNFFIQSCGCKGIVTPEMFKKMSNSEIIQHLTEQFNEDSGDYPLIAPGPSWKKFQGSFCEFVRTLVCQCQYSLLYDGFPMDDLISLLTGLSDSQVRAFRHTSTLAAMKLMTSLVKVALQLSVHQDNNQRQYEAERNKGPGQRAPERLESLLEKRKELQEHQEEIEGMMNALFRGVFVHRYRDVLPEIRAICIEEIGCWMQSYSTSFLTDSYLKYIGWTLHDKHREVRLKCVKALKGLYGNRDLTTRLELFTSRFKDRMVSMVMDREYDVAVEAVRLLILILKNMEGVLTDADCESVYPVVYASHRGLASAAGEFLYWKLFYPECEIRMMGGREQRQSPGAQRTFFQLLLSFFVESELHDHAAYLVDSLWDCAGARLKDWEGLTSLLLEKDQNLGDVQESTLIEILVSSARQASEGHPPVGRVTGRKGLTSKERKTQADDRVKLTEHLIPLLPQLLAKFSADAEKVTPLLQLLSCFDLHIYCTGRLEKHLELFLQQLQEVVVKHAEPAVLEAGAHALYLLCNPEFTFFSRADFARSQLVDLLTDRFQQELEELLQSSFLDEDEVYNLAATLKRLSAFYNTHDLTRWELYEPCCQLLQKAVDTGEVPHQVILPALTLVYFSILWTLTHISKSDASQKQLSSLRDRMVAFCELCQSCLSDVDTEIQEQAFVLLSDLLLIFSPQMIVGGRDFLRPLVFFPEATLQSELASFLMDHVFIQPGDLGSGDSQEDHLQIERLHQRRRLLAGFCKLLLYGVLEMDAASDVFKHYNKFYNDYGDIIKETLTRARQIDRSHCSRILLLSLKQLYTELLQEHGPQGLNELPAFIEMRDLARRFALSFGPQQLQNRDLVVMLHKEGIQFSLSELPPAGSSNQPPNLAFLELLSEFSPRLFHQDKQLLLSYLEKCLQHVSQAPGHPWGPVTTYCHSLSPVENTAETSPQVLPSSKRRRVEGPAKPNREDVSSSQEESLQLNSIPPTPTLTSTAVKSRQPLWGLKEMEEEDGSELDFAQGQPVAGTERSRFLGPQYFQTPHNPSGPGLGNQLMRLSLMEEDEEEELEIQDESNEERQDTDMQASSYSSTSERGLDLLDSTELDIEDF

SEQ ID NO: 36635 - protein, 1167 aa, Homo sapiens
  ENSP00000377586
MSSPLQRAVGDTKRALSASSSSSASLPFDDRDSNHTSEGNGDSLLADEDTDFEDSLNRNVKKRAAKRPPKTTPVAKHPKKGSRVVHRHSRKQSEPPANDLFNAVKAAKSDMQDSGDYPLIAPGPSWKKFQGSFCEFVRTLVCQCQYSLLYDGFPMDDLISLLTGLSDSQVRAFRHTSTLAAMKLMTSLVKVALQLSVHQDNNQRQYEAERNKGPGQRAPERLESLLEKRKELQEHQEEIEGMMNALFRGVFVHRYRDVLPEIRAICIEEIGCWMQSYSTSFLTDSYLKYIGWTLHDKHREVRLKCVKALKGLYGNRDLTTRLELFTSRFKDRMVSMVMDREYDVAVEAVRLLILILKNMEGVLTDADCESVYPVVYASHRGLASAAGEFLYWKLFYPECEIRMMGGREQRQSPGAQRTFFQLLLSFFVESELHDHAAYLVDSLWDCAGARLKDWEGLTSLLLEKDQNLGDVQESTLIEILVSSARQASEGHPPVGRVTGRKGLTSKERKTQADDRVKLTEHLIPLLPQLLAKFSADAEKVTPLLQLLSCFDLHIYCTGRLEKHLELFLQQLQEVVVKHAEPAVLEAGAHALYLLCNPEFTFFSRADFARSQLVDLLTDRFQQELEELLQSSFLDEDEVYNLAATLKRLSAFYNTHDLTRWELYEPCCQLLQKAVDTGEVPHQVILPALTLVYFSILWTLTHISKSDASQKQLSSLRDRMVAFCELCQSCLSDVDTEIQEQAFVLLSDLLLIFSPQMIVGGRDFLRPLVFFPEATLQSELASFLMDHVFIQPGDLGSGDSQEDHLQIERLHQRRRLLAGFCKLLLYGVLEMDAASDVFKHYNKFYNDYGDIIKETLTRARQIDRSHCSRILLLSLKQLYTELLQEHGPQGLNELPAFIEMRDLARRFALSFGPQQLQNRDLVVMLHKEGIQFSLSELPPAGSSNQPPNLAFLELLSEFSPRLFHQDKQLLLSYLEKCLQHVSQAPGHPWGPVTTYCHSLSPVENTAETSPQVLPSSKRRRVEGPAKPNREDVSSSQEESLQLNSIPPTPTLTSTAVKSRQPLWGLKEMEEEDGSELDFAQGQPVAGTERSRFLGPQYFQTPHNPSGPGLGNQLMRLSLMEEDEEEELEIQDESNEERQDTDMQASSYSSTSERGLDLLDSTELDIEDF

SEQ ID NO: 36636 - protein, 144 aa, Homo sapiens
  ENSP00000409283
MSSPLQRAVGDTKRALSASSSSSASLPFDDRDSNHTSEGNGDSLLADEDTDFEDSLNRNVKKRAAKRPPKTTPVAKHPKKGSRVVHRHSRKQSEPPANDLFNAVKAAKSDMQSLVDEWLDSYKQDQDAGFLELVNFFIQSCGCK

SEQ ID NO: 36637 - protein, 1225 aa, Homo sapiens; identical to SEQ ID NO: 36634
  ENSP00000319318

SEQ ID NO: 36638 - protein, 112 aa, Homo sapiens
  ENSP00000407884
MSSPLQRAVGDTKRALSASSSSSASLPFDDRDSNHTSEGNGDSLLADEDTDFEDSLNRNVKKRAAKRPPKTTPVAKHPKKGSRVVHRHSRKQSEPPANDLFNAVKAAKSDMQ

SEQ ID NO: 36639 - protein, 188 aa, Homo sapiens
  ENSP00000397067
MSSPLQRAVGDTKRALSASSSSSASLPFDDRDSNHTSEGNGDSLLADEDTDFEDSLNRNVKKRAAKRPPKTTPVAKHPKKGSRVVHRHSRKQSEPPANDLFNAVKAAKSDMQDSGDYPLIAPGPSWKKFQGSFCEFVRTLVCQCQYSLLYDGFPMDDLISLLTGLSDSQVRAFRHTSTLAAMKLMTSL

SEQ ID NO: 36640 - protein, 184 aa, Homo sapiens
  ENSP00000395039
GHPWGPVTTYCHSLSPVENTAETSPQVLPSSKRRRVEGPAKPNREDVSSSQEESLQLNSIPPTPTLTSTAVKSRQPLWGLKEMEEEDGSELDFAQGSQPVAGTERSRFLGPQYFQTPHNPSGPGLGNQLMRLSLMEEDEEEELEIQDESNEERQDTDMQASSYSSTSERGLDLLDSTELDIEDF

SEQ ID NO: 36641 - protein, 172 aa, Homo sapiens
  ENSP00000393790
PSSKRRRVEGPAKPNREDVSSSQEESLQLNSIPPTPTLTSTAVKSRQPLWGLKEMEEEDGSELDFAQGSQPVAGTERSRFLGPQYFQTPHNPSGPGLGNQLMRLSLMEEDEEEELEIQDESNEERQDTDMQASSYSSTSERGLDLLDSTELDIEITESLPLLGKSPHPYNSR

SEQ ID NO: 36642 - protein, 1167 aa, Homo sapiens; identical to SEQ ID NO: 36635
  ENSP00000484098

SEQ ID NO: 36643 - protein, 1226 aa, Homo sapiens
  ENSP00000477973
MSSPLQRAVGDTKRALSASSSSSASLPFDDRDSNHTSEGNGDSLLADEDTDFEDSLNRNVKKRAAKRPPKTTPVAKHPKKGSRVVHRHSRKQSEPPANDLFNAVKAAKSDMQSLVDEWLDSYKQDQDAGFLELVNFFIQSCGCKGIVTPEMFKKMSNSEIIQHLTEQFNEDSGDYPLIAPGPSWKKFQGSFCEFVRTLVCQCQYSLLYDGFPMDDLISLLTGLSDSQVRAFRHTSTLAAMKLMTSLVKVALQLSVHQDNNQRQYEAERNKGPGQRAPERLESLLEKRKELQEHQEEIEGMMNALFRGVFVHRYRDVLPEIRAICIEEIGCWMQSYSTSFLTDSYLKYIGWTLHDKHREVRLKCVKALKGLYGNRDLTTRLELFTSRFKDRMVSMVMDREYDVAVEAVRLLILILKNMEGVLTDADCESVYPVVYASHRGLASAAGEFLYWKLFYPECEIRMMGGREQRQSPGAQRTFFQLLLSFFVESELHDHAAYLVDSLWDCAGARLKDWEGLTSLLLEKDQNLGDVQESTLIEILVSSARQASEGHPPVGRVTGRKGLTSKERKTQADDRVKLTEHLIPLLPQLLAKFSADAEKVTPLLQLLSCFDLHIYCTGRLEKHLELFLQQLQEVVVKHAEPAVLEAGAHALYLLCNPEFTFFSRADFARSQLVDLLTDRFQQELEELLQSSFLDEDEVYNLAATLKRLSAFYNTHDLTRWELYEPCCQLLQKAVDTGEVPHQVILPALTLVYFSILWTLTHISKSDASQKQLSSLRDRMVAFCELCQSCLSDVDTEIQEQAFVLLSDLLLIFSPQMIVGGRDFLRPLVFFPEATLQSELASFLMDHVFIQPGDLGSGDSQEDHLQIERLHQRRRLLAGFCKLLLYGVLEMDAASDVFKHYNKFYNDYGDIIKETLTRARQIDRSHCSRILLLSLKQLYTELLQEHGPQGLNELPAFIEMRDLARRFALSFGPQQLQNRDLVVMLHKEGIQFSLSELPPAGSSNQPPNLAFLELLSEFSPRLFHQDKQLLLSYLEKCLQHVSQAPGHPWGPVTTYCHSLSPVENTAETSPQVLPSSKRRRVEGPAKPNREDVSSSQEESLQLNSIPPTPTLTSTAVKSRQPLWGLKEMEEEDGSELDFAQGSQPVAGTERSRFLGPQYFQTPHNPSGPGLGNQLMRLSLMEEDEEEELEIQDESNEERQDTDMQASSYSSTSERGLDLLDSTELDIEDF

SEQ ID NO: 36644 - protein, 436 aa, Homo sapiens
  ENSP00000360994
MDQPFTVNSLKKLAAMPDHTDVSLSPEERVRALSKLGCNITISEDITPRRYFRSGVEMERMASVYLEEGNLENAFVLYNKFITLFVEKLPNHRDYQQCAVPEKQDIMKKLKEIAFPRTDELKNDLLKKYNVEYQEYLQSKNKYKAEILKKLEHQRLIEAERKRIAQMRQQQLESEQFLFFEDQLKKQELARGQMRSQQTSGLSEQIDGSALSCFSTHQNNSLLNVFADQPNKSDATNYASHSPPVNRALTPAATLSAVQNLVVEGLRCVVLPEDLCHKFLQLAESNTVRGIETCGILCGKLTHNEFTITHVIVPKQSAGPDYCDMENVEELFNVQDQHDLLTLGWIHTHPTQTAFLSSVDLHTHCSYQLMLPEAIAIVCSPKHKDTGIFRLTNAGMLEVSACKKKGFHPHTKEPRLFSICKHVLVKDIKIIVLDLR

SEQ ID NO: 36645 - protein, 461 aa, Homo sapiens
  ENSP00000360995
MDQPFTVNSLKKLAAMPDHTDVSLSPEERVRALSKLGCNITISEDITPRRYFRSGVEMERMASVYLEEGNLENAFVLYNKFITLFVEKLPNHRDYQQCAVPEKQDIMKKLKEIAFPRTDELKNDLLKKYNVEYQEYLQSKNKYKAEILKKLEHQRLIEAERKRIAQMRQQQLESEQFLFFEDQLKKQELARGQMRSQQTSGLSEQIDGSALSCFSTHQNNSLLNVFADQPNKSDATNYASHSPPVNRALTPAATLSAVQNLVVEGLRCVVLPEDLCHKFLQLAESNTVRGIETCGILCGKLTHNEFTITHVIVPKQSAGPDYCDMENVEELFNVQDQHDLLTLGWIHTHPTQTAFLSSVDLHTHCSYQLMLPEAIAIVCSPKHKDTGIFRLTNAGMLEVSACKKKGFHPHTKEPRLFSIQKFLSGIISGTALEMEPLKIGYGPNGFPLLGISRSSSPSEQL

SEQ ID NO: 36646 - protein, 436 aa, Homo sapiens; identical to SEQ ID NO: 36644
  ENSP00000360992

SEQ ID NO: 36647 - protein, 270 aa, Homo sapiens
  ENSP00000360990
MRQQQLESEQFLFFEDQLKKQELARGQMRSQQTSGLSEQIDGSALSCFSTHQNNSLLNVFADQPNKSDATNYASHSPPVNRALTPAATLSAVQNLVVEGLRCVVLPEDLCHKFLQLAESNTVRGIETCGILCGKLTHNEFTITHVIVPKQSAGPDYCDMENVEELFNVQDQHDLLTLGWIHTHPTQTAFLSSVDLHTHCSYQLMLPEAIAIVCSPKHKDTGIFRLTNAGMLEVSACKKKGFHPHTKEPRLFSICKHVLVKDIKIIVLDLR

SEQ ID NO: 36648 - protein, 1113 aa, Homo sapiens
  ENSP00000338785
MFSQVPRTPASGCYYLNSMTPEGQEMYLRFDQTTRRSPYRMSRILARHQLVTKIQQEIEAKEACDWLRAAGFPQYAQLYEDSQFPINIVAVKNDHDFLEKDLVEPLCRRLNTLNKCASMKLDVNFQRKKGDDSDEEDLCISNKWTFQRTSRRWSRVDDLYTLLPRGDRNGSPGGTGMRNTTSSESVLTDLSEPEVCSIHSESSGGSDSRSQPGQCCTDNPVMLDAPLVSSSLPQPPRDVLNHPFHPKNEKPTRARAKSFLKRMETLRGKGAHGRHKGSGRTGGLVISGPMLQQEPESFKAMQCIQIPNGDLQNSPPPACRKGLPCSGKSSGESSPSEHSSSGVSTPCLKERKCHEANKRGGMYLEDLDVLAGTALPDAGDQSRMHEFHSQENLVVHIPKDHKPGTFPKALSIESLSPTDSSNGVNWRTGSISLGREQVPGAREPRLMASCHRASRVSIYDNVPGSHLYASTGDLLDLEKDDLFPHLDDILQHVNGLQEVVDDWSKDVLPELQTHDTLVGEPGLSTFPSPNQITLDFEGNSVSEGRTTPSDVERDVTSLNESEPPGVRDRRDSGVGASLTRPNRRLRWNSFQLSHQPRPAPASPHISSQTASQLSLLQRFSLLRLTAIMEKHSMSNKHGWTWSVPKFMKRMKVPDYKDKAVFGVPLIVHVQRTGQPLPQSIQQALRYLRSNCLDQVGLFRKSGVKSRIHALRQMNENFPENVNYEDQSAYDVADMVKQFFRDLPEPLFTNKLSETFLHIYQYVSKEQRLQAVQAAILLLADENREVLQTLLCFLNDVVNLVEENQMTPMNLAVCLAPSLFHLNLLKKESSPRVIQKKYATGKPDQKDLNENLAAAQGLAHMIMECDRLFEVPHELVAQSRNSYVEAEIHVPTLEELGTQLEESGATFHTYLNHLIQGLQKEAKEKFKGWVTCSSTDNTDLAFKKVGDGNPLKLWKASVEVEAPPSVVLNRVLRERHLWDEDFVQWKVVETLDRQTEIYQYVLNSMAPHPSRDFVVLRTWKTDLPKGMCTLVSLSVEHEEAQLLGGVRAVVMDSQYLIEPCGSGKSRLTHICRIDLKGHSPEWYSKGFGHLCAAEVARIRNSFQPLIAEGPETKI

SEQ ID NO: 36649 - protein, 1105 aa, Homo sapiens
  ENSP00000255486
MLEPSSVLHANVNQAPLWCLVLRWCRECKDTVCGGKQKSRVNHTFQRREIEAKEACDWLRAAGFPQYAQLYEDSQFPINIVAVKNDHDFLEKDLVEPLCRRLNTLNKCASMKLDVNFQRKKGDDSDEEDLCISNKWTFQRTSRRWSRVDDLYTLLPRGDRNGSPGGTGMRNTTSSESVLTDLSEPEVCSIHSESSGGSDSRSQPGQCCTDNPVMLDAPLVSSSLPQPPRDVLNHPFHPKNEKPTRARAKSFLKRMETLRGKGAHGRHKGSGRTGGLVISGPMLQQEPESFKAMQCIQIPNGDLQNSPPPACRKGLPCSGKSSGESSPSEHSSSGVSTPCLKERKCHEANKRGGMYLEDLDVLAGTALPDAGDQSRMHEFHSQENLVVHIPKDHKPGTFPKALSIESLSPTDSSNGVNWRTGSISLGREQVPGAREPRLMASCHRASRVSIYDNVPGSHLYASTGDLLDLEKDDLFPHLDDILQHVNGLQEVVDDWSKDVLPELQTHDTLVGEPGLSTFPSPNQITLDFEGNSVSEGRTTPSDVERDVTSLNESEPPGVRDRRDSGVGASLTRPNRRLRWNSFQLSHQPRPAPASPHISSQTASQLSLLQRFSLLRLTAIMEKHSMSNKHGWTWSVPKFMKRMKVPDYKDKAVFGVPLIVHVQRTGQPLPQSIQQALRYLRSNCLDQVGLFRKSGVKSRIHALRQMNENFPENVNYEDQSAYDVADMVKQFFRDLPEPLFTNKLSETFLHIYQYVSKEQRLQAVQAAILLLADENREVLQTLLCFLNDVVNLVEENQMTPMNLAVCLAPSLFHLNLLKKESSPRVIQKKYATGKPDQKDLNENLAAAQGLAHMIMECDRLFEVPHELVAQSRNSYVEAEIHVPTLEELGTQLEESGATFHTYLNHLIQGLQKEAKEKFKGWVTCSSTDNTDLAFKKVGDGNPLKLWKASVEVEAPPSVVLNRVLRERHLWDEDFVQWKVVETLDRQTEIYQYVLNSMAPHPSRDFVVLRTWKTDLPKGMCTLVSLSVEHEEAQLLGGVRAVVMDSQYLIEPCGSGKSRLTHICRIDLKGHSPEWYSKGFGHLCAAEVARIRNSFQPLIAEGPETKI

SEQ ID NO: 36650 - protein, 995 aa, Homo sapiens
  ENSP00000382300
MKLDVNFQRKKGDDSDEEDLCISNKWTFQRTSRRWSRVDDLYTLLPRGDRNGSPGGTGMRNTTSSESVLTDLSEPEVCSIHSESSGGSDSRSQPGQCCTDNPVMLDAPLVSSSLPQPPRDVLNHPFHPKNEKPTRARAKSFLKRMETLRGKGAHGRHKGSGRTGGLVISGPMLQQEPESFKAMQCIQIPNGDLQNSPPPACRKGLPCSGKSSGESSPSEHSSSGVSTPCLKERKCHEANKRGGMYLEDLDVLAGTALPDAGDQSRMHEFHSQENLVVHIPKDHKPGTFPKALSIESLSPTDSSNGVNWRTGSISLGREQVPGAREPRLMASCHRASRVSIYDNVPGSHLYASTGDLLDLEKDDLFPHLDDILQHVNGLQEVVDDWSKDVLPELQTHDTLVGEPGLSTFPSPNQITLDFEGNSVSEGRTTPSDVERDVTSLNESEPPGVRDRRDSGVGASLTRPNRRLRWNSFQLSHQPRPAPASPHISSQTASQLSLLQRFSLLRLTAIMEKHSMSNKHGWTWSVPKFMKRMKVPDYKDKAVFGVPLIVHVQRTGQPLPQSIQQALRYLRSNCLDQVGLFRKSGVKSRIHALRQMNENFPENVNYEDQSAYDVADMVKQFFRDLPEPLFTNKLSETFLHIYQYVSKEQRLQAVQAAILLLADENREVLQTLLCFLNDVVNLVEENQMTPMNLAVCLAPSLFHLNLLKKESSPRVIQKKYATGKPDQKDLNENLAAAQGLAHMIMECDRLFEVPHELVAQSRNSYVEAEIHVPTLEELGTQLEESGATFHTYLNHLIQGLQKEAKEKFKGWVTCSSTDNTDLAFKKVGDGNPLKLWKASVEVEAPPSVVLNRVLRERHLWDEDFVQWKVVETLDRQTEIYQYVLNSMAPHPSRDFVVLRTWKTDLPKGMCTLVSLSVEHEEAQLLGGVRAVVMDSQYLIEPCGSGKSRLTHICRIDLKGHSPEWYSKGFGHLCAAEVARIRNSFQPLIAEGPETKI

SEQ ID NO: 36651 - protein, 606 aa, Homo sapiens
  ENSP00000456233
MTSKRKPCQTQLRRSISEQLRDSTARAWDLLWKNVRERRLAEIEAKEACDWLRAAGFPQYAQLYEDSQFPINIVAVKNDHDFLEKDLVEPLCRRLNTLNKCASMKLDVNFQRKKGDDSDEEDLCISNKWTFQRTSRRWSRVDDLYTLLPRGDRNGSPGGTGMRNTTSSESVLTDLSEPEVCSIHSESSGGSDSRSQPGQCCTDNPVMLDAPLVSSSLPQPPRDVLNHPFHPKNEKPTRARAKSFLKRMETLRGKGAHGRHKGSGRTGGLVISGPMLQQEPESFKAMQCIQIPNGDLQNSPPPACRKGLPCSGKSSGESSPSEHSSSGVSTPCLKERKCHEANKRGGMYLEDLDVLAGTALPDAGDQSRMHEFHSQENLVVHIPKDHKPGTFPKALSIESLSPTDSSNGVNWRTGSISLGREQVPGAREPRLMASCHRASRVSIYDNVPGSHLYASTGDLLDLEKDDLFPHLDDILQHVNGLQEVVDDWSKDVLPELQTHDTLVGEPGLSTFPSPNQITLDFEGNSVSEGRTTPSDVERDVTSLNESEPPGVRDRRDSGVGASLTRPNRRLRWNSFQLSHQPRPAPASPHISSQTASQLSLLQRFSL

SEQ ID NO: 36652 - protein, 63 aa, Homo sapiens
  ENSP00000457840
MTSKRKPCQTQLRRSISEQLRDSTARAWDLLWKNVRERRLAGLSLELGSDHHMGQKKVLEKKV

SEQ ID NO: 36653 - protein, 52 aa, Homo sapiens
  ENSP00000428031
MPLLDVFWSCFRKVKCFPLLQVKKNAEAEAKRACEWLQATGFPQYVQLFEGG

SEQ ID NO: 36654 - protein, 1103 aa, Homo sapiens
  ENSP00000363727
MPLLDVFWSCFRKVKCFPLLQVKKNAEAEAKRACEWLQATGFPQYVQLFEEGSFPLDIGSVKKNHGFLDEDSLGALCRRLMTLNNCASMKLEVHFQSKQNEDSEEEEQCTISSHWAFQQESKCWSPMGSSDLLAPPSPGLPATSSCESVLTELSATSLPVITVSLPPEPADLPLPGRAPSSSDRPLLSPTQGQEGPQDKAKKRHRNRSFLKHLESLRRKEKSGSQQAEPKHSPATSEKVSKASSFRSCRGFLSAGFYRAKNWAATSAGGSGANTRKAWEAWPVASFRHPQWTHRGDCLVHVPGDHKPGTFPRSLSIESLCPEDGHRLADWQPGRRWGCEGRRGSCGSTGSHASTYDNLPELYPAEPVMVGAEAEDEDDEESGGSYAHLDDILQHVWGLQQRVELWSRAMYPDLGPGDEEEEEATSSVEIATVEVKCQAEALSQMEVPAHGESPAWAQAEVQPAVLAPAQAPAEAEPVAQEEAEAPAPAPAPAPAQDSEQEAHSGGEPTFASSLSVEEGHSISDTVASSSELDSSGNSMNEAEAAGPLAGLQASMPRERRDSGVGASLTRPCRKLRWHSFQNSHRPSLNSESLEINRQFAGQINLLHKGSLLRLTAFMEKYTVPHKQGWVWSMPKFMRRNKTPDYRGQHVFGVPPLIHVQRTGQPLPQSIQQAMRYLRSQCLDQVGIFRKSGVKSRIQNLRQMNETSPDNVCYEGQSAYDVADLLKQYFRDLPEPIFTSKLTTTFLQIYQLLPKDQWLAAAQAATLLLPDENREVLQTLLYFLSDIASAEENQMTAGNLAVCLAPSIFHLNVSKKDSPSPRIKSKRSLIGRPGPRDLSDNMAATQGLSHMISDCKKLFQVPQDMVLQLCSSYSAAELSPPGPALAELRQAQAAGVSLSLYMEENIQDLLRDAAERFKGWMSVPGPQHTELACRKAPDGHPLRLWKASTEVAAPPAVVLHRVLRERALWDEDLLRAQVLEALMPGVELYHYVTDSMAPHPCRDFVVLRMWRSDLPRGGCLLVSQSLDPEQPVPESGVRALMLTSQYLMEPCGLGRSRLTHICRADLRGRSPDWYNKVFGHLCAMEVAKIRDSFPTLQAAGPETKL

SEQ ID NO: 36655 - protein, 1023 aa, Homo sapiens
  ENSP00000363725
MTLNNCASMKLEVHFQSKQNEDSEEEEQCTISSHWAFQQESKCWSPMGSSDLLAPPSPGLPATSSCESVLTELSATSLPVITVSLPPEPADLPLPGRAPSSSDRPLLSPTQGQEGPQDKAKKRHRNRSFLKHLESLRRKEKSGSQQAEPKHSPATSEKVSKASSFRSCRGFLSAGFYRAKNWAATSAGGSGANTRKAWEAWPVASFRHPQWTHRGDCLVHVPGDHKPGTFPRSLSIESLCPEDGHRLADWQPGRRWGCEGRRGSCGSTGSHASTYDNLPELYPAEPVMVGAEAEDEDDEESGGSYAHLDDILQHVWGLQQRVELWSRAMYPDLGPGDEEEEEATSSVEIATVEVKCQAEALSQMEVPAHGESPAWAQAEVQPAVLAPAQAPAEAEPVAQEEAEAPAPAPAPAPAQDSEQEAHSGGEPTFASSLSVEEGHSISDTVASSSELDSSGNSMNEAEAAGPLAGLQASMPRERRDSGVGASLTRPCRKLRWHSFQNSHRPSLNSESLEINRQFAGQINLLHKGSLLRLTAFMEKYTVPHKQGWVWSMPKFMRRNKTPDYRGQHVFGVPPLIHVQRTGQPLPQSIQQAMRYLRSQCLDQVGIFRKSGVKSRIQNLRQMNETSPDNVCYEGQSAYDVADLLKQYFRDLPEPIFTSKLTTTFLQIYQLLPKDQWLAAAQAATLLLPDENREVLQTLLYFLSDIASAEENQMTAGNLAVCLAPSIFHLNVSKKDSPSPRIKSKRSLIGRPGPRDLSDNMAATQGLSHMISDCKKLFQVPQDMVLQLCSSYSAAELSPPGPALAELRQAQAAGVSLSLYMEENIQDLLRDAAERFKGWMSVPGPQHTELACRKAPDGHPLRLWKASTEVAAPPAVVLHRVLRERALWDEDLLRAQVLEALMPGVELYHYVTDSMAPHPCRDFVVLRMWRSDLPRGGCLLVSQSLDPEQPVPESGVRALMLTSQYLMEPCGLGRSRLTHICRADLRGRSPDWYNKVFGHLCAMEVAKIRDSFPTLQAAGPETKL

SEQ ID NO: 36656 - protein, 1023 aa, Homo sapiens; identical to SEQ ID NO: 36655
  ENSP00000252336

SEQ ID NO: 36657 - protein, 851 aa, Homo sapiens
  ENSP00000315768
MAQWEMLQNLDSPFQDQLHQLYSHSLLPVDIRQYLAVWIEDQNWQEAALGSDDSKATMLFFHFLDQLNYECGRCSQDPESLLLQHNLRKFCRDIQPFSQDPTQLAEMIFNLLLEEKRILIQAQRAQLEQGEPVLETPVESQQHEIESRILDLRAMMEKLVKSISQLKDQQDVFCFRYKIQAKGKTPSLDPHQTKEQKILQETLNELDKRRKEVLDASKALLGRLTTLIELLLPKLEEWKAQQQKACIRAPIDHGLEQLETWFTAGAKLLFHLRQLLKELKGLSCLVSYQDDPLTKGVDLRNAQVTELLQRLLHRAFVVETQPCMPQTPHRPLILKTGSKFTVRTRLLVRLQEGNESLTVEVSIDRNPPQLQGFRKFNILTSNQKTLTPEKGQSQGLIWDFGYLTLVEQRSGGSGKGSNKGPLGVTEELHIISFTVKYTYQGLKQELKTDTLPVVIISNMNQLSIAWASVLWFNLLSPNLQNQQFFSNPPKAPWSLLGPALSWQFSSYVGRGLNSDQLSMLRNKLFGQNCRTEDPLLSWADFTKRESPPGKLPFWTWLDKILELVHDHLKDLWNDGRIMGFVSRSQERRLLKKTMSGTFLLRFSESSEGGITCSWVEHQDDDKVLIYSVQPYTKEVLQSLPLTEIIRHYQLLTEENIPENPLRFLYPRIPRDEAFGCYYQEKVNLQERRKYLKHRLIVVSNRQVDELQQPLELKPEPELESLELELGLVPEPELSLDLEPLLKAGLDLGPELESVLESTLEPVIEPTLCMVSQTVPEPDQGPVSQPVPEPDLPCDLRHLNTEPMEIFRNCVKIEEIMPNGDPLLAGQNTVDEVYVSRPSHFYTDGPLMPSDF

SEQ ID NO: 36658 - protein, 847 aa, Homo sapiens
  ENSP00000450751
MAQWEMLQNLDSPFQDQLHQLYSHSLLPVDIRQYLAVWIEDQNWQEAALGSDDSKATMLFFHFLDQLNYECGRCSQDPESLLLQHNLRKFCRDIQDPTQLAEMIFNLLLEEKRILIQAQRAQLEQGEPVLETPVESQQHEIESRILDLRAMMEKLVKSISQLKDQQDVFCFRYKIQAKGKTPSLDPHQTKEQKILQETLNELDKRRKEVLDASKALLGRLTTLIELLLPKLEEWKAQQQKACIRAPIDHGLEQLETWFTAGAKLLFHLRQLLKELKGLSCLVSYQDDPLTKGVDLRNAQVTELLQRLLHRAFVVETQPCMPQTPHRPLILKTGSKFTVRTRLLVRLQEGNESLTVEVSIDRNPPQLQGFRKFNILTSNQKTLTPEKGQSQGLIWDFGYLTLVEQRSGGSGKGSNKGPLGVTEELHIISFTVKYTYQGLKQELKTDTLPVVIISNMNQLSIAWASVLWFNLLSPNLQNQQFFSNPPKAPWSLLGPALSWQFSSYVGRGLNSDQLSMLRNKLFGQNCRTEDPLLSWADFTKRESPPGKLPFWTWLDKILELVHDHLKDLWNDGRIMGFVSRSQERRLLKKTMSGTFLLRFSESSEGGITCSWVEHQDDDKVLIYSVQPYTKEVLQSLPLTEIIRHYQLLTEENIPENPLRFLYPRIPRDEAFGCYYQEKVNLQERRKYLKHRLIVVSNRQVDELQQPLELKPEPELESLELELGLVPEPELSLDLEPLLKAGLDLGPELESVLESTLEPVIEPTLCMVSQTVPEPDQGPVSQPVPEPDLPCDLRHLNTEPMEIFRNCVKIEEIMPNGDPLLAGQNTVDEVYVSRPSHFYTDGPLMPSDF

SEQ ID NO: 36659 - protein, 460 aa, Homo sapiens
  ENSP00000387354
MAQWEMLQNLDSPFQDQLHQLYSHSLLPVDIRQYLAVWIEDQNWQEAALGSDDSKATMLFFHFLDQLNYECGRCSQDPESLLLQHNLRKFCRDIQDPTQLAEMIFNLLLEEKRILIQAQRAQLEQGEPVLETPVESQQHEIESRILDLRAMMEKLVKSISQLKDQQDVFCFRYKIQAKGKTPSLDPHQTKEQKILQETLNELDKRRKEVLDASKALLGRLTTLIELLLPKLEEWKAQQQKACIRAPIDHGLEQLETWFTAGAKLLFHLRQLLKELKGLSCLVSYQDDPLTKGVDLRNAQVTELLQRLLHRAFVVETQPCMPQTPHRPLILKTGSKFTVRTRLLVRLQEGNESLTVEVSIDRNPPQLQGFRKFNILTSNQKTLTPEKGQSQGLIWDFGYLTLVEQRSGGSGKGSNKGPLGVTEELHIISFTVKYTYQGLKQELKVSENGGQGERKQLWKKA

SEQ ID NO: 36660 - protein, 65 aa, Homo sapiens
  ENSP00000450985
MAQWEMLQNLDSPFQDQLHQLYSHSLLPVDIRQYLAVWIEDQNWKLHLGVMIPRLPCYSSTSWIS

SEQ ID NO: 36661 - protein, 794 aa, Homo sapiens
  ENSP00000341208
MAGWIQAQQLQGDALRQMQVLYGQHFPIEVRHYLAQWIESQPWDAIDLDNPQDRAQATQLLEGLVQELQKKAEHQVGEDGFLLKIKLGHYATQLQKTYDRCPLELVRCIRHILYNEQRLVREANNCSSPAGILVDAMSQKHLQINQTFEELRLVTQDTENELKKLQQTQEYFIIQYQESLRIQAQFAQLAQLSPQERLSRETALQQKQVSLEAWLQREAQTLQQYRVELAEKHQKTLQLLRKQQTIILDDELIQWKRRQQLAGNGGPPEGSLDVLQSWCEKLAEIIWQNRQQIRRAEHLCQQLPIPGPVEEMLAEVNATITDIISALVTSTFIIEKQPPQVLKTQTKFAATVRLLVGGKLNVHMNPPQVKATIISEQQAKSLLKNENTRNECSGEILNNCCVMEYHQATGTLSAHFRNMSLKRIKRADRRGAESVTEEKFTVLFESQFSVGSNELVFQVKTLSLPVVVIVHGSQDHNATATVLWDNAFAEPGRVPFAVPDKVLWPQLCEALNMKFKAEVQSNRGLTKENLVFLAQKLFNNSSSHLEDYSGLSVSWSQFNRENLPGWNYTFWQWFDGVMEVLKKHHKPHWNDGAILGFVNKQQAHDLLINKPDGTFLLRFSDSEIGGITIAWKFDSPERNLWNLKPFTTRDFSIRSLADRLGDLSYLIYVFPDRPKDEVFSKYYTPVLAKAVDGYVKPQIKQVVPEFVNASADAGGSSATYMDQAPSPAVCPQAPYNMYPQNPDHVLDQDGEFDLDETMDVARHVEELLRRPMDSLDSRLSPPAGLFTSARGSLS

SEQ ID NO: 36662 - protein, 794 aa, Homo sapiens; identical to SEQ ID NO: 36661
  ENSP00000468749

SEQ ID NO: 36663 - protein, 764 aa, Homo sapiens
  ENSP00000443107
MAGWIQAQQLQGDALRQMQVLYGQHFPIEVRHYLAQWIESQPWDAIDLDNPQDRAQATQLLEGLVQELQKKAEHQVGEDGFLLKIKLGHYATQLQCSSPAGILVDAMSQKHLQINQTFEELRLVTQDTENELKKLQQTQEYFIIQYQESLRIQAQFAQLAQLSPQERLSRETALQQKQVSLEAWLQREAQTLQQYRVELAEKHQKTLQLLRKQQTIILDDELIQWKRRQQLAGNGGPPEGSLDVLQSWCEKLAEIIWQNRQQIRRAEHLCQQLPIPGPVEEMLAEVNATITDIISALVTSTFIIEKQPPQVLKTQTKFAATVRLLVGGKLNVHMNPPQVKATIISEQQAKSLLKNENTRNECSGEILNNCCVMEYHQATGTLSAHFRNMSLKRIKRADRRGAESVTEEKFTVLFESQFSVGSNELVFQVKTLSLPVVVIVHGSQDHNATATVLWDNAFAEPGRVPFAVPDKVLWPQLCEALNMKFKAEVQSNRGLTKENLVFLAQKLFNNSSSHLEDYSGLSVSWSQFNRENLPGWNYTFWQWFDGVMEVLKKHHKPHWNDGAILGFVNKQQAHDLLINKPDGTFLLRFSDSEIGGITIAWKFDSPERNLWNLKPFTTRDFSIRSLADRLGDLSYLIYVFPDRPKDEVFSKYYTPVLAKAVDGYVKPQIKQVVPEFVNASADAGGSSATYMDQAPSPAVCPQAPYNMYPQNPDHVLDQDGEFDLDETMDVARHVEELLRRPMDSLDSRLSPPAGLFTSARGSLS

SEQ ID NO: 36664 - protein, 141 aa, Homo sapiens
  ENSP00000464730
MSQKHLQINQTFEELRLVTQDTENELKKLQQTQEYFIIQYQESLRIQAQFAQLAQLSPQERLSRETALQQKQVSLEAWLQREAQTLQQYRVELAEKHQKTLQLLRKQQTIILDDELIQWKRRQQLAGNGGPPEGSLDVLQS

SEQ ID NO: 36665 - protein, 125 aa, Homo sapiens
  ENSP00000407327
MAGWIQAQQLQGDALRQMQVLYGQHFPIEVRHYLAQWIESQPWDAIDLDNPQDRAQATQLLEGLVQELQKKAEHQVGEDGFLLKIKLGHYATQLQKTYDRCPLELVRCIRHILYNEQRLVREANN

SEQ ID NO: 36666 - protein, 763 aa, Homo sapiens
  ENSP00000465437
MAGWIQAQQLQGDALRQMQVLYGQHFPIEVRHYLAQWIESQPWDAIDLDNPQDRAQATQLLEGLVQELQKKAEHQVGEDGFLLKIKLGHYATQLQKTYDRCPLELVRCIRHILYNEQRLVREANNCSSPAGILVDAMSQKHLQINQTFEELRLVTQDTENELKKLQQTQEYFIIQYQESLRIQAQFAQLAQLSPQERLSRETALQQKQVSLEAWLQREAQTLQQYRVELAEKHQKTLQLLRKQQTIILDDELIQWKRRQQLAGNGGPPEGSLDVLQSWCEKLAEIIWQNRQQIRRAEHLCQQLPIPGPVEEMLAEVNATITDIISALVTSTFIIEKQPPQVLKTQTKFAATVRLLVGGKLNVHMNPPQVKATIISEQQAKSLLKNENTRNECSGEILNNCCVMEYHQATGTLSAHFRNMSLKRIKRADRRGAESVTEEKFTVLFESQFSVGSNELVFQVKGRVPFAVPDKVLWPQLCEALNMKFKAEVQSNRGLTKENLVFLAQKLFNNSSSHLEDYSGLSVSWSQFNRENLPGWNYTFWQWFDGVMEVLKKHHKPHWNDGAILGFVNKQQAHDLLINKPDGTFLLRFSDSEIGGITIAWKFDSPERNLWNLKPFTTRDFSIRSLADRLGDLSYLIYVFPDRPKDEVFSKYYTPVLAKAVDGYVKPQIKQVVPEFVNASADAGGSSATYMDQAPSPAVCPQAPYNMYPQNPDHVLDQDGEFDLDETMDVARHVEELLRRPMDSLDSRLSPPAGLFTSARGSLS

SEQ ID NO: 36667 - protein, 229 aa, Homo sapiens
  ENSP00000466320
MKFKAEVQSNRGLTKENLVFLAQKLFNNSSSHLEDYSGLSVSWSQFNRENLPGWNYTFWQWFDGVMEVLKKHHKPHWNDGAILGFVNKQQAHDLLINKPDGTFLLRFSDSEIGGITIAWKFDSPERNLWNLKPFTTRDFSIRSLADRLGDLSYLIYVFPDRPKDEVFSKYYTPVLAKAVDGYVKPQIKQVVPEFVNASADAGGSSATYMDQAPSPAVCPQAPYNMYPQK

SEQ ID NO: 36668 - protein, 302 aa, Homo sapiens
  ENSP00000265087
MCAERLGQFMTLALVLATFDPARGTDATNPPEGPQDRSSQQKGRLSLQNTAEIQHCLVNAGDVGCGVFECFENNSCEIRGLHGICMTFLHNAGKFDAQGKSFIKDALKCKAHALRHRFGCISRKCPAIREMVSQLQRECYLKHDLCAAAQENTRVIVEMIHFKDLLLHEPYVDLVNLLLTCGEEVKEAITHSVQVQCEQNWGSLCSILSFCTSAIQKPPTAPPERQPQVDRTKLSRAHHGEAGHHLPEPSSRETGRGAKGERGSKSHPNAHARGRVGGLGAQGPSGSSEWEDEQSEYSDIRR

SEQ ID NO: 36669 - protein, 123 aa, Homo sapiens
  ENSP00000428470
  MOD_RES (1)..(1): Any amino acid
XQNTAEIQHCLVNAGDVGCGVFECFENNSCEIRGLHGICMTFLHNAGKFDAQGKSFIKDALKCKAHALRHRFGCISRKCPAIREMVSQLQRECYLKHDLCAAAQENTRVIVEMIHFKDLLLHE

SEQ ID NO: 36670 - protein, 53 aa, Homo sapiens
  ENSP00000427816
MTFLHNAGKFDAQGKSFIKDALKCKAHALRHRFGCISRKCPAIREMVSQLQRE

SEQ ID NO: 36671 - protein, 498 aa, Homo sapiens
  ENSP00000376822
MSHQPAVATKMPEEMDKPLISLHLVDSDSSLAKVPDEAPKVGILGSGDFARSLATRLVGSGFKVVVGSRNPKRTARLFPSAAQVTFQEEAVSSPEVIFVAVFREHYSSLCSLSDQLAGKILVDVSNPTEQEHLQHRESNAEYLASLFPTCTVVKAFNVISAWTLQAGPRDGNRQVPICGDQPEAKRAVSEMALAMGFMPVDMGSLASAWEVEAMPLRLLPAWKVPTLLALGLFVCFYAYNFVRDVLQPYVQESQNKFFKLPVSVVNTTLPCVAYVLLSLVYLPGVLAAALQLRRGTKYQRFPDWLDHWLQHRKQIGLLSFFCAALHALYSFCLPLRRAHRYDLVNLAVKQVLANKSHLWVEEEVWRMEIYLSLGVLALGTLSLLAVTSLPSIANSLNWREFSFVQSSLGFVALVLSTLHTLTYGWTRAFEESRYKFYLPPTFTLTLLVPCVVILAKALFLLPCISRRLARIRRGWERESTIKFTLPTDHALAEKTSHV

SEQ ID NO: 36672 - protein, 488 aa, Homo sapiens
  ENSP00000376818
MPEEMDKPLISLHLVDSDSSLAKVPDEAPKVGILGSGDFARSLATRLVGSGFKVVVGSRNPKRTARLFPSAAQVTFQEEAVSSPEVIFVAVFREHYSSLCSLSDQLAGKILVDVSNPTEQEHLQHRESNAEYLASLFPTCTVVKAFNVISAWTLQAGPRDGNRQVPICGDQPEAKRAVSEMALAMGFMPVDMGSLASAWEVEAMPLRLLPAWKVPTLLALGLFVCFYAYNFVRDVLQPYVQESQNKFFKLPVSVVNTTLPCVAYVLLSLVYLPGVLAAALQLRRGTKYQRFPDWLDHWLQHRKQIGLLSFFCAALHALYSFCLPLRRAHRYDLVNLAVKQVLANKSHLWVEEEVWRMEIYLSLGVLALGTLSLLAVTSLPSIANSLNWREFSFVQSSLGFVALVLSTLHTLTYGWTRAFEESRYKFYLPPTFTLTLLVPCVVILAKALFLLPCISRRLARIRRGWERESTIKFTLPTDHALAEKTSHV

SEQ ID NO: 36673 - protein, 457 aa, Homo sapiens
  ENSP00000386510
MPEEMDKPLISLHLVDSDSSLAKVPDEAPKVGILGSGDFARSLATRLVGSGFKVVVGSRNPKRTARLFPSAAQVTFQEEAVSSPEVIFVAVFREHYSSLCSLSDQLAGKILVDVSNPTEQEHLQHRESNAEYLASLFPTCTVVKAFNVISAWTLQAGPRDGNRQVPICGDQPEAKRAVSEMALAMGFMPVDMGSLASAWEVEAMPLRLLPAWKVPTLLALGLFVCFYAYNFVRDVLQPYVQESQNKFFKLPVSVVNTTLPCVAYVLLSLVYLPGVLAAALQLRRGTKYQRFPDWLDHWLQHRKQIGLLSFFCAALHALYSFCLPLRRAHRYDLVNLAVKQVLANKSHLWVEEEVWRMEIYLSLGVLALGTLSLLAVTSLPSIANSLNWREFSFVQCVATSSAGNTGSGTRRPESQSQDPHLPAPHHQTSFLGPRSFCCSLVPVSTPYGHQEDLSWTR

SEQ ID NO: 36674 - protein, 488 aa, Homo sapiens; identical to SEQ ID NO: 36672
  ENSP00000376819

SEQ ID NO: 36675 - protein, 590 aa, Homo sapiens
  ENSP00000351646
MESGSPMGEVEISRTIRTNGRGQRGYDWQCKRPIRVAEVRSSLHSWSLRWVNELKEKGNKALSVGNIDDALQCYSEAIKLDPHNHVLYSNRSAAYAKKGDYQKAYEDGCKTVDLKPDWGKGYSRKAAALEFLNRFEEAKRTYEEGLKHEANNPQLKEGLQNMEARLAERKFMNPFNMPNLYQKLESDPRTRTLLSDPTYRELIEQLRNKPSDLGTKLQDPRIMTTLSVLLGVDLGSMDEEEEIATPPPPPPPKKETKPEPMEEDLPENKKQALKEKELGNDAYKKKDFDTALKHYDKAKELDPTNMTYITNQAAVYFEKGDYNKCRELCEKAIEVGRENREDYRQIAKAYARIGNSYFKEEKYKDAIHFYNKSLAEHRTPDVLKKCQQAEKILKEQERLAYINPDLALEEKNKGNECFQKGDYPQAMKHYTEAIKRNPKDAKLYSNRAACYTKLLEFQLALKDCEECIQLEPTFIKGYTRKAAALEAMKDYTKAMDVYQKALDLDSSCKEAADGYQRCMMAQYNRHDSPEDVKRRAMADPEVQQIMSDPAMRLILEQMQKDPQALSEHLKNPVIAQKIQKLMDVGLIAIR

SEQ ID NO: 36676 - protein, 543 aa, Homo sapiens
  ENSP00000305958
MEQVNELKEKGNKALSVGNIDDALQCYSEAIKLDPHNHVLYSNRSAAYAKKGDYQKAYEDGCKTVDLKPDWGKGYSRKAAALEFLNRFEEAKRTYEEGLKHEANNPQLKEGLQNMEARLAERKFMNPFNMPNLYQKLESDPRTRTLLSDPTYRELIEQLRNKPSDLGTKLQDPRIMTTLSVLLGVDLGSMDEEEEIATPPPPPPPKKETKPEPMEEDLPENKKQALKEKELGNDAYKKKDFDTALKHYDKAKELDPTNMTYITNQAAVYFEKGDYNKCRELCEKAIEVGRENREDYRQIAKAYARIGNSYFKEEKYKDAIHFYNKSLAEHRTPDVLKKCQQAEKILKEQERLAYINPDLALEEKNKGNECFQKGDYPQAMKHYTEAIKRNPKDAKLYSNRAACYTKLLEFQLALKDCEECIQLEPTFIKGYTRKAAALEAMKDYTKAMDVYQKALDLDSSCKEAADGYQRCMMAQYNRHDSPEDVKRRAMADPEVQQIMSDPAMRLILEQMQKDPQALSEHLKNPVIAQKIQKLMDVGLIAIR

SEQ ID NO: 36677 - protein, 138 aa, Homo sapiens
  ENSP00000441036
MEQVNELKEKGNKALSVGNIDDALQCYSEAIKLDPHNHVLYSNRSAAYAKKGDYQKAYEDGCKTVDLKPDWGKGYSRKAAALEFLNRFEEAKRTYEEGLKHEANNPQLKEGLQNMEARLAVQPARQPRRCEATSHGRP

SEQ ID NO: 36678 - protein, 519 aa, Homo sapiens
  ENSP00000445957
MEQVNELKEKGNKALSVGNIDDALQCYSEAIKLDPHNHVLYSNRSAAYAKKGDYQKAYEDGCKTVDLKPDWGKGLKHEANNPQLKEGLQNMEARLAERKFMNPFNMPNLYQKLESDPRTRTLLSDPTYRELIEQLRNKPSDLGTKLQDPRIMTTLSVLLGVDLGSMDEEEEIATPPPPPPPKKETKPEPMEEDLPENKKQALKEKELGNDAYKKKDFDTALKHYDKAKELDPTNMTYITNQAAVYFEKGDYNKCRELCEKAIEVGRENREDYRQIAKAYARIGNSYFKEEKYKDAIHFYNKSLAEHRTPDVLKKCQQAEKILKEQERLAYINPDLALEEKNKGNECFQKGDYPQAMKHYTEAIKRNPKDAKLYSNRAACYTKLLEFQLALKDCEECIQLEPTFIKGYTRKAAALEAMKDYTKAMDVYQKALDLDSSCKEAADGYQRCMMAQYNRHDSPEDVKRRAMADPEVQQIMSDPAMRLILEQMQKDPQALSEHLKNPVIAQKIQKLMDVGLIAIR

SEQ ID NO: 36679 - protein, 236 aa, Homo sapiens
  ENSP00000442704
MEQVNELKEKGNKALSVGNIDDALQCYSEAIKLDPHNHVLYSNRSAAYAKKGDYQKAYEDGCKTVDLKPDWGKGYSRKAAALEFLNRFEEAKRTYEEGLKHEANNPQLKEGLQNMEARLAERKFMNPFNMPNLYQKLESDPRTRTLLSDPTYRELIEQLRNKPSDLGTKLQDPRIMTTLSVLLGVDLGSMDEEEEIATPPPPPPPKKETKPEPMEEDLPENKKQVLFFSLLTVTYL

SEQ ID NO: 36680 - protein, 137 aa, Homo sapiens
  ENSP00000443416
ACYTKLLEFQLALKDCEECIQLEPTFIKGYTRKAAALEAMKDYTKAMDVYQKALDLDSSCKEAADGYQRCMMAQYNRHDSPEDVKRRAMADPEVQQIMSDPAMRLILEQMQKDPQALSEYVESERRPCWKWRTKAGR

SEQ ID NO: 36681 - protein, 372 aa, Homo sapiens
  ENSP00000263955
MSRRRFDCRSISGLLTTTPQIPIKMENFNNFYILTSKELGRGKFAVVRQCISKSTGQEYAAKFLKKRRRGQDCRAEILHEIAVLELAKSCPRVINLHEVYENTSEIILILEYAAGGEIFSLCLPELAEMVSENDVIRLIKQILEGVYYLHQNNIVHLDLKPQNILLSSIYPLGDIKIVDFGMSRKIGHACELREIMGTPEYLAPEILNYDPITTATDMWNIGIIAYMLLTHTSPFVGEDNQETYLNISQVNVDYSEETFSSVSQLATDFIQSLLVKNPEKRPTAEICLSHSWLQQWDFENLFHPEETSSSSQTQDHSVRSSEDKTSKSSCNGTCGDREDKENIPEDSSMVSKRFRFDDSLPNPHELVSDLLC

SEQ ID NO: 36682 - protein, 372 aa, Homo sapiens; identical to SEQ ID NO: 36681
  ENSP00000386853

SEQ ID NO: 36683 - protein, 69 aa, Homo sapiens
  ENSP00000475843
KFAVVRQCISKSTGQEYAAKFLKKRRRGQDCRAEILHEIAVLELAKSCPRVINLHEVYENTSEIILILE

SEQ ID NO: 36684 - protein, 67 aa, Homo sapiens
  ENSP00000399755
MSRRRFDCRSISGLLTTTPQIPIKMENFNNFYILTSKELGRGKFAVVRQCISKSTGQEYAAKFLKKR

SEQ ID NO: 36685 - protein, 6 aa, Homo sapiens
  ENSP00000413289
MSRRRF

SEQ ID NO: 36686 - protein, 364 aa, Homo sapiens
  ENSP00000389352
MQKWFSAFDDAIIQRQWRANPSRGGGGVSFTKEVDTNVATGAPPRRQRVPGRACPWREPIRGRRGARPGGGDAGGTPGETVRHCSAPEDPIFRFSSLHSYPFPGTIKSRDMSWKRHHLIPETFGVKRRRKRGPVESDPLRGEPGSARAAVSELMQLFPRGLFEDALPPIVLRSQVYSLVPDRTVADRQLKELQEQGEIRIVQLGFDLDAHGIIFTEDYRTRVLKACDGRPYAGAVQKFLASVLPACGDLSFQQDQMTQTFGFRDSEITHLVNAGVLTVRDAGSWWLAVPGAGRFIKYFVKGRQAVLSMVRKAKYRELLLSELLGRRAPVVVRLGLTYHVHDLIGAQLVDCISTTSGTLLRLPET

SEQ ID NO: 36687 - protein, 368 aa, Homo sapiens
  ENSP00000413766
MQKWFSAFDDAIIQRQWRANPSRGGGGVSFTKEVDTNVATGAPPRRQRVPGRACPWREPIRGRRGARPGGGDAGGTPGETVRHCSAPEDPIFRFSSLHSYPFPGTIKSRDMSWKRHHLIPETFGVKRRRKRGPVESDPLRGEPGSARAAVSELMQLFPRGLFEDALPPIVLRSQVYSLVPDRTVADRQLKELQEQGEIRIVQLGFDLDAHGIIFTEDYRTRVCDCVLKACDGRPYAGAVQKFLASVLPACGDLSFQQDQMTQTFGFRDSEITHLVNAGVLTVRDAGSWWLAVPGAGRFIKYFVKGRQAVLSMVRKAKYRELLLSELLGRRAPVVVRLGLTYHVHDLIGAQLVDCISTTSGTLLRLPET

SEQ ID NO: 36688 - protein, 70 aa, Homo sapiens
  ENSP00000428007
  MOD_RES (1)..(1): Any amino acid
XPFPGTIKSRDMSWKRHHLIPETFGVKRRRKRGPVESDPLRGEPEGASRAGGDQNRPAGLRLGCPWNYLH

SEQ ID NO: 36689 - protein, 321 aa, Homo sapiens
  ENSP00000446620
MLVCASPPPLPALTGLRDDKLTLLSSSPGLGGTPGETVRHCSAPEDPIFRFSSLHSYPFPGTIKSRDMSWKRHHLIPETFGVKRRRKRGPVESDPLRGEPGSARAAVSELMQLFPRGLFEDALPPIVLRSQVYSLVPDRTVADRQLKELQEQGEIRIVQLGFDLDAHGIIFTEDYRTRVLKACDGRPYAGAVQKFLASVLPACGDLSFQQDQMTQTFGFRDSEITHLVNAGVLTVRDAGSWWLAVPGAGRFIKYFVKGRQAVLSMVRKAKYRELLLSELLGRRAPVVVRLGLTYHVHDLIGAQLVDCISTTSGTLLRLPET

SEQ ID NO: 36690 - protein, 364 aa, Homo sapiens; identical to SEQ ID NO: 36686
  ENSP00000395028

SEQ ID NO: 36691 - protein, 368 aa, Homo sapiens; identical to SEQ ID NO: 36687
  ENSP00000395864

SEQ ID NO: 36692 - protein, 321 aa, Homo sapiens; identical to SEQ ID NO: 36689
  ENSP00000449149

SEQ ID NO: 36693 - protein, 112 aa, Homo sapiens
  ENSP00000418350
MQKWFSAFDDAIIQRQWRANPSRGGGGVSFTKEVDTNVATGAPPRRQRVPGRACPWREPIRGRRGARPGGGDAGGTPGETVRHCSAPEDPIFRFSSLHSYPFPGTIKSRDMS

SEQ ID NO: 36694 - protein, 364 aa, Homo sapiens; identical to SEQ ID NO: 36686
  ENSP00000364480

SEQ ID NO: 36695 - protein, 368 aa, Homo sapiens; identical to SEQ ID NO: 36687
  ENSP00000364482

SEQ ID NO: 36696 - protein, 70 aa, Homo sapiens; identical to SEQ ID NO: 36688
  ENSP00000418866
  MOD_RES (1)..(1): Any amino acid

SEQ ID NO: 36697 - protein, 70 aa, Homo sapiens; identical to SEQ ID NO: 36688
  ENSP00000454870
  MOD_RES (1)..(1): Any amino acid

SEQ ID NO: 36698 - protein, 364 aa, Homo sapiens; identical to SEQ ID NO: 36686
  ENSP00000393272

SEQ ID NO: 36699 - protein, 368 aa, Homo sapiens; identical to SEQ ID NO: 36687
  ENSP00000391798

SEQ ID NO: 36700 - protein, 321 aa, Homo sapiens; identical to SEQ ID NO: 36689
  ENSP00000447097

SEQ ID NO: 36701 - protein, 364 aa, Homo sapiens
  ENSP00000372818
MQKWFSAFDDAIIQRQWRANPSRGGGGVSFTKEVDTNVATGAPPRRQRVPGRACPWREPIRGRRGARPGGGDAGGTPGETVRHCSAPEDPIFRFSSLHSYPFPGTIKSRDMSWKRHHLIPETFGVKRRRKRGPVESDPLRGEPGSARAAVSELMQLFPRGLFEDALPPIVLRSQVYSLVPDRTVADRQLKELQEQGEIRIVQLGFDLDAHGIIFTEDYRTRVLKACDGRPYAGAVQKFLASVLPACGDLSFQQDQMTQTFGFRDSEITHLVNAGVLTVRDAGSWWLAVPGAGRFIKYFVKGRQAVLGMVRKAKYRELLLSELLGRRAPVVVRLGLTYHVHDLIGAQLVDCISTTSGTLLRLPET

SEQ ID NO: 36702 - protein, 368 aa, Homo sapiens [sequence omitted]

SEQ ID NO: 36703 - protein, 67 aa, Homo sapiens
  ENSP00000476036
PGTIKSRDMSWKRHHLIPETFGVKRRRKRGPVESDPLRGEPEGASRAGGDQNRPAGLRLGCPWNYLH

SEQ ID NO: 36704 - protein, 321 aa, Homo sapiens
  ENSP00000448123
MLVCASPPPLPALTGLRDDKLTLLSSSPGLGGTPGETVRHCSAPEDPIFRFSSLHSYPFPGTIKSRDMSWKRHHLIPETFGVKRRRKRGPVESDPLRGEPGSARAAVSELMQLFPRGLFEDALPPIVLRSQVYSLVPDRTVADRQLKELQEQGEIRIVQLGFDLDAHGIIFTEDYRTRVLKACDGRPYAGAVQKFLASVLPACGDLSFQQDQMTQTFGFRDSEITHLVNAGVLTVRDAGSWWLAVPGAGRFIKYFVKGRQAVLGMVRKAKYRELLLSELLGRRAPVVVRLGLTYHVHDLIGAQLVDCISTTSGTLLRLPET

SEQ ID NO: 36705 - protein, 364 aa, Homo sapiens; identical to SEQ ID NO: 36686
  ENSP00000399915

SEQ ID NO: 36706 - protein, 368 aa, Homo sapiens; identical to SEQ ID NO: 36687
  ENSP00000403479

SEQ ID NO: 36707 - protein, 70 aa, Homo sapiens; identical to SEQ ID NO: 36688
  ENSP00000429285
  MOD_RES (1)..(1): Any amino acid

SEQ ID NO: 36708 - protein, 321 aa, Homo sapiens; identical to SEQ ID NO: 36689
  ENSP00000446725

SEQ ID NO: 36709 - protein, 491 aa, Homo sapiens
  ENSP00000390500
MEQPPAPKSKLKKLSEDSLTKQPEEVFDVLEKLGEGSYGSVFKAIHKESGQVVAIKQVPVESDLQEIIKEISIMQQCDSPYVVKYYGSYFKNTDLWIVMEYCGAGSVSDIIRLRNKTLIEDEIATILKSTLKGLEYLHFMRKIHRDIKAGNILLNTEGHAKLADFGVAGQLTDTMAKRNTVIGTPFWMAPEVIQEIGYNCVADIWSLGITSIEMAEGKPPYADIHPMRAIFMIPTNPPPTFRKPELWSDDFTDFVKKCLVKNPEQRATATQLLQHPFIKNAKPVSILRDLITEAMEIKAKRHEEQQRELEEEEENSDEDELDSHTMVKTSVESVGTMRATSTMSEGAQTMIEHNSTMLESDLGTMVINSEDEEEEDGTMKRNATSPQVQRPSFMDYFDKQDFKNKSHENCNQNMHEPFPMSKNVFPDNWKVPQDGDFDFLKNLSLEELQMRLKALDPMMEREIEELRQRYTAKRQPILDAMDAKKRRQQNF

SEQ ID NO: 36710 - protein, 519 aa, Homo sapiens
  ENSP00000429744
MLQLMDSGITICLRNGAASVFKKKEWSTQGEENKQDSKLKKLSEDSLTKQPEEVFDVLEKLGEGSYGSVFKAIHKESGQVVAIKQVPVESDLQEIIKEISIMQQCDSPYVVKYYGSYFKNTDLWIVMEYCGAGSVSDIIRLRNKTLIEDEIATILKSTLKGLEYLHFMRKIHRDIKAGNILLNTEGHAKLADFGVAGQLTDTMAKRNTVIGTPFWMAPEVIQEIGYNCVADIWSLGITSIEMAEGKPPYADIHPMRAIFMIPTNPPPTFRKPELWSDDFTDFVKKCLVKNPEQRATATQLLQHPFIKNAKPVSILRDLITEAMEIKAKRHEEQQRELEEEEENSDEDELDSHTMVKTSVESVGTMRATSTMSEGAQTMIEHNSTMLESDLGTMVINSEDEEEEDGTMKRNATSPQVQRPSFMDYFDKQDFKNKSHENCNQNMHEPFPMSKNVFPDNWKVPQDGDFDFLKNLSLEELQMRLKALDPMMEREIEELRQRYTAKRQPILDAMDAKKRRQQNF

SEQ ID NO: 36711 - protein, 228 aa, Homo sapiens
  ENSP00000428014
MEQPPAPKSKLKKLSEDSLTKQPEEVFDVLEKLGEGSYGSVFKAIHKESGQVVAIKQVPVESDLQEIIKEISIMQQCDSPYVVKYYGSYFKNTDLWIVMEYCGAGSVSDIIRLRNKTAIFMIPTNPPPTFRKPELWSDDFTDFVKKCLVKNPEQRATATQLLQHPFIKNAKPVSILRDLITEAMEIKAKRHEEQQRELEEEEENSDEDELDSHTMVKTSVESVGTMRA

SEQ ID NO: 36712 - protein, 82 aa, Homo sapiens
  ENSP00000429369
MEQPPAPKSKLKKLSEDSLTKQPEEVFDVLEKLGEGSYGSVFKAIHKESGQVVAIKQVPVESDLQEIIKEISIMQQCDRLFL

SEQ ID NO: 36713 - protein, 168 aa, Homo sapiens
  ENSP00000428167
MEQPPAPKSKLKKLSEDSLTKQPEEVFDVLEKLGEGSYGSVFKAIHKESGQVVAIKQVPVESDLQEIIKEISIMQQCDSPYVVKYYGSYFKNTDLWIVMEYCGAGSVSDIIRLRNKTGFLTDTTEGSASCDLRMDLTLFHLGAEFLHYLLLYEADPLSCVFSLLVFSV

SEQ ID NO: 36714 - protein, 1 aa, Homo sapiens
  ENSP00000428295
M

SEQ ID NO: 36715 - protein, 380 aa, Homo sapiens
  ENSP00000482260
MEQPPAPKSKLKKLSEDSLTKQPEEVFDVLEKLGEGSYGSVFKAIHKESGQVVAIKQVPVESDLQEIIKEISIMQQCDSPYVVKYYGSYFKNTDLWIVMEYCGAGSVSDIIRLRNKTAIFMIPTNPPPTFRKPELWSDDFTDFVKKCLVKNPEQRATATQLLQHPFIKNAKPVSILRDLITEAMEIKAKRHEEQQRELEEEEENSDEDELDSHTMVKTSVESVGTMRATSTMSEGAQTMIEHNSTMLESDLGTMVINSEDEEEEDGTMKRNATSPQVQRPSFMDYFDKQDFKNKSHENCNQNMHEPFPMSKNVFPDNWKVPQDGDFDFLKNLSLEELQMRLKALDPMMEREIEELRQRYTAKRQPILDAMDAKKRRQQNF

SEQ ID NO: 36716 - protein, 396 aa, Homo sapiens
  ENSP00000381030
MGANTSRKPPVFDENEDVNFDHFEILRAIGKGSFGKVCIVQKNDTKKMYAMKYMNKQKCVERNEVRNVFKELQIMQGLEHPFLVNLWYSFQDEEDMFMVVDLLLGGDLRYHLQQNVHFKEETVKLFICELVMALDYLQNQRIIHRDMKPDNILLDEHGHVHITDFNIAAMLPRETQITTMAGTKPYMAPEMFSSRKGAGYSFAVDWWSLGVTAYELLRGRRPYHIRSSTSSKEIVHTFETTVVTYPSAWSQEMVSLLKKLLEPNPDQRFSQLSDVQNFPYMNDINWDAVFQKRLIPGFIPNKGRLNCDPTFELEEMILESKPLHKKKKRLAKKEKDMRKCDSSQTCLLQEHLDSVQKEFIIFNREKVNRDFNKRQPNLALEQTKDPQGEDGQNNNL

SEQ ID NO: 36717 - protein, 166 aa, Homo sapiens
  ENSP00000487441
MGANTSRKPPVFDENEDVNFDHFEILRAIGKGSFGKVCIVQKNDTKKMYAMKYMNKQKCVERNEVRNVFKELQIMQGLEHPFLVNLWYSFQDEEDMFMVVDLLLGGDLRYHLQQNVHFKEETVKLFICELVMALDYLQNQRIIHRDMKPDNILLDEHDTWLSYKSH

SEQ ID NO: 36718 - protein, 407 aa, Homo sapiens
  ENSP00000381535
MGANTSRKPPVFDENEDVNFDHFEILRAIGKGSFGKVCIVQKNDTKKMYAMKYMNKQKCVERNEVRNVFKELQIMQGLEHPFLVNLWYSFQDEEDMFMVVDLLLGGDLRYHLQQNVHFKEETVKLFICELVMALDYLQNQRIIHRDMKPDNILLDEHGHVHITDFNIAAMLPRETQITTMAGTKPYMAPEMFSSRKGAGYSFAVDWWSLGVTAYELLRGRRPYHIRSSTSSKEIVHTFETTVVTYPSAWSQEMVSLLKKLLEPNPDQRFSQLSDVQNFPYMNDINWDAVFQKRLIPGFIPNKGRLNCDPTFELEEMILESKPLHKKKKRLAKKEKDMRKCDSSQTCLLQEHLDSVQKEFIIFNREKVNRDFNKRQPNLALEQTKDPQVTNGQMDTGLSETFQTSKVS

SEQ ID NO: 36719 - protein, 414 aa, Homo sapiens
  ENSP00000282908
MGGNHSHKPPVFDENEEVNFDHFQILRAIGKGSFGKVCIVQKRDTKKMYAMKYMNKQKCIERDEVRNVFRELQIMQGLEHPFLVNLWYSFQDEEDMFMVVDLLLGGDLRYHLQQNVHFTEGTVKLYICELALALEYLQRYHIIHRDIKPDNILLDEHGHVHITDFNIATVVKGAERASSMAGTKPYMAPEVFQVYMDRGPGYSYPVDWWSLGITAYELLRGWRPYEIHSVTPIDEILNMFKVERVHYSSTWCKGMVALLRKLLTKDPESRVSSLHDIQSVPYLADMNWDAVFKKALMPGFVPNKGRLNCDPTFELEEMILESKPLHKKKKRLAKNRSRDGTKDSCPLNGHLQHCLETVREEFIIFNREKLRRQQGQGSQLLDTDSRGGGQAQSKLQDGCNNNLLTHTCTRGCSS

SEQ ID NO: 36720 - protein, 51 aa, Homo sapiens
  ENSP00000422820
MGGNHSHKPPVFDENEEVNFDHFQILRAIGKGSFGKDCQCRLFLENLSEES

SEQ ID NO: 36721 - protein, 337 aa, Homo sapiens
  ENSP00000423209
MYAMKYMNKQKCIERDEVRNVFRELQIMQGLEHPFLVNLWYSFQDEEDMFMVVDLLLGGDLRYHLQQNVHFTEGTVKLYICELALALEYLQRYHIIHRDIKPDNILLDEHAPEVFQVYMDRGPGYSYPVDWWSLGITAYELLRGWRPYEIHSVTPIDEILNMFKVERVHYSSTWCKGMVALLRKLLTKDPESRVSSLHDIQSVPYLADMNWDAVFKKALMPGFVPNKGRLNCDPTFELEEMILESKPLHKKKKRLAKNRSRDGTKDSCPLNGHLQHCLETVREEFIIFNREKLRRQQGQGSQLLDTDSRGGGQAQSKLQDGCNNNLLTHTCTRGCSS

SEQ ID NO: 36722 - protein, 367 aa, Homo sapiens
  ENSP00000420984
MYAMKYMNKQKCIERDEVRNVFRELQIMQGLEHPFLVNLWYSFQDEEDMFMVVDLLLGGDLRYHLQQNVHFTEGTVKLYICELALALEYLQRYHIIHRDIKPDNILLDEHGHVHITDFNIATVVKGAERASSMAGTKPYMAPEVFQVYMDRGPGYSYPVDWWSLGITAYELLRGWRPYEIHSVTPIDEILNMFKVERVHYSSTWCKGMVALLRKLLTKDPESRVSSLHDIQSVPYLADMNWDAVFKKALMPGFVPNKGRLNCDPTFELEEMILESKPLHKKKKRLAKNRSRDGTKDSCPLNGHLQHCLETVREEFIIFNREKLRRQQGQGSQLLDTDSRGGGQAQSKLQDGCNNNLLTHTCTRGCSS

SEQ ID NO: 36723 - protein, 514 aa, Homo sapiens
  ENSP00000416750
MADSGLDKKSTKCPDCSSASQKDVLCVCSSKTRVPPVLVVEMSQTSSIGSAESLISLERKKEKNINRDITSRKDLPSRTSNVERKASQQQWGRGNFTEGKVPHIRIENGAAIEEIYTFGRILGKGSFGIVIEATDKETETKWAIKKVNKEKAGSSAVKLLEREVNILKSVKHEHIIHLEQVFETPKKMYLVMELCEDGELKEILDRKGHFSENETRWIIQSLASAIAYLHNNDIVHRDLKLENIMVKSSLIDDNNEINLNIKVTDFGLAVKKQSRSEAMLQATCGTPIYMAPEVISAHDYSQQCDIWSIGVVMYMLLRGEPPFLASSEEKLFELIRKGELHFENAVWNSISDCAKSVLKQLMKVDPAHRITAKELLDNQWLTGNKLSSVRPTNVLEMMKEWKNNPESVEENTTEEKNKPSTEEKLKSYQPWGNVPDANYTSDEEEEKQSTAYEKQFPATSKDNFDMCSSSFTSSKLLPAEIKGEMEKTPVTPSQGTATKYPAKSGALSRTKKKL

SEQ ID NO: 36724 - protein, 514 aa, Homo sapiens; identical to SEQ ID NO: 36723
  ENSP00000320754

SEQ ID NO: 36725 - protein, 514 aa, Homo sapiens; identical to SEQ ID NO: 36723
  ENSP00000379905

SEQ ID NO: 36726 - protein, 327 aa, Homo sapiens
  ENSP00000351743
MYLVMELCEDGELKEILDRKGHFSENETRWIIQSLASAIAYLHNNDIVHRDLKLENIMVKSSLIDDNNEINLNIKVTDFGLAVKKQSRSEAMLQATCGTPIYMAPEVISAHDYSQQCDIWSIGVVMYMLLRGEPPFLASSEEKLFELIRKGELHFENAVWNSISDCAKSVLKQLMKVDPAHRITAKELLDNQWLTGNKLSSVRPTNVLEMMKEWKNNPESVEENTTEEKNKPSTEEKLKSYQPWGNVPDANYTSDEEEEKQSTAYEKQFPATSKDNFDMCSSSFTSSKLLPAEIKGEMEKTPVTPSQGTATKYPAKSGALSRTKKKL

SEQ ID NO: 36727 - protein, 203 aa, Homo sapiens
  ENSP00000415688
VKSSLIDDNNEINLNIKVTDFGLAVKKQSRSEAMLQATCGTPIYMAPEVISAHDYSQQCDIWSIGVVMYMLLRGEPPFLASSEEKLFELIRKGELHFENAVWNSISDCAKSVLKQLMKVDPAHRITAKELLDNQWLTSTAYEKQFPATSKDNFDMCSSSFTSSKLLPAEIKGEMEKTPVTPSQGTATKYPAKSGALSRTKKKL

SEQ ID NO: 36728 - protein, 473 aa, Homo sapiens
  ENSP00000436418
MSQTSSIGSAESLISLERKKEKNINRDITSRKDLPSRTSNVERKASQQQWGRGNFTEGKVPHIRIENGAAIEEIYTFGRILGKGSFGIVIEATDKETETKWAIKKVNKEKAGSSAVKLLEREVNILKSVKHEHIIHLEQVFETPKKMYLVMELCEDGELKEILDRKGHFSENETRWIIQSLASAIAYLHNNDIVHRDLKLENIMVKSSLIDDNNEINLNIKVTDFGLAVKKQSRSEAMLQATCGTPIYMAPEVISAHDYSQQCDIWSIGVVMYMLLRGEPPFLASSEEKLFELIRKGELHFENAVWNSISDCAKSVLKQLMKVDPAHRITAKELLDNQWLTGNKLSSVRPTNVLEMMKEWKNNPESVEENTTEEKNKPSTEEKLKSYQPWGNVPDANYTSDEEEEKQSTAYEKQFPATSKDNFDMCSSSFTSSKLLPAEIKGEMEKTPVTPSQGTATKYPAKSGALSRTKKKL

SEQ ID NO: 36729 - protein, 211 aa, Homo sapiens
  ENSP00000436905
AESLISLERKKEKNINRDITSRKDLPSRTSNVERKASQQQWGRGNFTEGKVPHIRIENGAAIEAGSSAVKLLEREVNILKSVKHEHIIHLEQVFETPKKMYLVMELCEDGELKEILDRKGHFSENETRWIIQSLASAIAYLHNNDIVHRDLKLENIMVKSSLIDDNNEINLNIKVTDFGLAVKKQSRSEAMLQATCGTPIYMAPEVISAHD

SEQ ID NO: 36730 - protein, 215 aa, Homo sapiens
  ENSP00000391362
MSQTSSIGSAESLISLERKKEKNINRDITSRKDLPSRTSNVERKASQQQWGRGNFTEGKVPHIRIENGAAIEEIYTFGRILGKGSFGIVIEATDKETETKWAIKKVNKEKAGSSAVKLLEREVNILKSVKHEHIIHLEQVFETPKKMYLVMELCEDGELKEILDRKGHFSENETRWIIQSLASAIAYLHNNDIVHRDLKLENIMVKSSLIDDNNE

SEQ ID NO: 36731 - protein, 191 aa, Homo sapiens
  ENSP00000411510
MSQTSSIGSAESLISLERKKEKNINRDITSRKDLPSRTSNVERKASQQQWGRGNFTEGKVPHIRIENGAAIEEIYTFGRILGKGSFGIVIEATDKETETKWAIKKVNKEKAGSSAVKLLEREVNILKSVKHEHIIHLEQVFETPKKMYLVMELCEDGELKEILDRKGHFSENETRWIIQSLASAIAYLHNN

SEQ ID NO: 36732 - protein, 171 aa, Homo sapiens
  ENSP00000403599
MADSGLDKKSTKCPDCSSASQKDVLCVCSSKTRVPPVLVVEMSQTSSIGSAESLISLERKKEKNINRDITSRKDLPSRTSNVERKASQQQWGRGNFTEGKVPHIRIENGAAIEEIYTFGRILGKGSFGIVIEATDKETETKWAIKKVNKEKAGSSAVKLLEREVNILKSVK

SEQ ID NO: 36733 - protein, 63 aa, Homo sapiens
  ENSP00000397569
MADSGLDKKSTKCPDCSSASQKDVLCVCSSKTRVPPVLVVEMSQTSSIGSAESLISLERKKEK

SEQ ID NO: 36734 - protein, 37 aa, Homo sapiens
  ENSP00000397874
MADSGLDKKSTKCPDCSSASQKDVLCVCSSKTRVPPV

SEQ ID NO: 36735 - protein, 29 aa, Homo sapiens
  ENSP00000432822
MADSGLDKKSTKCPDCSSASQKDVLCVCS

SEQ ID NO: 36736 - protein, 131 aa, Homo sapiens
  ENSP00000437856
MAMTAGTTTTFPMSNHTRERVTVAKLTLENFYSNLILQHEERETRQKKLEVAMEEEGLADEEKKLRRSQHARKETEFLRLKRTRLGLDDFESLKVIGRGAFGEVRLVQKKDTGHIYAMKILRKSDMLEKEQ

SEQ ID NO: 36737 - protein, 464 aa, Homo sapiens
  ENSP00000373684
MAMTAGTTTTFPMSNHTRERVTVAKLTLENFYSNLILQHEERETRQKKLEVAMEEEGLADEEKKLRRSQHARKETEFLRLKRTRLGLDDFESLKVIGRGAFGEVRLVQKKDTGHIYAMKILRKSDMLEKEQVAHIRAERDILVEADGAWVVKMFYSFQDKRNLYLIMEFLPGGDMMTLLMKKDTLTEEETQFYISETVLAIDAIHQLGFIHRDIKPDNLLLDAKGHVKLSDFGLCTGLKKAHRTEFYRNLTHNPPSDFSFQNMNSKRKAETWKKNRRQLAYSTVGTPDYIAPEVFMQTGYNKLCDWWSLGVIMYEMLIGYPPFCSETPQETYRKVMNWKETLVFPPEVPISEKAKDLILRFCIDSENRIGNSGVEEIKGHPFFEGVDWEHIRERPAAIPIEIKSIDDTSNFDDFPESDILQPVPNTTEPDYKSKDWVFLNYTYKRFEGLTQRGSIPTYMKAGKL

SEQ ID NO: 36738 - protein, 213 aa, Homo sapiens
  ENSP00000439457
MAMTAGTTTTFPMSNHTRERVTVAKLTLENFYSNLILQHEERETRQKKLEVAMEEEGLADEEVRLVQKKDTGHIYAMKILRKSDMLEKEQVAHIRAERDILVEADGAWVVKMFYSFQDKRNLYLIMEFLPGGDMMTLLMKKDTLTEEETQFYISETVLAIDAIHQLGFIHRDIKPDNLLLDAKGHVKLSDFGLCTGLKKAHRTEFYRNLTHNP

SEQ ID NO: 36739 - protein, 64 aa, Homo sapiens
  ENSP00000445898
MAMTAGTTTTFPMSNHTRERVTVAKLTLENFYSNLILQHEERETRQKKLEVAMEEEGLADEEVM

SEQ ID NO: 36740 - protein, 94 aa, Homo sapiens
  ENSP00000443838
MAMTAGTTTTFPMSNHTRERVTVAKLTLENFYSNLILQHEERETRQKKLEVAMEEEGLADEEKKLRRSQHARKETEFLRLKRTRLGLDDFESLK

SEQ ID NO: 36741 - protein, 56 aa, Homo sapiens
  ENSP00000443456
MAMTAGTTTTFPMSNHTRERVTVAKLTLENFYSNLILQHEERETRGENWKSFNKQH

SEQ ID NO: 36742 - protein, 131 aa, Homo sapiens; identical to SEQ ID NO: 36736
  ENSP00000442253

SEQ ID NO: 36743 - protein, 131 aa, Homo sapiens; identical to SEQ ID NO: 36736
  ENSP00000440279

SEQ ID NO: 36744 - protein, 89 aa, Homo sapiens
  ENSP00000385174
  MOD_RES (1)..(1): Any amino acid
XQKKLEVAMEEEGLADEEKKLRRSQHARKETEFLRLKRTRLGLDDFESLKVIGRGAFGEVRLVQKKDTGHIYAMKILRKSDMLEKEQVT

SEQ ID NO: 36745 - protein, 87 aa, Homo sapiens
  ENSP00000443961
YISETVLAIDAIHQLGFIHRDIKPDNLLLDAKGHVKLSDFGLCTGLKKAHRTEFYRNLTHNPPSDFYVYVFSFCGEHFSLVITIPYC

SEQ ID NO: 36746 - protein, 216 aa, Homo sapiens
  ENSP00000342538
MTLAAYKEKMKELPLVSLFCSCFLADPLNKSSYKYEGWCGRQCRRKDESQRKDSADWRERRAQADTVDLNWCVISDMEVIELNKCTSGQSFEVILKPPSFDGVPEFNASLPRRRDPSLEEIQKKLEAAEERRKYQEAELLKHLAEKREHEREVIQKAIEENNNFIKMAKEKLAQKMESNKENREAHLAAMLERLQEKDKHAEEVRKNKELKEEASR

SEQ ID NO: 36747 - protein, 167 aa, Homo sapiens
  ENSP00000428474
MKELPLVSLFCSCFLADPLNKSSYKYEADTVDLNWCVISDMEVIELNKCTSGQSFEVILKPPSFDGVPEFNASLPRRRDPSLEEIQKKLEAAEERRKYQEAELLKHLAEKREHEREVIQKAIEENNNFIKMAKEKLAQKMESNKENREAHLAAMLERLQEKEPPAAR

SEQ ID NO: 36748 - protein, 189 aa, Homo sapiens
  ENSP00000265770
MTLAAYKEKMKELPLVSLFCSCFLADPLNKSSYKYEADTVDLNWCVISDMEVIELNKCTSGQSFEVILKPPSFDGVPEFNASLPRRRDPSLEEIQKKLEAAEERRKYQEAELLKHLAEKREHEREVIQKAIEENNNFIKMAKEKLAQKMESNKENREAHLAAMLERLQEKDKHAEEVRKNKELKEEASR

SEQ ID NO: 36749 - protein, 203 aa, Homo sapiens
  ENSP00000428428
MTLAAYKEKMKELPLVSLFCSCFLADPLNKSSYKYEGWCGRQCRRKDESQRKDSADWRERRAQADTVDLNWCVISDMEVIELNKCTSGQSFEVILKPPSFDGVPEFNASLPRRRDPSLEEIQKKLEAAEERRKYQEAELLKHLAEKREHEREVIQKAIEENNNFIKMAKEKLAQKMESNKENREAHLAAMLERLQEKEPPAAR

SEQ ID NO: 36750 - protein, 231 aa, Homo sapiens
  ENSP00000430699
MTLAAYKEKMKELPLVSLFCSCFLADPLNKSSYKYEADTVDLNWCVISDMEVIELNKCTSGQSFEVILKPPSFDGVPEFNASLPRRRDPSLEEIQKKLEAAEERRKYQEAELLKHLAEKREHEREVIQKAIEENNNFIKMAKEKLAQKMESNKENREAHLAAMLERLQEKVRGPWLERSFLGHAVFLLQQVCGDLLIISGRKQPQAKIRIFFLGRIFREFRRMIREVRGKK

SEQ ID NO: 36751 - protein, 258 aa, Homo sapiens
  ENSP00000430389
MTLAAYKEKMKELPLVSLFCSCFLADPLNKSSYKYEGWCGRQCRRKDESQRKDSADWRERRAQADTVDLNWCVISDMEVIELNKCTSGQSFEVILKPPSFDGVPEFNASLPRRRDPSLEEIQKKLEAAEERRKYQEAELLKHLAEKREHEREVIQKAIEENNNFIKMAKEKLAQKMESNKENREAHLAAMLERLQEKVRGPWLERSFLGHAVFLLQQVCGDLLIISGRKQPQAKIRIFFLGRIFREFRRMIREVRGKK

SEQ ID NO: 36752 - protein, 735 aa, Homo sapiens
  ENSP00000385273
MCSTNPGKWVTFDDDPAVQSSQKSKNFPLENQGVCRPNGLKLNLPGLREFPSGSSSTSSTPLSSPIVDFYFSPGPPSNSPLSTPTKDFPGFPGIPKAGTHVLYPIPESSSDSPLAISGGESSLLPTRPTCLSHALLPSDHSCTHPTPKVGLPDEVNPQQAESLGFQSDDLPQFQYFREDCAFSSPFWKDEGSDSHFTLDPPGSKKMFSSRNKEMPIDQKSLNKCSLNYICEKLEHLQSAENQDSLRSLSMHCLCAEENASSFVPHTLFRSQPKSGWSFMLRIPEKKNMMSSRQWGPIFLKVLPGGILQMYYEQGLEKPFKEIQLDPYCRLSEPKVENFSVAGKIHTVKIEHVSYTEKRKYHSKTEVVHEPDIEQMLKLGSTSYHDFLDFLTTVEEELMKLPAVSKPKKNYEEQEISLEIVDNFWGKVTKEGKFVESAVITQIYCLCFVNGNLECFLTLNDLELPKRDESYYEKDSEKKGIDILDYHFHKCVNVQEFEQSRIIKFVPLDACRFELMRFKTLYNGDNLPFSLKSVVVVQGAYVELQAFVNMASLAQRSSYAGSLRSCDNIRIHFPVPSQWIKALWTMNLQRQKSLKAKMNRRACLGSLQELESEPVIQVTVGSAKYESAYQAVVWKIDRLPDKNSSLDHPHCLSYKLELGSDQEIPSDWYPFATVQFSVPDTCASRTEVRSLGVESDVQPQKHVQQRACYNIQVEIEKKWIKIDGEDPDKIGDCITQ

SEQ ID NO: 36753 - protein, 735 aa, Homo sapiens; identical to SEQ ID NO: 36752
  ENSP00000384615

SEQ ID NO: 36754 - protein, 93 aa, Homo sapiens
  ENSP00000399868
RSSYAGSLRSCDNIRIHFPVPSQWIKALWTMNLQRQKSLKAKMNRRACLGSLQELESEPVIQVTVGSAKYESAYQAVVWKIDRLPDKNSIFRA

SEQ ID NO: 36755 - protein, 920 aa, Homo sapiens
  ENSP00000450857
MTTLDHVIATHQSEWVSFNEEPPFPAHSQGGTEEHLPGLSSSPDQSESSSGENHVVDGGSQDHSHSEQDDSSEKMGLISEAASPPGSPEQPPPDLASAISNWVQFEDDTPWASTSPPHQETAETALPLTMPCWTCPSFDSLGRCPLTSESSWTTHSEDTSSPSFGCSYTDLQLINAEEQTSGQASGADSTDNSSSLQEDEEVEMEAISWQASSPAMNGHPAPPVTSARFPSWVTFDDNEVSCPLPPVTSPLKPNTPPSASVIPDVPYNSMGSFKKRDRPKSTLMNFSKVQKLDISSLNRTPSVTEASPWRATNPFLNETLQDVQPSPINPFSAFFEEQERRSQNSSISSTTGKSQRDSLIVIYQDAISFDDSSKTQSHSDAVEKLKQLQIDDPDHFGSATLPDDDPVAWIELDAHPPGSARSQPRDGWPMMLRIPEKKNIMSSRHWGPIFVKLTDTGYLQLYYEQGLEKPFREFKLEICHEISEPRLQNYDENGRIHSLRIDRVTYKEKKKYQPKPAVAHTAEREQVIKLGTTNYDDFLSFIHAVQDRLMDLPVLSMDLSTVGLNYLEEEITVDVRDEFSGIVSKGDNQILQHHVLTRIHILSFLSGLAECRLGLNDILVKGNEIVLRQDIMPTTTTKWIKLHECRFHGCVDEDVFHNSRVILFNPLDACRFELMRFRTVFAEKTLPFTLRTATSVNGAEVEVQSWLRMSTGFSANRDPLTQVPCENVMIRYPVPSEWVKNFRRESVLGEKSLKAKVNRGASFGSTSVSGSEPVMRVTLGTAKYEHAFNSIVWRINRLPDKNSASGHPHCFFCHLELGSDREVPSRFANHVNVEFSMPTTSASKASVRSISVEDKTDVRKWVNYSAHYSYQTTETDNLPNPLYCSCLPHTDLKRGSKRVVKIRWNASLEVPLASSIRTMV

SEQ ID NO: 36756 - protein, 106 aa, Homo sapiens
  ENSP00000450577
  MOD_RES (1)..(1): Any amino acid
XRINRLPDKNSASGHPHCFFCHLELGSDREVPSRFANHVNVEFSMPTTSASKASVRSISVEDKTDVRKWVNYSAHYSYQVEIEQKKSLKPDFEGDEMENPKECGVQ

SEQ ID NO: 36757 - protein, 905 aa, Homo sapiens
  ENSP00000267540
MTTLDHVIATHQSEWVSFNEEPPFPAHSQGGTEEHLPGLSSSPDQSESSSGENHVVDGGSQDHSHSEQDDSSEKMGLISEAASPPGSPEQPPPDLASAISNWVQFEDDTPWASTSPPHQETAETALPLTMPCWTCPSFDSLGRCPLTSESSWTTHSEDTSSPSFGCSYTDLQLINAEEQTSGQASGADSTDNSSSLQEDEEVEMEAISWQASSPAMNGHPAPPVTSARFPSWVTFDDNEVSCPLPPVTSPLKPNTPPSASVIPDVPYNSMGSFKKRDRPKSTLMNFSKVQKLDISSLNRTPSVTEASPWRATNPFLNETLQDVQPSPINPFSAFFEEQERRSQNSSISSTTGKSQRDSLIVIYQDAISFDDSSKTQSHSDAVEKLKQLQIDDPDHFGSATLPDDDPVAWIELDAHPPGSARSQPRDGWPMMLRIPEKKNIMSSRHWGPIFVKLTDTGYLQLYYEQGLEKPFREFKLEICHEISEPRLQNYDENGRIHSLRIDRVTYKEKKKYQPKPAVAHTAEREQVIKLGTTNYDDFLSFIHAVQDRLMDLPVLSMDLSTVGLNYLEEEITVDVRDEFSGIVSKGDNQILQHHVLTRIHILSFLSGLAECRLGLNDILVKGNEIVLRQDIMPTTTTKWIKLHECRFHGCVDEDVFHNSRVILFNPLDACRFELMRFRTVFAEKTLPFTLRTATSVNGAEVEVQSWLRMSTGFSANRDPLTQVPCENVMIRYPVPSEWVKNFRRESVLGEKSLKAKVNRGASFGSTSVSGSEPVMRVTLGTAKYEHAFNSIVWRINRLPDKNSASGHPHCFFCHLELGSDREVPSRFANHVNVEFSMPTTSASKASVRSISVEDKTDVRKWVNYSAHYSYQVALGSIWLMLPTPFVHPTTLPLLFLLAMLTMFAW

SEQ ID NO: 36758 - protein, 49 aa, Homo sapiens
  ENSP00000450990
MTTLDHVIATHQSEWVSFNEEPPFPAHSQGGTEEHLPGLSSSPDQSESS

SEQ ID NO: 36759 - protein, 3 aa, Homo sapiens
  ENSP00000451383
MTT

SEQ ID NO: 36760 - protein, 920 aa, Homo sapiens; identical to SEQ ID NO: 36755
  ENSP00000477736

SEQ ID NO: 36761 - protein, 195 aa, Homo sapiens
  ENSP00000422118
MPGKMEKFLQIAPHSLAIVLGPAEAPAGERPGAARPAPPAQPRQLARHHIGYEIFADFKAENMQHFWNKKVTAAVAETFFLGWIDEQVLLIQGKEEHLEALREGWTRRALRPPSGFHIRCLGDVSPISMSPISQSQFIPLGEILCLAISAMNSARKPVTQEALMEHLTTCFPVLGRAWLPTHQALLKVTVVRTPL

SEQ ID NO: 36762 - protein, 926 aa, Homo sapiens
  ENSP00000311257
MKKTRSTTLRRAWPSSDFSDRASDRMRSRSEKDYRLHKRFPAAFAPQASRGYMTSGDVSPISMSPISQSQFIPLGEILCLAISAMNSARKPVTQEALMEHLTTCFPGVPTPSQEILRHTLNTLVRERKIYPTPDGYFIVTPQTYFITPSLIRTNSKWYHLDERIPDRSQCTSPQPGTITPSASGCVRERTLPRNHCDSCHCCREDVHSTHAPTLQRKSAKDCKDPYCPPSLCQVPPTEKSKSTVNFSYKTETLSKPKDSEKQSKKFGLKLFRLSFKKDKTKQLANFSAQFPPEEWPLRDEDTPATIPREVEMEIIRRINPDLTVENVMRHTALMKKLEEEKAQRSKAGSSAHHSGRSKKSRTHRKSHGKSRSHSKTRVSKGDPSDGSHLDIPAEREYDFCDPLTRVPREGCFIIEHKGDNFIMHSNTNVLESHFPMTPEWDVSGELAKRRTEMPFPEPSRGSSHSKVHRSHSHTQDRRSRNERSNKAKERSRSMDNSKGPLGASSLGTPEDLAEGCSQDDQTPSQSYIDDSTLRPAQTVSLQRAHISSTSYKEVCIPEIVSGSKEPSSACSLLEPGKPPESLPSYGELNSCPTKTATDDYFQCNTSSETVLTAPSPLGKNKEDHDTLTLAEGVKKLSPSDRQVPHSSREPVGHKEESPKGPGGGPAASGGVAEGIANGRLVQHHGAEPSSLDKRKEIFSKDTLFKPLHSTLSVNSYHKSSLSLLKSHPKTPADTLPGRCEKLEPSLGTSAAQAMPASQRQQESGGNQEASFDYYNVSDDDDSEEGANKNTEEEKNREDVGTMQWLLEREKERDLQRKFEKNLTLLAPKETDSSSNQRATHSARLDSMDSSSITVDSGFNSPRTRESLASNTSSIVESNRRQNPALSPAHGGAGPAFNFRASAEPPTNEAEKLQKPSNCLQASVTSV

SEQ ID NO: 36763 - protein, 40 aa, Homo sapiens
  ENSP00000425388
  MOD_RES (1)..(1): Any amino acid
XMLSLSQGCNEVMYHPSVCLPSVSLSLFHSGRSSAWPSQQ

SEQ ID NO: 36764 - protein, 219 aa, Homo sapiens
  ENSP00000426209
  MOD_RES (1)..(1): Any amino acid
XSSREPVGHKEESPKGPGGGPAASGGVAEGIANGRLVQHHGAEPSSLDKRKEIFSKDTLFKPLHSTLSVNSYHKSSLSLLKSHPKTPADTLPGRCEKLEPSLGTSAAQAMPASQRQQESGGNQEASFDYYNVSDDDDSEEGANKNTEEEKNREDVGTMQWLLEREKERDLQRKFEKNLTLLAPKETDSSSNQRATHSARLDSMDSSSITVDSGFNSPRN

SEQ ID NO: 36765 - protein, 46 aa, Homo sapiens
  ENSP00000445693
MRQTPLTCSGHTRPVVDLAFSGITPYGYFLISACKAKCGMLSQEMN

SEQ ID NO: 36766 - protein, 363 aa, Homo sapiens
  ENSP00000025399
MAMRQTPLTCSGHTRPVVDLAFSGITPYGYFLISACKGAGQHLPRLSGQHDGKPMLRQGDTGDWIGTFLGHKGAVWGATLNKDATKAATAAADFTAKVWDAVSGDELMTLAHKHIVKTVDFTQDSNYLLTGGQDKLLRIYDLNKPEAEPKEISGHTSGIKKALWCSEDKQILSADDKTVRLWDHATMTEVKSLNFNMSVSSMEYIPEGEILVITYGRSIAFHSAVSLDPIKSFEAPATINSASLHPEKEFLVAGGEDFKLYKYDYNSGEELESYKGHFGPIHCVRFSPDGELYASGSEDGTLRLWQTVVGKTYGLWKCVLPEEDSGELAKPKIGFPETTEEELEEIASENSDCIFPSAPDVKA

SEQ ID NO: 36767 - protein, 350 aa, Homo sapiens
  ENSP00000392270
MAMRQTPLTCSGHTRPVVDLAFSGITPYGYFLISACKDGKPMLRQGDTGDWIGTFLGHKGAVWGATLNKDATKAATAAADFTAKVWDAVSGDELMTLAHKHIVKTVDFTQDSNYLLTGGQDKLLRIYDLNKPEAEPKEISGHTSGIKKALWCSEDKQILSADDKTVRLWDHATMTEVKSLNFNMSVSSMEYIPEGEILVITYGRSIAFHSAVSLDPIKSFEAPATINSASLHPEKEFLVAGGEDFKLYKYDYNSGEELESYKGHFGPIHCVRFSPDGELYASGSEDGTLRLWQTVVGKTYGLWKCVLPEEDSGELAKPKIGFPETTEEELEEIASENSDCIFPSAPDVKA

SEQ ID NO: 36768 - protein, 95 aa, Homo sapiens
  ENSP00000445814
  MOD_RES (1)..(1): Any amino acid
XKEFLVAGGEDFKLYKYDYNSGEELESYKGHFGPIHCVRFSPDGELYASGSEDGTLRLWQTVVGKTYGLWKCVLPEEIASENSDCIFPSAPDVKA

SEQ ID NO: 36769 - protein, 1775 aa, Homo sapiens
  ENSP00000401513
MALSLWPLLLLLLLLLLLSFAVTLAPTGPHSLDPGLSFLKSLLSTLDQAPQGSLSRSRFFTFLANISSSFEPGRMGEGPVGEPPPLQPPALRLHDFLVTLRGSPDWEPMLGLLGDMLALLGQEQTPRDFLVHQAGVLGGLVEVLLGALVPGGPPTPTRPPCTRDGPSDCVLAADWLPSLLLLLEGTRWQALVQVQPSVDPTNATGLDGREAAPHFLQGLLGLLTPTGELGSKEALWGGLLRTVGAPLYAAFQEGLLRVTHSLQDEVFSILGQPEPDTNGQCQGGNLQQLLLWGVRHNLSWDVQALGFLSGSPPPPPALLHCLSTGVPLPRASQPSAHISPRQRRAITVEALCENHLGPAPPYSISNFSIHLLCQHTKPATPQPHPSTTAICQTAVWYAVSWAPGAQGWLQACHDQFPDEFLDAICSNLSFSALSGSNRRLVKRLCAGLLPPPTSCPEGLPPVPLTPDIFWGCFLENETLWAERLCGEASLQAVPPSNQAWVQHVCQGPTPDVTASPPCHIGPCGERCPDGGSFLVMVCANDTMYEVLVPFWPWLAGQCRISRGGNDTCFLEGLLGPLLPSLPPLGPSPLCLTPGPFLLGMLSQLPRCQSSVPALAHPTRLHYLLRLLTFLLGPGAGGAEAQGMLGRALLLSSLPDNCSFWDAFRPEGRRSVLRTIGEYLEQDEEQPTPSGFEPTVNPSSGISKMELLACFSPVLWDLLQREKSVWALQILVQAYLHMPPENLQQLVLSAEREAAQGFLTLMLQGKLQGKLQVPPSEEQALGRLTALLLQRYPRLTSQLFIDLSPLIPFLAVSDLMRFPPSLLANDSVLAAIRDYSPGMRPEQKEALAKRLLAPELFGEVPAWPQELLWAVLPLLPHLPLENFLQLSPHQIQALEDSWPAAGLGPGHARHVLRSLVNQSVQDGEEQVRRLGPLACFLSPEELQSLVPLSDPTGPVERGLLECAANGTLSPEGRVAYELLGVLRSSGGAVLSPRELRVWAPLFSQLGLRFLQELSEPQLRAMLPVLQGTSVTPAQAVLLLGRLLPRHDLSLEELCSLHLLLPGLSPQTLQAIPRRVLVGACSCLAPELSRLSACQTAALLQTFRVKDGVKNMGTTGAGPAVCIPGQPIPTTWPDCLLPLLPLKLLQLDSLALLANRRRYWELPWSEQQAQFLWKKMQVPTNLTLRNLQALGTLAGGMSCEFLQQINSMVDFLEVVHMIYQLPTRVRGSLRACIWAELQRRMAMPEPEWTTVGPELNGLDSKLLLDLPIQLMDRLSNESIMLVVELVQRAPEQLLALTPLHQAALAERALQNLAPKETPVSGEVLETLGPLVGFLGTESTRQIPLQILLSHLSQLQGFCLGETFATELGWLLLQESVLGKPELWSQDEVEQAGRLVFTLSTEAISLIPREALGPETLERLLEKQQSWEQSRVGQLCREPQLAAKKAALVAGVVRPAAEDLPEPVPNCADVRGTFPAAWSATQIAEMELSDFEDCLTLFAGDPGLGPEELRAAMGKAKQLWGPPRGFRPEQILQLGRLLIGLGDRELQELILVDWGVLSTLGQIDGWSTTQLRIVVSSFLRQSGRHVSHLDFVHLTALGYTLCGLRPEELQHISSWEFSQAALFLGTLHLQCSEEQLEVLAHLLVLPGGFGPISNWGPEIFTEIGTIAAGIPDLALSALLRGQIQGVTPLAISVIPPPKFAVVFSPIQLSSLTSAQAVAVTPEQMAFLSPEQRRAVAWAQHEGKESPEQQGRSTAWGLQDWSRPSWSLVLTISFLGHLL

SEQ ID NO: 36770 - protein, 969 aa, Homo sapiens
  ENSP00000415991
MALSLWPLLLLLLLLLLLSFAVTLAPTGPHSLDPGLSFLKSLLSTLDQAPQGSLSRSRFFTFLANISSSFEPGRMGEGPVGEPPPLQPPALRLHDFLVTLRGSPDWEPMLGLLGDMLALLGQEQTPRDFLVHQAGVLGGLVEVLLGALVPGGPPTPTRPPCTRDGPSDCVLAADWLPSLLLLLEGTRWQALVQVQPSVDPTNATGLDGREAAPHFLQGLLGLLTPTGELGSKEALWGGLLRTVGAPLYAAFQEGLLRVTHSLQDEVFSILGQPEPDTNGQCQGGNLQQLLLWGVRHNLSWDVQALGFLSGSPPPPPALLHCLSTGVPLPRASQPSAHISPRQRRAITVEALCENHLGPAPPYSISNFSIHLLCQHTKPATPQPHPSTTAICQTAVWYAVSWAPGAQGWLQACHDQFPDEFLDAICSNLSFSALSGSNRRLVKRLCAGLLPPPTSCPEGLPPVPLTPDIFWGCFLENETLWAERLCGEASLQAVPPSNQAWVQHVCQGPTPDVTASPPCHIGPCGERCPDGGSFLVMVCANDTMYEVLVPFWPWLAGQCRISRGGNDTCFLEGLLGPLLPSLPPLGPSPLCLTPGPFLLGMLSQLPRCQSSVPALAHPTRLHYLLRLLTFLLGPGAGGAEAQGMLGRALLLSSLPDNCSFWDAFRPEGRRSVLRTIGEYLEQDEEQPTPSGFEPTVNPSSGISKMELLACFSPVLWDLLQREKSVWALQILVQAYLHMPPENLQQLVLSAEREAAQGFLTLMLQGKLQGKLQVPPSEEQALGRLTALLLQRYPRLTSQLFIDLSPLIPFLAVSDLMRFPPSLLANDSVQQGYRGSEENSLEEDKGLRPMTPRSLAAIRDYSPGMRPEQKEALAKRLLAPELFGEVPAWPQELLWAVLPLLPHLPLENFLQLSPHQIQALEDSWPAAGLGPGHARHVLRSLVNQSVQDGEEQVRRWHMNFWVCCAHLEERC

SEQ ID NO: 36771 - protein, 351 aa, Homo sapiens
  ENSP00000394866
MALSLWPLLLLLLLLLLLSFAVTLAPTGPHSLDPGLSFLKSLLSTLDQAPQGSLSRSRFFTFLANISSSFEPGRMGEGPVGEPPPLQPPALRLHDFLVTLRGSPDWEPMLGLLGDMLALLGQEQTPRDFLVHQAGVLGGLVEVLLGALVPGGPPTPTRPPCTRDGPSDCVLAADWLPSLLLLLEGTRWQALVQVQPSVDPTNATGLDGREAAPHFLQGLLGLLTPTGELGSKEALWGGLLRTVGAPLYAAFQEGLLRVTHSLQDEVFSILGQPEPDTNGQCQGGNLQQLLLWGVRHNLSWDVQALGFLSGSPPPPPALLHCLSTGVPLPRASQPSAHISPRQRRAITVEAL

SEQ ID NO: 36772 - protein, 119 aa, Homo sapiens
  ENSP00000394755
  MOD_RES (1)..(1): Any amino acid
XSLAAIRDYSPGMRPEQKEALAKRLLAPELFGEVPAWPQELLWAVLPLLPHLPLENFLQLSPHQIQALEDSWPAAGLGPGHARHVLRSLVNQSVQDGEEQVRRWHMNFWVCCAHLEERC

SEQ ID NO: 36773 - protein, 663 aa, Homo sapiens
  ENSP00000407303
TFLANISSSFEPGRMGEGPVGEPPPLQPPALRLHDFLVTLRGSPDWEPMLGLLGDMLALLGQEQTPRDFLVHQAGVLGGLVEVLLGALVPGGPPTPTRPPCTRDGPSDCVLAADWLPSLLLLLEGTRWQALVQVQPSVDPTNATGLDGREAAPHFLQGLLGLLTPTGELGSKEALWGGLLRTVGAPLYAAFQEGLLRVTHSLQDEVFSILGQPEPDTNGQCQGGNLQQLLLWGVRHNLSWDVQALGFLSGSPPPPPALLHCLSTGVPLPRASQPSAHISPRQRRAITVEALCENHLGPAPPYSISNFSIHLLCQHTKPATPQPHPSTTAICQTAVWYAVSWAPGAQGWLQACHDQFPDEFLDAICSNLSFSALSGSNRRLVKRLCAGLLPPPTSCPEGLPPVPLTPDIFWGCFLENETLWAERLCGEASLQAVPPSNQAWVQHVCQGPTPDVTASPPCHIGPCGERCPDGGSFLVMVCANDTMYEVLVPFWPWLAGQCRISRGGNDTCFLEGLLGPLLPSLPPLGPSPLCLTPGPFLLGMLSQLPRCQSSVPALAHPTRLHYLLRLLTFLLGPGAGGAEAQGMLGRALLLSSLPDNCSFWDAFRPEGRRSVLRTIGEYLEQDEEQPTPSGFEPTVNPSSGISKMELLACFSVSALPEGKLLEQ

SEQ ID NO: 36774 - protein, 1002 aa, Homo sapiens
  ENSP00000440413
MELLACFSPVLWDLLQREKSVWALQILVQAYLHMPPENLQQLVLSAEREAAQGFLTLMLQGKLQGKLQVPPSEEQALGRLTALLLQRYPRLTSQLFIDLSPLIPFLAVSDLMRFPPSLLANDSVQQGYRGSEENSLEEDKGLRPMTPRSLAAIRDYSPGMRPEQKEALAKRLLAPELFGEVPAWPQELLWAVLPLLPHLPLENFLQLSPHQIQALEDSWPAAGLGPGHARHVLRSLVNQSVQDGEEQVRRLGPLACFLSPEELQSLVPLSDPTGPVERGLLECAANGTLSPEGRVAYELLGVLRSSGGAVLSPRELRVWAPLFSQLGLRFLQELSEPQLRAMLPVLQGTSVTPAQAVLLLGRLLPRHDLLQLDSLALLANRRRYWELPWSEQQAQFLWKKMQVPTNLTLRNLQALGTLAGGMSCEFLQQINSMVDFLEVVHMIYQLPTRVRGSLRACIWAELQRRMAMPEPEWTTVGPELNGLDSKLLLDLPIQLMDRLSNESIMLVVELVQRAPEQLLALTPLHQAALAERALQNLAPKETPVSGEVLETLGPLVGFLGTESTRQIPLQILLSHLSQLQGFCLGETFATELGWLLLQESVLGKPELWSQDEVEQAGRLVFTLSTEAISLIPREALGPETLERLLEKQQSWEQSRVGQLCREPQLAAKKAALVAGVVRPAAEDLPEPVPNCADVRGTFPAAWSATQIAEMELSDFEDCLTLFAGDPGLGPEELRAAMGKAKQLWGPPRGFRPEQILQLGRLLIGLGDRELQELILVDWGVLSTLGQIDGWSTTQLRIVVSSFLRQSGRHVSHLDFVHLTALGYTLCGLRPEELQHISSWEFSQAALFLGTLHLQCSEEQLEVLAHLLVLPGGFGPISNWGPEIFTEIGTIAAGIPDLALSALLRGQIQGVTPLAISVIPPPKFAVVFSPIQLSSLTSAQAVAVTPEQMAFLSPEQRRAVAWAQHEGKESPEQQGRSTAWGLQDWSRPSWSLVLTISFLGHLL

SEQ ID NO: 36775 - protein, 834 aa, Homo sapiens
  ENSP00000249344
MEDPAAPGTGGPPANGNGNGGGKGKQAAPKGREAFRSQRRESEGSVDCPTLEFEYGDADGHAAELSELYSYTENLEFTNNRRCFEEDFKTQVQGKEWLELEEDAQKAYIMGLLDRLEVVSRERRLKVARAVLYLAQGTFGECDSEVDVLHWSRYNCFLLYQMGTFSTFLELLHMEIDNSQACSSALRKPAVSIADSTELRVLLSVMYLMVENIRLERETDPCGWRTARETFRTELSFSMHNEEPFALLLFSMVTKFCSGLAPHFPIKKVLLLLWKVVMFTLGGFEHLQTLKVQKRAELGLPPLAEDSIQVVKSMRAASPPSYTLDLGESQLAPPPSKLRGRRGSRRQLLTKQDSLDIYNERDLFKTEEPATEEEEESAGDGERTLDGELDLLEQDPLVPPPPSQAPLSAERVAFPKGLPWAPKVRQKDIEHFLEMSRNKFIGFTLGQDTDTLVGLPRPIHESVKTLKQHKYISIADVQIKNEEELEKCPMSLGEEVVPETPCEILYQGMLYSLPQYMIALLKILLAAAPTSKAKTDSINILADVLPEEMPITVLQSMKLGIDVNRHKEIIVKSISTLLLLLLKHFKLNHIYQFEYVSQHLVFANCIPLILKFFNQNILSYITAKNSISVLDYPCCTIQDLPELTTESLEAGDNSQFCWRNLFSCINLLRLLNKLTKWKHSRTMMLVVFKSAPILKRALKVKQAMLQLYVLKLLKLQTKYLGRQWRKSNMKTMSAIYQKVRHRMNDDWAYGNDIDARPWDFQAEECTLRANIEAFNSRRYDRPQDSEFSPVDNCLQSVLGQRLDLPEDFHYSYELWLEREVFSQPICWEELLQNH

SEQ ID NO: 36776 - protein, 758 aa, Homo sapiens
  ENSP00000392393
MEDPAAPGTGGPPANGNGNGGGKGKQAAPKGREAFRSQRRESEGSVDCPTLEFEYGDADGHAAELSELYSYTENLEFTNNRRCFEEDFKTQVQGKEWLELEEDAQKAYIMGLLDRLEVVSRERRLKVARAVLYLAQGTFGECDSEVDVLHWSRYNCFLLYQMGTFSTFLELLHMEIDNSQACSSALRKPAVSIADSTELRVLLSVMYLMVENIRLERETDPCGWRTARETFRTELSFSMHNEEPFALLLFSMVTKFCSGLAPHFPIKKVLLLLWKVVMFTLGGFEHLQTLKVQKRAELGLPPLAEDSIQVVKSMRAASPPSYTLDLGESQLAPPPSKLRGRRGSRRQLLTKQDSLDIYNERDLFKTEEPATEEEEESAGDGERTLDGELDLLEQDPLVPPPPSQAPLSAERVAFPKGLPWAPKVRQKDIEHFLEMSRNKFIGFTLGQDTDTLVGLPRPIHESVKTLKQHKYISIADVQIKNEEELEKCPMSLGEEVVPETPCEILYQGMLYSLPQYMIALLKILLAAAPTSKAKTDSINILADVLPEEMPITVLQSMKLGIDVNRHKEIIVKSISTLLLLLLKHFKLNHIYQFEYVSQHLVFANCIPLILKFFNQNILSYITAKNSISVLDYPCCTIQDLPELTTESLEAGDNSQFCWRNLFSCINLLRLLNKLTKWKHSRTMMLVVFKSAPILKRALKVKQAMLQLYVLKLLKLQTKYLGRQWRKSNMKTMSAIYQKVRHRMNDDWAYGNGESSQSS

SEQ ID NO: 36777 - protein, 780 aa, Homo sapiens
  ENSP00000263918
MDEQAGPGVFFSNNHPGAGGAKGLGPLAEAAAAGDGAAAAGAARAQYSLPGILHFLQHEWARFEVERAQWEVERAELQAQIAFLQGERKGQENLKKDLVRRIKMLEYALKQERAKYHKLKYGTELNQGDMKPPSYDSDEGNETEVQPQQNSQLMWKQGRQLLRQYLQEVGYTDTILDVKSKRVRALLGFSSDVTDREDDKNQDSVVNGTEAEVKETAMIAKSELTDSASVLDNFKFLESAAADFSDEDEDDDVDGREKSVIDTSTIVRKKALPDSGEDRDTKEALKEFDFLVTSEEGDNESRSAGDGTDWEKEDQCLMPEAWNVDQGVITKLKEQYKKERKGKKGVKRPNRSKLQDMLANLRDVDELPSLQPSVGSPSRPSSSRLPEHEINRADEVEALTFPPSSGKSFIMGADEALESELGLGELAGLTVANEADSLTYDIANNKDALRKTWNPKFTLRSHFDGIRALAFHPIEPVLITASEDHTLKMWNLQKTAPAKKSTSLDVEPIYTFRAHKGPVLCVVMSSNGEQCYSGGTDGLIQGWNTTNPNIDPYDSYDPSVLRGPLLGHTDAVWGLAYSAAHQRLLSCSADGTLRLWNTTEVAPALSVFNDTKELGIPASVDLVSSDPSHMVASFSKGYTSIFNMETQQRILTLESNVDTTANSSCQINRVISHPTLPISITAHEDRHIKFYDNNTGKLIHSMVAHLEAVTSLAVDPNGLYLMSGSHDCSIRLWNLESKTCIQEFTAHRKKFEESIHDVAFHPSKCYIASAGADALAKVFV

SEQ ID NO: 36778 - protein, 731 aa, Homo sapiens
  ENSP00000368513
MDEQAGPGVFFSNNHPGAGGAKGLGPLAGAARAQYSLPGILHFLQHEWARFEVERAQWEVERAELQAQIAFLQGERKGQENLKKDLVRRIKMLEYALKQERAKYHKLKYGTELNQGDMKPPSYDSDEGNETEVQPQQNSQLMWKQGRQLLRQYLQEVGYTDTILDVKSKRVRALLGFSSDVTDREDDKNQDSVVNGTEAEVKETAMIAKSELTDSASVLDNFKFLESAAADFSDEDEDDDVDGREKSVIDTSTIVRKKALPDSGEDRDTKEALKEFDFLVTSEEGDNESRSAGDGTDWGPNRSKLQDMLANLRDVDELPSLQPSVGSPSRPSSSRLPEHEINRADEVEALTFPPSSGKSFIMGADEALESELGLGELAGLTVANEADSLTYDIANNKDALRKTWNPKFTLRSHFDGIRALAFHPIEPVLITASEDHTLKMWNLQKTAPAKKSTSLDVEPIYTFRAHKGPVLCVVMSSNGEQCYSGGTDGLIQGWNTTNPNIDPYDSYDPSVLRGPLLGHTDAVWGLAYSAAHQRLLSCSADGTLRLWNTTEVAPALSVFNDTKELGIPASVDLVSSDPSHMVASFSKGYTSIFNMETQQRILTLESNVDTTANSSCQINRVISHPTLPISITAHEDRHIKFYDNNTGKLIHSMVAHLEAVTSLAVDPNGLYLMSGSHDCSIRLWNLESKTCIQEFTAHRKKFEESIHDVAFHPSKCYIASAGADALAKVFV

SEQ ID NO: 36779 - protein, 302 aa, Homo sapiens
  ENSP00000259400
MSEDEEKVKLRRLEPAIQKFIKIVIPTDLERLRKHQINIEKYQRCRIWDKLHEEHINAGRTVQQLRSNIREIEKLCLKVRKDDLVLLKRMIDPVKEEASAATAEFLQLHLESVEELKKQFNDEETLLQPPLTRSMTVGGAFHTTEAEASSQSLTQIYALPEIPQDQNAAESWETLEADLIELSQLVTDFSLLVNSQQEKIDSIADHVNSAAVNVEEGTKNLGKAAKYKLAALPVAGALIGGMVGGPIGLLAGFKVAGIAAALGGGVLGFTGGKLIQRKKQKMMEKLTSSCPDLPSQTDKKCS

SEQ ID NO: 36780 - protein, 45 aa, Homo sapiens
  ENSP00000434323
MSEDEEKVKLRRLEPAIQKFIKIVIPTDLERLRKHQINIEKVYIH

SEQ ID NO: 36781 - protein, 41 aa, Homo sapiens
  ENSP00000433694
MSEDEEKVKLRRLEPAIQKFIKIVIPTDLERLRKHQINIEK

SEQ ID NO: 36782 - protein, 68 aa, Homo sapiens
  ENSP00000433701
MSEDEEKVKLRRLEPAIQKFIKIVIPTDLERLRKHQINIEKYQRCRIWDKLHEEHINAGRTVQFRNYI

SEQ ID NO: 36783 - protein, 141 aa, Homo sapiens
  ENSP00000436666
MSEDEEKVKLRRLEPAIQKFIKIVIPTDLERLRKHQINIEKYQRCRIWDKLHEEHINAGRTVQQLRSNIREIEKLCLKVRKDDLVLLKRMIDPVKEEASAATAEFLQLHLESVEELKKQFNDEETLLQPPLTRSMTVGGLN

SEQ ID NO: 36784 - protein, 302 aa, Homo sapiens; identical to SEQ ID NO: 36779
  ENSP00000435981

SEQ ID NO: 36785 - protein, 302 aa, Homo sapiens; identical to SEQ ID NO: 36779
  ENSP00000433484

SEQ ID NO: 36786 - protein, 41 aa, Homo sapiens; identical to SEQ ID NO: 36781
  ENSP00000434547

SEQ ID NO: 36787 - protein, 111 aa, Homo sapiens
  ENSP00000470313
MDHPSMRILSSCCKMSDILAEGITIVEDINKRREPIPSLEAIYLLSPTEKSVQALIKDFQGTPTFTYKAAHIFFTDTCPEPLFSELGRSRLAKVVKTLKEIHLAFLPYEAQ

SEQ ID NO: 36788 - protein, 169 aa, Homo sapiens
  ENSP00000471161
MAPSGLKAVVGEKILSGVIRSVKKDGEWKVLIMDHPSMRILSSCCKMSDILAEGITTCPEPLFSELGRSRLAKVVKTLKEIHLAFLPYEAQVFSLDAPHSTYNLYCPFRAEERTRQLEVLAQQIATLCATLQEYPAIRYRKGPEDTAQLAHAVLAKLNAFKADTPSLGE

SEQ ID NO: 36789 - protein, 604 aa, Homo sapiens
  ENSP00000413606
MAPSGLKAVVGEKILSGVIRSVKKDGEWKVLIMDHPSMRILSSCCKMSDILAEGITIVEDINKRREPIPSLEAIYLLSPTEKAQAQRVIHLPQSVQALIKDFQGTPTFTYKAAHIFFTDTCPEPLFSELGRSRLAKVVKTLKEIHLAFLPYEAQVFSLDAPHSTYNLYCPFRAEERTRQLEVLAQQIATLCATLQEYPAIRYRKGPEDTAQLAHAVLAKLNAFKADTPSLGEGPEKTRSQLLIMDRAADPVSPLLHELTFQAMAYDLLDIEQDTYRYETTGLSEAREKAVLLDEDDDLWVELRHMHIADVSKKVTELLRTFCESKRLTTDKANIKDLSQILKKMPQYQKELNKYSTHLHLADDCMKHFKGSVEKLCSVEQDLAMGSDAEGEKIKDSMKLIVPVLLDAAVPAYDKIRVLLLYILLRNGVSEENLAKLIQHANVQAHSSLIRNLEQLGGTVTNPGGSGTSSRLEPRERMEPTYQLSRWTPVIKDVMEDAVEDRLDRNLWPFVSDPAPTASSQAAVSARFGHWHKNKAGIEARAGPRLIVYVMGGVAMSEMRAAYEVTRATEGKWEVLIGSSHILTPTRFLDDLKALDKKLEDIALP

SEQ ID NO: 36790 - protein, 593 aa, Homo sapiens
  ENSP00000221283
MAPSGLKAVVGEKILSGVIRSVKKDGEWKVLIMDHPSMRILSSCCKMSDILAEGITIVEDINKRREPIPSLEAIYLLSPTEKSVQALIKDFQGTPTFTYKAAHIFFTDTCPEPLFSELGRSRLAKVVKTLKEIHLAFLPYEAQVFSLDAPHSTYNLYCPFRAEERTRQLEVLAQQIATLCATLQEYPAIRYRKGPEDTAQLAHAVLAKLNAFKADTPSLGEGPEKTRSQLLIMDRAADPVSPLLHELTFQAMAYDLLDIEQDTYRYETTGLSEAREKAVLLDEDDDLWVELRHMHIADVSKKVTELLRTFCESKRLTTDKANIKDLSQILKKMPQYQKELNKYSTHLHLADDCMKHFKGSVEKLCSVEQDLAMGSDAEGEKIKDSMKLIVPVLLDAAVPAYDKIRVLLLYILLRNGVSEENLAKLIQHANVQAHSSLIRNLEQLGGTVTNPGGSGTSSRLEPRERMEPTYQLSRWTPVIKDVMEDAVEDRLDRNLWPFVSDPAPTASSQAAVSARFGHWHKNKAGIEARAGPRLIVYVMGGVAMSEMRAAYEVTRATEGKWEVLIGSSHILTPTRFLDDLKALDKKLEDIALP

SEQ ID NO: 36791 - protein, 408 aa, Homo sapiens
  ENSP00000471327
MAPSGLKAVVGEKILSGVIRSVKKDGEWKVLIMDHPSMRILSSCCKMSDILAEGITIVEDINKRREPIPSLEAIYLLSPTEKSVQALIKDFQGTPTFTYKAAHIFFTDTCPEPLFSELGRSRLAKVVKTLKEIHLAFLPYEAQVFSLDAPHSTYNLYCPFRAEERTRQLEVLAQQIATLCATLQEYPAIRYRKGPEDTAQLAHAVLAKLNAFKADTPSLGEGPEKTRSQLLIMDRAADPVSPLLHELTFQAMAYDLLDIEQDTYRYETTGLSEAREKAVLLDEDDDLWVELRHMHIADVSKKVTELLRTFCESKRLTTDKANIKDLSQILKKMPQYQKELNKDLAMGSDAEGEKIKDSMKLIVPVLLDAAVPAYDKIRVLLLYILLRNATPLDPGTLLHWLGDSSTEV

SEQ ID NO: 36792 - protein, 590 aa, Homo sapiens
  ENSP00000409471
MAPSGLKAVVGEKILSGVIRSVKKDGEWKVLIMDHPSMRILSSCCKMSDILAEGITIVEDINKRREPIPSLEAIYLLSPTEKALIKDFQGTPTFTYKAAHIFFTDTCPEPLFSELGRSRLAKVVKTLKEIHLAFLPYEAQVFSLDAPHSTYNLYCPFRAEERTRQLEVLAQQIATLCATLQEYPAIRYRKGPEDTAQLAHAVLAKLNAFKADTPSLGEGPEKTRSQLLIMDRAADPVSPLLHELTFQAMAYDLLDIEQDTYRYETTGLSEAREKAVLLDEDDDLWVELRHMHIADVSKKVTELLRTFCESKRLTTDKANIKDLSQILKKMPQYQKELNKYSTHLHLADDCMKHFKGSVEKLCSVEQDLAMGSDAEGEKIKDSMKLIVPVLLDAAVPAYDKIRVLLLYILLRNGVSEENLAKLIQHANVQAHSSLIRNLEQLGGTVTNPGGSGTSSRLEPRERMEPTYQLSRWTPVIKDVMEDAVEDRLDRNLWPFVSDPAPTASSQAAVSARFGHWHKNKAGIEARAGPRLIVYVMGGVAMSEMRAAYEVTRATEGKWEVLIGSSHILTPTRFLDDLKALDKKLEDIALP

SEQ ID NO: 36793 - protein, 171 aa, Homo sapiens
  ENSP00000471585
GVIRSVKKDGEWKVLIMDHPSMRILSSCCKMSDILAEGITIVEDINKRREPIPSLEAIYLLSPTEKSVQALIKDFQGTPTFTYKAAHIFFTDTCPEPLFSELGRSRLAKVVKTLKEIHLAFLPYEAQGPRGHSPVGPRRPGQAERLQGRHSQSGRGPRENPLPAADNGPGS

SEQ ID NO: 36794 - protein, 220 aa, Homo sapiens
  ENSP00000471737
  MOD_RES (1)..(1): Any amino acid
XLRTFCESKRLTTDKANIKDLSQILKKMPQYQKELNKYSTHLHLADDCMKHFKGSVEKLCSVEQDLAMGSDAEGEKIKDSMKLIVPVLLDAAVPAYDKIRVLLLYILLRNGVSEENLAKLIQHANVQAHSSLIRNLEQLGGTVTNPGGSGTSSRLEPRERMEPTYQLSRWTPVIKDVMEDAVEDRLDRNLWPFVSDPAPTASSQAAVRLLTHPHPDPLPG

SEQ ID NO: 36795 - protein, 149 aa, Homo sapiens
  ENSP00000473040
  MOD_RES (1)..(1): Any amino acid
XSVEKLCSVEQDLAMGSDAEGEKIKDSMKLIVPVLLDAAVPAYDKIRVLLLYILLRNGVSEENLAKLIQHANVQAHSSLIRNLEQLGGTVTNPGPHQAQPLCDQPPSPQSPCCPPCPACRARGPPAGWSRENAWSPPISCPAGPRSSRM

SEQ ID NO: 36796 - protein, 128 aa, Homo sapiens
  ENSP00000473406
MEPTYQLSRWTPVIKDVMEDAVEDRLDRNLWPFVSDPAPTASSQAAVSARFGHWHKNKAGIEARAGPRLIVYVMGGVAMSEMRAAYEVTRATEGKWEVLIGSSHILTPTRFLDDLKALDKKLEDIALP

SEQ ID NO: 36797 - protein, 395 aa, Homo sapiens [sequence omitted]

SEQ ID NO: 36798 - protein, 592 aa, Homo sapiens
  ENSP00000359025
MAPPVAERGLKSVVWQKIKATVFDDCKKEGEWKIMLLDEFTTKLLASCCKMTDLLEEGITVVENIYKNREPVRQMKALYFITPTSKSVDCFLHDFASKSENKYKAAYIYFTDFCPDNLFNKIKASCSKSIRRCKEINISFIPHESQVYTLDVPDAFYYCYSPDPGNAKGKDAIMETMADQIVTVCATLDENPGVRYKSKPLDNASKLAQLVEKKLEDYYKIDEKSLIKGKTHSQLLIIDRGFDPVSTVLHELTFQAMAYDLLPIENDTYKYKTDGKEKEAILEEEDDLWVRIRHRHIAVVLEEIPKLMKEISSTKKATEGKTSLSALTQLMKKMPHFRKQITKQVVHLNLAEDCMNKFKLNIEKLCKTEQDLALGTDAEGQKVKDSMRVLLPVLLNKNHDNCDKIRAILLYIFSINGTTEENLDRLIQNVKIENESDMIRNWSYLGVPIVPQSQQGKPLRKDRSAEETFQLSRWTPFIKDIMEDAIDNRLDSKEWPYCSQCPAVWNGSGAVSARQKPRANYLEDRKNGSKLIVFVIGGITYSEVRCAYEVSQAHKSCEVIIGSTHVLTPKKLLDDIKMLNKPKDKVSLIKDE

SEQ ID NO: 36799 - protein, 870 aa, Homo sapiens
  ENSP00000353007
MGPPSLVLCLLSATVFSLLGGSSAFLSHHRLKGRFQRDRRNIRPNIILVLTDDQDVELGSMQVMNKTRRIMEQGGAHFINAFVTTPMCCPSRSSILTGKYVHNHNTYTNNENCSSPSWQAQHESRTFAVYLNSTGYRTAFFGKYLNEYNGSYVPPGWKEWVGLLKNSRFYNYTLCRNGVKEKHGSDYSKDYLTDLITNDSVSFFRTSKKMYPHRPVLMVISHAAPHGPEDSAPQYSRLFPNASQHITPSYNYAPNPDKHWIMRYTGPMKPIHMEFTNMLQRKRLQTLMSVDDSMETIYNMLVETGELDNTYIVYTADHGYHIGQFGLVKGKSMPYEFDIRVPFYVRGPNVEAGCLNPHIVLNIDLAPTILDIAGLDIPADMDGKSILKLLDTERPVNRFHLKKKMRVWRDSFLVERGKLLHKRDNDKVDAQEENFLPKYQRVKDLCQRAEYQTACEQLGQKWQCVEDATGKLKLHKCKGPMRLGGSRALSNLVPKYYGQGSEACTCDSGDYKLSLAGRRKKLFKKKYKASYVRSRSIRSVAIEVDGRVYHVGLGDAAQPRNLTKRHWPGAPEDQDDKDGGDFSGTGGLPDYSAANPIKVTHRCYILENDTVQCDLDLYKSLQAWKDHKLHIDHEIETLQNKIKNLREVRGHLKKKRPEECDCHKISYHTQHKGRLKHRGSSLHPFRKGLQEKDKVWLLREQKRKKKLRKLLKRLQNNDTCSMPGLTCFTHDNQHWQTAPFWTLGPFCACTSANNNTYWCMRTINETHNFLFCEFATGFLEYFDLNTDPYQLMNAVNTLDRDVLNQLHVQLMELRSCKGYKQCNPRTRNMDLGLKDGGSYEQYRQFQRRKWPEMKRPSSKSLGQLWEGWEG

SEQ ID NO: 36800 - protein, 870 aa, Homo sapiens; identical to SEQ ID NO: 36799
  ENSP00000418290

SEQ ID NO: 36801 - protein, 207 aa, Homo sapiens
  ENSP00000417894
  MOD_RES (1)..(1): Any amino acid
XEVRGHLKKKRPEECDCHKISYHTQHKGRLKHRGSSLHPFRKGLQEKDKVWLLREQKRKKKLRKLLKRLQNNDTCSMPGLTCFTHDNQHWQTAPFWTLGPFCACTSANNNTYWCMRTINETHNFLFCEFATGFLEYFDLNTDPYQLMNAVNTLDRDVLNQLHVQLMELRSCKGYKQCNPRTRNMDLGLKDGGSYEQYRGQLWEGWEG

SEQ ID NO: 36802 - protein, 867 aa, Homo sapiens
  ENSP00000418442
MGPPSLVLCLLSATVFSLLGGSSAFLSHHRLKGRFQRDRRNIRPNIILVLTDDQDVELGSMQVMNKTRRIMEQGGAHFINAFVTTPMCCPSRSSILTGKYVHNHNTYTNNENCSSPSWQAQHESRTFAVYLNSTGYRTAFFGKYLNEYNGSYVPPGWKEWVGLLKNSRFYNYTLCRNGVKEKHGSDYSKDYLTDLITNDSVSFFRTSKKMYPHRPVLMVISHAAPHGPEDSAPQYSRLFPNASQHITPSYNYAPNPDKHWIMRYTGPMKPIHMEFTNMLQRKRLQTLMSVDDSMETIYNMLVETGELDNTYIVYTADHGYHIGQFGLVKGKSMPYEFDIRVPFYVRGPNVEAGCLNPHIVLNIDLAPTILDIAGLDIPADMDGKSILKLLDTERPVNRFHLKKKMRVWRDSFLVERGKLLHKRDNDKVDAQEENFLPKYQRVKDLCQRAEYQTACEQLGQKWQCVEDATGKLKLHKCKGPMRLGGSRALSNLVPKYYGQGSEACTCDSGDYKLSLAGRRKKLFKKKYKASYVRSRSIRSVAIEVDGRVYHVGLGDAAQPRNLTKRHWPGAPEDQDDKDGGDFSGTGGLPDYSAANPIKVTHRCYILENDTVQCDLDLYKSLQAWKDHKLHIDHEIETLQNKIKNLREVRGHLKKKRPEECDCHKISYHTQHKGRLKHRGSSLHPFRKGLQEKDKVWLLREQKRKKKLRKLLKRLQNNDTCSMPGLTCFTHDNQHWQTAPFWTLGPFCACTSANNNTYWCMRTINETHNFLFCEFATGFLEYFDLNTDPYQLMNAVNTLDRDVLNQLHVQLMELRSCKGYKQCNPRTRNMDLDGGSYEQYRQFQRRKWPEMKRPSSKSLGQLWEGWEG

SEQ ID NO: 36803 - protein, 189 aa, Homo sapiens
  ENSP00000410026
MGPPSLVLCLLSATVFSLLGGSSAFLSHHRLKGRFQRDRRNIRPNIILVLTDDQDVELGSMQVMNKTRRIMEQGGAHFINAFVTTPMCCPSRSSILTGKYVHNHNTYTNNENCSSPSWQAQHESRTFAVYLNSTGYRTAFFGKYLNEYNGSYVPPGWKEWVGLLKNSRFYNYTLCRNGVKEKHGSDYSK

SEQ ID NO: 36804 - protein, 256 aa, Homo sapiens
  ENSP00000361032
MSELPGDVRAFLREHPSLRLQTDARKVRCILTGHELPCRLPELQVYTRGKKYQRLVRASPAFDYAEFEPHIVPSTKNPHQLFCKLTLRHINKCPEHVLRHTQGRRYQRALCKYEECQKQGVEYVPACLVHRRRRREDQMDGDGPRPREAFWEPTSSDEGGAASDDSMTDLYPPELFTRKDLGSTEDGDGTDDFLTDKEDEKAKPPREKATDEGRRETTVYRGLVQKRGKKQLGSLKKKFKSHHRKPKSFSSCKQPG

SEQ ID NO: 36805 - protein, 256 aa, Homo sapiens; identical to SEQ ID NO: 36804
  ENSP00000487370

SEQ ID NO: 36806 - protein, 629 aa, Homo sapiens
  ENSP00000308727
MTAEGPSPPARWHRRLPGLWAAALLLLGLPRLSVRADGKFFVLESQNGSQGLQLEAARLSCKSRGAHLASADELRRVVQDCSFAVCTTGWLADGTLGTTVCSKGSGEQQIMRAVDVRIESNPVPGGTYSALCIKDEEKPCGDPPSFPHTILQGRTGLEMGDELLYVCAPGHIMGHRETAFTLLCNSCGEWYGLVQACGKDEAEAHIDYEDNFPDDRSVSFRELMEDSRTEADEDRGQGDSSEEAPKQDRLVSISVGRENIARDKVFVPTTGLPGAGSSVPADSPGSRLLQKHLFWFPAEAFHKPGLEKEVDDDTKKQFSAGDNHSGVKLVPGEPETKVIYGNTDGPSGPFVGKNDSKAGDPVVSSSDESWLDGYPVTEGAWRKTEAEEEEDGDRGDGSVGLDENVLVTPDQPILVEVKKPKSSTLTPSEGMTHSSVLPSQMLDVEALALRPVNASETEGIGDGDLTKYQSTLPWRFITEESPMATLSYELTSSTLEILTVNTVKQTPNHIPSTIMATTQPPVETTVPEIQDSFPYLLSEDFFGQEGPGPGASEELHPTLESCVGDGCPGLSRGPVIATIVTVLCLLLLLAGVGMVWGYRKCQHKSSVYKLNVGQRQARHYHQQIEMEKV

SEQ ID NO: 36807 - protein, 243 aa, Homo sapiens
  ENSP00000406475
  MOD_RES (1)..(1): Any amino acid
XAEGPSPPARWHRRLPGLWAAALLLLGLPRLSVRADGKFFVLESQNGSQGLQLEAARLSCKSRGAHLASADELRRVVQDCSFAVCTTGWLADGTLGTTVCSKGSGEQQIMRAVDVRIESNPVPGGTYSALCIKDEDEAEAHIDYEDNFPDDRSVSFRELMEDSRTEADEDRGQGDSSEEAPKQDRLVSISVGRENIARDKVFVPTTGLPGAGSSVPADSPGSRLLQKHLFWFPAEAFHKPGLE

SEQ ID NO: 36808 - protein, 303 aa, Homo sapiens
  ENSP00000344424
MCHGRIAPKSTSVFAVASVGHGVFLPLVILCTLLGDGLASVCPLPPEPENGGYICHPRPCRDPLTAGSVIEYLCAEGYMLKGDYKYLTCKNGEWKPAMEISCRLNEDKDTHTSLGVPTLSIVASTASSVALILLLVVLFVLLQPKLKSFHHSRRDQGVSGDQVSIMVDGVQVALPSYEEAVYGSSGHCVPPADPRVQIVLSEGSGPSGRSVPREQQLPDQGACSSAGGEDEAPGQSGLCEAWGSRASETVMVHQATTSSWVAGSGNRQLAHKETADSENSDIQSLLSLTSEEYTDDIPLLKEA

SEQ ID NO: 36809 - protein, 532 aa, Homo sapiens
  ENSP00000443243
MIVYLGMMAGAFILGGLADKLGRKRVLSMSLAVNASFASLSSFVQGYGAFLFCRLISGIGIGGALPIVFAYFSEFLSREKRGEHLSWLGIFWMTGGLYASAMAWSIIPHYGWGFSMGTNYHFHSWRVFVIVCALPCTVSMVALKFMPESPRFLLEMGKHDEAWMILKQVHDTNMRAKGTPEKVFTVSNIKTPKQMDEFIEIQSSTGTWYQRWLVRFKTIFKQVWDNALYCVMGPYRMNTLILAVVWFAMAFSYYGLTVWFPDMIRYFQDEEYKSKMKVFFGEHVYGATINFTMENQIHQHGKLVNDKFTRMYFKHVLFEDTFFDECYFEDVTSTDTYFKNCTIESTIFYNTDLYEHKFINCRFINSTFLEQKEGCHMDLEQDNDFLIYLVSFLGSLSVLPGNIISALLMDRIGRLKMIGGSMLISAVCCFFLFFGNSESAMIGWQCLFCGTSIAAWNALDVITVELYPTNQRATAFGILNGLCKFGAILGNTIFASFVGITKVVPILLAAASLVGGGLIALRLPETREQVLM

SEQ ID NO: 36810 - protein, 683 aa, Homo sapiens
  ENSP00000377779
MDDYKYQDNYGGYAPSDGYYRGNESNPEEDAQSDVTEGHDEEDEIYEGEYQGIPHPDDVKAKQAKMAPSRMDSLRGQTDLMAERLEDEEQLAHQYETIMDECGHGRFQWILFFVLGLALMADGVEVFVVSFALPSAEKDMCLSSSKKGMLGMIVYLGMMAGAFILGGLADKLGRKRVLSMSLAVNASFASLSSFVQGYGAFLFCRLISGIGIGGALPIVFAYFSEFLSREKRGEHLSWLGIFWMTGGLYASAMAWSIIPHYGWGFSMGTNYHFHSWRVFVIVCALPCTVSMVALKFMPESPRFLLEMGKHDEAWMILKQVHDTNMRAKGTPEKVFTVSNIKTPKQMDEFIEIQSSTGTWYQRWLVRFKTIFKQVWDNALYCVMGPYRMNTLILAVVWFAMAFSYYGLTVWFPDMIRYFQDEEYKSKMKVFFGEHVYGATINFTMENQIHQHGKLVNDKFTRMYFKHVLFEDTFFDECYFEDVTSTDTYFKNCTIESTIFYNTDLYEHKFINCRFINSTFLEQKEGCHMDLEQDNDFLIYLVSFLGSLSVLPGNIISALLMDRIGRLKMIGGSMLISAVCCFFLFFGNSESAMIGWQCLFCGTSIAAWNALDVITVELYPTNQRATAFGILNGLCKFGAILGNTIFASFVGITKVVPILLAAASLVGGGLIALRLPETREQVLM

SEQ ID NO: 36811 - protein, 683 aa, Homo sapiens; identical to SEQ ID NO: 36810
  ENSP00000450992

SEQ ID NO: 36812 - protein, 683 aa, Homo sapiens; identical to SEQ ID NO: 36810
  ENSP00000332818

SEQ ID NO: 36813 - protein, 727 aa, Homo sapiens
  ENSP00000423541
MEDSYKDRTSLMKGAKDIAREVKKQTVKKVNQAVDRAQDEYTQRSYSRFQDEEDDDDYYPAGETYNGEANDDEGSSEATEGHDEDDEIYEGEYQGIPSMNQAKDSIVSVGQPKGDEYKDRRELESERRADEEELAQQYELIIQECGHGRFQWALFFVLGMALMADGVEVFVVGFVLPSAETDLCIPNSGSGWLGSIVYLGMMVGAFFWGGLADKVGRKQSLLICMSVNGFFAFLSSFVQGYGFFLFCRLLSGFGIGGAIPTVFSYFAEVLAREKRGEHLSWLCMFWMIGGIYASAMAWAIIPHYGWSFSMGSAYQFHSWRVFVIVCALPCVSSVVALTFMPESPRFLLEVGKHDEAWMILKLIHDTNMRARGQPEKVFTVNKIKTPKQIDELIEIESDTGTWYRRCFVRIRTELYGIWLTFMRCFNYPVRDNTIKLTIVWFTLSFGYYGLSVWFPDVIKPLQSDEYALLTRNVERDKYANFTINFTMENQIHTGMEYDNGRFIGVKFKSVTFKDSVFKSCTFEDVTSVNTYFKNCTFIDTVFDNTDFEPYKFIDSEFKNCSFFHNKTGCQITFDDDYSAYWIYFVNFLGTLAVLPGNIVSALLMDRIGRLTMLGGSMVLSGISCFFLWFGTSESMMIGMLCLYNGLTISAWNSLDVVTVELYPTDRRATGFGFLNALCKAAAVLGNLIFGSLVSITKSIPILLASTVLVCGGLVGLCLPDTRTQVLM

SEQ ID NO: 36814 - protein, 676 aa, Homo sapiens
  ENSP00000316983
MEDSYKDRTSLMKGAKDIAREVKKQTVKKVNQAVDRAQDEYTQRSYSRFQDEEDDDDYYPAGETYNGEANDDEGSSEATEGHDEDDEIYEGEYQGIPSMNQAKDSIVSVGQPKGDEYKDRRELESERRADEEELAQQYELIIQECGHGRFQWALFFVLGMALMADGVEVFVVGFVLPSAETDLCIPNSGSGWLGSIVYLGMMVGAFFWGGLADKVGRKQSLLICMSVNGFFAFLSSFVQGYGFFLFCRLLSGFGIGGAIPTVFSYFAEVLAREKRGEHLSWLCMFWMIGGIYASAMAWAIIPHYGWSFSMGSAYQFHSWRVFVIVCALPCVSSVVALTFMPESPRFLLEVGKHDEAWMILKLIHDTNMRARGQPEKVFTVNKIKTPKQIDELIEIESDTGTWYRRCFVRIRTELYGIWLTFMRCFNYPVRDNTIKLTIVWFTLSFGYYGLSVWFPDVIKPLQSDEYALLTRNVERDKYANFTINFTMENQIHTGMEYDNGRFIGVKFKSVTFKDSVFKSCTFEDVTSVNTYFKNCTFIDTVFDNTDFEPYKFIDSEFKNCSFFHNKTGCQITFDDDYSAYWIYFVNFLGTLAVLPGNIVSALLMDRIGRLTMLGGSMVLSGISCFFLWFGTSESMMIGMLCLYNGLTISAWNSLDVVTVELYPTDRRRRVLPCCPG

SEQ ID NO: 36815 - protein, 3571 aa, Homo sapiens
  ENSP00000363593
MWPRLAFCCWGLALVSGWATFQQMSPSRNFSFRLFPETAPGAPGSIPAPPAPGDEAAGSRVERLGQAFRRRVRLLRELSERLELVFLVDDSSSVGEVNFRSELMFVRKLLSDFPVVPTATRVAIVTFSSKNYVVPRVDYISTRRARQHKCALLLQEIPAISYRGGGTYTKGAFQQAAQILLHARENSTKVVFLITDGYSNGGDPRPIAASLRDSGVEIFTFGIWQGNIRELNDMASTPKEEHCYLLHSFEEFEALARRALHEDLPSGSFIQDDMVHCSYLCDEGKDCCDRMGSCKCGTHTGHFECICEKGYYGKGLQYECTACPSGTYKPEGSPGGISSCIPCPDENHTSPPGSTSPEDCVCREGYRASGQTCELVHCPALKPPENGYFIQNTCNNHFNAACGVRCHPGFDLVGSSIILCLPNGLWSGSESYCRVRTCPHLRQPKHGHISCSTREMLYKTTCLVACDEGYRLEGSDKLTCQGNSQWDGPEPRCVERHCSTFQMPKDVIISPHNCGKQPAKFGTICYVSCRQGFILSGVKEMLRCTTSGKWNVGVQAAVCKDVEAPQINCPKDIEAKTLEQQDSANVTWQIPTAKDNSGEKVSVHVHPAFTPPYLFPIGDVAIVYTATDLSGNQASCIFHIKVIDAEPPVIDWCRSPPPVQVSEKVHAASWDEPQFSDNSGAELVITRSHTQGDLFPQGETIVQYTATDPSGNNRTCDIHIVIKGSPCEIPFTPVNGDFICTPDNTGVNCTLTCLEGYDFTEGSTDKYYCAYEDGVWKPTYTTEWPDCAKKRFANHGFKSFEMFYKAARCDDTDLMKKFSEAFETTLGKMVPSFCSDAEDIDCRLEENLTKKYCLEYNYDYENGFAIGPGGWGAANRLDYSYDDFLDTVQETATSIGNAKSSRIKRSAPLSDYKIKLIFNITASVPLPDERNDTLEWENQQRLLQTLETITNKLKRTLNKDPMYSFQLASEILIADSNSLETKKASPFCRPGSVLRGRMCVNCPLGTYYNLEHFTCESCRIGSYQDEEGQLECKLCPSGMYTEYIHSRNISDCKAQCKQGTYSYSGLETCESCPLGTYQPKFGSRSCLSCPENTSTVKRGAVNISACGVPCPEGKFSRSGLMPCHPCPRDYYQPNAGKAFCLACPFYGTTPFAGSRSITECSSFSSTFSAAEESVVPPASLGHIKKRHEISSQVFHECFFNPCHNSGTCQQLGRGYVCLCPLGYTGLKCETDIDECSPLPCLNNGVCKDLVGEFICECPSGYTGQRCEENINECSSSPCLNKGICVDGVAGYRCTCVKGFVGLHCETEVNECQSNPCLNNAVCEDQVGGFLCKCPPGFLGTRCGKNVDECLSQPCKNGATCKDGANSFRCLCAAGFTGSHCELNINECQSNPCRNQATCVDELNSYSCKCQPGFSGKRCETEQSTGFNLDFEVSGIYGYVMLDGMLPSLHALTCTFWMKSSDDMNYGTPISYAVDNGSDNTLLLTDYNGWVLYVNGREKITNCPSVNDGRWHHIAITWTSANGIWKVYIDGKLSDGGAGLSVGLPIPGGGALVLGQEQDKKGEGFSPAESFVGSISQLNLWDYVLSPQQVKSLATSCPEELSKGNVLAWPDFLSGIVGKVKIDSKSIFCSDCPRLGGSVPHLRTASEDLKPGSKVNLFCDPGFQLVGNPVQYCLNQGQWTQPLPHCERISCGVPPPLENGFHSADDFYAGSTVTYQCNNGYYLLGDSRMFCTDNGSWNGVSPSCLDVDECAVGSDCSEHASCLNVDGSYICSCVPPYTGDGKNCAEPIKCKAPGNPENGHSSGEIYTVGAEVTFSCQEGYQLMGVTKITCLESGEWNHLIPYCKAVSCGKPAIPENGCIEELAFTFGSKVTYRCNKGYTLAGDKESSCLANSSWSHSPPVCEPVKCSSPENINNGKYILSGLTYLSTASYSCDTGYSLQGPSIIECTASGIWDRAPPACHLVFCGEPPAIKDAVITGNNFTFRNTVTYTCKEGYTLAGLDTIECLADGKWSRSDQQCLAVSCDEPPIVDHASPETAHRLFGDIAFYYCSDGYSLADNSQLLCNAQGKWVPPEGQDMPRCIAHFCEKPPSVSYSILESVSKAKFAAGSVVSFKCMEGFVLNTSAKIECMRGGQWNPSPMSIQCIPVRCGEPPSIMNGYASGSNYSFGAMVAYSCNKGFYIKGEKKSTCEATGQWSSPIPTCHPVSCGEPPKVENGFLEHTTGRIFESEVRYQCNPGYKSVGSPVFVCQANRHWHSESPLMCVPLDCGKPPPIQNGFMKGENFEVGSKVQFFCNEGYELVGDSSWTCQKSGKWNKKSNPKCMPAKCPEPPLLENQLVLKELTTEVGVVTFSCKEGHVLQGPSVLKCLPSQQWNDSFPVCKIVLCTPPPLISFGVPIPSSALHFGSTVKYSCVGGFFLRGNSTTLCQPDGTWSSPLPECVPVECPQPEEIPNGIIDVQGLAYLSTALYTCKPGFELVGNTTTLCGENGHWLGGKPTCKAIECLKPKEILNGKFSYTDLHYGQTVTYSCNRGFRLEGPSALTCLETGDWDVDAPSCNAIHCDSPQPIENGFVEGADYSYGAIIIYSCFPGFQVAGHAMQTCEESGWSSSIPTCMPIDCGLPPHIDFGDCTKLKDDQGYFEQEDDMMEVPYVTPHPPYHLGAVAKTWENTKESPATHSSNFLYGTMVSYTCNPGYELLGNPVLICQEDGTWNGSAPSCISIECDLPTAPENGFLRFTETSMGSAVQYSCKPGHILAGSDLRLCLENRKWSGASPRCEAISCKKPNPVMNGSIKGSNYTYLSTLYYECDPGYVLNGTERRTCQDDKNWDEDEPICIPVDCSSPPVSANGQVRGDEYTFQKEIEYTCNEGFLLEGARSRVCLANGSWSGATPDCVPVRCATPPQLANGVTEGLDYGFMKEVTFHCHEGYILHGAPKLTCQSDGNWDAEIPLCKPVNCGPPEDLAHGFPNGFSFIHGGHIQYQCFPGYKLHGNSSRRCLSNGSWSGSSPSCLPCRCSTPVIEYGTVNGTDFDCGKAARIQCFKGFKLLGLSEITCEADGQWSSGFPHCEHTSCGSLPMIPNAFISETSSWKENVITYSCRSGYVIQGSSDLICTEKGVWSQPYPVCEPLSCGSPPSVANAVATGEAHTYESEVKLRCLEGYTMDTDTDTFTCQKDGRWFPERISCSPKKCPLPENITHILVHGDDFSVNRQVSVSCAEGYTFEGVNISVCQLDGTWEPPFSDESCSPVSCGKPESPEHGFVVGSKYTFESTIIYQCEPGYELEGNRERVCQENRQWSGGVAICKETRCETPLEFLNGKADIENRTTGPNVVYSCNRGYSLEGPSEAHCTENGTWSHPVPLCKPNPCPVPFVIPENALLSEKEFYVDQNVSIKCREGFLLQGHGIITCNPDETWTQTSAKCEKISCGPPAHVENAIARGVHYQYGDMITYSCYSGYMLEGFLRSVCLENGTWTSPPICRAVCRFPCQNGGICQRPNACSCPEGWMGRLCEEPICILPCLNGGRCVAPYQCDCPPGWTGSRCHTAVCQSPCLNGGKCVRPNRCHCLSSWTGHNCSRKRRTGF

SEQ ID NO: 36816 - protein, 868 aa, Homo sapiens
  ENSP00000363585
MWPRLAFCCWGLALVSGWATFQQMSPSRNFSFRLFPETAPGAPGSIPAPPAPGDEAAGSRVERLGQAFRRRVRLLRELSERLELVFLVDDSSSVGEVNFRSELMFVRKLLSDFPVVPTATRVAIVTFSSKNYVVPRVDYISTRRARQHKCALLLQEIPAISYRGGGTYTKGAFQQAAQILLHARENSTKVVFLITDGYSNGGDPRPIAASLRDSGVEIFTFGIWQGNIRELNDMASTPKEEHCYLLHSFEEFEALARRALHEDLPSGSFIQDDMVHCSYLCDEGKDCCDRMGSCKCGTHTGHFECICEKGYYGKGLQYECTACPSGTYKPEGSPGGISSCIPCPDENHTSPPGSTSPEDCVCREGYRASGQTCELVHCPALKPPENGYFIQNTCNNHFNAACGVRCHPGFDLVGSSIILCLPNGLWSGSESYCRVRTCPHLRQPKHGHISCSTREMLYKTTCLVACDEGYRLEGSDKLTCQGNSQWDGPEPRCVERHCSTFQMPKDVIISPHNCGKQPAKFGTICYVSCRQGFILSGVKEMLRCTTSGKWNVGVQAAVCKDVEAPQINCPKDIEAKTLEQQDSANVTWQIPTAKDNSGEKVSVHVHPAFTPPYLFPIGDVAIVYTATDLSGNQASCIFHIKVIDAEPPVIDWCRSPPPVQVSEKVHAASWDEPQFSDNSGAELVITRSHTQGDLFPQGETIVQYTATDPSGNNRTCDIHIVIKGSPCEIPFTPVNGDFICTPDNTGVNCTLTCLEGYDFTEGSTDKYYCAYEDGVWKPTYTTEWPDCAKKRFANHGFKSFEMFYKAARCDDTDLMKKFSEAFETTLGKMVPSFCSDAEDIDCRLEENLTKKYCLEYNYDYENGFAIGN

SEQ ID NO: 36817 - protein, 3574 aa, Homo sapiens
  ENSP00000384917
MWPRLAFCCWGLALVSGWATFQQMSPSRNFSFRLFPETAPGAPGSIPAPPAPGDEAAGSRVERLGQAFRRRVRLLRELSERLELVFLVDDSSSVGEVNFRSELMFVRKLLSDFPVVPTATRVAIVTFSSKNYVVPRVDYISTRRARQHKCALLLQEIPAISYRGGGTYTKGAFQQAAQILLHARENSTKVVFLITDGYSNGGDPRPIAASLRDSGVEIFTFGIWQGNIRELNDMASTPKEEHCYLLHSFEEFEALARRALHEDLPSGSFIQDDMVHCSYLCDEGKDCCDRMGSCKCGTHTGHFECICEKGYYGKGLQYECTACPSGTYKPEGSPGGISSCIPCPDENHTSPPGSTSPEDCVCREGYRASGQTCELVHCPALKPPENGYFIQNTCNNHFNAACGVRCHPGFDLVGSSIILCLPNGLWSGSESYCRVRTCPHLRQPKHGHISCSTREMLYKTTCLVACDEGYRLEGSDKLTCQGNSQWDGPEPRCVERHCSTFQMPKDVIISPHNCGKQPAKFGTICYVSCRQGFILSGVKEMLRCTTSGKWNVGVQAAVCKDVEAPQINCPKDIEAKTLEQQDSANVTWQIPTAKDNSGEKVSVHVHPAFTPPYLFPIGDVAIVYTATDLSGNQASCIFHIKVIDAEPPVIDWCRSPPPVQVSEKVHAASWDEPQFSDNSGAELVITRSHTQGDLFPQGETIVQYTATDPSGNNRTCDIHIVIKGSPCEIPFTPVNGDFICTPDNTGVNCTLTCLEGYDFTEGSTDKYYCAYEDGVWKPTYTTEWPDCAKKRFANHGFKSFEMFYKAARCDDTDLMKKFSEAFETTLGKMVPSFCSDAEDIDCRLEENLTKKYCLEYNYDYENGFAIGPGGWGAANRLDYSYDDFLDTVQETATSIGNAKSSRIKRSAPLSDYKIKLIFNITASVPLPDERNDTLEWENQQRLLQTLETITNKLKRTLNKDPMYSFQLASEILIADSNSLETKKASPFCRPGSVLRGRMCVNCPLGTYYNLEHFTCESCRIGSYQDEEGQLECKLCPSGMYTEYIHSRNISDCKAQCKQGTYSYSGLETCESCPLGTYQPKFGSRSCLSCPENTSTVKRGAVNISACGVPCPEGKFSRSGLMPCHPCPRDYYQPNAGKAFCLACPFYGTTPFAGSRSITECSSFSSTFSAAEESVVPPASLGHIKKRHEISSQVFHECFFNPCHNSGTCQQLGRGYVCLCPLGYTGLKCETDIDECSPLPCLNNGVCKDLVGEFICECPSGYTGQRCEENINECSSSPCLNKGICVDGVAGYRCTCVKGFVGLHCETEVNECQSNPCLNNAVCEDQVGGFLCKCPPGFLGTRCGKNVDECLSQPCKNGATCKDGANSFRCLCAAGFTGSHCELNINECQSNPCRNQATCVDELNSYSCKCQPGFSGKRCETEQSTGFNLDFEVSGIYGYVMLDGMLPSLHALTCTFWMKSSDDMNYGTPISYAVDNGSDNTLLLTDYNGWVLYVNGREKITNCPSVNDGRWHHIAITWTSANGIWKVYIDGKLSDGGAGLSVGLPIPGMLGGGALVLGQEQDKKGEGFSPAESFVGSISQLNLWDYVLSPQQVKSLATSCPEELSKGNVLAWPDFLSGIVGKVKIDSKSIFCSDCPRLGGSVPHLRTASEDLKPGSKVNLFCDPGFQLVGNPVQYCLNQGQWTQPLPHCERISCGVPPPLENGFHSADDFYAGSTVTYQCNNGYYLLGDSRMFCTDNGSWNGVSPSCLDVDECAVGSDCSEHASCLNVDGSYICSCVPPYTGDGKNCAEPIKCKAPGNPENGHSSGEIYTVGAEVTFSCQEGYQLMGVTKITCLESGEWNHLIPYCKAVSCGKPAIPENGCIEELAFTFGSKVTYRCNKGYTLAGDKESSCLANSSWSHSPPVCEPVKCSSPENINNGKYILSGLTYLSTASYSCDTGYSLQGPSIIECTASGIWDRAPPACHLVFCGEPPAIKDAVITGNNFTFRNTVTYTCKEGYTLAGLDTIECLADGKWSRSDQQCLAVSCDEPPIVDHASPETAHRLFGDIAFYYCSDGYSLADNSQLLCNAQGKWVPPEGQDMPRCIAHFCEKPPSVSYSILESVSKAKFAAGSVVSFKCMEGFVLNTSAKIECMRGGQWNPSPMSIQCIPVRCGEPPSIMNGYASGSNYSFGAMVAYSCNKGFYIKGEKKSTCEATGQWSSPIPTCHPVSCGEPPKVENGFLEHTTGRIFESEVRYQCNPGYKSVGSPVFVCQANRHWHSESPLMCVPLDCGKPPPIQNGFMKGENFEVGSKVQFFCNEGYELVGDSSWTCQKSGKWNKKSNPKCMPAKCPEPPLLENQLVLKELTTEVGVVTFSCKEGHVLQGPSVLKCLPSQQWNDSFPVCKIVLCTPPPLISFGVPIPSSALHFGSTVKYSCVGGFFLRGNSTTLCQPDGTWSSPLPECVPVECPQPEEIPNGIIDVQGLAYLSTALYTCKPGFELVGNTTTLCGENGHWLGGKPTCKAIECLKPKEILNGKFSYTDLHYGQTVTYSCNRGFRLEGPSALTCLETGDWDVDAPSCNAIHCDSPQPIENGFVEGADYSYGAIIIYSCFPGFQVAGHAMQTCEESGWSSSIPTCMPIDCGLPPHIDFGDCTKLKDDQGYFEQEDDMMEVPYVTPHPPYHLGAVAKTWENTKESPATHSSNFLYGTMVSYTCNPGYELLGNPVLICQEDGTWNGSAPSCISIECDLPTAPENGFLRFTETSMGSAVQYSCKPGHILAGSDLRLCLENRKWSGASPRCEAISCKKPNPVMNGSIKGSNYTYLSTLYYECDPGYVLNGTERRTCQDDKNWDEDEPICIPVDCSSPPVSANGQVRGDEYTFQKEIEYTCNEGFLLEGARSRVCLANGSWSGATPDCVPVRCATPPQLANGVTEGLDYGFMKEVTFHCHEGYILHGAPKLTCQSDGNWDAEIPLCKPVNCGPPEDLAHGFPNGFSFIHGGHIQYQCFPGYKLHGNSSRRCLSNGSWSGSSPSCLPCRCSTPVIEYGTVNGTDFDCGKAARIQCFKGFKLLGLSEITCEADGQWSSGFPHCEHTSCGSLPMIPNAFISETSSWKENVITYSCRSGYVIQGSSDLICTEKGVWSQPYPVCEPLSCGSPPSVANAVATGEAHTYESEVKLRCLEGYTMDTDTDTFTCQKDGRWFPERISCSPKKCPLPENITHILVHGDDFSVNRQVSVSCAEGYTFEGVNISVCQLDGTWEPPFSDESCSPVSCGKPESPEHGFVVGSKYTFESTIIYQCEPGYELEGNRERVCQENRQWSGGVAICKETRCETPLEFLNGKADIENRTTGPNVVYSCNRGYSLEGPSEAHCTENGTWSHPVPLCKPNPCPVPFVIPENALLSEKEFYVDQNVSIKCREGFLLQGHGIITCNPDETWTQTSAKCEKISCGPPAHVENAIARGVHYQYGDMITYSCYSGYMLEGFLRSVCLENGTWTSPPICRAVCRFPCQNGGICQRPNACSCPEGWMGRLCEEPICILPCLNGGRCVAPYQCDCPPGWTGSRCHTAVCQSPCLNGGKCVRPNRCHCLSSWTGHNCSRKRRTGF

SEQ ID NO: 36818 - protein, 1788 aa, Homo sapiens
  ENSP00000364549
MKRKERIARRLEGIENDTQPILLQSCTGLVTHRLLEEDTPRYMRASDPASPHIGRSNEEEETSDSSLEKQTRSKYCTETSGVHGDSPYGSGTMDTHSLESKAERIARYKAERRRQLAEKYGLTLDPEADSEYLSRYTKSRKEPDAVEKRGGKSDKQEESSRDASSLYPGTETMGLRTCAGESKDYALHVGDGSSDPEVLLNIENQRRGQELSATRQAHDLSPAAESSSTFSFSGRDSSFTEVPRSPKHAHSSSLQQAASRSPSFGDPQLSPEARPRCTSHSETPTVDDEEKVDERAKLSVAAKRLLFREMEKSFDEQNVPKRRSRNTAVEQRLRRLQDRSLTQPITTEEVVIAATLQASAHQKALAKDQTNEGKELAEQGEPDSSTLSLAEKLALFNKLSQPVSKAISTRNRIDTRQRRMNARYQTQPVTLGEVEQVQSGKLIPFSPAVNTSVSTVASTVAPMYAGDLRTKPPLDHNASATDYKFSSSIENSDSPVRSILKSQAWQPLVEGSENKGMLREYGETESKRALTGRDSGMEKYGSFEEAEASYPILNRAREGDSHKESKYAVPRRGSLERANPPITHLGDEPKEFSMAKMNAQGNLDLRDRLPFEEKVEVENVMKRKFSLRAAEFGEPTSEQTGTAAGKTIAQTTAPVSWKPQDSSEQPQEKLCKNPCAMFAAGEIKTPTGEGLLDSPSKTMSIKERLALLKKSGEEDWRNRLSRRQEGGKAPASSLHTQEAGRSLIKKRVTESRESQMTIEERKQLITVREEAWKTRGRGAANDSTQFTVAGRMVKKGLASPTAITPVASPICGKTRGTTPVSKPLEDIEARPDMQLESDLKLDRLETFLRRLNNKVGGMHETVLTVTGKSVKEVMKPDDDETFAKFYRSVDYNMPRSPVEMDEDFDVIFDPYAPKLTSSVAEHKRAVRPKRRVQASKNPLKMLAAREDLLQEYTEQRLNVAFMESKRMKVEKMSSNSNFSEVTLAGLASKENFSNVSLRSVNLTEQNSNNSAVPYKRLMLLQIKGRRHVQTRLVEPRASALNSGDCFLLLSPHCCFLWVGEFANVIEKAKASELATLIQTKRELGCRATYIQTIEEGINTHTHAAKDFWKLLGGQTSYQSAGDPKEDELYEAAIIETNCIYRLMDDKLVPDDDYWGKIPKCSLLQPKEVLVFDFGSEVYVWHGKEVTLAQRKIAFQLAKHLWNGTFDYENCDINPLDPGECNPLIPRKGQGRPDWAIFGRLTEHNETILFKEKFLDWTELKRSNEKNPGELAQHKEDPRTDVKAYDVTRMVSMPQTTAGTILDGVNVGRGYGLVEGHDRRQFEITSVSVDVWHILEFDYSRLPKQSIGQFHEGDAYVVKWKFMVSTAVGSRQKGEHSVRAAGKEKCVYFFWQGRHSTVSEKGTSALMTVELDEERGAQVQVLQGKEPPCFLQCFQGGMVVHSGRREEEEENVQSEWRLYCVRGEVPVEGNLLEVACHCSSLRSRTSMVVLNVNKALIYLWHGCKAQAHTKEVGRTAANKIKEQCPLEAGLHSSSKVTIHECDEGSEPLGFWDALGRRDRKAYDCMLQDPGSFNFAPRLFILSSSSGDFAATEFVYPARAPSVVSSMPFLQEDLYSAPQPALFLVDNHHEVYLWQGWWPIENKITGSARIRWASDRKSAMETVLQYCKGKNLKKPAPKSYLIHAGLEPLTFTNMFPSWEHREDIAEITEMDTEVSNQITLVEDVLAKLCKTIYPLADLLARPLPEGVDPLKLEIYLTDEDFEFALDMTRDEYNALPAWKQVNLKKAKGLF

SEQ ID NO: 36819 - protein, 2214 aa, Homo sapiens
  ENSP00000348128
MKRKERIARRLEGIENDTQPILLQSCTGLVTHRLLEEDTPRYMRASDPASPHIGRSNEEEETSDSSLEKQTRSKYCTETSGVHGDSPYGSGTMDTHSLESKAERIARYKAERRRQLAEKYGLTLDPEADSEYLSRYTKSRKEPDAVEKRGGKSDKQEESSRDASSLYPGTETMGLRTCAGESKDYALHVGDGSSDPEVLLNIENQRRGQELSATRQAHDLSPAAESSSTFSFSGRDSSFTEVPRSPKHAHSSSLQQAASRSPSFGDPQLSPEARPSTGKPKHEWFLQKDSEGDTPSLINWPSRVKVREKLVKEESARNSPELASESVTQRRHQPAPVHYVSFQSEHSAFDRVPSKAAGSTRQPIRGYVQPADTGHTAKLVTPETPENASECSWVASATQNVPKPPSLTVLEGDGRDSPVLHVCESKAEEEEGEGEGEEKEEDVCFTEALEQSKKTLLALEGDGLVRSPEDPSRNEDFGKPAVSTVTLEHQKELENVAQPPQAPHQPTERTGRSEMVLYIQSEPVSQDAKPTGHNREASKKRKVRTRSLSDFTGPPQLQALKYKDPASRRELELPSSKTEGPYGEISMLDTKVSVAQLRSAFLASANACRRPELKSRVERSAEGPGLPTGVERERGSRKPRRYFSPGESRKTSERFRTQPITSAERKESDRCTSHSETPTVDDEEKVDERAKLSVAAKRLLFREMEKSFDEQNVPKRRSRNTAVEQRLRRLQDRSLTQPITTEEVVIAATEPIPASCSGGTHPVMARLPSPTVARSAVQPARLQASAHQKALAKDQTNEGKELAEQGEPDSSTLSLAEKLALFNKLSQPVSKAISTRNRIDTRQRRMNARYQTQPVTLGEVEQVQSGKLIPFSPAVNTSVSTVASTVAPMYAGDLRTKPPLDHNASATDYKFSSSIENSDSPVRSILKSQAWQPLVEGSENKGMLREYGETESKRALTGRDSGMEKYGSFEEAEASYPILNRAREGDSHKESKYAVPRRGSLERANPPITHLGDEPKEFSMAKMNAQGNLDLRDRLPFEEKVEVENVMKRKFSLRAAEFGEPTSEQTGTAAGKTIAQTTAPVSWKPQDSSEQPQEKLCKNPCAMFAAGEIKTPTGEGLLDSPSKTMSIKERLALLKKSGEEDWRNRLSRRQEGGKAPASSLHTQEAGRSLIKKRVTESRESQMTIEERKQLITVREEAWKTRGRGAANDSTQFTVAGRMVKKGLASPTAITPVASPICGKTRGTTPVSKPLEDIEARPDMQLESDLKLDRLETFLRRLNNKVGGMHETVLTVTGKSVKEVMKPDDDETFAKFYRSVDYNMPRSPVEMDEDFDVIFDPYAPKLTSSVAEHKRAVRPKRRVQASKNPLKMLAAREDLLQEYTEQRLNVAFMESKRMKVEKMSSNSNFSEVTLAGLASKENFSNVSLRSVNLTEQNSNNSAVPYKRLMLLQIKGRRHVQTRLVEPRASALNSGDCFLLLSPHCCFLWVGEFANVIEKAKASELATLIQTKRELGCRATYIQTIEEGINTHTHAAKDFWKLLGGQTSYQSAGDPKEDELYEAAIIETNCIYRLMDDKLVPDDDYWGKIPKCSLLQPKEVLVFDFGSEVYVWHGKEVTLAQRKIAFQLAKHLWNGTFDYENCDINPLDPGECNPLIPRKGQGRPDWAIFGRLTEHNETILFKEKFLDWTELKRSNEKNPGELAQHKEDPRTDVKAYDVTRMVSMPQTTAGTILDGVNVGRGYGLVEGHDRRQFEITSVSVDVWHILEFDYSRLPKQSIGQFHEGDAYVVKWKFMVSTAVGSRQKGEHSVRAAGKEKCVYFFWQGRHSTVSEKGTSALMTVELDEERGAQVQVLQGKEPPCFLQCFQGGMVVHSGRREEEEENVQSEWRLYCVRGEVPVEGNLLEVACHCSSLRSRTSMVVLNVNKALIYLWHGCKAQAHTKEVGRTAANKIKEQCPLEAGLHSSSKVTIHECDEGSEPLGFWDALGRRDRKAYDCMLQDPGSFNFAPRLFILSSSSGDFAATEFVYPARAPSVVSSMPFLQEDLYSAPQPALFLVDNHHEVYLWQGWWPIENKITGSARIRWASDRKSAMETVLQYCKGKNLKKPAPKSYLIHAGLEPLTFTNMFPSWEHREDIAEITEMDTEVSNQITLVEDVLAKLCKTIYPLADLLARPLPEGVDPLKLEIYLTDEDFEFALDMTRDEYNALPAWKQVNLKKAKGLF

SEQ ID NO: 36820 - protein, 963 aa, Homo sapiens
  ENSP00000488171
  MOD_RES (1)..(1): Any amino acid
XPQEKLCKNPCAMFAAGEIKTPTGEGLLDSPSKTMSIKERLALLKKSGEEDWRNRLSRRQEGGKAPASSLHTQEAGRSLIKKEEGGVADDSAISNLLWRVTESRESQMTIEERKQLITVREEAWKTRGRGAANDSTQFTVAGRMVKKGLASPTAITPVASPICGKTRGTTPVSKPLEDIEARPDMQLESDLKLDRLETFLRRLNNKVGGMHETVLTVTGKSVKEVMKPDDDETFAKFYRSVDYNMPRSPVEMDEDFDVIFDPYAPKLTSSVAEHKRAVRPKRRVQASKNPLKMLAAREDLLQEYTEQRLNVAFMESKRMKVEKMSSNSNFSEVTLAGLASKENFSNVSLRSVNLTEQNSNNSAVPYKRLMLLQIKGRRHVQTRLVEPRASALNSGDCFLLLSPHCCFLWVGEFANVIEKAKASELATLIQTKRELGCRATYIQTIEEGINTHTHAAKDFWKLLGGQTSYQSAGDPKEDELYEAAIIETNCIYRLMDDKLVPDDDYWGKIPKCSLLQPKEVLVFDFGSEVYVWHGKEVTLAQRKIAFQLAKHLWNGTFDYENCDINPLDPGECNPLIPRKGQGRPDWAIFGRLTEHNETILFKEKFLDWTELKRSNEKNPGELAQHKEDPRTDVKAYDVTRMVSMPQTTAGTILDGVNVGRGYGLVEGHDRRQFEITSVSVDVWHILEFDYSRLPKQSIGQFHEGDAYVVKWKFMVSTAVGSRQKGEHSVRAAGKEKCVYFFWQGRHSTVSEKGTSALMTVELDEERGAQVQVLQGKEPPCFLQCFQGGMVVHSGRREEEEENVQSEWRLYCVRGEVPVEGNLLEVACHCSSLRSRTSMVVLNVNKALIYLWHGCKAQAHTKEVGRTAANKIKEQCPLEAGLHSSSKVTIHECDEGSEPLGFWDALGRRDRKAYDCMLQDPGSFNFAPRLFILSSSSGDFAATEFVYPARAPSVVSSMPFLQED
